United States Patent 7,868,149 (PLANT GENOME SEQUENCE AND USES THEREOF) - sequence listing, part 71

SEQ ID NO: 38931 - DNA, 616 bp, Oryza sativa
ctgcaccccgttttgaagttcagcaaataaatcttatatgattatagggaatacaatatggaataaatatataaaagtattgcaatcgtcataaatattgaacaacgcgttcctgtccaagcaatacttctaggtgcaccagaggcagttgcgggccttgcggcgtacttggcgcaggagactagggatccatcaccgccacgaccggatccaacacctccacgtcaggctaggccgtggtcgagcggatgtgggagcgagcgactggggaggttggggttgccgtgggtgatggtagcaagcggccggcgcgaccgatggcgatggtagaggccgacgtagctgagggttgcaggagaggctggtgtggcctagtcgccaagagaggcacgcacaaccgagggctacgagagaggccaaagcggccgagggtgtcgggagaggccgatgcggcgaatggcagtgggtgaggtcggcgcagctacgatagtagacaactgatgcacatttggtacaagtgttttgggggggcccgggatttttttttttgggggggtgtgaagatggaggtatggctcttgtggtggtaggtgcaccggtagcggacgcggatgac

SEQ ID NO: 38932 - DNA, 13543 bp, Oryza sativa
cgactgcgaaggtctcaggggctactgtggatattatgggtaccccatacccacacggcatggttatccgactagttataggggataacttatatctatgtaatatgtaaccgatcatgacttgggtattacgtttccttttatattatggagcggcctaaagtcctgattcgattatattgtaaaatagatttaggaaaccgataccgtattggttaaggtttctatcttgtaatcctgccccccatcctatataaggtgggcaggaggccctctagggggcatgagacaacctgatcgtcagatctatactacacccggcggattcaaatccccaaacaggagtagggtattacctctcattgagagggcctgaacctgtctaaatcctttgtctctgcatccatccacttttaggtctcgtgcgctacccccttttattattgccgaaatcatgtttcgacaccgactcatataaattccatgcattctatggtgagccacaaataatgttaatctttccttaagaaaatcccaatatcccagacggcaaacttcagcaggaaatgggcgttcaatatgaataactgatggaaccatgccattttattttctcaccccccaaatttggtccagcctatgttgagcaatattttagctgagaaatgggccaatactaggcaaatctaaattaataatgggccgattagtacaaagtaaacacattaacaacgatatgatggcgatggcgctctttctcggaataagttcaatttaggttcctcaatttgttgcccagtctgattgttgtccttgaaccacaaaaccggatacaacgcaaccccccaacttacaaaaccaatgcacataaggtcctaaggcggtttggatagcggttttggctgacgtggcgcctacgtgactggtttgactaggtctccgtcccacctggtagtgacgtggcgcttacgtggcaatcatatctcggaaaaataataaaaaccatgggcccacatgtcaactacacaaaaaaataatttaaaaatggtggggcccacgtgggcccacatgtcagctacaaaacaaaataaatatggtggcgcccacctagtccccacatgtcattccctctcccctgtcggctctccctcctctttctcatcgcgccacggtgccgcctcacagccgttgccgccgccattgggcgtcggcttggatctgcgtggaaaggaagggcgggcggcgaggagaacgacggagcaagcgagcgaggcgggcagtgggcagagcgaaccgacggcgggtggcgaccttggtgagacggacagtgggaggagcgaactgatggcggacggcaacctttgtgaggtggggaggaggcggaggggagcgtggagaagtcgatagtgacggccggcaggaagaaggcaagtgtgctggagatcgagcagaggaaatccgcggtaggtccatcgtgaaagacgacaacgacaaggacatcggtggcttggagggccacgtcagtggcgaggacgggcgccaccgaggccagcctctcacctgcggcaccggcgttgttgtcatcgtcctctgcagccttacccctcgtttgtgccgtggtcgccgcctgctagagatgcgtgtggagctcagccttgcccctcgcttgctccggccgccaccgctccgccggcctgcttcggccacggcccgccccacccctcgcctactctggccgggagagagaggaattattttgtgtgtagctgacatatgggttccacgatttttattattttttgggataaaattgccacgtaagtgccacgtggaacaaagatctagtcaaaggagtcacgtaggcgccacgtcggctaaaaccgccctccatactgccgagggacctcgtttgcctggttttcgtaagttggggataggtcgtactcggttttacggttaaggaacgaaaatcggactagccgactaatagagctaccttaagtgaacttattccctctttctcccatataacattcaagttatttgtcctacggcccacggccacgagagaaggatgacgcaaacgcaaagcatatcgtttccgaaactcctagttggcgattgatcgccaggagtgatcggtttcccccctttctccacgtggtttcctttttttttttgtcaccgcattactttcctattttagtaaatttatgcatctaaagtttatacatctcaagtttacacatctaaagtttacagacccaaagtttataaatcaaaagtttatatattcgattcaaatttgaatttgaattcaagtatttttaatatataatatttctatatatctaaagtttatgcacctaaagtttatagacctaaagtttataagtcaaaagtttatatacccgattcaaatttgaatttgaattcaaatattttttatatatagtattcctatacatctaaagtttaaagtttataaacctaaagtttatagacccaaagtttataagtcaaaagtttacatacccgatttaaatttgaatttaaattatatccgatttaaatttgaatttgaattcaaatattttttatatatagtatttctatacatctaaagtttataaacctaaagtttatagacccaaagtttataagtccaaagttaacatacccctttcaaatttaaatttgaattcaaatattttttatatatagtatttctatacataaatttttttaactttgtttttttatttttttaaaaatttatagtgtagtaggaagagaagaagtggaggagaggagcgcgcgcgtgtacagaggggcatagggatcaatcgatcggacgcccattagccacaccctatggtttccgttgctttggttgctatgaccgtcgttaatcttagtttagatcaccatttctttttaacgaaaaaaaaagaatcaccatttcttaattctttcggctgtgatattaccaatctggtttacaccgtaggaggactttccggtaacagccttaaaaataagttaccacttgtttgaattgggttttaatgcacagcttaatattcccgtcacttaaaacctttttttcttaacactagcaatatgttcgtgcttttgtaactgatcatacctatataattagtgattaactaggtgggtggattgagtataaatcatgagctagacccatataattaagaattggctatgtttgtggattgaggagaaagtagttaacgacggtgtggttaattcgcacatacgaaagagcacacgacctcttgcattcagtgagaaggagacgtaaggacggcaactatgtttttgaagcagtagagatataaacacaaattaactcttaaacttagagcgattagaatattatatacatataattaaacatatatccgtatttgatattattcaactattatatgggatacttgttttcgtttctaaatccaagaaaaatatgaaagaaaacatagtaaaaaaatattctcatttttgtgccatttttcacctagtaggtcaaagtccggccaaggttacgttatgttcgtttcagctaacggctgatgaattttgtgtactgattattgtaccatgtttatagaaatatgattattgaaaactttatatatcagcagtactgaaacctaacttgttctaaactatttattagcattatagggacaagcaatttgtcaataatctggccaatcatttcatttcaaacgctcccaaactagttttgcttccgccttacaaggtttccgccatgtaatacgagcatttgtggtatttgaaaatttatctacaaatataaatattttaaaccactcacttcgtatcaatttacttgtcattcttgtactcaattttttttcaaaatacttgttgtcctctcctcacatccaagtaattttagagatgcatttccttcgtacctttcatcaatacagctatactagtactcctcacaaagaattttaaggcttgatttaggaaagatgattaggatttaattaatgagagtagtaatataatttgatacacattctagttttacgtgagattagctagaacgatagataaactaaaacggacagagtactactctttccctatccatcatacaactacatttatctttctcaatcaagtaatctctcatgtgggtattaaaagtacttttatctctacctaatttctgctaaaacccctaaaaaatacttatatttgtcgatgtaaagaatatttccatgtaaacgagtaaatgctgctggcattattctatcgtaccaagatgccaagtacatagtcttttcgtcccaaaatataagccgtttttaacagagattaaatagagatgaagttaaactagctagagattattgggattggttgagaaaataaaacagatatataagtttatcatattttacaataaattttgaactcttaagaaattgcatattggaacggagggagtggtaattataaacagacaaacagtagagctcacaacttaccccgtccgtgcgtacgtagcagcactgcagctgtgaagcagagcataaatccgataccaactctgccgcacaagctggaaccgaactaaaagcatccatccgatccggatccaaacgtagtacgcgactccgacctctgctctcttccttttacaccccatatccatcgtcccgcctttctttcccttctttctttctatcttttccacgaccgtgccacggcgtcagccagcaaactaatactaactacacaagcctcctccgttcctcctcttcttcttcctcattctcctcctcctctcgaggccggccgagatatcaatggaagtcgaataccacgaggtgagccgcgcttcgcattgcatctgttctatcgttttcccattttctcgcgtactgaacctgacatgcattcttccgggcgccatggatggatggggggagcaggagtacgtgcggaactcgagaggggtgcagctcttcacctgcggctggctgcccgccaaaacgtcgcccaaggccctcgtcttcctctgccacggtacgtatgtagtactagattcaaagctcgatagctagctgcatatgcattgagcaaaagaaccaaccgagaatgaactttgtctttgtttctctctgaaatttttagacggaaacgagattgttctcatgtttcgaggctaattgattcttgttgttttgtttctgtgtgttgttcatcaggctatgccatggagtgcagcggctacatgagaggtatgaacctggcacacatttggcttgtctgtttttttccccttttcttttgcttgtttagcttttgcttgcctcagacagagtagagcatgcatgcacagagaaatcttttttttttctgtgacttttttttttggttggacctctccatttgttctgctgccacctgggcacgtagcgattaggaacccagcaaataagaacaaagaaaagaaattttttaggtggggtttcacgagttagatgttggtaggcgtggatatcacaactctgcttctagatgcattgatggattcacatgcagctttattcaggctgtgtaattgttggtcattatacagtgcttctagatgcttttggcactgaaaaattctcatacagtcctggccaccaatctgctgtaggcagtaaatggtggaggatctcagtaaatatatatactgtcttaatactattgccatatgtttgatatactaccaaattaacatgaagaacccaaaaacgtattagcggttagtgctataccatttatacaagatggtagatagttaatactccacttgcataattctggtgggtgcccatatagtttgctcaacaacactaactcttctgcatgctacaaattcagttaagataactttaaaatatattcagttcagagaaccttaacaaaatttcagttcagagaacctttccaattctgtctgcactgcgatgtagtactagactactagtgtatagtgctcgatctgtcattaacctagatcatgaactcagagaaaagggagggttatattcgcagtaatagtgttcttctgtctcaagaggatgcagcatgcaagcatcgatcacatcgacatggatattgatcaatgtggacacacactgcagtagcagcggtaggagtagctgctgcgatttactggccgatcgacgcatttaaaagccgtcctgggcaggtcgatctcgatcgaacgatcgatcgatcgatcgatttcgatcggttcaattcaaggcagcaggcaggcaggcagtgatgcatgcacctcccaaaattaaattaactgctccccatcaatcattcatatgcttctgaccttgaaaactacctcctgtctcctcctcttttggctgtcaccagtggtaaccctgttgccacatctgcgagctcattgacctccatagttaatcgactgtagagtggtctagcgattagcacgaccattagtcgatttgcacgtgttgtacaatgtagaacttgagcaagggtgatgcatcattgttcctacgaaaagcatctctcaccttacattctatatagtcactatgtgtctgtcatctttgtagcatgtttttctgttttaggactactttgaaatagaaaaatttcgtgagaagaaattatcgggtttacactagttttcctccgaaaattctgtaaaattcttacatttcaaagcaaccctaagatttagttaggcttttccaagtcatttggtagttgctgatcgatgagctagacacattggtagccaccaactaatgctgctattattgaagtacttgatacgtccttgagccggaggctagccaggttttaagcataagcctgcataatctgttctgacggtccctttcaagcatcttctgcaggccatagttgtcaacaatgcaacgagtcccttccatccatgcatgatgcatccattaatttctgatttccatccatttatatgagatcgcgagaaggaaattagagaaaaaaaataagaagggaggttgcagtacaggtgagcggcctgacctgccggccctgaccattaagttaagcaccaaccacaccgccaactcttttccttaatctaaccaccatatttaacactaatcacacacgatttaagcagacgacacttaatgagttgctttagcatcattgttattgttgcgtttaatttagctgagagatggcgaggcataatttgccacttgtcgaatcgcctcaatctctattaaaccatctccttcgttgtttgtatgccacgttagtaattataaattaattaaaattttgagttttttaaatgtttgaaaagaaataaaaattgggttgggtgggtgtgggtgtgggtggttgcaacgctgcgtcagcttggctgatccgggctatttggcaaccgatcgaaggagtgttgatgagcattgggcacacgacgagaaggatggcctacgtacgtgcctgcaatgcaatggctgggtgtggttgagctgccattaaaattccttaatggagtagaggttgcagatcgatctagctaggccaccaagtactactactgtagccgtaatgcttgggttcattcaatactgcgacttgacgaattcatttcctgacaatcttggctgtgtacagtatgagtagtactgtgtggtagcaaattaagtattgtgtatttgtgtttgtgtagtgccagttttacagtattatactcccaactgcatgcgtgcacaatactgtaccctgaacttacactgtgctgtattacacccctgcagaattggccccgttgatctgttaaaagagatatagaaaacttgtaggagttaaattctatatgaaaattgtctatttggttctttaaatcaaacgattgagactccaataatagttctataaaattcatataaagtggttcaagaaaaggagagtttgctggaaatttagcataaggtcgaatcacatggaaacttttccttcatgcctctgcgttgctgtagccaaggcagcagatcaaccgcttatttttcatatgtttttcaaccatgtgctttacactcgtatttccattaaaaaaaaccttacattttttatagttctgtgtgtttttcgatttcttgttttaaaggcttaatttattagctagatgaagtgagtatgtgacaatatctgaatcttttttttatatgagaaatgggttcctggatatgtggaagagtaacatttgggattggatggatatgggatgcagagtgtgggatgcggctggcggcggcggggtacggggtgttcggcatggactacgaggggcacggcaagtcgatgggcgcccgctgctacatccgcagcttccgccgtctcgtcgacgactgccaccgcttcttcaagtccatctgcggtaaacaacaaaatctctaccctttcttcattacttccctcttcaacctctctgcttactttacattcagctacacaatttcagtacactatcaagccaggctctgtctgtgtgtagctatgcaatgtttcaacttagctgccgtttactgtacgtccgttttagcattagtgatgacatgataattcaggcaccaactagcttttaatccttgtcgttgcccgcttaggctaaatacctgaatccaacatatggtagctagccagctacttgtcatttgtcccccacctaatgatgaagggggacgtacgtacggagtttggcacgcattgaatcgatcttggttcatcatcggcaatggagggctcgatcggtaggccattgagcattaatcatatatatatgatcgtcatcggtgatggtactatagtagggtacccactgttcagcgatcaccactacccggcaatcaccagtgcttggtcggtcctgtggcaacattaattattatcggtttgtttggattgaagccaattttactctactaaaatcttagtaatttcaatagcgtcatttgcatgtttggtttggtatcaatttttttcacgctagttcagattttatactactaaaattggtagtattaaaatttggcccatgtggctggttactcgagaggcgtccgttcctggttgctgttgtatactgaagcctgatatatcgcagtaagctacattctccgttttatattataggccgttttgattattttaaaatcgaacttcttaaaaatttgatcaagttaataacaacgtttatagcaccaaattagttttatattaaatctaacattgaatatattttgatagtttctttgttttatgttaaaaatattgctatatctttttcataaatttagttaaaaataaagaaatttgatttagaaaaatatcaaaacgacttataatataaattataaaactaaggtagtgatttcacagtataacatattagtgctacagttacatgcctatgcattctttcgtgctgaatagctgaatgatttgtgatatttattggatggtataaacgaatgaattagctgttataaagtttcaaaatacgcttaaaacagcgttctgaaaaattcatatgtacaaagtttttgcaaaacaagaaaaagaaaaaaaaaatcgcaccatttaggcatttactagttcggaaagcaaatccatggtttttgttcattaattcgttaagtgcagaaaaaaaatatactccctccgtttcagcttataagactttctaacattgtcaacatttatctatctattatatactaaaagtccatgaaacatgctacaaacgctctcaagccgccacatggcgctctaataaaatagagaaaatcctagaaattctaagaaaaaagcaaaacatctatctcttgattttcacttaaattagtgggtccaatatacaccgttagataaaattgatcttaaaacaaactaaataccatgggtcccacctatcctctcctcccgcgcattggcaggtggagtatatacgtacgtacatggtacgtacgctacctccccccctttttttttccttttttcttctttttttcatttatatatataatggatatattttttaaataatcataattttataaacaaagaatctaccatcatataacttaagccggtgtactctgtactattattttcaaataacgcactattttaaaataagttttacataattatatcgtgtacctatcaaataaacaatatctatattaactaatttatacgggtacttaaactgatggctccattatataaatcattagatctactttttattacattggtctattattatcaagtaatgcactgtttcaaaataatgcctacaccattatattgtttacccattaaattaacaatgtaaaatctatattaactaatttacacttacactagaactggtggacctattattataatcatcggatctattatttgttaataaataaagcgtccaaaattctctttttgcccgctgcataatgcaacgtctgcacttttgcctttcgcatgtgtgacaaagcatagtgtttgagacatctaaagtgatcacaaccgctatagcgctaccgctttgccacatatcaaatcatatatggatatgattaattttgttaataacatgaaaagaaaattaaaggtgtgatgcagcgagagaataattaagaaccatgggttgtgtttttctcaacactaattagctctgtttaagttgaaaccgagagttgattacataacaattataatatatttgtgttatgtcgtatttggattttgtactatttgttcgtacatgtgaaaggattcattacgttataaatgtgagcgcaatattaacgaatatcaatagaactcttactacgacaagggtgataaaagggagtttaaggccttctcttttttttcccgattccatattttggatttttgtttgcacgctttccaagtttctaaatggtgtcttctttaaataacattctaactttttaggagtcatgtcatttatttataccctcaaatagctatcacataaattatataattcatcaatttcaactatcctaaaccttaagtactacatattttttttcatgcgagccatggtgatcaggaaattggtgatcaacggatcatcaaagtcgtaagatgaatatataagagttactcttaacaattgtaaataggtgtcaaaattagttgctattaattagacatctaatggcttgctagccacaaaattaatttctctctacatgtatataaacatggacgaagttggaacaaatattaccatatgtcccatacatatatattgcgcagttaatattctaattagtcatttaaaattccttaaaatactctcaagctgtcacgtggtgctataataaattagggcaaatattataaattctcagaaaaaaatcaaagtatctattatttgattttcacttaaatcggtatgtccaatattccgttagattaaattgatcttaaaacaacctaaatactacgaggtcccacctcgtcataggtacgcacctacatacgcgggtacgtacgcctcccctccctttttttcatttttctctttcttctttttttcctatgtatatgtttccctccctttattactatatcatgcgccttcatgagacgatttaatcaaaagaattttgagtaccttgcactcacatttttaatttgcggccataatacacggtatgtatatacatggactgtatgataattaactatcaatagtttctaatttactcgagaaaaaaacatgattcaaaaatcataattacttaatccatctcctactcaaaagtttgtgaatggttttctaagataccttaagaaaaatagaacccttaaattattataaaataatattatccaaactttagtttgccctaaatctatgagacaaaatttctgaacaaacaataattttacctttcaataatatagtgcccgcgcatacgcgcgggccaccttcctagttcatatagatgctaataaatctaagcacatatatttgtctaaattcattaacatatatataaatgtggacaatgctagaaagtcttataatatgaaacggagaaattacttctctgacttctaccagaaaaccacagcaggccaaacaataatcttacctttcaataatatagtgcccgcgtatacgcgcgggccaccttcctagttcatatagatgctaataaatctaggcacacatatatgtctaaattcattaacatatatatatatatatatatatatatatatatatatatatatatatatatatatatatatatatatatatatatatatatatatatatatatatatgaatgtggacaatgctagaaagtcttataataagaaatctgacttctaccagaaaaccacagcaggccattttaaaaagacgtggatattagggaatgacctaatatgaaataattagaaagggtgagacgtcgaacccaggtcgtctagcccaccacctcgtggagctagctgcaagagcgctgcgcttttctcacttcaggccattttcccaggtcttgcatggatgcctgcctcactgtgactgatgctgctcgcattgcaaaatttgcagacatggaggagtacaggagcaagagccggttcctgtacggcgagtccatgggcggcgcggtggcgctgctgctgcacatgaaggacccaacgttctgggacggcgccatcctcgtcgcgccaatgtgcaaggtagctcgctgcatgcgcgtgcagaaatattcttctgaataatttgatctgagaaaaattaagactgaaacttggtgcgtttccttccgatttgctggtgttcagatatcggagaaggtgaagccgcacccggtggtgatctctctcctgacgcaggtagaggacgtcatccccaggtggaagattgttcccaccaaggacgtcatcgacgccgccttcaaggaccctgccaagcgcgaaaaggtccgtgcaaaaacatttgcagtttttttatttctgttttgtgttatcaagtcagtttcagtaacatttgcttcagttaacattggtagtagccctatgttaactgttaagtttgctagagaaacccacatgatgagttagttcaacatgatttctgaacatttgatacagtggtccaacagatttgttgtcgttgagcatataaactcagtttggtgtgttctttgccatgccatgccaaatttaacagatcaggaagaacaagctgatataccaggacaagccgaggctcaagaccgcacttgagatgctcaggaccagcatgtacgtagaggacacttgtccaaggtatgtacccctcgtcttcaaatcaactcaatatatgcaccaattagttctcacatctttaggatggcactaagatcacttgagtatgatcttggccatg

SEQ ID NO: 38933 - DNA, 2313 bp, Oryza sativa
acccggaggtgagccgggcgctgtacgagcgcgccgcagcgccgacaaggccatcaagctctacgccgggatgtggcacggcctcaccgccggcgagcccgaccacaacgtttacgccatcttctccgacatcgtcgcctggctcaacgggcgcagccgcacctggacggtggaggaccgcctgatgaagatgatggcgtcgccggacaggttcatccgcggcgagaggggcggcgccgctgacgtcgacggtgacgccaagcgcggccctccacggcggcgcggcggctgcttctccgggctcgccggccgaacgcatcaccactcggaaatgtagctttgtaacaatgtaaagattagaggctccagcctgcctagaatggtcaataagtggcacagtgtgcatgacttcgtgtattatagaggtgttaagagtcaagacatatgccaacttgccaagtaatgtaatgtatcacaaaccattccttttcctccaatccagtgcaaatttggtcaaaaaaaagtttaaaaagatgcttcatgtaagcaagtggaatgttctgttcatactgaaacatatatcgagtttccaataaagattacatgtataacaccatatggcttctatgagcaagaccaaaaaagacagtagcttacagtagtgcctatgatagattgatagtattagtagcatccccatgtgtccaaagaactagctatgtattcagccatggccattttgtccgtgaggtatgaagcaaccaaagaaccaaggcaccaatttcctttccaagtatttctacccgatttaacttctccacatgtagttactataaagtacaagttataggattttaatgagttgtgtgccgttgtcatgttgaaatttaatacatgccaccagctgctgcagattaggcttcctggtcgccaaagatgcgtttgcggaagtcggtaaccatgaggggaaggccctcacgcaggggaaccttgggctcccagcccaggagctctttcgcacgggtgatgtcaggcttgcgcttgtgtggatcatccgcagtgttcggacggaactcaatgcgagcattcggatcaatggtgtcctggacaaccttagccagctccagcatggtgaactcacccggattacccaggttaaatggtcctatgtgctccccttccatcaagctcatcaacccttccacctgaaagaatcatcacattagcagcttgatacacgcattatcaataaaattagatggcagatctaaatattggtttataattaaagaggggattgctccttgtatataaacaaaaaaagatgtgagatgatctaatcaccataaaccctcaccgtcaatcaaagttactggatacctaaatatatactgcaagaagtcaacattctgctcttcagcagatcataaatgtgtactcagagtattatgcagaggacatcaagtatattagtcatttcggtgatgctactttcatgtatgagacaacaaaacacaattatatgctcagggaatgtatgcaaataaggtaacaggcagatatcaggtcattgatattgttcaggtgtctcatcatgttatagatatacccaccaaatcagagacatattgaaagctcctagtctgcttgccatcaccatagacagtcaaaggttccttcctcagtgcctgaaaaccataattgcagaaacaagatgtcagtatcaaaggaacaatcaaaccatctgtaaattcgggagccaaaagaggaagatgcaagtgacggctacctgagcaacaaagttgctgacaacacggccatcatcaatgcacatgcgaggaccatatgtgttaaaaatccgagcaatcctcacctaaatacaacacaatatcataaattaacataatttccaaaagaagaaagtagcctgaatgctatccatcacaaataacctaaacagcataaacctcaaggttggcaccacggtggtaatccatggtcaacgtttcagctgtgcgcttgccctcatcatagcagcttctaacacctattatcgaataaataattttcattaaaaatctcttgtggaacaagcaaaacattgcttaaatgaaaccacacagtatatgccaaaatataaggactgctttttggaaagggttagctgttgcagtgttgctgtcaaatgtcaagttgaagaaaatactcctttctctactgttgtttgattcttctctaatgctctattgctgtcactattttggaaaaaactatgctgacttggtgtagtttttatcctactcttcccttgtt

SEQ ID NO: 38934 - DNA, 1739 bp, Oryza sativa
ttcttctctaatgctctattgctgtcactattttggaaaaaactatgctgacttggtgtagtttttatcctactcttcccttgtagcgaggtatccaacaagtgggggggggggcccttttggggaaaaccccccttctctcggagctacttctaccaagcaaaagtgtaatcttctaaacgaaagattcaaagcatgggtgccctaaaaattaggacagcccagccacaatccccagcatttggaattccagccagtagccctcctttaaaaaaaaaaaaaacaaacatctatattctcaacggttcatattagcagtggctccatagtactatagccttttcaaatcacagggtaatccaataatagcttatttttctgtcagtattttgattcttagaaaaaatttctagaacaaataaacataattttgttggtttctgtcctacagtaaaattataagaaattaatacggagtattgacagcataggtgttcccatactcttatctgttatccaacaaacaactcagtccaaacatgaaaggtaactattaagttaatttgtcagttaaatgctgagacattaaataatatggcaaacaaaatattggcagagaattattaccaatggggttgacattgccccagtaagtctccacctgagggtgctggaggggatctccatatacctcactggtgctggtgaggagaaattttgccccaatcctcttggccaatccaagcatgttcagtgtcccaaccacgttggtcttgtgtcatctcaaatgttaaggctcacagtaaccatttgtagaaactaaaagaaaccgctcatcaacaaatcaaaacacttgcttgtttgacctttcgggacagacattccgattaacaaatcggcacgaaatccactaaactagatctagttgttggaaaaaactgtatgcaatcttgacttggtttcttccactaaaaatcgtttttttttcacagttacttaccacaaaaaataaatagaaagcataattttgatattcaatcctttttggagttaaaacaacattaagcaaacttcgtttccatcagttcatgaagtttaaagcaactagagatgcgggttgcagaacgccagatccaaagatctttaattagagcaatccagatatgccagtttatgtatcagaaagcaagccctgacttcatgttcagatggagtataaagtatgcaatgaatttggccaaaaataaatgagaaaggttgaccagacaatcaagatgaacacctcagctccagaattacagctgaaatctattcacactctatttgttatcggaaaaggctatacgtactaactttttcttactaaattcttactaacacggatatgtcatgctatgagtatatctagattttttataacgtccatctacctaaatcaagcagttgaatatatatgcttaaaagaaggaatttccccatccaaaactaaccgaatccagcaaattcacctaaaatcgacaaaatttaactagaaatgggaaagtaaattaaacaacccagctatcagttagcaccaaaacttagatgagcatcgagaaagagtaattgatgagcaaggatatgatggtcttgatggggttgtacttgtagtgcacggggctagcggggcaggcgaggtggtagatctggtcgacctcgagcaggatgggctcgacgacgtcgtggcggatcacctcgaa

SEQ ID NO: 38935 - DNA, 8687 bp, Oryza sativa
ggaaggggcgtagagggagaagagggcggcggcgaggagcatcccggcgagggcgaaggcggggcggtgctcggcggcggcgtagcgggcggcgcgggtgagccaggagagcggcttggagggcttgggggagtactccccgccgtcggaggcggagcccggggcccccgcgccgccgcggtacgtgagctccgacgccatctccggcgaacgtctcagatgtagaaaaaaaaagcttctctctctctcactgagacgtgggacccacgcccctataattgcgtgtaaggaccaaggacgggaggttggagagtcagatttctctccgcgccgtcggcgaggtttatcgcggcgagggaaaggaaggggagaggtgtgtttaatacgacagccacgctgcggggtggtgtgggttgatctggtgcgttggatttgagatggacggtaaaattcggggagtttagattttttttttccgcgagcagaaaagaagaaatggacttggctgtatattgcgattgacttatcagcacaatttaataaattttcaaatttaatttgattttgagattttttgtcgcagtttttcttttatccctacttttagatagtttaaaacatgtatataaaagttttatttataaattaccttttatttgcaaatatgtgcttttgttttttcctccattatgcaaaatgatggggctactaccttggggtaattcttcacgtttcaacgtttgggggaatacttatgttgcgaacaataaaattgcgctaaaaaatgtgaaacatttcgaagaggcatacagatggataacaatattttattcaaccataatttgatccgtaaaacaaactgaaataattatatattcgtatctaaaatttatctccacgccaaatcaattattacaaagataaacaagtgaagcaaccagaaattaaaacttaattgtactacttgtttattattctgcttagaaggtgtttttacaactgcagcttataatggaaaaaccaagtaatacaaataattttagaatagaacttctataattctactcttgacagtacaaaagtcaaaactgaaaaaattaaagtgatggaaaaagaaaaaaaaacctagactaagttctgattttcaaatttggttatgactttcacacctcaaacaaacatgctcattaattatttacaaagtatgattcaagagaacgtagcttaaattccacgtgtaaaaattaactacatattcccacgcatccttagtgcagtgttgattctctcgaacatgctgacaaataaggtatggagactcggatgaatgtgttggttgatatccgactcattttttcggagctgctgatcatgaatataagatgtgcatgtatacattcaaaagggtgagtgtttacttgttgtgatcgtctatatttgtaacttgtgagcacccctttgccccgtgagccacctccgtcggttgtgggcagcacacaaattaatcgaataaactccctactattttgctgagtgtagatatataatttattttattaagaaacacactacaatgcagacacttacaacgcgtacaaactcactcttataaacatgtgcatacattctatttctatgaagactaaaaaacaatatgtataaacgtacacacacattctacctctttaatcaccttcgaaaacaccatgctatgtcgcagcagatcgcgaagagaaacaacgacaatagggctaataacacgtactcgtactactttggacctggagatataatatatcgtagtcgaccttatcctcgttaattagtcaccgttcttctatttgctacaagatgacacctaatccgctctagccaattgccacctccgcttgctaactactcatttggatagttgcaaaatgaaatgggcgtttgtaactcccttaaatttatactatctatgtagtactacatgccaaggatgtatgactgtttactacgtgtaaaagataaggagatctgaaatatatttagtgagtgcatttttcaatctctctctcaacactgattaattaagaagaggtagaaaccgtagaaagccagcaaattgctgcaaatgtggaatgtactattgcaccttactctttcatgttgaactttcagcgtttggacgcatgagctcgctttacgcgcctccagatgaccttaattacaaaaccgcaccttcctgaattcttttcacatcatcagaaggaaaacagaaaacatggcaatccaagagcggctgcctaaattgtgtatctgtttttttcttttccttctcctcacaagaaaataagtcttgcatgcccaaatttgccaaacttcgtttggttcagcagagaagaaactttgatttcaattgttccatcaacatcaagtaggcatagtaccatcatcaaacttggactagctggatgcatggtttgagtgtctctgcatctgtaccggaaatagatgaggtgcagtgcaagtcactgtttggagtgtgtttttgcatttttggagggccaaaatcgggattgctatatagtattcgaataaaatttggggatgaaatcttacagattttggaccattggatccatgttaagattcgtgcatcggcctctctcctctaactccggcgggctccccttcttctccggcgccagcgacaccccaactccggcgggttagggtttgaggttggggtgagggtaggcgggggttgggggagggggaagagaggggtttcctcggagcttagagggatggccgtggacggcggaagaccggtgatgggcggtggactccggcgggcggagaggcggcggtggcgccgccaaagctgcggagatggaggagggcggtaggccggcatctgcggcgggggcaaatcaagcgtaagattaggaggaggcggccggtggtggtgaatcctgcggcggggagccgccggatacggtgaatacggcggggcgggggcacctcgtcgtcaccgctgtgaggagaaagagggggggggagggggatgggagggggctcgccgggagggtctcgccggcgccgttgactctttccggccagccggcgaggcgggcggcggcccggtggggcggtggtggcggggaatcgcgggagaggataggaggaggagtggtggcggcgactcagtcacggggagaaggaggagttagggttaaggggctgcacgaatctcaaagcatatctaatggtctaaaattcgaatgataggaggtgggattttctgtcacatgatatatagacagcgccaggggcggatcaagaaacaaaaagttggggggactcaacataccaagtacaccgatataaacacataatctcagtactaaactatgctaaaatgctattataagacctttagcacctcctatcttatcaactatgatgaaaaaattgaagtgggggcttaggggggtatccataggttttgtgggtgcaggggcacgttggatccgcccctggacagcaccactaaaacaatagtgcatatcagtgcgttgaaatgatgtgttgtactaattcgaaatcgggccttacatgttaaaaatttagaaatatacgtattttctgtagaatttgcaagaaaatatcgaacgcgtgaagatttgcaaaaatataccgccatcgtggtttcgttgagcgagatcgtggtctcgcacgatcgaggcgcgagaacgagagcggtatcgctcgttcggtcagcgaggacagagcgcacacggtggcctaggcggtgcgattagcgagagcacacggtgtcgcactctaaaagtgcgagagcgagccggtgggccccgcaactgctgcgatgcgcgatctagcatgagaggaaagcgagagtgccggtgggcgcggtctcgcgcaagagagatgcgagagcgctggggccgcgactgcgatccacgcagtctcgcgctacaggaacacgagagcggtaattagtgattaattaccataattagtgattatttaatgataaataatgatcaattagttgctaatcaatgtgattaagacattaatcattggccccacagcagcccatgcggtctcgcacattggttgtgcgacaccgtacgctctcgcaaaaccaacacgcgagaccgcgggccctccacgcgccatatcgcactcccactgtgcgataccgtggctgcccgatcttccaactaaaaagtcccgctatcgcgctctaaaagagcgatactgatgccgctctcgcgattcgggcatgcgagaccgcatgcccgcgctctcgcgcgtctaaacccgatagcgaccccgttctcgcgctgccaataagcgagaccgatggcgccacgtggcactctcgctcggtggaaacacgaaaccgcatcgatattgcataacaaacaagtgacaccgccagctcaaatctcctcgccaattcgacgcgcgagaccgtcaagctctcgcacattggtaatgcgataccgtggcgatctcacgcttttccgtagcgaatctcggtatcgtgttttctatccgtgatttcgatggtatatttatgctaatcaaaccacatccggtatatttctgaaagaaagatcgatgaacagtatttttcaaatttttttcttacatgttcttccaaatatttggctgtgttcgggagctcagtttggaaacttctccttccgcacatgtagaaacgatgtctcattatcgtatgattattattagctaaaaaacttaaaagagtaaagttcatcaccggtccatataaacttgtaccgctgtgtcatcctggtccctaaactagcaaatcgaccgtttagatccttaaacttgttcgactgtgtcatcccagtccctaaacttgcagatgactcgtttaggttctccaacttattcagttgtgtcacccaggtctctaaacttggatttgaatatcatctgggtcaaataggacggtctaaagactttatatttaaaaataattcataactttttcacgtgaactctaatgaagacaaactttatatcaaacttgtagccctcgacgcgatctacaactttgtagttgatttttttattttaagtcattttttgtcccaaaatgtaatttttaaattaaaatttcaaaatctataaacatgcaacaatattttgggaccctaaacagttttaattcaaaaacttttcaactacaaagttgtaggtcgcgtcgagggctataattttaatgtaaagtttgtctttgttagagttcacatgaaaaagttatgaattattttttatataaagtttttagaccgtcctgtttagggaccggggtgacacaactgaacaagttggatgaccaaaacaagtgatctgcaagtttaaggaccgggatgacacagtcgaacaagtttgaggacctgaacggtcgatttgcgagtttagtgaccgagatgacacagcggtacaagtttagagatcggtgatggactttactcaacttaaaatatagattaatataatttttaaagcaacttcctttttttaaaaaaatgcaccacttagcaattcgagatgtgcgtaaaggactagtaaaggactagtgtgtagatctcaagaactttgcacattcgaacacagccaagcatagttggctcaattttttgtccataaggctctaggtatggatgggaatgatttaggagtgaagtacgagtacttaatacttaaaaagtattacgtacaatatgcatgccgtacagcacttagggctatttaggggctgtttggttgttgccactttaaaccttaggcctgtcataatttattaggttagtgtttggttgagtgccacagttaagtcaagtcacactttgttagtatactggccacacatcatacttttattttctagctaaaatttgtcatagctatggctaataaattattggccacatttgtgtctcttgtcactgttataacaaaatggagttgtaacaaagtcatcgaagtcccacaccggcaacgtacgccatacatgccattcttgagatggttaagcctttgctcatttcatattcacgacgaatatttgatcaaactttcaaaaaattaatcatcaatatgtttttaaattcttacctttaaaaattgtatgcgtagatttacctttagaagacactatcgtactgttatatacttatcagattttatatattacatcgatggtcaaattatcaaaagattgactatatatttatatgatcggagagaatacaaaacaaagctttttttatgtgactgcgagaaaacttatgttttgtcactctgagaattgccccttcaattatgttactactatctaacaaggaataagttcattttatgacccttaaaagtgatcgaaatctaatctataaccctaaactacaaaaccaatatctcgacccccaaactcctaaaaccggtacaatttgactccttggacggttttgggaggcggttttgctgacgtggcgccacgtggcgcctacatggcaatattgaccgagtcttcgacccacgtggtgttgacatggcattagaattaaaaatatgtgtgggacccgtttgtcattcacacaaataaaaaaaattgtggggcccactgacatgtggaccctacatgtcatccttcttccttcttcctcctccctctctccccttcttccccttcggctggctgcggcagctagagctagctggagcggcggcggtggcgggtgggcggctcggccctgctctagctcggagggccgaaacttgtggccgccgccgccgtcctgctcgtctcgcaacggccccaagtggccgcctccctcttccacgtcggcacggctgcgccgccgccttcgactgcgtggaccgccgtcttcaacctccgcctctgtcctcagccatcgacaacgccaagtgcgaccccccctggtcgacttcctccacgacgccgaccccatctcgccgagtgttagccttgccatcgtcgactcctccactccggggaccgccgccccgtcggaggggggcgaccgcctctttgtcgcgccgaggtccgtcgccgtcgacccgggggatgagctccttgcgccacctccgtccaccatgccggcggtgctccagaacccactccagctagcttccgctgccgccgccgcttcagctcccgccggcggccaccacaccgcggcccatgccccactgctggtcgagggtgaacaaggggagagagagaaagaagggagagagggaggaggaagaaggaaggaggatgacatgtggggcccacatgtcggtgggccccacaatttttttatgtgtaaatgacaaacgggtcccacaattgtaatgccacataagtaccacgtcaacgccacgtggatcgaagacttagtcaatattgccacgtaggcgccacgtcagcaaaatcacctcccaaaaccgcccagggagtcaaattgcaccggttctaggagtttggggttaagatatccggttttatagtttagggccatggattagatttcgatcacttttgagggttatgaagtgaacttattccatctaacaatgacatgtgtgaaatcatcttggtaaacaatttgtgggccaagagcccaagaggaaaaataacgaaggccattttgtaaagtagctaaatactgctacttagtcccataataatattaaatagtctttggccttgtacatccatgcgaacttgctaatggcgcgacaaaccgcgcggcgagacacgtgacgcgcgcggagagggccgcggcggcagcgcgtgcgcagtgggcccgggcgttttttttctttcctgtttggttttttctttccgttttttttctggttttttcttctttttttcttttcgtttttttaaacatatacttatacaaactttttatacgtacttatataaactttgtgtatgtgtatataaagtttgtatacatatatacaaactttgtatatgtcatatataaagtttgtgtacgcgtatacaaactttgtatctcgtacgtatacaaaccttatattgtggccaatttttgtttctgcctttgtttctgattttttttttcgattatttccttgtaggtttttttggtttttcgttttttatacgtatggaatacaaagtttctatacacgtatacaaagtttatatacgcatatacaaactttgtatcccgtacgtatccaaaatttatatgtgtacaaactttattgacgtgatgtattttttatttttgttcgattttttaatatatacatatataaagtatgtatgcgttgtatataaactttgtatacgtatacagaagtttatatacatgtgtgtgtctatgtatgtgtgtatatatatatatatatatatatatatatatatatatatatatatatatatatatatataactactatacagcaccctaaggcgctacttattaaacaacacctgatatagccttcagccccaccaacccacgctccctaccaggtccataatacgtagttaaaatttaactcaccgacgaccaatctccaatccacccctagccgtagtagtaatttttttacttgcattttgcaccacctatatatgtatttgt

SEQ ID NO: 38936 - DNA, 7347 bp, Oryza sativa
gatcaccttagatgtctaacactatgctttgtcacacgtgcgaaaggcaaaagtgcagacgtgcattatgcagcaggcaaaaagagaattttggacgctttattatttgcaaataatagatccgatgattataataataggtccaccagttctagtgtaagtgtaaattagttaatatagattttagattgttaatttaatgggtacacaatataatggtgtaggccttattttgaaatagtgcattacttgagaataatagaccaatgtaataaaaagtagatccgatgatttatataatggagccattagtttaagtgcccgtataaattagttaatatagatgttgtttatttgataggtacatgatataattgtgtaaaacttattttaaaatagtgcattatttgaaaataatagttcaaagtaaagagtacaccggcttaagttatatgatggtagattatttatttgtaaaattatgattatttaaaaaatatatccattatatatataaatggaaaaagaagaaaaagggaaaaaagggggggaggaagcgtacgtaccttgtatgtacgtatatactccacctgccaatgcacgggaggagaggataggtgggacccatggtatttagtttgttttaagatcaattttatctaacggtgtataatattaaacccaccaatttaagtgaaaatcaaggcatagatgttttgctttttttcttagaatttctaggattttctctattttattagagtgccacgtggcggattgagagcgtttgtaggaagtttcatggacttttagtataattaatggtataaaatatagttgtgtaacctttattttaaaccgcgtgttttttaaaataatggttctaaataaaattatattatattgttaatataatgggtaaaataatagaatcctaaaaattttattttcaaagattatggatctaatttatttacgtatatattgtgatatatataatctatgtttataaagttatagttctttaaaatttaatatcactaattatagttacgatctcatcagagaaaagaggggaggagatggaagcggatgtaatttttaatgatatatgcaatatatatttatttgtttttaattgtacgttgctgcgttacagttgtatatgtatttttttggtttttttatgagcagtatgtaagtacctttttctcatcggtgtgctgagagagattaggtgtgaggttattaatagatttaatttaatgatctgagataacatatctactaatttcaatgaaaatcgattactagatgttttacatttttcctcagatttgcttgaatttttttctaatctattaaagtgcattttagaacttaaaatattagcagttaatatgtgtattaaattattaatttggttttctatctcatctaactaagaagaagggaaaaaggaaaaaaaagagagtacgtatgtatgtacgtgcacgtatgtggaacagtggaacttttttttttacgtgcaaatctttcacagctaaacatagttagaaaatctgcagatagatataggtgttaactaaaaaataggagcagttaccgagaaaagaggagagaaagagagagaccggagggagggaggtatagcacgttcctgcacatgccgcatatatgcacgatggggatgagggctaccagatttttgtttcttgcgtcgtacgccaagtttgaggtatttataaaagcgagatattaaccagagaacatctatcacgatttctccataaattctttttgtcagtattaattaattgtttaataatattttaacctattagcttcatattgtatcatatataagtaatatctataagcaatcatttataatcttcttcatttgaaaagaaggtagatttattttctttagaaaacatgtcaacgaaagtaaagcaagtgtaaaatagaagcaaggtgtttttttaattgtataatatattatcataatatgttaaaagataaattgggtgggacatgaagctccacgaaatacatgggtttatatagcctaatattattgatatattttgagaggtgatatatttatgaacatttcatgtagagtggatgagagactccacgcaacctagtaggaatacgataacgacgaagtatcattgcacagtaatatttttaaaatgtcatgtaccatgaataaacacttttttatatataagatagatctaacggttagaaatactggttctaccggtttaagaggcataggagtattttaaaaatgtagcttaaaaattatggttgtttttatatctaactaataaagtgagcgtagttcaactagttaggtttcttgttgtgaaacttgcccacccatgttattaatcagaaggtttaaactgtattatgattttttcttaaaaatgcatggataagtgaacaatagctatagttcgtagaatatatatgactaaaagtaatgaatttctttaataatatagttaatttggatcttcaattttaaattttatagttaataatctaatagtgtgcacaaataaaaattatctatctgatttagataatataattgtttaaaatttgttatcataaaatattttttccatataactaaaagaggaaaacatgagagaagaaatatgtggggaggtaagtacacacatgcatactggactggacaggcggagaggatctaggggcccttttttttatcattttgtatttggataaatcataaaatatttttcaactaactaaaaaggaaaatagaagagaaaggaaatatatgggagaggcacataggcacgtacgcaagcatacgtactagatgggaggggtgggatatgtgggcccttctttttatcgctttctatttggataaataaatctaatggtagaaaataatgggtgcacagtatattagtaaaaatcgacggctagatgattaaatgccacgtgacagcataggagcgattgtaggagtgctatgtggcggcgatggtcggatttctcttatttattagagtgccacttggtgacttgagagcgtttacaaggcaccacttgacggtttgggagcatttgtaggaagtttaatggacttttagtatataatagataaattagaaaggtagcccgcgcacatgcgcggacaccttatataatgtgagaaaattttattatgaatatttatgtgcgggtagatttttattaaaatattttttattatattctaaactaaaatgaaactcatcttgtgtgctttgaacgctggttatttttttataactaaccatgcaacatataaattctaaaataaaattatttgagatcatgccgttttgaattggtgagaaaatattgcgtcgaaacaatgcatgtggtttctatgagaaaattttgggtattttaactcgctagaaggatatcttacaacccaaaagaaatccaataataacatttttttattggattgtattttaaaattttttatatatattcattctaacagtcctcgaaaaattttgaatttttctattaagtatgggttttaaatccagcaacgtttgtccaattttcaatttatttcatgtccatttatttttcttttggagattttcattctattaatcatccttgaaatgatttgatctttacaatttgggacgaaaatataagtgcatataacctggcatggggtaaaggcatactttctagattttctctcataaaatattaaagtaatggtcatagtgtttttagtgaatatcactaaagtggattgtcttgtaacaaatacacgtttctagattgttctacgtcaagactttacaatggactgtagcaagttttacaaaaaataaaaaaatagacatggtctttaatttctatatggaatgtacttgatttattgctaaggccactgcaaggtaaggttatttctcagtataatgttcaaccaaccacacctttattttcaatctattgtctatattgctagatgaatatttgttatgattagtgacttcatagatcatatgtgtaattcggacgctatgatcatctttcttaataatatttatttttctcctaaaagatcatcttaaaattatcaaggtcaatttgtataggtacgtagccctcatatgcatgttaagagaaatcaattaagttggtagagagtcgttagatgcctaatgggatttaagtaatagatagaggtccatttgtgttttttgtttgcccatataaataactttaattttaattgtcaaggagataaaaaaaaatagagagaaaagaatggtgcgtgctgtacacgggagggagggagggaggtttgggatatttttgtaaatgattaatctgacaacctaagataatgtgttagatttgctaaaaaataatgtgtcagatgtttatgttgaaaccgatggtcgaatgttttgttttctggtcagaaattttataagtttctctgatttaagagaatgatgtaacatcttaagagtgtttataacatatgtgaccgtctattaacaccacatgccgcaaagaaggatggagggatggatgtttggggtgttcttcttttaaacaatagatttaataacctaaaataacgcgtccatctttttttatgtcaaatccgatggttggattatttttttttgcaaaaattctaagatttttctctaatttaagatgtcatatagcagcttagaagcatttataagatgtttaatggattttaatgctgcaaggagatggggatggagggaaaggtttgggtttttcgtattagaaaactaacaaatcaatagacgaatgccttgttcttttttaagattttctagtattttctttaatttaatagcaccacctagcagcgtagaagcgttcataggatgtttagagtgacagagtgagagttgctagatctagcaggtggaggtctatttgtggttttttaatgtaaaaataattttgactttaatttctcatgaagatagctcgttggtgcgtacgtgacggggaagttccggatgtatgtatttaggaaaaggatctaaccttctaaaataaaataacggattcaccgatttaaatgaaaatcgatggtcggagccacttgatgacctaggagcatttgtaaggtatcgcttggtggattaggagtacttacaggatgtttaatggagttttagtatataatattatttttctgaaatttttaagatttttttgatttaataatgtcatatagtagcttagaggtgtttataaaatgtttaacggattttaacactacacgggggtggggagggatggagagaggtctaggattttttattaaaaaatctaacgacctaaatccatcaatttaagtagaaatcgatgatcggttgcttggaattttttaaaattttctagtactttttctaattcaatagcaccacgtagtgatttaaaagcttctgtaagatctttaatgtgacggagggagagctgctagacttagtagttggtctattttgtgatttttgactgtaaaagtaattttgattttagtttctcattaaatagaaaataaaaggaaggaactgaaagggaaactcacgcacgtaagttcggcaatatgatgccaaaaatattaggtacgttggttccagatgttttttttttgcaaaatagatctaaccatccaaaataatgggtccaccaatttaagtgaaactagattgtcggatttctcttatttattagagtgccaattggcgacttgagagcgtttatagggtgccacttggcagtttgggagcgtttgtaggaagttttatggacttttagtatataatagataatgcaaaaaagatgtaataaaaatagtatcgttaacacaaagaaactggtgtgaaaaatatacggggagtaatatcgagcccctaatttgtggggagtaaagttttaataaaatttaaactaacttgtggggagtaaaattttaactaagtttaaatagaggggagtaaaattttaactacgtagatataaaggtctgattttgctatggaattttttactggaattaatactaccggatgtaagtgggaaaaagattaacaaaataattttattagtgagaatggaccaactgcagtaaatattttacttaacacaggctggcgtcgggagtgctgcatgcggaacgaataagtcgggaggaggtgggaggaaaaaaaaaagaaaagaatagcggtactaagggagttaaaaccgggaaaagcggaggcaggagggggaggggggcgagtgttactcgagatgtcgactagagggggtgaatatgcgatttaaaactaaatgacacctaatcaaaactaacttaagttgctagggttggtgagggtgaactctaactaagcaactaagttatattttgcaaacctagggtgatagtggctcaattatatctctaggaaagtaaatcacactcctatgtcaatgtttagcaatcctagggtgatatgatctcaagtatgtctctaaaaatgtaaattgcacaaatgtaaatgcgacaatcaaatgagacaaggagacaagagatttttcaccgaggttcggaaactcgctggtttcctactccctgttgaggcgagcccaactccaccgctcaaccacaaagccaccgcacgcccccttcgtcaaggggtgggcaaggcgggagccggcccacggagaggactacccaagcctcgatcactagggtagttcttccttcactccgaaggtggtgaactccaaaccactcacaaaccggcgccaggcctcctccacaatcttctcggagaggtcaccgggcaactcctccacaagccgtctaggaggcggcaacctccaagagtaacaagcaatgacccggcgtgcagatgatcaatcaagtgccacactagctcttcaaatggaagcaatgcacttgactcttggctaattaaccctctaacacattagatggatggacacaaagctcaagtgggtgtgagagaggtgcaaggggtgtatgcaattgaattgggtgccaagagagcccccttgctgctggagggggagtatttatactcccaccaaccaaaactagccgttgggggcgaaatcccccaactttgtgctctgtcggtttgaccggagatatgtggccagtcagaccgtgctactctgcaacgcctagaaaactagccgttgtagtgctgtcagagggccccatcggcccggccggtcaaaccagcgttgagtgggcggtcagac

SEQ ID NO: 38937 - DNA, 3637 bp, Oryza sativa
tcagaccggcctcggcttgttcagaccgccatcggctcggtctgaccgaatacggctccgtcggctctatatcggccaccccgagcagcaccatcccggcctctaggaggccgggctgaccgcgcaagtgccgccggtcagaccggccgcccctggtcaggccgaacccagtgaattgcaaggtgatttttgtgtgtgtgatgaaaatgtgagcacaagtgaaaatgcaatgaactaatgtggcaatttaatcatctctttgctaggtcattaccccccttgatagtacggcgaaactaacaaataaactagcaaatttgagcgccctacacctcgatcaattctaaattaaagcactagttttaccgtcttctttctctttgctttgcgccgtcaattttaatccatcgataatcatccatgcgcacatatgacttggtcctaacttaaaatatatagctcaaagacaatagttagtccacaattagtgcttgtcattaattaccaaaattaacaacgggggcctagatgcttcaatctccccctttttggtaattgatgacaaacaccacaaatatatatataatcaaacatagaatacatggacatatattgcaatgtaaatcaaaagctccctctaaacatgtgcatatcaatcatagacaacaaatatggagccaatgcacatttcaatttcacatttcaacaagcacaaacacattagcaatatttcaatgtgaacttcaagaaatattcatccatgagcataacatggtcacatatatatcaatatcacatacaccattcatcattgcataagttcacatcacttaaccatttaactcacaaaagtcacaaatcatcctaaaagggctcacaaataaacataggctattacaagaccacgaagggtccaaatgacatagagtttaacaaaacgacaaataacacacaatataaagtaatagcccatacccatacaaaatatagcccaaaccaccttaacctattagatatgagggcactatcctcactactactagtcctaacccacaaaacataaagcacacttttctcccccttttggtatcaagcaccaaaaaggtctttactcttgtggaggagaaggaggacgcgccgaagtggaaggatgagtagcatcacgacgacgatcatacacaaatgcttgggagctcttcaacatttggactcgagaatccaatgcacccactctagtgtgcaatctccccatggaagcattcaagtctccaacatccgtgcgcaagccacgaacatcctcatgcaaagcttcatgcccggtagacaagcgttgaatgctttcacttaggggattaatagccccaagtaccgggttgaagtactcgttgggttgcattccaaaataagcatactgtggatggaagaaagcatttggatcatacccaggaggaggaggaggtgctgagcttgagctagctccaggatgagaggagggcgccaccctaggagcacggggagctccaagctgaaggcggggcttgtactgcttgtgcttcttcaaagcttgtcttgaatcaacctcatgatgtaaggggcataatagattccctgagtgaaggtcctcttggagatggcaatctcttgcatcatgagagacacaatgtcgaactgacggccctaaataattccatcgatgacgtgccaagccaccccccctaatgtcatcattgttgccaaggcgacggaggatggtagctctcacaatcctgttaaccacactggggatagtcctcaagctggcaaccttcccatatgtgtaccgcactccatcttcataaaactgagagagatagtctatgaagagcggattgtgggtgtgctcctcatattgaggagccatcggaattgccacctagagatagaacactggagggtgtcggacatccacttcatctcactatagtctccagcgacccacactgtagcataaaactgccggatcaaatcttcattgtagtcttgcttgagagtcacaattcggtcaatgccaacagtcttgaagagatcctgcaagccctcaaactctggagtctcattgatgtctctccaagaaatccacttatactctgcaaaagctttccctgcataaacttgctcatacacactcttctggaaagcaatgtgaaaacggggatccggggtgtcccgaggcctcaaaaactgatcatggtgcctcaagatggtatattgcgatggattactcatgttcacaacaaactggatggagggatcaatgtgcatatcatcacttccttcatcctcatcctctccacttccactgacatcatctccactttcctcctcactagccccctcaacattggcctcaacctcttcatcactttgagcgtactcatctccgcttgactcctcactcacgggatcggccgtgggctcacgacgaccatgatgagtgcggggaggcatcactgaaaaaaaaggagcaaaggatatatgagcaatgattttagggaccacatagtgaagtgagaggaaagggggttgctacctgtcaggggcggtcagaccaagggccaaggccggtcagaccgccggcctcaagtcggttagactgacgacccatggccggtcagaccgccggcctcaattcggtcagaccgacactttggggccggtcagaccgccactgacaggagcacacccaaatccttccacaatccacacaaatgattctaaaaattgctaggacaatgttgcacaagattggaatatgatcatcaaaggggatggcctatttcatcaagattggaacaatgggggaaactacccttaaaccctagagattgaaatagaccgatttgagagcaatgcacaagagggagagagatttaccggttggaggggatgaatcacaccaagaaactaccatctattggtgcaaatcgaagaacacctcgtgcttcacctagggttccatgccatggatcaaaaactcaacaaaaacacaaacaaatccatggaatagagagaggaagcggaggagaatcacttacggtgtaaccggagagaaatccgcggtcaaaccgaggggatttggtggagagaggtggctagggtttgggagaggagagaggaggagtttttccaatttgggaaaaaaaatgcttgattggaaaaatttggaacggttaggaaaaaaaggaaaagaaaaagggccaaatttcctggccccacttgccggccgggaaaatgtcccttatggggccgtaaaaacccccacacctggccggacaaaccgtccatatagcgccggtcaaaccgccagcccccctgccggttgtgcacagcctttgcacaaccgggcaccccccacacaataaattctaataaaaaaagatttttggagcaatttttgaaatgtgtgagtttcagtattgctaaccacccaaatatttggagattatgatgatttgcaacaaaactcacttaagtgataggaggtgaccttttatggtctataggggtgtcggtgacatggggccgggggtatcgtgactagaggcttgggtagccgcggtcacccacgtggcctgaccccctcggggggggggggggg

SEQ ID NO: 38938 - DNA, 15173 bp, Oryza sativa
tccctagccggagccggcgtgctaactcctggagttggtatgtcagtcccggtcagatccattccaggcttcagcgcaagtatggcaaggaagtcgctggccattaaatgaaggttgaaatgggcgtccaccgggaaagcgggcgagcggggcaggaggcgtgtgctctgcttgtcagaggtcacttctggctgtagactagccctcattgtaaaaagcatgtttcccttcttaggcagctagaggcccatgtggtgacccctgaccagataaaaaggaggcccaggcctaggaggaaaaaaggaaggaggggggttgggactctggggaatgggttctagagcctgaactctctctcgctctccggctctctgtattccttcacgcacagatccaccagaacacaggagtagggtgttacgcttctcagcggcccgaacctgtctacgtcgcccgtgtcttgtgcacttcctctcccgctgacgttcctcagatcgagggcgaagaacctcacttagcgcccccggccgaaccggcaaaggggggcctgcgcggtctcccggtaaggagccccacgctccgtcaaggggtttttgggcgaatttgattttcaaataacttttgaatgatttggtttgtgaaataggtttgaataccaaaaacttttcaaatcttcttctctaccaaatttgttttgaaatttttctcaaattccttctcaatctcattttggccaaaactaagaatctagattcttcaaaaaattgccaaaatggcattttcattcaaaaatcatttttcttgcaatgtgaggcttggaaaacataaagggaacctttttaaacattttccaagagatagttttcaaattatgttggcttggccgttttgaaaatactactagcaccactagttgatttgctcacatataaaacgaagtagagcacatgtaagagtgcaaaactcccccttaatgtgacatgctccattttcgcaatgaagaaccaaatggcaataaatccaaagaataagagcaaataggagcaaatatacaaaatgcaaaaagaagcaaccatggtgcaccatctcaagccacattagagaaatctatgacatttaactcattcctcaatttgcaaaagcgggtttcatcaagaggcttggtaaagatgtcggctagttgatcctcggttcttatgtggctaatgactatgtcactcttggcaacatggtctcttaggaagtggtggcgtatgtcaatatgcttggttctagaatgttggaccgggttattggctatctttatggcactatcattgtcacataggagtggggttttggtgaaggatatgccatagtccaacaatgtttgtttcagccaaagcaattgggcacaacaactacccgccgaaatatattccgcctcggtggtagagagggctacagagttttgtttcttggatgaccatgacacaagggatctaccaagcatttggcaactactggatgtgctctttctatccactttgcaaccggcataatccgaatcggaatagccaacaagcttaaacttagcaccttttgggtaccacaagccaatagtagaggaatgctttaaatatcttagaatccttttcacggccactaagtgacactccttaggagcggcttaaaatcgtgcacacatgcaaacactaaacatgatatccggcctagatgcggtaaggtaaagcaagataccaatcatagaacgataaagctttaaatctaccggtttacctccctcatcaaggtcgagatgcccgttggttgccataggtgtcttgatgggctttgcatcctccaagccaaacctcttgagtagatccttgatgtacttggtttggcttacgaacgtcccatccttgagttgcttgatttgaagtccaagtaagaagctcaattctccgatcatggacatctcaaattccctagacatcatatcaccaaattccttgcaaaatacctcattagtagaaccgaatatgatgtcatcaacataaatttgacacacaaagaaatcatcaccaatgatttttgtgaaaagggtggtgtcaacttttccaattttgaaatcctttgacaaaataaaatctctcaatctttcataccaaaccctaggagcttgttttaaacatggttaggatttttaggatcttcaaaaccggaaggttgttcaacaaagataagttcggcaatttcaccatttaaaaaagcacttttcacatccatttgaaatagttttatatcaaagcatgatgcaaatgcaagaaggatgcgaatagcctcaagtcttgccacgggggcaaaagtttcaacaaaatccaaaccttcaacttgtgtgaaaccttgtgccaccaaccttgccttgtttcttaccaccaacccgttctcatcttgtttgttcctaaagacccactttgtccctatgacattgtggtctctaggtctttcaaccaaagtccacaccttgtttcttgcaaaattgttgagctcttcatgcatagcattcatccaatccggatcacaatgagattcatctacatgttttggctcaagacaagaaacaaacgagtaatgttcacaaatcgaagcgacacgagatcgagtttgaacacccttactaatgtcacccaacacttggtcaattgggtgatccttggaaagagcggtgtgtatccttggtggcataggtggatcttgtgccttctcctcttccacttcaacttgagcttgacttggcatagcggaagtagatggctcatcttgagtggaggtggatggcttgtcttccacttcaataggcttgacatctccaatagacatgttcttcatagctctcatcaagccttcatcacctacatcatccaaattctcgtgcccctcttgggagccattagtctcatcaaattgaacatcggcggtttcttccacaatacctttgttcttgttgtagacccggtataccttgctatttgaggcataacctagaagaaacccttcatcacaccgactttcaaatttggttagtctaacaccatttcggtaaatataacacttgcaaccaaaaactcgaaaataggcaacattaggcttcctcccaacaattagctcataggaagtctttttaaagagacgatgcaaataaaacctattggttgtatggcaagcggtgtttatggcttccgcccaaaaggaatcgaaaacaccatattcatcaagcatagtccttgccatctcaatcaatgtacgatttttcctctccactataccattttgttgaggtgagtaggtagcggaaagtttatgtttaataccaagatcatcacaatagtcctcgatattggtattcttaaagcaaagtgtcccttctcaccacactcaagcacctcaagttggagagagtcttgttgggtcttctatttcttctcctatttgagttagagcccattcatctctctttctccttcccaagagatcattgaaccttctagcaagaagagcaatctcttcctccaagtcctcattgacttcattcactttgcccttgcccttatcttcaacttcggcttggagagcaatgcacttcttggaaggtgaggcttcatccatctccttcttcttcaacttgtacatgtcattggtgttgatcttccccaagaggcttgcgggtttcatccttgacatgtcggagttgatgagcatggtgacaagtgtctcatacttctccggtagagccctaagcatcttttgggcaatctcaagatcggtgtagtttaccccaagccccttgagatcattcacaatgacattgagcctcccatacatgtcattcacactctcatgaggcaacatggagaatgtctcatattggatcttgaggaaatgaagcttggcatccttgtactcgcttgtgccctcatggatctcggccaacttgttccaaatctcatatgcggtctcaaggttgctcactctatcgaactcctcttggctcaaagagttgaacaaagcattcatggcttgggcatagagttggaggttgcggtgatcaatctccgtcaagggcgtgccggtgatagtaaagcctatatccacaatactccaaatatggaagctcatagctttgaggtgagtagacattttaattttccaagtggagtagtttgtgccattgaacatgggagccttccctacatggttcaccttgttcgacatcttctctctaggcggtgaagcccaatcaagagagaccaagctctgataccacttgtaggatcgagatgtcgactagaggggggtgaataggcgatttaaaactaaatgacacctaatcaaaactaacctaagttgctaggcttggtgagggtgaactctaactaagcaactaaattatgttttgcaaacctagggtgatagtggctcaattatatctctaggaaagtaaatcacactcctatgtcaatgtttagcaatcctagggtgatatgatctcaagtatgtctctagaaatgtaaattgcacaaatgtaaatgcgacaatcaaatgagacaagaagataagagatttttcaccgaggttcggaaactcgccggtttcctactccccgttgaggcgagcccaactccaccgctcaaccacgaagccaccgcacgcccccttcgtcaaggggtgggcaaggcgagagccggcccacagagaggactacccaagcctcgatcactagcgtagttcttccttcactccgaaggtggtgaactccaaaccactcacaaaccggcgccgggcctcttccataatcttctcggagaggtcactgggcaactcctccacaagccgtctaggaggcggcaacctccaagagtaacgagcaatgacccggcatggagatgatcaatcaagtgccacactagctctacaaatggaagcaatgcacttgactcttggctaattaaccctctaacacactagatggatgaacacaaagctcaagtgggtgtgagagatgtgcaaggggtgtatgcaattgaattgggtgccaagagagcccccttgctgctggagggggagtatttatactcccaccaaccaaaactagccgttggaggcgaaatcccccaactttgtgctctgccgatctgatcggaggtatgtggccggtcagaccgtgctactctgcaactgctagaaaactagccgttgtagtgctgtcagagggccttatcggcccggccggtcagaacggcgttgagtgggcagtcagaccggcctcggctcggtctgaccgaatatggctccgtcggctctgtatcggccaccccgagcagcaccatcccggcctccagggggccggtctgaccgcgcatgtgccgccggtcagaccggccttatgcgccggtctgaccggccggtctgatcgcccctggtcaggccgaacctagtgaattgcaaggtgatttttgtgtgtgtgatgaaaatgtgagcacaagtgaaaatgcaatgacctaatgtggcaatttaatcatctctttgctaggtcattaccccccttgatagtacggcgaaactaataaataaattagcaaatttgatcaccctacaccttgatcaattctaaattaaagcactagttttaccgtcttctttctctttgctttgcgccgtcaattttaatccatcgataatcatccatgcgcacatatgacttggtcctaacttaaaatatatagctcaaagataatagttagtccacaattagtgcttgtcattaattaccaaaattaacaacgagggcttagatgcttcagttactcgcattacgaaactcggtggcgcgtacgggcgctacgtagcgtcaccgtatatatatatatatacatatatatacatatatatatacatatatacatacatatatatatatacatatatatatacatatatatatatacatatatatataaaagtagtgttgtagtataacaatagtactagtaagtagtattaggctctgtttctttcagcttgggattattataatccagattattagaagtaagctgaaagaaacagacaacttattgaagtagcttattataatctggagcccagcttattataatctgataagctcatttaggtgagctttttccagattattggatgaaaaattacccaccatgccaccccacctcttctttagacttgcaaacctaataatctaggctctaataatctaggaaagaaacaactaaccgcttattctactgtagattataacaatctatagtaatctgactaaataatctagattataataatcccaagctaaaagaaacagagccttagtagtagtaccattagtatatagagtagtactactaccaccacctagcagcagcagcaatactagtagtactagctgcgcacggggcccactagtagcagcagcagcaggccagcagcgctagtagtagtattagcagcgcttgtaataacagtagtagactagtagtactagtactagtagtaggagagacgaactggtcgcacgcccacacccccgtgtgaccagtcgcgcattaggacccctacatgtaggggccgcattcttaatccataattaaaaaaaagattaaaagatctatgctggacaagtacaaactaaacacacccagttagatgatatggcccagctaggtttttggtcgggctgtgaaaagcctaacaagaaaacgctaaatgagcctaggccgaagataagaaaaacattatcactttccttcttttcgtaatcaaatagtattagtataaaggaaaagttgtaaaccctcctaaatgtcaccctaagtttgagagtcctccctataaaaagatttgttgaaaatccccacctcctaattcaccttaatttgatgggaaaattgcaaaaactatcccatgagtcacttgaagcttgatatttcatcccataagtcattttgttgcaaatgcctacctcatactcggttttgatgagacaaccatcctagggcgcacgtgcttaaccgaatcagtctattatcgttgatgtatagccatcacaggataagctagctaagtcaatataatcttgtccaagttcttatattatacttatttttcatgtttcattgaacttttttgtgatatagagaaactcagtacgataatgtttaagctctcattagaaattatcttcaaagaagtgttaaggccattctctatatgtatttaattttgttattttggtaaggaccacactgataccttataatttatgagaacatgttaatatggttaagcatgtgcgcacaagagtgatttgtgcaataaaactaattaggtgggtgggtatttgcaacaaaatgacttatgaggtgaaatgtcaaattttaagtgacttatgggatggttttgcaaatttccctagtataatacattgtatggctatttggagcaatttcattcacagacgcatgttttcagcccgccaaggcccacgacatgtgtcttcctgcgctaatttgggaatcccgccgcgggacgttccatcggcagctcacagattttccttgtggttttttcttcgctagcattggtcctaagtgtcaatcgttttttcttttaaaagtaaactttcagtgggatcacctatatatttgtcactaaattttttaaaaaaaaatatttgtcaataaattttttaaaaaaaaattgacagatgtaattatagtataattgtaatgtaattacgctgtaacttacatgtaacttgtatataactttcaaaaatctctccgtaacatgctatttctgtgaaatgaaggtcatgggaatgaagcatctcacatgtgtccgcgctgtagctgttttcttcttcacttgcacaaaacttgaaacagatctaacgaataaaaattatttaaaagttacatacaaagttacattgtaggcaagttacagcataattacactatgattgtatgtactttagttacatctgccaaatttttagcagaaaatttattgacaaatatataacgagtcaaaatttcataattttgaactaaaaattaaaaaaacaatcaaattctagaacttccaaattaatttcaaaactttcagctcaatttcaaagctgtcaatttaatttttaaaacttttaactcaaatttaaagctttcaaccaaaaattaaaaaaaaatctaaaatttaaaactttcaactcaaaataaaagatgagtaaattgcattcaaagtatcataacttggcatgtggttgcaaattaatacaagaatttgagaattggacgtctaaggataacaatttgataagtgggtacgtcctagtagaataaaccgtcaacctagtattttgatgcagcagcttagcttagtatgtaccgttttggtcaatgagtggcatggtgagaggaaggccaacccaatcttggatagcaacttgtgcccaacttgttcaagcgaatacgcactccaccaagatatggtgatccgcttccagctcctacgcatttacacatagggcacatggtatgactatccatcttgcagatgcgtatttggttagtcgtctaacacaaccgttgaagtgtaagccagaggaaaagtttgcccttcacgggaccaatgctgcgtcaaagtaactcagagcaagaaaagaagatcgagcccttaaagaacgcattgtagttcaaggcggcgctatacctaccacccatccagcgccaaatgaaatcatcttggacaaactcttgtagtgagaaattctatactctatcccagagtgtgaggaatagggagagtacatgcacagtcagtgcaccaatgatgttagatatccaagtactgctagccaggccaacaaccaccgaagtggaatttcggtgacgagttgggacaacaaggaacaactatagggcgattagttgaaccgatcgcccatcgagccagttgtccaactagaacaatgagcggcatccatctccaatgacgaccatggcagacacacgtagcatctccgacatacactactcttacggtagtttgaagccggcctagtaggggtcgctaatgtgttggagctagggccatcgcatccgtagggtccagccaatgatccagaggtctgtgattcctaacacccccccctccccagctctttgggccgacacacgttgggccaagcgacaaggcaactcccgccatggaccgagtctgactccttccaaaggaaggttggccactatttgtcaacgactttcaagacccaatctagcaacccaatggcaagggagatgtgtgccggggtggaggggacggattgcaccaaggttagccttcccgacatagccaagagcctccccttccaggcaggcaactgattatgtactgagtccacaagttgttgtaggctactcttcagaggctgcgtgacagagagggggggatacctaggtatttgcatgggagctccgtgaccacacatagcatgatgtgagagagtactgccatatcatcctctgatcacctgattggagtgatggagcacttgtcgaggttagtaagcagcctcggaactaccccaaagcaggagagaatctccttgatcacctccaaatcctgggccatcggtgaaaggaagagggcgaggtcatcgcatagaacgaagctctgtgtttgacagcactcacgtcaagcggaagatgccgagctcactagtcctaccaatgagggcattgacccttcatgaccaagatgaacaacattgttggttgattttattgtctaatgccggttagttaggacaagaataaaatcccaccgtttttcctatcctaactagaaaccaaagaagagataaaatatattttgtgtgatcggtacaaaatagattcgaattttaattgaagataagcccccgagccccacaagtgtcactatatatgagaaaaaggagaagaggcagatgctatgccgaactctctttctaaccctaaaactctaagaaaatcgctcgatcaatttaggcactggaaggggttcatgaggtatctcacaatagaagaaatggagaagagaagaaggaaaagcgaaaaccaaatatcagctttgatggcttcatctcaggtcagttagatcaattccacattgttgtcgaacgacaactgcgtcacgtcgaaagacatggttctctcaacaatggttggaaacgataacaattgtattgcttagtaaaaaatttcagggatcccatgttacatggccctatggggctatttatagccctattacggactcctttagggtttaggttttacaagagaatttgcatggttacccttataatagggacattattgggggtatattgcgtcctttacttgcatgggcccctaatgggctgggtgactcggcccagttattggtgaagcccccagagggcatgatggcccgttgggcccttttcaagtgaggtccggctcttggcgaaacccgtgtccttcgcggcacggcttccaccctgcagtccttgcccgtatagccctccgacaaggtccatccttggcgaagcccacgtgcttcataccacggctttcgccatacggtttccacccatgttgtctcttcatgggatgtagtcacgccttctcagccttcgagcgtgcctccggcctgagtcctcgcctagattcctggtttcggtaggcacggtcgaaggtcctcgtggtatacctccaacacgcataattaagcagaggtgatcatgtttagactaagattcaaattaattaagtggattaaattccaatacaacatcagattgaggggatcgccttagacaggtcagatgtcaaatcaaccatatccatagcaaatatataaagtttagttttacaaactaaaaattgttacagttgaaagcacaagctagtagcaacttgaagaagatttgatcagcttgaagaggaagtcttgatcagcttgaagaagattacaaaggataatccaacaactactccaacaataatcacatgcatgatacaataatacatcatatttcatcgcaacaatcattgaattgaagctagtttcccatggcgttgccctcaaaccggctgatcctgaagtgccggagctccaccccggcctccgccgccgtcctcgcctccccgtccatggccatctcggccaagatcctccccaccgccggccccatcttgaacccgtggccggagaacccggccccgaccaccacgtcgtcgccgaactcgccgccgaggaagtcgatcacgaagtccttgtccggcgtcatggagtacatgcacggctgccggacgaccggcccgccggcggcctcgacgtggtccggcatgaactcctcgatccaccgggcgacgcgggaggccgcgtcgccgccgccgccggcccagtcccggccgtccgggtcgcacggcgggccgccgtcgtagttgatcttgatcaggcccgggagctccagcgacggcgtgccgtacacgtgcgggtcgccgtggctggagaacgtcgggaagccggcctccgccgcgagctcgcgctcgcggccgggcttgaccttccagtacaggacgagcgcgtgcagcggctggatggggaggtccacgccggcgacggacttgaccagcttgctcgtccaggcgcccaccgtcacgacgcacttggcgccgtggaactcctcgccgccgctcgtcctcacgaagactccggcctcaccgtccttcttgacgacgccgacgacctccgcgttgtccctgacgacggcgccccccttgacggcgagcgcctggaacatggccaccgccttggtcgcgttcagcacgccgccgccgagctcgctgacggcagccacccacccgtccgggacgccgcggaacgcgccgccccacctcccggcgaggtcgtcctcgtccacccggcgcgcgccggagttcccgacggcggcgagcagcgaggcatcgccgggcgggcccacggtgagctgcggcgccggggtgagcacgcggtagccggactcggcctcggcgtcggcccagaggcggcgggcgaggcgcaccatgggcgggtagtgcgccttggcgtaggcgtcgcggatggtgcgcgacgcgccgtgcgaggagccgaggtggtggagcaggtcgaagcgctccaggagcagggcgcgcgcgccgcgggacgccgccgcgtgcgccgcgcagctgcccatgatgcccgcgcccaccacgatgacgtcgaagtcgaaccggccgccggcggcggcggcatcatcggacgctgcggctgcggctgcggccatggcgcggtcgaacactactcgatgtgcaggatggagtgagtagccagccacagtgaacatcacatcacaccagcacagtctattatagaggcgagcttgtgactggcgaactagtagtagtaatttgcaacttgtgctcttataaaattgtttcattggaattcactttaattttattttttaaactcgtgccaagtcatcgcagaaaatcgtaaaaattcgaaaacgcaaaggattgggttggtgtagggatgaaaacggtcggaaacggtcggaaaaaccctctaccatttccattttcattttattttctcgaaaatggaatcggaacgtatactcggaaacggtaaggatatcggttatatcggtatctcggaaacggaaccgtcggaacgagaatataccgatatcggacggaagtcgaaaattcatgtcggaaacagcgaactgtggtatcatcccgcatttaactatgtatgaagataaccttataatttcacctttgcatcattatgctgccacacaacaccgttatatgatgattaataagttgacaataagattgacaaataatataaataaagttcaatgatacttcaacatcaatgtggctaaagcatacaatgtggcttacatgataggattatagcataactaatattgtccgactttttttaggatatagatttgaagtcttcgagaacaccaagcttacaagctggcatggcttcagctgatcagctccttgtcaaatatcattcattatttcatcatcaattgacatagctatatcgtcgtcctacagtgccacattgcataagaacttttatgttgacactgtataactaccgttgtaattaagtttcatgctaaactagactttttggtatttccaggtcgatcacagagaggagtcaagatggtggggcccgccggtggatcccacagcctttcttttcctctctttcttttattttctctctctcttatccttcccttctctcggttccttttcctgctctctcgatttcttctctgttttctctcttgttctcttctctgcctttggctccttcacgcgcgcccgagaggagagaggcgccggagatggcggcctggcgcagggcggcggtgggggaaggagagaggagaaaggggcggcatcggtggggaggaggaggctggggcggtgcggcggcgctcggcgcttggctcggtggcacggaagccggcggtggagcatgggggagggaaaggtggccggctgcgacggaggccgtcggggcgaaggaggttgcggccggcgtcggcgacctggtggcggcgcccaacacggcgcggcggtgccccagcgccgatgaagacgacgatgcggtcaggcctagttggcttctttattcggaatgggctgctccttaatgcctaatgggctcctcctcctgctagccaggcccagccgacttccttcttcggaattttgtcggaaatttgacggaaattaccgataaaaaacggttaccgacaaaacggtcggaaaaaaccccatatcatttccgctaccatttccgaaaaagattaccgtttccatttccgataccgacaattaccgataccgattgaaacggtcggtgcaaaccgaaaacggtagccggaattctcggaaatttccgtaccgttttcacccctaggttggtgtaagcaagcatataggcgaaacttcaagcagctttcatatatatggaaaacaaatgaagccggctatttctttaacccgtcggcggctatcagatcaggccatgcaccggttagcgaatactaatggagaatgaaatcttcttcctcccattctaaaattcttaccgttttatataagattattatttgaacttagactatttactctgaagacactagaacataacacgaggtacagattagtcttgaaaggtaatttaataataataaatatttactcaattatagttttttggagaccttgtaattgtccaaaatgctacttcctccgtttcacaatgtaagactttctaacattgcccacattcatatagatgttaataaatctaggtatatatatgtgtctagattcattaacttctaaatgaatatgagcaatgctaaaaagtattacaatctgaaacggggggaataagaattatggaaccttggagtagtgactagtgagttcaaaaaacaaactcccatactttgcatacctgaccatccacaaattgcaagatgttttctcttgtgccaagaaggaaaaaggaaatcggcaagagcaccatgtcagaaggtagtgcgctaccaaggttgttgttataaaaactagccccgaaatcgacatcggtagctaaacgcggaagaaaacgtcataggagatccaaaacgatgacgacaccgagacacgatatttggtaacggagttcagccgtagcctacatctccggggcactgattacgggcgctcctccccgatccagcatatacagcgtatcagagttacaacgactcacagccggtcgacgccggcagccgctccctctcgctatgctaagtcgccatacggttacaacaagcacgcccctctatttatgagagaacctaggatagagtccaactcatactctagtcctaatacctattataactccaagtcctaaactgtaactgactacatacacatattcgacacaaactctaacaaactccaccttggcgaatatgccacgccaacttgaatctg

SEQ ID NO: 38939 - DNA, 5939 bp, Oryza sativa
agtccaacatccacgcttctccagacttctcgtcagacactgtgagaatctcatgactgctgctatctgaatcatcaccacgagctgctaaacttgcaatgccacctttcctcttcttcagtaacgggcaattcctccttatatgtccaaactcatgacacttatagcaccgtgcccccttctccttgctcttcgacacccctgtttcatgatcatgcttcgctttgaccagcaaactctcaccctgagaagcctctgttgcctcgtttttctttgatcttctcaagtctcgtgcaagcaacgacgaaattatctcctcagttttgacagtatccttgccgtgcgtcagggtagtcaccacatgttcataagacggtggaagcgagcacagaagaattatggccttgtcttcatcatccaatttcacatctaacttacttagatccacaacaaactgattgaagacatccacatgcttcctaagatctgactcctcttgcatctgcaaaccatacagttgttgtttgagatacaacttactcgtcagcgacttggacatatacaggcttgccaacttgtcccaaatttccttcggtgatttttcatccatgacctggtacatgacggaatctgagagactcaagcgtattgttgcagctacctgcgccttcatctcatcccacttatcagcatccatcatttccggcatcgtctcatcaagaaccttggatatcccctgctgagccaacagatccttcagcctcatctgccagagaacgaaattcccggtgccatcgaacttcaccacctcaaatttggaaaccaccgtcgccgccatcgacgataatcaactcaacagcggttgccctgttaaattgatctgccctgattaattgacccaccgactacagtcactagccggacaaaaccaacccgatcggttttcttttctagtcaaaaagccagtcaacagcggtcaaagaccggctcagatcgagccgatcccctttttccttcggcttccttccctcctctctgcacccgcgtcctccagatgcgtcgccgcctctcgccgccgtatcgcgcctgcaccgccgctgccttgcgccgccggcccagcagggaaacgccgccttacgcactgggagccgccgccgccgaagtcaggcgtcggttcctcgccgggaactatcgcatccgccgccgcaagctcctgcgaaccccgacgaatgccgtgccgagctccacgccgccgcacaccgcctacaaggatgcgcctccagccgcccgtgacctcgccacccaaaccacctccgcctctgtgaaaatcaggtacgaatctcgccctctgctaggtgatttgtttcgattgcgttgttgcaatcccgtggtcctctgttgcttttatctgggaaaaattgagtccgattcctgaacgaatcgaagtcctcgtccgattccctttcgtgttgaaacttggtatccactgtttgtcttcgattgtgtccgtgccatgaccgaaccggagacgactccatgtccgtgtcttccacaccacaaaccctcaagaccgaaccctgcacgacatagctaaaccctagccagctccttctcggcatcgccctgatctccgtcaccggctcggcttcgacgcaggacgcgcacaccgtcacgaccctgacctcctgggcttcttcgtatctctgacaacatctagcaccaacgccaagcaccactgacgactccaccaacaactgttgtcattgatctacagcccgtgtggttttcttcttgtctgctagagggaaaaacaggttgaaccaaagcctctccagggttgaaccgctactggatgccggtctattcgccctaggctttgttcagccatatgccacaaaatacgccgcctttgaaacaattccatcgtgcaaatacctcgtcaacacctccaaacagcctatgggatccacccgctccgacttccgattgatcgccatcgatctagtcgcgagccgaagccgacaagtcgcatgccgtcttctcagccgccgaacgacccgagtgctatgtctagccatctccctgtcgaacgcaactcatcgaaaggcccgggccaccccgcccaaagtgttcgaatccaccgatcgagaacgccgatcgcctccaacttcaatcaacccgagcatgcggccgcacgtctccctgtcgagagtagctcaccggaaagtccgggccacctgcccgaagtgtccgacccgccgattggatcgccaatcgcttccgccaccatcaacccgagcaccacgtctagtcatctccctgttgaaagcagccatcgacggtttcggccgccgccagaagtgttcgatccaccgatcaagactccgttgatcgccgccgtgctccaccttgtgccaatgcccctccctgggcattacagcaggctacgcggtgtggagcacctcggtcgcgcctctaccatagaccttctacaggctctgataccacttgttataaaaccagccccgaaatcgacatcagtagctaaacgcggaagaaaacgccataggaaatccaaaacgatgacgacaccgagacacgatatttggtaacggagttcagccgtagcctacatctccggggcactgattacgggcgctcctccccgatctagcatatacagcgtatcagagttacaacgactcacggccggtcgacgccggcagccgctccctctcgctatgctaagtcgccatgtggttacaacaggcacgcccctctatttatgagagaacctaggatagagtccgtctcatactctagtcctaatacctattataactccaagtcctaaactgtaactgactacgtacacatattcgacacaaactctaacaattgttttggtgcttttgtgggtagattatcagccttaacagcattgtcagcagctcatacaaatttgatcctccattcaaaaaagatttctactctatatcactttgcacttcaatagatcattcatattacattatctatattatacaatcctatattttagtaatatcttacagctacctatccatttgtattactttgtaatatttattttttaacatctatatttccatcattggtacttgatgcagatctccatgcttcacatacatccggtgatagtatgttgtgaagagaaaaaaacataatcgaacagataagtcatcactcccaaaggggaacagataactcatcccccccacccctacacgcacaatgcgccatgtgatgcattcgttgctttgtagctttgggcagcagcgcatgggggtgggggagcagtgttcctcgaacatggtcagcactagcagaaaagccgtcggctgaaggtgtagtagaggagcggcatggttgcgagtggaggtggaggagcagcagaggaggggaggggcgtggaggagcagcagaggggtgacgtggctcggggcggtgaagtggcgcgctttggtgatcagcatagcaccagagggacaatgccgcttctactccggtaacctctctagtgatccgttagctctccgcttctactccgagcctccgccgctagatccagtaggcgtgtctctcctctgtacctccattactccacatctacccctggcacaacgacgtgatccaaatggtggcgcgagttcgatccggagatgaccagttgctagatggcgtgaggagagagaaacgccaaatttgacgtttttgtttccggcatagcggatgcgctaaatttgaaggggatgatggtgtatctattggagccctttttctctctccttgtgcaagtggcatgtgttatatagaggagctgctacagatgttctaagtttcactctttcagtttttcctggtttgtttgcattgttatataggctactactactagctaaatgcctaaatcaaatgatattgtagcaatcttatgttaacatgtggagccacaattcatgtagatcaatataagatgagtaacatgtacatgtgtcctagtatgaatcgaataagcatctagcatctgaactagattacaagtgacaatatgtgtatgtactggagggaaaattaataaagatttgtccattagctcgtaagatgtaatagattatgactcgataaataatttagttaagaaatgcactagaatgtgacaaggttctaccagaataccccaagtcataccgaatacatcatcgcatggtgcatatgtatgcagccactcctaactccaagttcacttttgcatgcttagctcactgcttacgcatgtatcaggagcaaaacaaagtttatcatgcggcacaagcaagtacatgccaaaatacaccattatcaattttaagcataacttgtgcccaatcgaacgccctaacgaacgaatcagtagttcagcagtcaaatagcagcaagtgataccaggaaattcaactgctggcacagcatagatcatacatgcacatacagaattctcgaaaacatgctcacacaactactgattgccccggaacaacaaatcaactatacatacattgatacatcagtaattagtttgaccacacatcagcacaagctgcacaaaagaagcaaggaaattgattcctcagaactgcggtggtatatataggtcatgtagatatttcatattttaccaaaaagtttcaagtttttgcctcaaggatccagcatcctcacatcatgcttcttgcgcctacaacggtgatggctcttctgctccccaaaattattgtcaccaacaatccccatcttattcatatctgctatacaatctgcattgtaaaaattcggcagtaattagagcgtttgttaggtggataccaaaaggtactttgcaaattacatcgcctctctgttgcaggaacaaacaattgtaccaaatccaagacaagggcaaaagacaattccaatgtcaaacataacaaaacatttctataaaataaagaaactgtggctagtatttataagttacaacagtcagatctgacagcttcagaaattgacaggcatggctaacaattactaataacataacttcaaaaggacatcataaaaataaaagcttctgccatcagttcttattgtttcactcatcatgatagcagtgtagcacaaatgacaggggtacaggattacagtagaacagacatttggtcagcacacatgtttcaaacaaggtcaagttaaatttatctagaatttaatcgaaatattaccttcctgaacacattgacatagtcaatgctttaagcaatcatttagttttggacgagacaaatataactaaaatgcatggtggctaaaataaaatttcgtcagaatttcgagcacataatcatttattaagcttattatcaattccattaaatcaatactggatagagcactaaatgaatacgtgtgctttccaccagtcattccattactcaaaacatgcagcaggcaagtgcatttccatcatcttcccatcccacagcccaaaaaaaaggagaaactagaaaatgagtacatccctttgatcagaatccacaggtagaatatacattgatcaagcatccgatatcctagaacatagttatgtaaaaaatcaacaaattgttcaatccaaaccaagaactctagccaacaagctaggatcccaacccatggattttacaaactaagcatattatatctacggaatcatatcaaataaatgcacacagtaacgatgaaaacgatgtcaatctctatacatgaaaaggaaagcgtgagctaaatcagagattgtcccaagaattgggctcagggacgccaatcacctccgatttcctcgccccagaagaacagctgctgccttccgtcctcttcctcctcgtcgatctcatccccgtacc

SEQ ID NO: 38940 - DNA, 30725 bp, Oryza sativa
attaaacagtgctaaattcgtcgtgactcctttgcttattctgcatttttcgaaaaggtactcccttcgttttacaatataagtcattctatcattttttatatttatatttacattaatgaatctagaatgagatcaatataaatatggaaaatgctagaatgacttacattgtgaaactatatatctagattcattaatctcagtatgaatgagggaaataatagaatgatttatatatctagattcattaatctcagtatgaataagcgaaataataaaatgatttatattgtgaaacagagggagtatttaagttaaagaaaacttcacgcaagagacgaccgtatgtccttgactcctttcatagttgctttgtttttttttccgttgcgatcttgctttctcaactcatattaaccatcctcacacgtcatccatatttctgtttacaacaggaagatggagtgtatacgtagattcatcatgaaatataatttgataatgtcacaattcttcgagcttacaattaataaatatacaccactagagaaattagtagtcaatttgtatgggaaatattgtgacaatgttgtttatagcaacgaattctcgacataattgggattggtaattaattcttctcgcatttaacatttagttttgctatttttatttcagttgtttgtggctcaacttcagaccgtagatattactggatttagagtttgcaagaacaatgttgtaagatcttatgttttaatctgaacaaaatgatgcatccaaacgttttttaaacctaggaatacgcaactctaaatatcctaaatagatatggatcacgtgtcaatccgagcatttttctcttcattttctaattaacataaaaggttatcttggttttcgttaatatgtatttaaacagttaaatgatgtatttcgtgtgaaaatattttattatataaaagttattttaaaacatcaggtgaatatatattttaagtttgaaataattaaaacacaattactccctccatcacataatataaggtatggtaaaagttacacgatctccaaaactaatatttaacttataatttctcatatatataaggtttgtagcaacaaaattataatcatatgaaagtaaatttaaatgtcaatttaattatataatttttaacaaataaaattaatttcatattacattaaatattagtcaaatgttttcctattaaacgaagttatgtttactatgcagaaagatattgaactttttaggtacaacttagccggtatattactgtgttggaaaacaaatatggcggctgaggcttccaatgttgaacaagtcgaagatacagacaatgaaaatgatgttgtgatagtgggcagtcgtcaaagagaaagatgggacatgaaggaatctaaagtacgctcggcaaccaacgatcacaaatatagttcccttctctcggtggtttctgctatgagtttataggagttgataggcggccttttccagtacatataaataaattgtgccgaaaccttggagtaagccacttctatataatatatctaccccatagttcaaagatgcactaacttattttttttattgattgacaggaatatatgggtgcaaagttcacgtccgcacaccataaaattaagtctcaaaacacttcaaacagtactaaaggatggaccacttgaccgtgattgcttcaacatggccatacgcaagttcatgtatgaaaacatccagtcgcttcacaaaaccagcgaagcaataacgaagcattgcctggacttaccatttttggtaagtttttataatctacccaatattgattcttttgctcatattttaaacaattattgtacatcatatagactgctactggatttggtataagtccgatgttccataaggatatagatcttgcagggtcggttggtagctggtcgaaaatccattatgaagttgcaaaatgcaaatcggtaagctaactatcctttgttcttatttgaatgtgttttttatattatcttgacggttgactttttccagattcttataccagtatgtgctgttggaagctatatcttggtcatactggaccaagaaagcaaaacactttatcttctagaccctaatccactaaatccaatgtatctatgagatatatcaaaaaattgttaaacgttaccaactatttcaacagagccatgcgtgtggcatgtcttggctctaggtggactgaggatatcgacttgtggcgccatatatatgtcacaaatccggtggctaactcgtaagttttcttgtaaaatcttgtttgatccaataaattatttttgtctaacgcatggtacctaactattcaaatttcataggaatttgtcgggttgtctcgtacatctgttcatgcgatcctggaaagatggagcacttcatttgccgtcttttaaggtcattctgactagcattgacatttagaatattatattttattttataatacaattatttattttataaacatatacatttgcaggatgttgacgagctaaggaaacaaatttttgctatatatattgatgtacgagcaaaatgagtgcgcaagcaacgttcctagcggcgcacgagattttcttcactgtatcgcaaatgcaaaacattagaatagtcattctttacctatggggtgtattctatacattacaaatgctttatttaaataatagaataactctatacttctctaacatatttttctgcccgcaacaaataatggaataactctatacttctcttacatatttttatacgtatattgccttttatattgtgtacatagggtatattatatataattaagtctggtaaagttttactgtgcccacgtaatatcatagtactgtacttacatgaaatatatttaatgtactatatgaatttaattaaagtttaaatgcacagatcatataaaaatattttttggtaacatgaaatttttttaaagatacagttaaatagaattgcaccgtagcatttagcacggacatattactagttacattaaatattagtcaaaaagttgaattttgaaacgccttatatcatggatggagggagtaatattattgatttatccgtcgctttcgaaatgggcaccacgcacgcatctcaaagccacacacgcgtctccacaacacgtccctccaggtccaaccccaccacatgtatcggtttctcgtgggcggccagatttttgtcgcaggtcggtttcgtttccgctctccgctccacgcggcgtcgcctccggagcccccagaagcttctcgacccaccaccaccgctctccctctccccgtcaggtgcgttcgtcggaaatcatcgggaaaaaccccgaaatcctctcccagctttcccttttttttttcccttcttctccgcgcgcgtgttctcctcgatctctccgatcatcatcgcgtgtggtggccgattggctgcggttcccttcccggaaattctgcggcgcgcgccgccatttttatccgtctgtctacagggtagggagttctcagattagaaaccaggggttctcccgttttggcgctagttatggtagagatttcgttacctttgcatatgccatggcttcgtcggctctatgcacggagcctatgtatgtatgtatgtatgcttttatttttaagtttgtctcgtctagagtacgcggtggcgatgggaaacagccgctagatttgtttattgtttctttaccctaatcacaggtatgggtatttgagattagttacgaaacatcttagatatatgcggctattcagtttttttttttaatgtgcaagaatccaaaagtctattaattagcatgtaaaaggacttgtgctgataaattctttagtttttagtacaagtgtctgtatctagtttcaatacaagttgcaatccagactacgttaataacactaaaagattgtattgatacaaatccatgattattatggcgcattgaagagaggaaacagaggaaggtaggcttgtcctgcacggcttgaagctctgcttgccttggccaaggtttggacagaggcccttttgagttctatacactggttgattactccctgttacaaatctgagcaatctttatcgacgagggcctagctaataatcaggaaaaatagagataaagtggaaagtagataacaaacgccaaactaggaaatagatgactgcatatctttcagccggatatggtccctcctgctgtaggcgcggacccagaatgcttgtacagctggtatttatacctatttggcaggtagataatgatgattgaacatggtattggtgctttgggtgacagttaaatatttctaaggaaatcactgcacaaatatcattttttttgtttgggaaatatcttgtttttgttttgaaaaatttaaagtttatggtgaaatctcttttgtgcagccttggtattatgtaaatctccaaattctgtagtttagtgttatactgtcgaaatttgccctttccccaatctttgctgttgtttgacaatatgcgcctacacaaaattagtacagtgctacgctcctttgtgcttgaaatgtttccccatattatttattaacagaatcttgaatttacaaggtcattttatcttgcatatttgcatctataattttagttgacctgctttaactcctatatatgcagaaacaatgagcagacgcaacagccgcaccatctatgtaggcaatctccctggggacattcgtgagagggaggttgaggatctcttttacaaggtgagctttactgctttacaatctacctcagttcttctcataagcaactaccatttcaatctggtcgtagctgtataggcataatacattgcttattttcctacctgttaagttgccttagcttattaatgtgagaaatagctagcggttgaaggatttaaatcactattatgctagtggttgaaggatttaaataattattattatagtattataagagttataaaggattattgttctgtaattcgtggatgagtctaagggtaaagcaattgcgggaagaaaggaaccatctggccttgtgtcgccaaagaagcgctatttaggaagttgtcttgtctgtattaaatatctgttggctgtttcaacttgcgatgtcttctcctgctgttttggtagtgaataatcattttcttaatagcacaaccattgatgctcttgagcatccatcagcgtaaacagttgggtgtgatttatcctagatgacaactgataacctgtgtgccattgcgaaaaagtagtcatatattgcagatgggaacgtgttgacaaatgatatatttcatgagtcatattcagattaagggtgttgtatttgtacttattttctaagctaatgtggaggtgcagttgtgaaaagtttcactaataagtccaattaagtttatgtatatatgttattccagtgtttttatcccttacaattgcaataagaaccttaatcttgataacatgcatgcttttttttctcataaatttattctaatgcagtacggtcgcattttggacattgacttgaagattcctccaagacctcctggttatgcttttgtttaggtgagtgtccttttgcaacagccatgtcttctgtaagggtacttgtattgaaaattttattgaaatttataatatagtccctattattaccctgatattaatatcatttcttctttaaaggatggttgttttcaataaaatttacttctagatttttttcaagactaagttttagtttaggtatagctaagttttcttaagatgtaagtgcatcttttaagatgtatagctaagtattggatgctaaatagctaatagaaaatatgtgcttttgtagtttgaggatccccgtgatgctgatgatgcaatttgcggccgtgatgggtataactttgatggctacaggttgcgggtatggatatcaaaatgtttttcttccggtcttctggtctgctttggttttctgtgcctgtggctttatattttctgtacgtaggtggaattagctcatggtggaagaggtcaatcttactcatacgatcgcccaagaagctatagcagtggacgacgtggaggtgtttctaggcgttctgaatatcgcggtttgtaattctttctcttgaatgtgttagtcggtgtatcccaacaaagaatgtgatgtttctatttgttggaccatgcagttatggtcactggcttaccttcatcggcatcatggcaggatcttaaggtattggtgttgtacataacttctatttatagatttttctctaatgacctaattattacctacattcaggaccatatgcggcgggctggtgatgtctgcttctctgatgtataccgtgaggctggaggttagtaataaatgttctcttcttgttatgtcatcgtaccatgggccctgggatgagaatcaattgcttatgtgttgatcttagttttaattcattgtcctccgaaatcaagattcatgctttaatattttttctgagaatacaaaagctgtgtattatttcattaagacagagactggatgacgtctgtcagctggtcatcaggcccgtcaaaccccctcaggtcagggaaaaataattataaaagaagtcctaaaatgctaaaactgaaaatgaaagaaacgacaatgtcctatactcagaagcaacctctgagcctgcagaggcctttctatatagtttgcgggctatgtcagtaatatttgtctttctgtttgtgttgcagcaaccgttggaattgtggattatacaacctatgaagacatgaagtatgcggtatgtttgatatcttctgtataaagtgcattctgaaaatattatactttttggtaattgatgagggaacattttcagatgtgttattcctgttatacactttggtcatatacgttgacatttatggcaagatttggtcaaatttttgaaatgttgactatcaattttatattagaataagtttataaaatctaataaatttatgacattatgatagtacttttcaaggtaaatctagcctaccatctttttttttcaacaaagcatttgaaaaattattaatgattgaagtttcataagtttgacataaaaatcaaatatttatgattagagggagtatttggtatgtatctcttatgatcttttgatgatcttgcagattaggaagcttgatgactcagagttcagaaatgcattttcacgggcatatatcagggtatggatttatttgttttttgaccatgagggtttttcctgtttttgctatgataatagataatatgtcttctagatgcatttgattgtgatctttcgtcaacgtgttcttatttctatgataggtgagggagtatgatgatagatcaagaagcagaagccgctcttactcaagaagtcgtagttacagcaggagcactatggcagcactaattgttgactgcattgttccacagatctgtttctcggtcaccgtcacctgtggatgaaaggtatatccttttataacatcagctttttactggcatgccttttttgtcgttaaagagaaacaggagtatgtgttggaatttgggtttttatatactttggaacttccactgtggttcataaaacatatgattgaaaagcttgtaatgtatttccttttttttgaccgactaatgtatgtctccttttaaattgatatgacttaaatttcctctatggcccaatgactaaaacacagtgctggtggctaacttgcaatgttcaaggtttgcttttgtttttcctagatctggccatgcggcaatctggggactgctttcatagattttggatatgttgagaatcgaaaggatggtttggaactttggatagtagagctggattgtgatgcatgtatggcaaatgggcaacaaccagtcctaggagcgagctaggcctgacagtaaggatatgtggagtggatttgtgttattattgagaatttgttgaccgtaggcacttcaatttcatatactgcatgacatggacctaacttacatgagatctcaaagttttcttttaattattcttgcatcctgataaaacaagattatggtacttggtaagcatttttctggaatatgtacgtgcttttttcacaacaaaagaaattgatcctgcttagtttttatgcggattctgttgaaatagagattttgttttgttcattggcacatattagccatttagcatgaatacaaaaatgcttacttatcagtgtggttcttctgtaatttgttttgatatttctgttagtagtttttggatgaaatcacactgagtgattggttttgcctgtgaaattttgcagatcaatatcaagatcacggactcctgtttcttcagtaagtcttgcagcaagtcatctattattaaaaagtgaattaagtcctattttcaatcattttgtttattgcaatttgcctttttttggcagccttctcgtggaagatctgttagtaaaagcccaagcaggagcttatcccgctctccctctccggtaaataccaaataattcctcccacatttacaatgcccctcccgccctgaacaaaggaaaaaaaaaaatagagagaactcattacactggtgaaacactttatgatcatttgctgcctacgttgttgcaggtgaagtctgattgaacatgaaaaccctccagactgtgacggctacttaaggatccaggaacctggaactcgaggatagcatggattagatcaaatcatcctggttatggcttcactgcgctacaggcttcgccctttgtttagtaggtcgacttctgtttaatattattcatattgcattatatttgcgaaacagagatcatgtgttctgtagtcatagtcccagtacttattttacatctagtaagtggaagaaactatctgcacattgttgtcgactgtattttaaatatctgatgccatatatatgttgatgtaccacctttggttgtcctttgaaccgtggttgatgtgctgacgtactagatgttctgtgttgctgatttatattatgtaaacttagggtgtgtttagttcacgtcaaaattggaagtttggtcgaaatcgaaacgatgtgacggaaaagttgaaagtttatgtgtagaaaaattttgatgtgatagaaaagttggaagtttgaagaataattttggaactaaactcggcattagatctgtactccatttagttgtttcagttcactacgttaactgcaatgacagcaggaatgattggtgtctatgtggctctcaatactttttacccaagcttgacataggtgtatgacgaggtcggcacatatagattaaaatttgaaagtagactgtttattgtttttttctcacaaatgcgtactcgaaatatttgcatggtactgcagcgcggtgatgcgaagtagcaagttcgcacggtgggaagcgagcatgaaatcgtgcattggtaacgcaacgcgaaggcgagatgaatcgtaataacatttgtttaaatagacatttataattataatactccctccctccgattataacccgattgaggttataagatgttttgactttggttaaagtcaaactgcaatagtaatattttcaacctaagataaatttattataaaaaatatgtaattattaatttaatacaactaatttggtaatgtcaaacttatataagcagtataactttaaacaaagttaaaacatcttgtaacctgaaatggagggagtagaacggatctgatttaccttttttgggtgcctcctaagtgggcttcctcttccttgagatccattttcccctttttttttttgacgacaaaattttgaaatcatactgttgaagtttttagaaatatactagatgcgaacaaatttacacaaacataccatcgtcgtggttcggcagtgtgaaatcacgacggaatcacaaatagaccgtcgccacggttcggcagcgcaaaatcgcgactaaatcacaagacgaacacacaatagtgacgaaagcgcgatggcaggggcggtctggcaaggttaaaatgcgagaccagcctcggtgtcactagttggccgagcgagatggccgttgagccttggtctcacttgtgggccgcactggcagctaatgacgcaattaatcatactaattagcgagtaattaattactgatgatcttaattaaagaaataataattaattgctaacgactctaattaattaattaatcgcgtgagtttgtgcggtctcgcggactagccgcgcgagactcgcgcgaggtatcgttcactcacctcccggcctcgcacttccattttgcgataacggtatttctgtcattcccttctaaacgtgtatattccagttaaatcatagaaaaatatatatctatttttcttgttttgaccgtactcctcttcaattaagtaataatataattagtactatgaaaagaaattggaaatataccttttcattggtttttagaaatgtaccttgtcgccaggagggtatgtgtgccatggttacaaataagacatacctcatatcctacgacttatagaatatacggatataacatatctttgcatatacgagatattttcgtgtacaataacaaaatttacgaggtgatatagaaactatcctcacgagaagagaaatgtcagagtcctacttaaaaaggattgggtttatactatattgtggagggtccgttgtcttcgagtcctactcagaaaggattgggtttatactatattgtggagggtcagttgtcttcgagttctacttacagactaaggtgacttacgatataaaaaagacacacccctaagggtctggatcattgaatcatagcaccaatacaaccaccatagcctacaatccggatgacgcgaaacatactcgtcgggagatctcatcgaacccatctcgatagggatctcgccgttaatctcgagatcatcaattctctattgtaatatgtggtctttccatatcaatctcatataaattggattagggctattaccttacaagggacttaaaccagtataatccttgtcttcttgtttgcttgatgtcgtatcgtgtagatcctcgtaccaatgtatccaaataccctatttatccggtctacggatatccaccatcgacaatgtgaactcactgcggtctgcatccatgtagagcgaaccgagcaaacttgttgtggagattatgagtaccatatacctacacgtacggctagtttattcgactgattataggggatatgttatatctctaaaatatgtaacggattatgacttgggtattacgtttccttgagtattaaggaaacggtttaaagtcttaatcgggaatatcgtaaaatatattctctattcggttaggtttgtatctgtaatccgctcccgatctatataaggtgggcaagaggcctcttgagggcataaccacactaaaggtcgtcagatcaatacaatattcggtggagtcaaatccctaaacaagagtcagtattacttttcgtcaagagggcctgaacctgcctaaacccttgtctttccacccatctactttagctctcgtgcactacccccttttcatattgtcgattcctagtatcgacaattggcgcgccaggtaggggttgcgtcgagttttccgtcgacaagtacgatgggttctactccaggagtcaactccttctccttccctccagggcaggcctaccgctttggcagtctcgacttcatcactgacaacttcggcaacatctctcttcttgactcggattcgaactagtcggggaagaggtcgtgaccactcggcaccgtttggcttaccaaattccgccgagatgtactccaacactttatcttctaggctggcttcaaaccactcgggggattcatctacatcagtgcgccctcgcaatctttccaccatcaccagtgcatatcctcaggtcatcatgcaacttccccctctgccacgttcgaatctggatctgtctatccccttaggtcccgatctgagcaagcttcggcttcgcctagattgggcttcagggagatgggcgtcacgctccaaccactcggatcttgttcggacacggagattgccaactttctcagctcttttgacgtctatgacgaccgcaccaccgaaagtctaggaagctcatagttcaacgacgactacacccaattcctttttggtgtgttcatggcagattcgctgaaccaagaggaagttgcccggctagccagagaagctgaagaggaacacgctagacttgaagaggagcgcaagcgcagggaagaggaagaacgcatgaggcgagatctagctcatgctggacgtgcctctcacaatagaatgcttcagactcgagtcgacaacactaatgtcttcgttacacctcaacaaaacaaggtagcggtagtcaccttgcaccattattgacgcggctccggctaacttcaggcctatcctgaacaaagtcaagactatgatcgctgcaatagtgccccccggaagttggaggcagctatcggcctgaggaatctacgattgagacaccgtcccagacccgtctcccactagagatttttttttgaccagatctcccaccagagattgtcgtgcatgctcccgagcgcagcagagggcacaccagatctaatctacaccatcatgaaagacgatgactggatcagtcggtcgactctcgcgaccggcagcacgacagtgaccatcatggtgactcctactacgacggacactgcgcccacactcctagcgatatgaggcacgcgctcaatcaacattattgcgaccgcgaaaatcgcgcctaccgtgacggccaaaggcattcacccgagagaggcgatgaaggtgttccgcttttacactcgacctacgtcgagtggactggccgattggttcacttgggaaataagaggaaggaataagtttacttgactcccttaattagcggccgaatctgattcatatccttaaactacaatactggatatcttgaacctccaactattaaaacgggtacaatttgactccctaggcggttttgaaggatagttttgctgacgtggcgcctatgtagcggttttgatttggtctttattccacgtggtgttgatgtggcgcttatgtgatattagaattaaaaaaagtgtggtacccatttgtcatttacaaaaaaaaattatagggcccactgacaggtgggtcccacatgtcatcctatgtccttcccttcctcctccctttctctctcccttctctctctttctctccccctttctcttcacggcaactcgggcaaggacgcgccgccatgccgtagtcgtgggtggtgaaggcagcggcagactcggcgctggcgctcatgttgagggggtagttgaggtggagccgcgccatcctttcgctcctgatctttccccagccggcggagcgtcgtagatgagcgcgacggaggaggggcaaccggacggtgaggcagattgagggagattgcagcgggcgagcggcgatgggtgaactaaggggattgtggctagattggggctaggattgtggtggcgagcagcaatggtagagggagcgaaggggccagccgatggtcgatggagcgaaccggccgattgcggcaccgggagagggcttcttcttcttttcattgaggtcacgagggccttgatgatgggcgtggggacgaaagccggcggtagcaacggatgagataggaggtcgatgggcgtgggtgggcccctcccgatccagtggcgcgacgacgagcatgcggcagcagtgccctcccgtcgctacgggagggggtggttgtggggggggggcgaggtggtggtggtggtggtgacggcggcggcgtcgccgagagcctcgggaactcctccgagctcatcgtccgccgtgtcgccactctcgccagggacaaggtgtggaacctttccttagacaagctgctaggtgaagatggtgcgcccattcgcgctcgcaaagtccgccacttgccgatgcaatcccctcacccgcctaccaccgccgctccaacgaccgctggtgccactccgccatcgccacggctcaaggggaagagagggagggggaagggggggttaaagaggtaggctaacatgtgggtcccacatggcagtgggtccacaatatttttcgtgaatgataaatgggtctcacatatctatactttctataaagttatagcccactaagtttaaagctcaacacacaaccatgttacatcatcacccactagcaataattacatatttaacctcatgcgagcatacaacatcatctacaaatttatttaattatgcaatcaacatacaagcatatccaattatcacccctcacatcatttgcacaatattttaacaaatctatctattattttttttataatatttaacataaaattatcaatatgtttcacattaaagcgcgtgtatcatttgtttatttcatgataagtactgataaaccctaatgtttcattatttttttcctttttacttctagtttgattgtcaaaaaaatatatattgagaattgattagtaatttacgcagcaaagcgcggggaatcatctattatttttttaattctaatgccatctaaacgccacgaagtacgaaaaccaagtcaacgctgccacgtcagtgaaaccgtcatccaaaaccaccgtgggagtcaaattacaccggttttgacaattgaggggtcatccggtattgcggatcagggatacgaattagattcgatcattagttaggggagccaaagttaacttattcctaagaggaaatatgacttgggcggacggcctccgcgccgtgctgtgctcgccatgccttaccggcccataatgcctaggtggtgctacgacggcccatttgccatcgtgctcgtgccgtggctggcgtctcccgtctactaccgtatttctcctttccccgaccccaagcaaagcacatcgactcctatcggcggtcgcgcgagctccagcgccaaggtgcgttcagttcatccgattccctcctggatccaaaccctaattttcgctggcctcaccgatccttgcctatcctatccaggggatccgttgcgtccggcgggggttaatttcttgcggttgtaggatccccgatggcggatacggcgaaggccgatgcggcggcggaggcggccaagatggacctgctcgaggacgacgacgagttcgaggagtttgagatcgaccaaggcatgcaccgatccgtttccttgtcctctattcttttttgttgatgatgatactgctggtgatgtatgggtctacttcagatctagcgcgtcctactagatttgctcttcttgcaagaggtctcgccgcaacgcaatcgtgtggtctacttgtctgttcagtgatctggtgattagtgtcttgtcatccctgtcaaattactcacctagcttagtagctttaatctgttggtaaataacaagaacaaaactacccgaaaaaaaaaagaataaaactagctcaccataattctgtctgtctatgttcttttaaaattcagtactattaaggatccgttcttgtgtcagtacaattattatagtcgcacttcgccactagtcagagaattcctgtctacgccctccaaaaatcaggattatggatctgttcttgtgtcaatgccgcaacttagggaattccaatgtgctgtccgagcggtatatcacgtcggctcgtttgtagtatgaaccagtgttttttcatgatgtttatgtttattggttcctgtatctataagcgcaaagctcgtacataattatcacttgcccatgcttcaatttttttcctctagcatatgaagaatggtttgtcatagaagttcagcaacaattttctttatttccatcctatgatgatgtgatttgccttcagccccgagttcttgacatacaagtgactctttttgggccgtccgattacgcttcatttagttctgatggtcaaatgatgctcaatatagatgataggtagatgatactctgtagttcagccacaaaaacatttcagggtttatttcaataagtatgcaattttttttatctcaatctgttccttgcaacatcccgaacaatatactggtatatttattgttcaaataatacacatgacatacacttgttactgtatttctaacgacatctcgtatacattttggaacttcagaatgggatgacaaggaagaaggcaacgaggcagttcagcaatgggaggatgactgggatgacgatgatgtcaatgacgacttctctctgcagctcaggaaagagctggagagcatcccatcgaagaactagaacttgtggtcttgtattcagtactttcagataggaagtggtatctgctggatttggcatgtttactgttatatttaccaactcgagcattttgcttgttctgtggtatgcctttccgttatacattttattaccaaatacggttcataaaactatattgcctatgtctagaaagtggtatcggttgtagaaccgtaatccatcaactggctgaacctttttgttccgtgaatgcagaaaggccattgcttagtgttttttttatctaattaatgtgaagataatatgtttgttacttgtgcttcggtagtgtaactctggaatacgatgaaacatgatgaaaatggaagacatggacatgaaaggtgtgattaacggctggtttggtttgtagcctaaattggccttaccaatatttggcaatttcaatagtgtttagtgactttgaagttaaattttggtatgcctaaaaaaataagtcatttcaatagttagcttaggctattttggtttcaacccaacacaattttgtcttgtcaagattagccatgtcgaaatttaacattgataaaaattagtcttgataaaagttggaaagatcaatttagaccacaaaccaaacacgtctaaaagacattgttcggtgagctgatcagcatgtatcgaatagcttggggattgtggggttcacgcagacgttacagttttaactgaaaaagcataccatacagttacttttatatagaaaattttcatgcaattacttttatataaaacgttttcacacgaaaaatattggttaaaaagtatgctgacgaaaatcaaaataaaatctttaacttaataataaaaaagggacatcaagcccaacaaccatccacgtaactgatcatatgtcctcaacctaaatcaaaatcaagggaaaatccttagccacatcctgcaatccaagggaggaggatcctttacttgccccgactttaggtcattgacagataggacagatagattcataacaaagagggtttacatgtcagtaacttaaaaattatgtaagatctcaaactatagtggcggagttacctcccgggtaggtcgagcgaccgtccgggctccgttcctgccatctgcaccgtcgatagtcgtcgacacctataaaatttaatctatcagcgagaaacattattagttgtttgggcttgacgacgccgctggctctctgtcaatctgcaatccaagacgtagtcttgacccttgagtctttcacgaattctgctgatcccctggccaatgcagcacggggtagttgggttgggtccggacgcggcgcgcctccacttcttcggcgtctacgaggacggctctactagtactagtattgcatcgtcgccgtatcggatgaaatttcgaggtttcgacgaggtttgaaagtagaagtcatctgacattttggtgagtttcatccaaatttaaatttgaattgataaaaaaagaaaaataatcaaataaaatcttataaatagtatgatatttacaaaacctgttgggatataaattttcaaaaaaaaatgatgtattccgtgtatttactgaaatttacagtagaaaagaaaagaataacgaattaaaaaaagaaaaaaaaatcagtttacctctttttctgattaccgattgaaatttcgatgatttcgccaaagctgaccggttttcgcgagcttatcggtaagcttagggaatttgtatttaaattttggtttataaaatttattcggaatctatcggctttataccggatttcgtaaaaaaatgttattccgccgtaatccaaaacggaaggtcatctcgacattataaaccctgtacaactacagcaccgccccgaaacaaacaatatccaccacctagttgctgccacctcctgagaaccaagcaaagtttccgacctcaccttgctttttgatcagcgtgacgctgctgcatcttgttgggaacttttcctctcctctcctctcctctctctctctctcctcttcccgaaagaaataaaaccaagcggcgccgaaggaaaggcgagcgccagggccatgccccaaatcgatctcgcctcgagctcgaggccctcgcgcccgcggattccagccgattgaatcccccccacccctaaccccgttctctcggtgctctgctcgttataagcgggtggcctttagccctaggttttttgttcgattgggattttatatatcccgcttggttgggggggggggggatcggatttttcgtttcggtgccgcgaggtttgcgaattctactcgcgtcgtgcgtccgattctgcgctgtttctgttcgtggattctgttgcggtttctctggcgtaatctctgtgttccttttcctctctgcaggtgccgggggggtttcctcgattctggcgcggttttgcttagaggaattccggatttcttagcggaattctgatttccgggctgttgcgaggtgcatctaccagccatggcgccggcgccggccgtggatgcggagggggagtgtggcggggggaagagccacaacaccctcaagcccgacggtgttcgtgtagctgcagcctctaccaccctggactcctcggatagccatggtccagccgctgatgttcagggcgggggtggctccggcgagaggttggactcctccgacggcgagggacgagccacggatgttcagggcaggagcagcgccggggagagcctggtggtgaaatccgagcacgcgtgcgcggcggatgaccccgtgggtgacggtgcccttctcgcccctgccaacaagcctactggcgcggaccctttggcggtagcatcctcctcgcatgacatcgatgcggcgagtgctgatcccgcaaacgacgaggaagacggggacaccacggaatgctcgagttcatttgggaactcttgctgcgagaccgatgatgaggctgaccatggtggttcggaagtggattctccattttcggagaatgctgatggtgttcaagcattgattcggcctaggtgagcttgtttattgattccaatgccttgtatgcactaaatgatagattgattttattgttgttggaggaaattaacaagtataagacggcaactggagactaatttactactcagttaggtttcccgcgcttttggggatcttaaaaaggaaggttgtattaaagtttcaactgccaaaccatatcgtaactaggattcgtatatctaaaagttgtatgactagagcatataaagttcgataatattagatgtcttcgtatatcatgtccaagtgaaacttcagatgttatttatttactaacaaggtgccctgttcacttgtacagttagtctcattctcaatatttgtttcagctgcatatgttttttatttgttggccatatattttatctattgtgtatggatggatataagtgtgtcagatttagtcttgttggtcttacagatgtagtttatgcaaaaatgtggtagtacctatttcctcgaatggcgcttatgtgaaagtataacagtaataatagcagactctgaatacagtgaacattgggaccttttaaattactgtcagacttctctcacactatgttaaagaatataaataattgtgagtaatgaaaattgatggaaattactcaaattggaatatggagcagtcataaccagtgaaccaattaagggctcaattagaacacgagaaattaaagcttaagaatagaagaaaacacaagaataggaaatgaatacaatgcagaacataggattggggaatccatgaatttcattggaacatagatgtttagattggtgacaattaaaaacaggaatatttagaagtgaacttgtgtaattgcatacatacagaaaaaataaagaaagagtgaattgcactttggactatattttattacctaaatttcatgttggactaggctttaacactccttttcacattggactatgttttgttgccaagcttttgtactttgggctgctcttcttcctaagtcttcctgagcaaacatggcacactggctaactcctcgcctctcctcccacatattgttagcttcagcgctagcggcatcggggtgggtaccagatggaggctttggaactagtcttgccgagggataaccataacctttatccatgcccatacccttggtaaacaggtagtgtatgggtaaaatttgctttacccattagaaatgggttgggtctggatatacccatttataatagggtgggggggggggggggtggggtgcccgtatacctgtttgaccaatcttatctttctctccggttgcttcttccccaaatcctgagagaagctgacaccatggcgtatccctcttcctcgatgaacaccttgcgggagtgcaggacgtgtcagctcaccagtctcgtgcagctgccggacctctttggcgacgctgacgaggtgatccctgacgaggagcagcaggagggagaagacacagccccgtgtggcgagcaacgattggttctcctgccggagcgaagtgtccatgcgctcgtccacggccttgcggaacctgtgcagcacggtgcacgccgcagagtgatgtcgtgtacattcccattccgttcttctgctgctgccagctgtgtggctcctcctggatcctcctcaggtttgggtggtgccttggcggcacggtggtgaatggccagatacgttggcttcttggagaacggcctgacaaaaccatggccaaattcatcatctctgcattttccaagatcttggctccattgttgctagttctttgctttgcttcctggttagatcgttctacccaattacccaaatacccactgtatatgggtaatttgattaatggggaaattggggagggtaagattggggattctgttttatgggtatgcggaattggggatgggtatggccgggtaatactcatataccctccccattggcaggtctaatcagaacagggtcggcgctgagcctgggcagctacttgatgtctacagatatcctccgaactgacaactcatggatgcatagagctagcatggccaggaacatgaaccagcagccagtttgttcattgcgtaccttgatggctcgatctcaaagatcatagccatccttcttgctttgtcacattcatatgcataccttcttgctagcatttgtcacatattcatatgccatgcttctgttttgcgcatgtaacataagttcctcgtgcaacctgaagacatatcatgccatgttgatctttgtcatatattcatacatttttcttcaaatttgtgtatgtaacacaatcaaaattcatacattttgctttaaatttgtgtatgtaacataagttactcccacaatctaaatgcattatatgtgttagctttgctataaatacacacgttttcattttttttaaaaaagaacattatacttccaagtcgtgaatgtaacatacatatcagtataccagagttgagtcccactgtaacttcatatgaaaaaaattctattaattttaatatgctttcatattgtgtcagtgtttaacatgtacaaactatctttcagaaagaaaaaggtaactgctgagtggaggagtgctgtccgcccaatgatgtggagatgtcagtggttagagttgcgcatgaaggaccttttatctcaagtgtcgaagtatgaccgagagcttgctctaatcaacaaaggaaaagaattgcagcaggcagtaaacatgacaaatggttctaggtcagaatcagcacagtcttccaaaagccgtgaaaatagttgtatggagaggcgaaagaggagaagacttgaagaaactgtgaatacctcattgtacatcaagaagcacgagatattgtcatacttctttggtagggcattcatttcatttttctaggaataggataacagtttcttgcattgtctaatcttgcaccaggttcctatttgttggtaatgaagttcttgcattctttaacagataaacagaataagggtgctgaaacagatggcatcttaattgatgacgatagcagtggcccaggtatgtatatggtagtgtgtccacttgtatagttgtgctggagtttacacaggaagcattgtagttagcaaaaatttgcattaaaccaatctgcaatttacctaattatgtgtgtcacatttctagtggttaattgataatagagtctttaggagcttaaggactgttaaatctatcattagctaagtgcttgcgtgtcgcaagttctcccctacacttcacaggttcctctcccgattgagctgcttgttttcatctcctctttgttgtattaatggatggtatggccttgaatgtgtaagaacttatcaaccaaatggagatgaaaaatgtaaaacattttgctgcatttttaatttctaaatacttaaaaacacaacattgaaatagaccatagcaacactgtactgatgatcaggtacaatgcactaataactaggtgttgaatgattcatctgcgcagcctatagtaatcagaatggcatgtgtgtcctcgccacgattgccagcacagttgaccaggacccagcctggtgtccaccaatgcgtgttgacgtccttgcctagaaaccgtgcgggcaacccacgccctatcgcccaatcattcattgcctgtccgcatgctatgctttaagtctttcccaggtcccaattgagatcactcccatttcctgactatccattacccaggtaatcaacagaacaatgcaactctagcccaaattaggtggtaaacataaggtagaagtttgatgacccacccaacttctaagcctgaccagttaatctaagaccaaggcagcccagtgtggcatcttattcttcccagtcccagctgccagccatgtctaagaccaagcgtacttgctgccccttgccagttatttgaattagcttgctagtgtctatggactgggtacctggggagttccaatttaggtggggctggaacgcccacaagccccaatggtaagttcacagtcacggagaaaagcttggctataaatgacaccttgctggtatccttggtaaaatgtatgtgtcttgttaatgattaaaagtagtatacatctcattgtcagtgtgttacccacatctttccttaccgcgatgtaaacattttggtatcttcgtacttttatttttagtgttatccattataattttggattgaactaatgaagggcagcatacttgagctattcagacattggttatgttggcattgcaaaatgaaatctatcttcattacctaatgtctgaattttacatgatttctcattgccaacgctaactctttatacgatcgattcctacagttggcaatgatgttaaaggtgggatccatactgttgggttgcttgagcccaaggaatatgatatggttgcggagcaactcacactgcagaaatttcttttgacaattgatggtattcggtcccaagttcttcggctacaagatcgtctcagtaaggttcgttcaaaacaagaaaacatggtttccttggtggaccatgcccatatcaaggtgtctgagaagaggctaaggactcaaaaacggtcattctcatataagaaagatagatatagtaaatcaaagaaaaagaagaatctaaacattttatcgaaggaagaggataaaccagctcatgcagtaatatctactttgtctaagagggcaccagattgccaaacagaagttacaatgtacagtagcgaagaaaaaagtggagagaggtgccagtcacataagaaagccatcactgtggatttactccttccaaatggtcatatgggagatttgtgcaaagtaagtccttgatcctttccttatgatgtttttatttgattacttaacttccatacaaatgttttgactagactgaacgaatgttcaattgacaatattggggatgacaatcctcaattttcccattaacagtagagagaatagcacttctttttttgcatttattaaaatagtgtggatttcttggatcgaattccaataaataatgcgtgtcaaaaagtgttattctccagtggaacaagaattggagttaggtgtgcatgtgggccactcacggatacaattatagttgattattggttctacgttctgcatatggttcttacgttagtggtaaagtagggttattgactttgttgttcccctcacccaacctagtggagtcgctgattgtaagtctaaaaacatgggattgggacccatgtcagatgtgcagcatggtaatgcatgacatgagttgccttggactagtgcagtatttgttactccctccgtcccaaaatctagcaatctgtccagattcgtagtattaggtggtgtctaatcgtgtactaggttgctatattttggaatggagggagtaggattcttgcagaattgaaggaaatcagttcgatgtgctaaaggaattcactctttggttacgctatgcagttctagtatgttgtatttctttggaacaatggaattccagtgcccagatagttttgattatctcatattctttatttcttcatcctacaactgtttgtgatcaagaattatttggttgggctgtcaagtttttcaatgttagcttactcttcacaggacaatgatgacgtcctcatagacaatcaagcagccaatgaaggataccagccatttgagaacgccaagcagccgatggataaatcattagaactaacagagaaggtctgtgaaactgctaatttgagagttggaagtaactcttcccctgttgaagtcacaagcacttcagctccattcagagttgagaacgcttctgtttccctggaagccaggagtacgcctggtcaagtggtgaagcaagaaccggtttttgaaaaaccaccagctttgaagcatgtctactctggaaagaggaggcgaaaacttaaaatgaaggagggtagtggtcctgtatctggattgacccagagtaaagaggcctctaaaacacctgctacaaagaagaaaactgagagcacatccccagctgcaaaaaagctgaaaattgaggagaccacagccccagatgaagggaagaaagctgtgaagactcactcaactggaaagaagcgaaaagctggaaagtcatgctcatctaccaagaatcaggaagctgagaattcatcctgtgctgcaaggaaggatataagcgaaagcaccccctccaaaccgaggattgaaaaggcagtcttggtggcggtgaatagccggagaagtcagagggtccggaagccgaaaatttactgaaacaaagcagtctctccaatttcaggattgtgtatgtatcacagacgcgtctttttatgttttccgtgctgctgaaatttatttctatacgttattatgtgctcgccatgtaagttagtgtatatatcagcttgtctagataaagagggttcgtaatggtttagccatacctttttcttttgggctgccagactaaatagtacagttatcttgtgctgtctaaaggaaatgtcgtgtttgatactgttcatgttgtgcttgtactgcaaagatggctgcagccaagatggcactatttcgatatctggtctttttagtgacagcatttaggtatgaccccctggctggctgctagctatttggatcagagttggccgcagggctcgcaaattcaacgaacaccacatttctttttgcagtttttgatcgatgtgagctggtttgaatcctgaaaaagaagggaactcggtagaattcgcaaaaattcaaattcaagctgaaaaatatggagaagatttgaaaaaaaaacaatcatggtaatgctacatgacatcaaaatctgttaaaaatgtgaattttgatacttcaacaataattaaggaacaacactttgttatattttgttgaaattcaaactattatgttattgatgtcatggtctcatggatactataatattcttcagtcatattatgttgtttgatgacatagtaataatgttggtgctggcactttaaaattttggattactgttataatgtttctaattatgtattggattattgtaatattgtttctagttataatgcttttaactatgtacattccactattatatagttgatgtcatggatattataatattatgttatttcattgacattataacagtgctgatgatgtcatggactttaaatgttttaagtattgatgagctcacggacttaaattaacttttcaatcatagctatgcttttaactgtgaacacccgttactattatgctatttatgtcatggacattataatattttgttttcatataacgttgtgtgattgacattataatagtgttgatcatggcatggatattaaactttctaattgctcttctaatgtttctaattgtatacgtgcataatcacatcaatgtcaactttattgtctataatctggtatgccaaaattataatgccatgccaaatgtttctctcttctccgtcattttttcaaatttgtttacttttatttttttaattttcatttttccatagaaccttttggttgtcaaccaaacagtttaacaaaaatattatgtatggcttttttccgttccccaaaaaatatgtacaatttttgcttcaaatcgatcattttcgttacaaacgatcaaaattcgttatcgattcactcgaaacggatcatcaagatccaaatatcaatatgtgaatttcgttagtccactgtgtttcacaatccaaccttcaaatggttttgtaaactctgattaggagtcaagttaaaatattcaagagaattctactcaattccaatttctagaatgtgtcattgtataggtcattttcttcctcatgtcatccatgttaacttattgtttgctatccaatgtttggcgtggatattttttttacacgtgcccaaataccatccctcaactctcatattgtggccttgctcaaggggtggatgactcaggtggcagaacccctactccaatctccagcagctgctgaactatgcaatttaattagcgaccaatctagatcgcggctgccttaggtggggtgactctagcttatttttgagtattggtcactcccgaacagcacgatccctgcacaagctccaccatagtgtacacattgtccttaagacatctatcgttgtgattctagtatttgaagatgcattttagtgggcaagatatgctttccggaatggcacgaaagagattgtgttggtaaaatatagtagaatttctcgtaactaaatttgatgtaacacagtccgtactaccaccaagtaaccttctcttcatgagcatttgcgtccattgaacccatacaggaactttgaatagttggatgcatgtgaattctgagcttgccaagcatttatctgggccatgggcatttgagaacagcgcttgcagttatgccccacacggatacggggctgcagttgcaagcaagaaatgaatacgcgctgaacttaatggtaaagataactcatgatgtacattcctgggctaagttggctgaaaagaagggcgatgccagatactattactgttgctatcgtaggcgtggaccatgcaaagattgaggtcatctaggccgtgctaatgatacataatcccattaattgcctacatgtctccattcaattcttgtacatagaacagctgagcgagaatggcttctgaaaccatgtggtagctagtaccgagagaaacaactagttcttgcattttagcggaggagaacacttgaatgcaattgcaggagaggactgcaggcagcacgttgcatggtcatctcaatctcgcacacagactgaacattgggcatggtttggaacatgggaattctctgataaattcctataaagatctcgtatgatattctctgataaattcatgcgttttacactaaacctttgccggagatagttcgagcaggactatccgaagagtcattttctgtttacacgtttctcaagttattaaattgtctattttttttaaaaaaaattccaatatataagtttctttaaaaagttaaataaatttatttttaaaatttttatagctaatacttaattaattactccctccgtactcgtaaaagaagtcgtttaggacagcgacacggtctccaaaatacaactttgacttcttgtttctataaaaatatttatttaaaaatgatatatgtatactattatgaaagtatttttcaatattcatataatttttaccttttcaaactcaataacttaagaattatttataatttatattttcaaggtttgacttaaatattatcctaaatgactttctttataaatatgaagagagtatgtgttaatgggtcacccgttttacgtgccgctatcatctcagttatagctgacaggttgtgaaaatacgaaaccagagatactactgtttagtgaaagtggctaaaacttagtcctgtgggtgtgtgctgtgtgtataaatggtcaaatacggtgggtgtacactaacacttagccaaacatggtggcatcgctgcagttaagagtgttgctcgatggaaggaaaaacaagcattctactggtccattgccgttgataagacgcataacggccttccattgccgttgataagacgcataacggcctgctatctctgtacaaaagaaaaagaatttaatcttacatatgaatctgtagaagtgattatccagatttatttttattttagacgaagggaatacgtgactcaactgtgtggttttcttctgataggagaggagagaaatgaaattggacaaaagggtgaaacacatttataacatcaacacagagaaggacaaagtgcatcttgtgtgaaatacactcgtctaacactaaaacgggatcggttatctctgatgggcttaaagccttatctctttcgggtagagccccgtcactaagcaaaggtcactgatatgagaaaatatcttaatcggacatccgcccgtctcggatgacacacatctcaaccgggccaacacaaaaacccgtcacggatgactctcagctcaatcggacctaaattttagggcatgccaaattatagcccatcacagagagtataataatttttttttttgctttttggctagactcagaccttgcacactttgtccttactcgtgtccactccccggtcggtcacccatcccgaaattgctccaagccaagtacgctaaaccttaaaattctatggagatcggcttccggaaaagaaattgtaagttgttggtattagtattctattaatcctattaagccctgggctaggatatcacaccccaacatcccccattcatatacattcattcacatacacaaccattaatatatttaacacaaccacattcacataacatccattttgatcacatattttacatatttcaccgcaaaaccgagttaaatggatcaaatatatatttagcaagtattaacaagaagaggaagcaaatcagatttctaggcaaaaatagatttcgaattaaattttatgatactaaatgaactcatatgaaaaaactgtcaaaaacaatcttctagaactcattgagatctaccaattttattttggtcatttttccatccatgtttgatcgaactatataaaatttgaattttaaaatataagaaattcaaataatttttcgggtagtaaatgatttcaaatggaaaaattgtcaacaacaaagttgtataactcatcaagatctataacttttatttttgtcatttttctatataatattttttgaatagtttgaatttgaattttgaaaatatgacaacttcaaacaatattttcaaataatagatgatttcaactaaaaaagtcatcaacaacaaagttgtataacttatcaagatctataacttttattttggatattttttctatataacat

SEQ ID NO: 38941 - DNA, 1514 bp, Oryza sativa
gtgcctggagcgaaatttgatcgacaaggatcagccgctgatttcaaaggttttttcttttcttatttgaggaagataaggactacatttaacttgtaaaccgttggtagaaacaatgactatacatactcttgccaaccatagatggaaatatttgtctttaaagtggtatactatgtagttttcttatttttaatcgagctgtaattttgtaatttgcactcatttgtcctgcaacctccgtaataactggttgtagtttttctttaagcaaaagccggaatgaatttcattataaaaaaaaactacttcaagggtcactgatcttgccgatgcaaaaaaaaaaatgttcctatgatcaatcgatgagtaaataagtaaataagaacaacataaaaacaatctgaattagaaatacgaaaaaacacatacgataagttaggttccaaagatgggaaaacaactatctaactgttcacagcttcatacattaaattagcaataataatgatttaaaaacccaagacaccctgaagtaatacatagctattggaagaggtgggatgatatccaagacgtccctgctacctaggaacatcctccatcagaacatggtctcactttggccatggtcacagatgaagttgcaagaccaaacaaccattaaggtcacgtggcatcttgtttgttaaattgctgacacctcgatctaaatattaatacaaagtcgaatccgttggaaagtggacaacacacctaccgcactgtaaccataccatgtcagtgtttataaacaattggacaaaattttacctctgcattgcactgaccattacagataaaaggttatctattaacttttttttttgagtagtgaatacaccacagttattcaccatttacaaattattaggagcaaacttttgttaccaggaaagattcaggataagtaattccattgtttgcaataactcacatcgacacaaaattacaaaattatgtaaaaaaaaggagttacaatatcgtcatttcaaaccaatatagatggcccatagattttctacattaaattcacctcacctggagagaaacttcagtgatctctttttgcctactcaactcagggttgctagaccatgcgtagctgctagtggtgttgctgctgtacccaccacccctaagctgccactcagtgatgtagcttggcttggtgaccaccttagccacatcgacatctccagtcaacattgtcacgaccttcgacattggcggtcgctggtgcggagagccctgagtgcagacaagtgcaacatatatgactctaaaagcttcatccttgtcaaattccttgagacttgggtcaacaattccaagtgcttgatccatttcatacaggccccatgccttttgataaacatagtttgagtaagcaaaaggcaatttacaatgaattgaagttttctagtatgggaagaacatagaccagcatacccattcaaggagacagatcttgc

SEQ ID NO: 38942 - DNA, 2902 bp, Oryza sativa
taaaccaacaagggtgttttactatcaatgcagcatccatgcaatatcacaagatttcgatgttgcacagcggaaattgtcgcaacctctgtcacaaactggcttgttccctgatgagatgattgtgaaagttgcttcacagctataactctttcatcaggtagcttaccctgccaaggtttttacatgtgtattttgagcatagacaaatgttgctaaaacacagcacttcaatgccaaatcagataaatttataaccagctgcagttgtacataattaattatggaaataaagaaccttatacactggcccgaatccaccttcgcctagaatattttgagaactgaaattgtctgtggctagctttagctcagcataactaaaaacgtcaggtcgtccaaccaggttgtatagttctgcatgttatttttagcacagatgagaagagtaaaccagataattttgatgtttgaattatatatgtcctgatatataataccttctttctgttgtgccaatgctctccgcttctttactagtgtaaacactccaaataatgctgctaatactaaaactattgcaccaatcaatattccggaaattgcacctgctttacttttcctttttggtatgccgtttcgaacggtaggagtaaaatctgcaaaggaaaaatattatttatcggcagcgaatataacacttcctgctgttgttttagtgtggtgcttacttggagtgacgctcaatgctgagatcattggcccatagtaattatctttagtaggtatgtcaacagtgcccttgccagcccagaatagatggatctcaaggaagtttttagacacagttaccatgaaactcctattaactacggtaaaagattttccacctgctgttttccttatatcgaaatccttttgttttagagcaccctatgtaaatatcagtaatacttttagataaatattggtaagattcagtagaaaaacattatataaaatgcacaaaatttctacctggatatatatgtcaaaaactcttctccctaagcttagccaagtctgtgagtctggaaaagctaattctgcgaattggagcaaaacagtgtaatttccattctcaagtccaagtccatagtacctcagagatgatgatgacatccttgcagtttcaaacaactctgaatcaactacattttgaaaaggttgggagctatatataatattctttgcatctatggcgttccctacactactgacaccccatcttgtttgaccggtaacataatatgttgcagctccaagatttgtaggatctgcttcataaatagtgtcatctgagcctcttatggatgcattactgccacagtcaactgcgaaggaataatctgcaattaagattaaaaaaattgtagccatcattcaaattcgtaagttcatgttactgtttagttttatgaagaatgagaaatatacattctggagatccacggaaacaaggggtgtcttgttggaggcagtttattccccaaggtagcgtactgtgcacaatttgaattgaaaatttaaagttaccagcaagattttcatatagttcactcgccaaattagaactaaatgtcacaagtacctttcactggtggtatcgagtaagaagttgtttgccaccaaattcctttcaaaaaacagaatattagtatttatattttttctcagcgacacaaatatcacacttttacacttacaactgtaaattgttttgtctagcccaagaaggaatgctcccagtgagttggttgtacgaaaaatctctgtcaacattccagaattatgttatacaaaattagtgcgtactattatgaatgtagtttgtgctatactgccatgtcaattgtatttgacatacatcacttttaatgaagagcttataccatccggcaactttcctgtaaggctattgttcccaagaaacctgaattgggcacagttcaagattataaaatatactcatctgcttaatacaggctcgtatgaacaaattgatgtaaagaaagaatttcttacaaagaattgagatttcccaaattcaagatggattgaggaacttctcctgtgatattgttaaaactcaagtccctgtgccacatgactatcatattacttgaacatatggtacacaacatgaggaaatgagtaataacgtcatcagttggcaccatggcctgtaattgaaaacttacagcaattttaactgtttaaacatggaaaattctactgctccgagatcactagatatcttgcagttcctcaatattctgtaacgaggaaatacaaccttggtaacttgcaactagacaatactgtaagctttatagctaaaagcatcacatacagtgtgctcagggatgccatattactgataaatgccaacggagagaccccatttataatatctccaatccatctgctcatttgagtttttcataaattagttatcagccttgacattgtcaaccttcaagagttcatgccacaaaaagagtatacttacaatcttgttaatttggtcagattagacagactttctgggactggtccttcaaaggagtttccgtggaaagcactacaagctcattattttagaaaaaaagttagggacattcaacctttataaagtaagaaaaaaaatctctgtgtgagcattcttaataagatctctaggtatgaacatgccatgtggaccgcttactgtgatgcacatatctgcatttatattgagtgaggactgaaatgtgaaaaaatgcttttgtttaagtctgaatggagataatgtgatatacagacagtaatttatcttgcacagattcatctatctctgaacagtaagaacgaatgatatctt

SEQ ID NO: 38943 - DNA, 10107 bp, Oryza sativa
ccacgccctacacccgattgatacgacgagctatgtggatctctcaggccttcgtgtgcgacaaatttcacgtcaacatgttgccacgtggttccatctaaaccctagattgaatcggtttgagccgtcagatcttggttaactcttggttaactcttggtcaagatcaatctcggttgtccatctcagtgaacatgtggtcaatctctgtggacctactctacggtggactgattgctgatgacatcataatttatctttttcttctttaaaataattataaattatgtaataaatctatttaatccttttaaataggctttagttgaattaaatcttgtaaaattcattactaattcatatgaagtcgaaatgaggcagttcataattcatctaaaataaagctctaaatgtttgtttactttttatgtattgtttatttggtttttattagtcttttttctcgttttgcatgttagcttgtagtttccatcctttttatatattgtttaattgattattgtaaggcatgtcacacatgtcccaaacaatccctttgagcatgttgataaaatatttaaattcttcttttattttaaatgtgcatttaatttcgaatgtcattaggtggtgggaacctttcctttgaatagctagtttgtattgataatcctgttccttgatatcttgggatataatttgactagcttgagccatatatattggttcgactagatattagtgtaattgcttagccatgctaagaaacattagtatcattttacatgcaataactaatgattcactcatgattaatgatggttaattaatggtatgttgtgatgtttggtcatggttgattaataatatgctaactaaaacttgactaatggtaggttttgagcacatggatgtgatgatcatgctcatcacaattaaggaccggttttgtatagcatgattcatcatggagcaccacactaagaagtggtagagataggcccatgtgggtcactgcggagtctattccgggctatggaaagacgatgatccgggaacggtgaactactttgagttgagctatgcgaagagtcacaattttgcacgtggtgacatattaagcgtgggcacacgataacatggtgacatgttgtggaattgtcttgtgggtatattggtacacatctgactagagtaaaacttttcaaatagccatacatgcggttattggcaagcctagcaatgtttttttggtgattagtcacacactactcattaatcataaataaattggtcataacaatttgtttgcattttgtatggactttagatctgtgtagtcgggtttggttgtttagagatggttgggcctacgcagcataggtatgctattcagagttgattttaaattgattaattactctcaactatttactgaatgttgcttttgcaaatgaaccctactataccttcctttgtatccccatgcacctgcattttttctatgtggcttacggagtattctatttactcaccttgcaataatcatcaaatctcagttgaagaaagttttcgaaggagaagacatgtggcttatacctcagttgaactgtctgtgagagtggagctgaagctaatgttagattgtttgttacctgttgttttcttttcatttataagtaatatctaacgtaattataatattggatctgtatattcaattgtcaattttagtatctcagctaattagtagatgagtgtattatatgcacaacttagttcggaaattactagtgaatttccgaatgtgacaggtagcaagataaattaagaagagaagtcttcgataccgtacaggtccactagatgggtgagattctgtagctccgcaggtatttgaccaactacatccaaataagttaccctcctacataacaaacaagtaataattctgataagagaactatgttcaggatacatatatacagccggaggaccaaatgaatacctccgtttgggtccagcagatatgtacaatttttctttagggaagatctgtaccaaatttaggatagacttttctgattcctctatatgcagccttggagatactaattaatatcaataatctggtgtgtgtctatatatatatacacatatatatgtatgtatgtgtgtgtgtgtctatatatatatatatatatcttaatttgcatacttgcatatacgtgtatatgggctagcacacacgatgaaaccacgataaagataaagagagtgtgcgtacagtctcgtaatgtggcagagggtgttgttgttaatgtgcaatcgcacttgatgaacgggttgatgtcgcggtagttatcccaatcggttttatcagctgcgaaaccgctgcagagctcaccgctgatgttccactccggtgatgccttcttgccccatctccctagtatcgtgttcagagcagccgctgcatggttaatttattaactcaccattagtaatcatgcggatgaaagctacgcaatagtgaaatcagacttcatgaaactcacgggttgctgcgtaagttttatacagtaataatagaaataacatataatcagtaggcataacattatataatttcatctttatcgactgcagaaaaaaaactatatacaattaggatgttatttataataatttaaactagattggccatttaaaatcacaacaatagtgatgtggctaagtacatcatcttaaatataaaacaaaggtgatacggcttaataacaaaagaaaacgtgagagataatttgaacaatatacctatctcaactatcatagggataaagaaacaatttagatgatgtggcttaataagaaaagatataaatagcattaataaccactgtagaaatgaactttatataaatatataggatttctctaactctttggtttcaacgcggcaagagcggacacactatcaaagttattatcaaccacaaattagtactcctgcgatcaaagtacatggagggaaaccaaacaagagagacatgcatgcgtggaagcctgccaatggtttgaaatccaatccacaaccagcccaaaccaaagcagtaagctacacaagtccaaaccactctaattcatttgtcttctcttagaatccaaaccaatccaacccatatcatatttcaacccaaatcaacccaacccatttcatctatatggattcagttcacttttccagtccatttcaccccattccaaatcgacaccaaccacatgtcggcgacgaggtgggcgaggagcatcggcggcgagccgaggaagtcgcagcgcgactccgagcaggagcagggcgcgtgcgggcaggcgcgctggtggccggcgacgtcgtaataggcgacgtagctccagcagccgaacaggtcgttggggcacaggatcttggcggcgccgccgcacgcgtggcactgcttgccgggacgtcgccatggcagctgctgcacgccaagtgccccgccgcggactgcacgccaagaaattgccactagccgagccctcacgaatcgaatgaaagaacaacaacaagaagaagaatgtcagatggattggatgaacagctaggaaggaggcagatagggcaacggagcacggccaagtcgatccgcttttcttcttcttctccggctccggctgcagctccctcgccgcgcgccgcttccaccgccttttctcgcttcacttggccgttgggcgacaccacccacgccgccttcttggcgccgctctgctcgtcgtgctgcctgtacgccgcactgttcgcgctcaacttggccacgtggttcggcgacggcgtggacggcgagctcgtcggcgccatgcgcgccgtgcagcaggagttccctccgcttcctcccccgcgcccgcgtcttctccaccttccagaaggcggcgggcggcggcggcggaagctctccgacggcgaacctagtgcggcggccggacatccaaacgcggctgcgcggcgaggtcgaggcggccgagggcggtggtgatggagtgcctctgtgtctgagacgacatcatctgctatttggggatgaatccaattgaaatccatggactccatccattttagacccaaaaattatgactaaaaaccaatccaatccaacccaaccatccctcatccaagctgctccaatccattagttatctcaacccgtttacacccataccaagtgaatccaaattgaaaaccaatccattagacccattccaatccaacccattggcaggctacatatacgtacgcgtgcattcttaattaccttcgactggatcagtttttggtgcttgttgatcctgagcagctgcaacccgccatgagcacaaaattagcaccagccacgccagatggtggcgaatgacacctctgatgctgcaagaacgcatatctctccctctctctctctctatctaaacaacactgtgtgcatgccaaagagatgtatatctgtaggtatatatgtacgtgccactaaacattaaaaaattggtcaaatgtgtactcagcttcaacaacgaccctcgtgctttggttaatcttatccgtcatggttgataacgatatggattactctatccgtcccaaaaaactcaacttatagagtttaaatttatccaaaaaaaaaatcaacttctaccactttacctacctcctctagcatataaaatgagaagttttatctcttaaatatcatttacctacttatcaccattactacctttactactattgatgagggttatttttgtcatttttactcctcactaaatttgttttgggatgctaggaatctcactaaatttattttgggatgctaggaatcctcttttagcaagcaagtgttttggtcaaattaaagatgacattaacaagagcatgaggatgaccaactagtgtatgcccggtgagttcttaattaaagattagttatttttcatatatatctaaattcaagaaaacagcttgaaaaattctttttagtttttgcactttgcgtccttttattcagttttacttcgttaaagttttgtcccatatgagtacttgtttaatgctatcttaggttacgttcagcgacaatacacagagagaaaaattaccttctctttcaaaagcatacgcttaccgaaatactagacaatatttttttacaaaagaaattacaaaaagttgtatttttaatttttaagtttaaaataattaatattaattatcttattttgtgagtatgttttaatttttttttctttcgtcaactctcaatcataatgttaaaaaaaactctcaactagtatgttttaaagttttatggtgttagtcgtgtcaaaaacattgacttgtccacccgccgttgttttgactgcctgccgcgggaagggaaaaacttgccgtggaaatctgatgctgccacggcatcctttgcgtcaggacggcgttccccgttcttcaattttttgtcgatcagctctgttgaatcgtatgattcatatgctagctgtgtctataggatttggtgcttgcagaatgtattcttttcaccaaagtgcatatacacacacctagttgcatacatgcaatctagatagctatataaaatttttaaaattttcacaaaacgagtcctcctggtagatatgtgagcgtttgcacgattgtgttgtgtgtgcgttagacttgtactgacaaaaaaaaagaaatattaaattgataagatagatcatgaagatgtaaattactaaacaaatagatctaaacttagtctatactcactactgcagaaaaacccatagaggtgcacccttttttatttttataggtgctaaaaaaacatgaaaaaatatttggtatttttattacttccctataacgtcacacttcgcttcccacatatcacatgatttttgcaacccatattcatagacatgcttctaaagattcttaccatgctattgttttgtgattattgttatccaaatttataatgctcaactgaaaattttagcgactacaaaattgtagacgtcatctatacctacaacgttcatatatgttttgtctccatccgagatcatttagaaattttaaatattcacttatgtaaatagatctgaaacattataacacattttcggacatcagaaaaacattaaataaaaaattcatcacctacaaagttatatgtctcgtcaactacaaatttgatataaagtttatcttcatccaactttatatgaaaatgttagatagaaaatattgtgtcattattggtgccgattttagttgtaaaccaacatctatgagctcataagtactagtttttattaagaatcaacacatatatgatgcctataagtatagtttttattaagaaccaacacatatatgatgcctataagtaacggttcatgataaaaaccagtacatatgcttatagaggtgccattttattataagaatcatcgacacctatgtgttgtttataggtatgtaccagtttgttatagcctgatagaaaccgacacctatgatttgatagattattggtgctgacttttgttacaaaccaataccaataagtgattataagtaccggttcttaattttatactggaaaaaggtggagaaagcttcataggcgccagttttaggcaaaccgtcatatgtaagtccagtctttatgtgctgttttataatagtggctggataaatataaatagctagcaaactgtattgatgtgcacttattcatagttgtagcattttattattttagaatgttcaggcatatggctgtgttcgttgggtaggttgggaactcattccctccacacggaaaacggagcggtccactagcgtgtgattaattaagtattagctatttttttaaaataaatagatcaatatgattttttaaacaacattcatatagaagcttttttcaaaaaaaacacaccgtttagcagtttgaaaaatgtgcacgtggaacacaaggaagaggggttaggaaccctgaggaaataacacagcctatagaatacatgagaaagtccagagcaagtaaccagctaaactattaaaaacaattaactttactccctaatggcatttgtatgtttttttctccttaggcactaaaatttaggactatcatatatgtattacaacttatatcttaatattctcaatatttttttagatttttttatagttatttacataggttagaagcatttaagactgaatcaaatatcaagatctcaaagttaagcaaacacttctgaaaatattgaaaatattttcgaactttgataatggtgtatctatggctataaaaagtgcaacttaaaatatagagcttatataaagaagaaaaaaaaggtgaaatgtcacccgagtaccattttcaatatgctttatggagtcaaatgagtaaagaaaaggtttaggggttgatctaatgaaatagtttgagagattaaaaatttagtcttgaatgtttctatatataattaatctaaacttattattataccacaatcagtattactattttgcaaactttacgcaacttatttgttaggtgcacgcctgggtggagcacctatgctgtgatgtcacgcccataaattcacaagtaatttccaaactaatttgtgcattaaaaccctcgtccaggaatcagccgaggtacacaaactgacaatttaatatacaaattcatcaaaataactaaaacgataaatacttacataagaggcacttagtcctcaccatgaagaaaactgcagcggaaagtaaaatctagcgaagcttcagctccactcccacaggcagctcaactgggatctaagccaaaggtcttctcattctggatccttttcttcaactgaggtttgatgattattgcaagaatgagcatatgacatactcaacaagccacacagcaaatatgcaagtgcacaaggataccaaaggatggcataatatagggttcatttacgaaagcagcatttagcaaagagttgagaatttgtaaaacagtagagtaattaatcatcaatattaatcaacactgaatagcacacccatactgctcaggcccaaccaaacctgaacaaccaaccccggtcgtacagatcaaacctccaaaccaggaattatccattccaaaccataagtcaaattaattatcacattattatcattaatgagtagtgtgggactaatcacgaaaaacattgttagacccgcccataaccacgggcacggctattcgaatagttttactctggccagagatgtaccactgtacccacaagacacgattccacacatgctgccatgccccgaagtaccaccacggcactgctaagggggaaatcgtgacagtacccttcacacaacacaactcaccacagtgtactatttctggatcataatcaccccctcaataaccagaggcatggactccccagcgaccccccacggacttctcgccgcttcacagtctggcacaccataatgaatcatgctatacaaaagataaagtcgttgcccacgctggcttgtggttggcatgattaatgtctcacaacagtagctcgcgaaccggtccttaattgtcatgagcacgaccttcaaaaccatgtgctcacaacccaccattaatcatattttaattatcaattaattatcataacacgtttgaccatcgtgagctaccattaactataaccataaataataatgtagtatatatgattcatcccattaatgagctaatgtttctaagcatggctaagcaattatatatatatatagcatttagctgaaccaaaccaatatataaggttcaagctaatcaatttattatccataggaaattaaagtcatctttggccataatcaaatgggaaggctcgccacccaatgacattctaaagtaatgcataagttgaaataaaacaatagctttaaatgggttcaacatgctcaaaggattgtttgggatctgtgtgacttgccttgcaaacaagcgtcttcaattcgtcttcaggaatttctccaacgaacgaacgatcctccgaaacaacggaaaactaaacctagaacgcaaaacaaggaaagaaactaataaaaaccaaataaacagtacaattaaagttcataaataggtagagcttgaatttagatgaattatgagacttgaacgacctcattccgagttcgtatgaattagatatgaattttacaagatttaattccaattaaacctattaaagaaaagactattccaaattgattaaacaatttacaaatgacttatagctgagacaaaagattaaaacatcctccggaaatagattagatcatatttggtagatgacatatattaaaaaggaataatatgccattgaaaagaaagaacggatttatatcgattttggacggctgagattaatctcgaccgagtcgaccaagatcggatggcttggattgacacacggcagcggcacaacagcggttgcggtggcacacatacagcagcagcgcgacggcgacgtacagcggctaaacagcgacacggcggcaacaaggcagctagcgcagcggcgacgctagggcagcagctagtgacacagcaacggctacgctagggttagagcaacagcggcggtgacacgaccgagggattgaaacctaacccgaggggacacggatagaagtctcaccgaaccaaagcgaccggagagggagggtcgacgatgacgatccggcgacacacacggaaacgatgacgacgctagggccaaacaacagattagattagattagattagattaaatccctagggataaactacaccggtaaatgacatgggagagaggagagctcaccggagaagacgacggcgacgaccaagacgacgacggcgacgaccaagatgacgacggcgacgggtgacggctagcggcagcggcgagctagggcagcggcggctagggtattggagaaggcggctaaacaggaggag

SEQ ID NO: 38944 - DNA, 737 bp, Oryza sativa
tcctgcacccccggcaggacatgattctatttgggtagtggttgataggttgacaaaagtcgctcacttcataccggtcaaaacaacctacacggggaataagcttgcagagttatacatggccagagtggtatgtttgcatggcgttcctaagaagatagtgtcagatagaggtactagtttacttcgaagttttggcagaaattacaagtagagatgggtacccgtttgaatttcagtaccgcttatcacccgcaaacagatggtcagacggaaagagtaaaccaaattttagaagatatgttgagagcctgtgttctagattttggtggaagttgggataagaatttgccgtacgcggaattctcatataacaacagttatcaagctagtatgcaaatggctccgtatgaagcattatatggccgaaagtgccgtacgccgctcctttgggatcaaaccggtgaacgtcaagtttttgggacggacatattgcgagaggcagaagaaaaagtgaagattatccaagaaaggttgcgcgttgctcagtcacgtcagaagagctatgccgacaatcgtcgcagagatttggctttcgaagaaggagattatgtataccttcgggttacgccgttacgaggtgttcatcgtttccagaccaagagaaattggcaccgcgtttcgtgggaccttttaagattgtgagtcgaagaggtgaggtagcttatcagttggaa

SEQ ID NO: 38945 - DNA, 12399 bp, Oryza sativa
tcatttgctggatggcatcgattttctcgggattcgcctcgatgcccctttcggaaacaaggaaacccaacaacttgcctgcgcggacgccgaatacgcacttctccggattcagctttatgcctgccgcgcgcaagctgtcgaacgtctcttgcaggtcgaacacatggtcgaaagccttgcggctttttacgacgatgtcgtcgacgtaagcttccacgtttcgccccaactgcttgccaaggaccttgtacaccagcctggcgaaggttgctcctgcgttccttaagccgaaaggcatcctaaggtgacaaaatgtgccgaatggagtgatgaaggatgttttggggatgtcgagcgggttcatgtggatctggtggtaactggaatatgcatccaggaaactcatgagctcgcatccacgagctggtcgattcgcggcaaggggaaatcgtctttcggacatgccttgttcaggtctgtgaaatcgacacacatgcgccatttgccatttgacttccgcaccagcactggattagccaaccactccggatggtcaatctcttgaataacccccgctcggagtaatttttgtacttcggtcttcgccgcttcttggcgatcgacagacatcttgcgcaacttttgctttcttggcttaatattcggcttgactgctaagtgatgcatgatgagatccgccgggacgccccccacctcatcagggctccaggcgaagatatcgatgttctttttgagtacctctaggatgctctcaacttcttcttcgcccatgtcgccccccagtgatacgagctttgtggggtcggcatcatcaatctgcactattgttatcttgccgtgaggggtgggcttcggcgtgtgcttgggccgctcatgcggttcggcctcaacattgtgcactgctctgttgattatggctagatcgcgttttgaagcggccgaaggctgaagccccttgactactatcactcctgttgggccaggcatcttgagcttgagataattgtggtgggaaatggcttcgaacttgttcagggttgcacggccgaagatagcgttgtagttgtatgggatgtcgacgacgtcgaacggtatttgctcttcgcgcctgttttctcccgagccgaaagctatcagcaaaagtgcttggccaagaacttgcactgcctctccgccgaacccccggagcgacgttggtgccggtgcaagagcttgggttggcaagcccatcttagcatatgcttcggcgaagatcacgtcagccgaactccctccatcgaccaggattcgtcggacttcaaaaccggctatctcagctgagattactagtggatcttgatgcgggaacaggactccttcggcgtcttctggcccgaaagggatcagctggttcacgtactgtggcgccccctcacctgccgaagtgatgatgtggaccgtacggatctgcatcttcctctgccgtttcgacaactggcttggcgggtcagctcttgtaatcacttggattatcctttgttgtgtatattggcgttgttcggctgggggtatttgctcctgaactgcttcacggggtgtttcgacagttgttccttgctgcggccttgggtcttgcgcgttgccacgttgcctaatgtttcggcattgttccgtggtgtgcgaagagcgtccgtgaaaggcgcagtagaggtcttttcggaccttctgcgggctggctgctgatggttgcttgcttgctgggcgtcgaactccttgcggagggcttgcacttcttcgacagccatcacagccttgcccgcccgatctgttctgaactttctccaagtcatgggggcttggctttgccttggcggctgtccctggatcgccggctgagactggcgaacagagaggggaggtggttcggcaatttgaacttgtgcttgagcttgagcagcggcgacggaggctttatcgtactcaacttgtatagcttgtcgtcgcttagaatcctcctcgccccttgcgaacccgtcaatgatgcgaagtggtgctcgagcgtctgcggctccttgttggcgatttttcttgttagttcgccctcaagcagaccggccgaagtggcgtttataaccgacgcctcggttatgtcttgaacttggcaccaggcttgcgagaagcgacgcatgtactcccttatcgactcccccggcctttggcgaatgccaagaaggtgttgttgcgtcttcggctcctcataggtgcctcgaaagttaaggacaaaaacatcgcgcaattgctcccatgagtaaatgctattggctggtaaattgaaataccaagaacgggcgataccgtctagagcgagatgtattaccttcgccttggtattttcatcaccatgagtcgcttcgatcgttgactcgtagatggagaggaactccttcgggtcagtttcgcccgaataacgcgggacaggtgggaacttcaactggggtgggattggacgagtcttgattcccccactcagcggcagccccttttcgcctcccgccctgtttaccgcaccttgctgcgggtacggtgtggcgaagggcgaaatcgcggcttgtgcgtggagttgggccacggcattcgattgcccggctccaactggtggtacttgctgggccgctatggatgggtcaaagattggctgcgaccacatcatggcagcttggattgtgtcacgccctaaaaatcgcctaaattaaaaatacattgtttaaatcatttttagaaattaaaattaaaagcctacaagctaaaccctaattgtctaggaaaattttcaacgtaaaattgagctagataaaattttattaaatactttgcttgttcctctattttctagaattttctgggaattatttgagcaagggaagtatttttaataaatgaaacaacatttcacaaattatatttaattaaaaagttctgaaacccctccctaaagccattgggccgtttttggcccaacatccttcccctctcccgcggctgagccggcccaaaaccggtccaacccgtcgccgccgccccctcctctcgggagaccgacatgtgggccccacatgtcggatccttccccttcctctagcagccggccgagccgtgcatgacgagcccgagccgccaccttgcgccctcaaatccgccccaatccggccaccccgagtccggatattagaggggttttaatccccgtatcctcctctatctttacccgcaaaaatcggagcaaatcgttgagtatcttgtccgaatcaacctcgttttgattttatctctccaaactaacccgaagattttccggtttcgattcctctcgtttggagtccgatctcttcaatccaaggctataaataggaccccctagttcccctctttcgtttgccccttttcccgtcctctcccgtgccccgtagctcaccgccgacgccgccttgtctcgccgtcgccaccggtgatctccagccgcgccgcgccttcgatttcgccgtcgccgccgcttcctctcgccgccgttaggtgcgcacggaggtgaggaacctcggccgccctctccccgctgtcgccggtcgccggagacccgtcgccgccgtcgaccgagccgccgcgccgcctcctctcgtcgccggccaccatcggtcgtcgttggacgcattggtgagtaccgttgcgttcgtctcgtcgttctctacgtgtggatgccctccaaaatcccggccgaccactctagctccggcgaggtcaccaactcgagccggccgccattgatgacatcatgctgacgtcatcatctccttttttccaatttcttttaatagattaaatcttcggaaaatcataactaaataaccgtagatccgtttcaggtggttcaagttgctaaatttttctaaaatcaaggtctacatgttaaaaatatccacatgtactgtttatgcttgtttttgtactgttttgttgatttttgtttaattgctttagtttccgacgttccggaggagagcgtttccgttaaggaaggctccgaagcgtttgcggaagcccaaggcaagtcacacagatcccaaacaactctttgagcatgttgaacccgtttaaagctattattttattttaactatgcattgttttcgaatgtcatcgggtggtgaaccttcccaattaattaacggccgaagatgatcttattttcctatgggttataatttgattagcatgaaccttatatgttggattggttcagctaaatgctatatgtaagtttgcttagccgtgcttagaaacaatagctaactaaagggattaattataaactatgttacattattattttaattatggttacattaatggtagctcacgatggttgatcgtgtgaggttaattaattgataattaaaacctggttaaggtgggttgtgagcatatggtattgatggttgtgctcatgacaattaaggaccggttcgcgagctactgttgtgaaacttttaccgtgccaaccacaagccagcgtgggcaacggctttaccttttgtatagcatgattcattatggggtgccagactgagaagcggcgagaagtccgtgggggtcgctggggagtccatgcctctggttgtagagggggtgattatgatccaggtacggtgcactgtggtgagttgtgttatgcaaggggtattgtcacagttcctttccgaggtatcgtggtggtactaaggcgcatggtaacatgttgtgggattgtgtcttgtgggtacagtggtacacctctgatcagagtttaatctattcgaatagccgtacccgcggtaatgggtgagttgagcaatgtttttcgtgattagtcccatgttattcattaatggtaattgtgataatcaatttgactcctggttggaatggtacgttcctggtatggaggttagatttgtacaaccggggttggttgttcatatgaggttgggcctatgcaacacgggtgtgttgtatggtgttatttaatattgattaattatacaactgttttactattctcttaaatatttatttaatgctgtttctgcaaatgagctatattatgtcatcctttgttatcctgtgcacttgcatatttgctgtgtgacttgttgagtatgtcatatgctcattcttgcaatattcaatcatcagaagaggagtatctcagtgaaggtgatgatctggaggattaggcttgttctggttaagttgcctgtggagtggagtcgccatagctgttccgtagtttgttatagatttattttttttcgctgcgtagaaggatattctttgagaggaactatctacctctgtaatattttattatttgcgaatattctatagttgttcatttgtactctattatcaatttgttattgtgtgcctcggttgattcctggacgagggtttaacacacatgtaagcgtttggaattttggatagaaattccgggcgtgatgtcacgccctaaaaatcctaaatatataaactgatgtttaattggaatttttagaaattatttttaaaagcctacaaactaaaccctaattttctaggaaaattttcaacataaaaatgagctagataaaattttattaaatactatgcttgctcctctattttctagatttttctgggaattatttgagcaagggaagtatttttaataattgaaacaacatttcacaaattgtttttattttaaaaagttcaaaaatcccctcctttaagccgttgggccgaattcggcccaacactctctctctcccgcgcggcccaagccggcccagccgagccgcccgtgccctcctctcgggagaccgacatgtggggcccacatgtcggatccatctcctacctccagccggccgaagccgagcccgagccgcccttttccgcctccgattccgctccaatccgaccccgattcttccgggtttttgaggggttttgttcctctcgttctcctctatctttcccctcaagaaacggagcaatccgttgagtatcttgttcgaatcaaactcgttttcgagtttatccctaaaaccgagtttggatttttcccgagtcgattcctctcgtttggagttcgatctcttcaatccaatgctatatataggaccacatcgtcgccctctttcgtttgcccctctctcgtcctctcccgtgcaccgtagcgccgccgccgcgttgctttagctcgccgccgccgtcggccttctccagccgcgccgccgcgccgcctccgccgtcgccgccgcttgccgtcgccgccgttaggtgcgccgtggtgaggggaacctcggccgcccgtcccccttcgccgccgaccaccggagctccgccgtcgccgtcaagccgagccgccgccgccgtcctcttcgtcgccggccatcatcgttcgtcgtttgtcgttgtggtgagtaccgttgggttcgcctcgtcgtcctctacgtgtacatgccctccaaatccccggccaaggtctctatctccggcgagctcgcaaaccctagccggctgccgtggggtgacgtcatgctgacgtcatcatctccttcttttttctttttttccaattttctaatagattaaaactttggaaaatcataactaaataaccgtagatccgtttcaggtggttcaagttgctaaatttttctaaaatcaagatctacatgttaaaaatatccacatgtactgtttatgcttgtttttgtactgttttgttgatttttgtttaattgctttagtttccgacgttccggaggagagcgtttccgttgaggaaggttccgaagcgtttgcggaagctcaaggcaagtcacacagatcccaaacaaccctttgagcatgttgaacccgtttaaagctattattttatttcaactatgcattgttttcgaatgtcatcgggtggtgaacctttcccagttaattattggccgaagatgactttattttcctaggggttataatttgactagcatgaaccttatatattggtttggttcagctaaatgctatatataggtttgcttagccatgcttagaaacattagctaactaaagggattaattataaactatgttatattattattaataatgatgattatattaaatggtagctcacgatggtaaatcgtgtgatgttaattaattgataattaaaacctggttaaggtgggttgtgagcatatggttttgatggttgtgctcatgacaattaaggaccggttcgcgagctactgttgtgaaacatttatcgtgccagccacaagccagcgtgggcaacggctttatcttttgtatagcgtgattcattatagtgcgccagactgagaagtggcgagaagtccacgggggtcgctggggagtccatgccttgtttataagggggtgattatgatccaggaaaggtgcgctgtaatgggttatgttgtgcaaggggtattatcacaactcctttccgaggtaccgtggtggtattgaggcacatggtgacatgatgtggggttgtgtcttgtgggtacagtggtacacctctgatcagagtttaaactattcgaatagccgtacccgcggttatgggtgagttgagcaatgtttttcgtgattagtctcacactactcattaatggttataatgtggtaattaatttgactcctggtttggaatggataattcctggtttggaggtttaatttgttcaactggggttggttgttcaaatgtggttgggcctatgcaacatgggtgtgttgtatggtgtttatttaatactgattaattattcaactgtttttatcattctcttaaatatttattaaatgctgtttctgcaaatgagctatattatgccatccttcgttatcctgtgcacttgcatatttgctgtgtgacttgttgagtatgtcatatgctcattcttgcaatattcattcatcagaagaggagtatctcagtgaaggtgatgatctggaggattgagcttgttcttggttaagatgcctgtggagtggagtcgccatagctgttccgtagtttgttatagttttttttccgctgcgtagaatgttattttttgagaggaactatctacctctgtaatcttttgttatttgcgagtattaaatagttatttatttgtactctattatcaaattgtcattgtgtgcctcggttgattcctggacgagggtttaacacacatgtaagcgtttggaattttggatagaaattccgggcgtgacaagttggtatcagagccaccttgaccttaggataagccaaatggtaaaccttaagtagccttcaaaatatttttgaaaaaaaaatagaactgctcttctctattctcttacaaattaaataagttggcagcacatgcaaggttatgcacaaaattcatttaattcaatttcttttcttttaaaaagcaaaaagttgttcttctcaaaatgtttctttttctctttactaaatcttatggattggtcggcactgtacatctattatggtatcgatttaatcatgttggcactagtactactcatcccttttaatggtgacattgtaccgtgcttatagtaggtcttaagtattttggttttattttattcacttgttcaaactgatttgtctctgttcaaaagttaaattcaaaaagaaaaatatataaagtagctttgtatgtgtcttttcttttattttcttcctttttggtctaaatcagttaagtctagttggtgcagctaacttaaaaatatgcattaattcttcccttctatgtttctttagatgccaccccattcaccgagaaatttgatcaaggtgttagggttcgtcagggagctgaggttgatggcttttgaggtaggctatgaagttgctcccgagtatcgccaaatttcccatgaccccgacgaggagaagtgtcgtgttcgtgtgacgttggctagtgatagtgatgaccttccgtcttttaagttcgaagctggaggaagatcgtacagccatgcttgtcaagaggcagctttggtggccattggagagttgcgtcaacgctttgaagaagagttggattcatcagctttccagtatcatcctcacaagcctcatggtcaagactatggaacctatacctgtcctgacggtgaagagagtgccactctgatgcatgcggtgcatatgcttagtgctatggatgcagtaagtgtggagcgagacaaagcagctcatgacagggaaaactggaatcgaggcaagatttgcaagttggagagcaaggtgtaccgtctacaaaaggaattagctgaacttaaaggagaaacgccgccgccaacacccaagcatcgcctcactcaaagaaaaagaacctgtccgccacctcgtctccagttagcttcgaagattcgcgtgatgggtgaagctgtgcccgatcgtgctgaacctgtcatcgacatcataagtgatgaggaagaggaggaagaccctgaagaaagagagccagctactccagaggaagaagatccatcgcttcgttccgacacaaggcgggtttagtcgcttagttagatcgttgccgtagatcgctgtgttagattgcttgtttaagtttgcttgtgagtgtgtgggttttagttgttgcttacatcattggtgggatgtaacagcatgagtctctgcttatcgtcagatggtgaacacgcgcaccggaagtggaagtggaagtggaagtggagctactaacaatggaggagatcccacgctagctcagattctggcccaacaaacacaactgatcaatctgttagtgcagcaggcacagaatcagcaggcaaacaatcagaaccagaatccacccccacctccccaaaacaagctggcagatttcttacgcgtgagaccccctaccttttccagcaccaccaatccagtagaagcaggagattggctgcatgcggtggagaagaagttggatttgatccagtgtactgagcaggagaaagtttcttttgcttcgcatcaactgcatggtcctgctgctgaatggtgggatcattttcgccaaggcagggctgaaggagagcctattacgtggcaggaattcacggccgctttcaggaagacacacataccgtcgggtgttgtagctctaaagaagagagaatttagggcactcaaccagggatctcgatcggtcaccgagtacctccatgatttcaaccgtttagctcgttatgctccggaagatgttcgcaccgatgaagagcgtcaggagaaattcttggagggactgaatgatgagttgtcttatgctttgatgtctacggatttccgggatttccagcagttggtggacaaggcgattcgtcaggaagacaagtataaccggatggagcagaagaagcgcagggctgcccaattcaaggcacaacagggcagtaaccagaggccgcgtctcgttactggacctcaagttccatcgtaccctcaaggaggatcttcatcagttgtccgtccccaacgccagttctacaacaacaatactagtaatcgtggcaatgacaaccgcaacgtggttgctcgtcctgcagcaacttcagctcagaaccagcctgtcaggaaggaacagggaagcaagccagtgatatgcttcaattgcggtgatccaggacattatgctgataagtgtcctaagcctcggcgcgtgaagaacgctccagccccgaacaactccaatgttccagcaccaaaggcacgtgttaatcatgttgcagcagcagaagctcagaatgcaccagatgtggttttgggtacgttccctgttaactctatacccgcaactgtgctttttgattccggtgctacacattcctttttgtctaaaagttttacgagcaatcatgggatggaagttattagtctcgagagacctttactagttaataccccaggcaatcaagtattttcgacacagtattgtccttccgctactatagaaatagaagaagttcctttcccatcctcgcttatcttgctagaatccaaagatctagatgttatcttagggatggattggttatcttgtcacagaggagttatagattgtgccaaccgtaaggtgactttaaccagtagcaatggggaaacagtttctttctttatgtcctctcctaaatctcatggtgtgatcttaaaccaagttgctctacaagagatccccatagtacaagactacccagacgtgtttcccgaggatttgccaggcatgccacctaagagagagatagagtttcggatagacttggtacctggaaccaaccctatccataagagaccatacagaatggcagctaatgagttagttgaggtgaagagacaggtggaagatttgcttcagaaaggatacatcagacccagtacttcgccatggggagcaccagtcatctttgtggagaagaaagatcatactcagagaatgtgcgtggattatcgagcgttgaatgaggttactatcaagaataagtatcctctacccagaattgatgacctatttgatcaattggaaggtgctacagttttctccaagatagatctccgttctggatatcatcaacttcgaatccgtgaggaagatataccaaagaccgccttcacaactcggtatggtttgttcgaatgtaccgttatgtcatttggactcactaatgccccagcctttttcatgaatctgatgaacaaggtgtttatggaatatctggataagttagtcgtggtgtttattgatgacattcttatttactccaagacgaaggaagaacatgaagagcatcttcgtctagctttagagaaactacgtgaacatcagctttatgccaagttcagtaaatgtgaattttggttgtccgaagtgaagtttcttggtcatgtcatctcgtctggaggagtggcagtagatccaagcaatgtggagtcagtgttaagttggaagcaacccaagacggtttcagaaattcgtagtttccttggacttgcggggtattaccgcaggtttattgagaacttttcaaagatcgccagaccaatgactcgtctgcttcagaaggaagtgaagtacaagtggacagaggattgtgaacaaagtttccaagaactgaagaaaaggctagcgactgcgctggtgttaattttgcctgattcgaggaaaggtttccaagtgtattgtgatgcatctcgactcggtttgggttgtgtgttgatgcaagaaggaaaggtggttgcctatgcatctaggcaattacgtcctcatg

SEQ ID NO: 38946 - DNA, 7348 bp, Oryza sativa
atcattgctgatgagagttacttttctgttagcacagtctatcacacctttatgtctggctaaccagtccatccctagatgacatcaaggtctttggattctaacaagataagattggccagaaatggtactccttgaatttctattctgacagaggggctacgttgcaaagagagtgcttgattgcttggggtactaaccatcaaaggacgtctaagatcttctacttccatcccatgatttcccgcaaaactcatagataagaatgaatgtgtagcaccagaatcgaaaagcactgttgcaggaactgagttaacagaaaacgtacccaaaatcacatctggagcatcttgggcttctgcagcagcaacatgattgacacgggcctttgatgctggtgcggtagagttgctctgggcagggacaaccttcacgcgtcggggcttcggacacttgtcagcataatgtcctgggtctccacagttgaaacacaccacgggcttgctgcctggctccctcttggcaggttgttgctgtgttggagctgcaacaggacgtggagcttgattgcggatgttgttgccagcattgttgttgaaaaactgacgttgcggacgaacaacagacgaagaacctccctgtggcatagactggggtcctaaagtaagacgcggcttctgattactcccctgttgtgctttgaagtgagcaatccggcgtttcttctgctccatgcggttgtacttgtcttcctgacgaatagccttatccattaatttctggaaatcagaataatctccagtcatgagtgggtaagaaagctcatcattaagtccttccaagaacttctcctggcgctcttcatcattgcgcacatcttccggagcataacgagcaagacgattgaactcgtgcagatactccgtaacagagcgagatccctgggtgagcgacctgaactccttcttcttgagagacaccactcccgatggtatatgcgtcttccggaaagcagcggtgaattcaagccaagtaataggttcagcagtagtcctattcaggcggaagtgatcccaccattcagaggcagggccatgcaactgatgtgatgcaaatgagaccttctcctgatcagtgcactgaagcaaatccaacttcttctctatggcatgcagccaatcaccagcttcaacaggattagtggtactagagaaaacaggcggcctcacacgaagaaattctgctaacttattctgaggaggtgcatggttatttccttggttctgctgattctggagttgctgcatcatcatgttcatgagttgtgtctgttgagcaagaacttgggcaagagtgggattctctccattattgttgttattggggttgttagggccattcccattgctgcgagtgttcaccatctggcatggacagggcacaagaagagaaaccgggggaaactacttaggatagagaattactttaacttttattgatcttaactgagttttattacaaactgaagactctcacaccactaaactcaccaacttcctcacactcaaaagcaaacaaacgcatgcacttacatcccaccactgatgtaaatcacatgcgagacacacacaagcaaacttaaaacaagcaaactaacacaacgatctaagaccacgacttaacaagtcactctagttcttctgagcatcggaggtcgattgaaggctcgttcggctcgtcttcatcatcttgagttgctacccactcaatcttggaatgggtgcgcttggattcttcatcttcatcactacttatgataatgaccggaggatctgctggggcaacttctttctccaccacacgaacctttggcgccaattgatagcgagggacaaatagagctctcttccttgcggtaagacgaatcctggccttctgcggcggagcttctcccttcaatgcggctaattccttctccaaacgatccaccttgtcttcgagcttgcaaatcttaccacgattccggtcttcacgatcttgagctgctaacacagtctccgcacgactttcatccatagcccacaacatctcaaccaaatgccttgtggtagcatcattctcaattccttcagtctcaaggtaactgccacggtcacttccctgtggttgacgaggatgatagcgatactcagtgtcggccaactgatcactgtagcgatcacggagctctcctatggcgatccttgccacttcctgacatgcatggatgtagtttcttcctccagcttcgaacattactgaggggacctcttcactattgctgttcaaagtaactttgactcggcacttctcttcatgacgatcatgaggaatctgggcataaaaaggggcagtcccaaatccaatgacaaaggacatcgtacgcaactcctggacaaaaccctcaacaccaaacaagtactcaggcttgtagcgcggcatctaaagacaagtgaaaggagggagttaagacatctatccaattaacagcacaagtttttggattaatttgaataaagtttagaaatcaaaataaaccaaacctgcaggataagttgaaacagttggaaacaaggttacaagctttgtgcttttgagtaacaggttttaaaagaaataaaagaaagttataaaatcaacttgctaaatctattttattgcagcaagattaaataaaacaacattgtaaaacttttgctggtaaatgagccattggtacagtaataaatgtacggtactaataacactggaataaattttgaatgagaaccattaaaagagattatgaagtgcatgtgccattagtttggtttaattaaaagagaaagggaggagaacagttctacttttccaatatttttagaaggcttctatgggtaaccatttggcataacctagggtcaagggggctctgataccaacttgtcacgcccggaatttctatccaaaattccaaacgcttacatgtgtgtgaaccctcgtccaggaatcagccgaggcacacaataacaaattgataatagagtacaattattactctaattaataagcgtataaagtgtcattacagaggtagatagttcctctcaaacaataaatatctaagcagcggaaaaagaaataaacggcgcagacggctccactccacataccgaggtgcgagcttcccttttgtctgaaacctgtgcacacctcgcaatggcgtgacccgaaggtatacaaaatcacccactgcgaattccaggtcacggcgacggttatctgcataacttttctgccgagactgtgccacctttagattatcccgaatgattctgactttagcttcagcttctctcaggatatcagtcccgaacacttggctttctccaacttggtcccacaagagcggtgtccggcatttgcgcccgtacaacgcttcataaggtgccatttgtatgctggcttgataactgttattgtaggagaattcggcataggggagactcttatcccaggtcttcccgaaatctagtacacatgcgcggagcatatcttctaggatctgatttagatgctcggtctgtccatctgtctgcgggtgatacgcggtgctgaaatttaatcgggttcccaactcttcttggagtttcttccaaaaatgagaggtgaattggcttcccctatcagatacaattttcttgggaacgccatggagactcacgatcctagcgaagtagagctcggctagtttgttccctccataggtggtcttcacaggaataaatcgagctaccttggttaatcgatccacaactacccatatagaatcatatccaccttgggtttttggaagtccggtgatgaaatccatcccaatttcatcccatttccattctggtacttggagaggttggagaagtccggccggtcgttggtgctctgccttgacacgctggcacacatcacaaagggccacgaactctgcaatttcccgcttcatactaacccaccagtatttctccttcaagtctaagtacatctttgtactgcccgggtgaatggaataagggctctcgtgagcttcctgaagtatcagctgtttgagttctcggttatctggaacgcatacccgctttccgttccatagggttccgtgttcatcctctgtgaaaccagcggctttaccctgtttcatattcttgaggagtccatgcatgtccggatcattcttctgagccttgcggatttgatcgagcaaggtaggcttggcttctagcgcagccaagaatccgcgaccaactatgcttaggttcagggcttccatctgttgattaagttcgggtggaatgccacggacgttaagagtgttgcaatggccctttcgacttagagcgtcggcaaccacgttggccttaccaggatgatagtgaattcccacatcatagtccttgatgagttctaaccatctcctttgccgaagattcagatccgactgggtgaagatgtatttcaaactcttatgatcggtatatatttcacagcgattcccaatgagatagtgccgccagatttttagagcatgaaccaccgcggctaactccaaatcatgtgtagggtagttgccttcatgaggtcgcagctgacgtgaggcataggctaccacatgaccgtcctgcatgagcacgcaccccaatccttggcgcgaagcgtcacaatacaccaggaagtccttgcgagtatccggcaagattaacaccggcgaggaaaccagcttttccttgagagtttggaacgccttctcgcattgcgggctccacacaaatttctcttctttcttcaacaactgtgtcatgggtcgagcgattttggagaagttctcgatgaatctccggtagtatcctgccaaacctaagaaactgcggacttgagtaactgtcttgggttgcttccaatcggtgacggtggtcactgtttcggggtccacagaaactcctttagcagatatcacgtgtcctaagaatttgacttcggacagccagaactcacacttgctaagtttggcatacaattgatgttcccgcagctttcccaacaccagacggagatggtgctgatggtcttcctctgattgtgagtataccagaatgtcatcaatgaaaaccacaacaaacttatccaagtattccatgaacactttgttcattaagttcatgaagaaggcaggtgcattggttaggccgaatgacatcaccgtgaattcatacagcccgtatcgcgtggtgaatgcggtcttcggaatatcttcttcacgaatacgtaattggtgatatccggaacgaagatcaatcttggagaatacagtggcacctttaagctgatcgaacagatcatcgatccggggaagagggtacttgtttttgatggtgacttcattgagagctctgtagtcaacgcacatcctcttagtcttgtctttcttctccacaaaaatcacaggagcaccccagggggaagtactcggacgtatataccccttttctttcaactcttccaactgtttctttacttcggccagttcatttgctgccatacggtagggtcgcttgtgcagaggagtggttcctggagcaagatctatccggaactcaatctctcgcttgggcggcataccgggtagttcttccggaaacacatctccgaactccctgacgatggggatttctgacagtcctatctgatgcagttctgaactactgacagaggttgggggtgcaaagaaaacaaccggttgttccggccctcggtacagagtgacagtgcgcctcgcgcaatccactactccttggaattgagccaaccaattcatcccaaggatcacatccaagttcttggtgtctagcagaatcagatccgagggaaaaggaatcccctgaatttctatagggacggcagggctataatactttgctgtcataacccctccaggggtggtgatgagcagagggttcctaagcctttctacccccaactgatttctccccacgaatggcacagatataaaccagtgggaagctccagagtcgaacaaaatggtagcagggatggaatgaacgaggaacgtaccaacgatgacgtctggagttgtcagcacgtcctcggccgtcacgtgattcacacgaccccgaatgacatccttcccaccgttgttggagtggggaggcgcttggccttgctgacgccttggcttcgggcatttatccgcaaagtgcccgggctcgaagcagttgaagcacagacgctgctgaccttgagcgtccctgcggccttgaccagactgcacggttggcgtaggaggacggggcgcacgagtcccttgctgattctgctgctgctgcggctgtgggacgcgcaccacgaattgaggtcgcggcgcggagcgaggttgctgctgctgttgttgctgttgcgaggaggatccccctggataggggttggtgtagcggaccctttggttagcaccctgttgattgcggaaattcgccaagcggcgcttgtgcgactccagttccttgtgctttgtcgcgtcccaaaacgactctaaaatacatcctcgaaattgtgccgagaataattaaaattcatgtgaaagcctccaacaattaaaatgtgcaaatataaaagtcaaataaggcttggaggatttttgtatatttcctaaaagcctaaaatgcgtaaataaattttagtggaattttcagagcacaaataataattgagaagaaataaacaaagttaaaaaggttttataaaaagaaaaaccctaaaagaagtccttttcccccccttcctctcttgggccggcccggcccaactccctccctctctctcctctcccccgcggcccatcggcctcctccccgcgcgcgcgccgctgacgggcgggcccgcccgccaccctcgctgacgggtggggcccacctgtcatcgcctacctcgcgccgcgcccgccgccgcccgtgccctagcgccgccgccgccgccgaatccgccgcatcccgccgtccccgcgcgccataaagagggggaaatcactccccgtgattccctccctctttccccccactttcccctctctctctccctcggattcgctcggatttaatcccgcaaagttcgccggcgcatcaatggagcccgagatcgccgcgccggtttccttcctccccggccgccctctctcgctcccgtccctatataattgttccccgtgcctcactcctccgtttccgccactcgccgctcgctctttccgtcggattcgtgctcg

SEQ ID NO: 38947 - DNA, 14325 bp, Oryza sativa
aagtttctccaggggttaaaagatgagcttgaagtgcaactactcctagaggattatgaagattttgagaaacttgtggacaaagccatgcaactcgaaagtgagcataatcggatgacgaactgcaagagaaggattgtcaacatcccagtaattccatgtggtaaccaaagacagcgcactgagccacttcagatcaccggatcttctgttgtgcatcaagagttcctgccccaagaagacggacgcaatacagacaacaaccctagcaatactaatggtgatgataccaccaacaaccatggttcttgccccattagtgaccactcgaatcaagcgtgcaattttgacactgagaaagactccaattgtgatagcaactacggtaccactgatgccaatgttagcaaggatttccaaccaccaattccaactcctagtcagaacgatcgttcccagacggacaactcagcaaagaagacgttgatttgttacaactgcaaagaaccaggtcatttctccagagattgtccacagccgaagcgtaacctgcgccatcactccggccattatgcaagaagaagacaagtcactcgccttgtggtcactggagcaaacgccgtacctgtgaggcctcatgttaattctaacccatagtagaaacaatgtaccgatgttaagtaccgtccctttttgtttaagacagtgccttgtattcatgtaatatgggagaaattggtaataaaaacaagttctaagaggattctttcggaagatgcggatatgtgatcatgtgtataattgtttactgacaaaggagacctagggtctcgtgccagaggaactatattctaacctcgagctaataaccaacctgaggatggaaaagaaaatcaggtgattaaccaaagagacatttgtttggactaagagtttcagatgtgtcttttccggatcaaaggcaatgacagtcagtgtagcttttggcgaaacacttcaaggtttcactgaaaggtagcagaccaaaggacctcctcgccaccagaagcatccacaactctcggagtgaagagtacttagtgaccaaggtcaaaagatgactgatagaagatatcgaaaaagatgtttattaccaggcaaagaagtaggtcgaaaggtgattaataagagaaatcgggaaagaacacatcaagggcaaaggtgtaaaggaatacgttgaatgctaaatgatgacaagttatgacaagcatggtatcttagtaaagacgagctgatctcgacgcatgacatgaagtgggtaacttgtatgaggttgactccaaagatatgaactatgcaaagttctggaactgaagccccatcttcaagtgccgcaacccagtcgaagtcagctaaggttcaaccagggacaagtcaggtgaagagaagattccatctgcaacaggagatcgagccaagcagtccagagtgaagaagtgttgttaggcaagtttgttatagaagacggagcggaagaagtcagacaagaagagaagaccgcccaacctatcttcttgctagcctcctcgaatctcggggacgagattcttgtaaggggggtggatttgtcacgtcctgataaattcatcccgaaataaaattcattcgctaaaaggaataatagaattaattaaaattcgaaaagaaattggcaaacactaaaatacgtacaagaaaaattcgaatgtggcccggagaatttttgttaaattctccttggtctaaaacgagccctcaaattttacttgaattttcagagcgccggaaataattattaaacaacaacaacaattaacaaagtttattaaaaagaaaatctaaaaataaccctccttcctcctttgggccaagcccagcccaaaagtccttctctcctccctctctttctctccctccccttctctccctctctctcccgggcctctcttcccctcccgggcagcccactccctcctctcctcctccttctgggccgcccctccctcctctccttcccggcccatcttctctccctcccctcctcctgggccgcctcggcttcgcccggcccaagccgagccgcgctcccacccgtgccgcgcacgtgcgcgtgcgtgcgcgccgttgccgcgtgtcggccgcgcgcccgaccgcgtggggcccacgcgtcaggccgccgtcgccttcttcctcctccgcccggccacctctctctctcttcccgtggaaccctaatcccttcctccctcaaatccacgcgaatcaatgcccttctttccaaattgaataggggaaattaaaccccattgaatcctcttcaattcccccttaattcccccttgaacggcgcccccaatcgccgggaacggacgcgccaagtccggccgccttcctttgccgccggccgccattcccgtcgccgttcccgctcctcccgtggccggctctctcccccatcctataaaatgggatcctcatcccccgttctaccgttttagcctcttcccgagctctcccgtggtctctagccacctccccaccgtcgccccctctctcccacgttgccggccggcctccagccgcctctcccgcctcgccggagcgtcttccggccgcgccgtcgcctcctccagcatcgcagccgcctcctctcccacggcctaccctccgtttcgcgcggtgaccgccggaggcgcgttcccgccgtcgccctcccctttccctcgcgccggccacctccagccgccttcctctcctcgcccgagcgccgcccggccgcgccgtcttctccctcggcctcgcagctgccccctctccctcggtcagccctccgtttcgcggggaaatcaccggagacgcgccctcgccggcgtccagtggcgtcgccaccacttctccgcctccggccgcctctgccacgtccccggagcgccggccgacgtcgccaccaccttcctcggctccacgacgccgctctcatccccggcatcacctcctcctcgcccgaacttcgccggaacgccgtcgtctccgcgccggcctctccttcctcctcgtcggctcgtcgccccgctgcaccaccaccttcaccaacgtcgcagcggcgtgttccacgctgtcccctcctcctctcagccgctgctgcctgccatcatcgtcgtctccgatcgttctcgccgtcgacgtcccgtcggtcgcccggctcgtcgtctcgcggcgccgcctccgtcatcgtcatcgtagcggcgtgttccacgccatcctcaccgccgtgcagccgctgctggctgccctcgtagcctcctcgccggccccggtcgtcgtcgtcctcgtcctctcgtcgttcccgatcgtcggggcgttcgtccctccgtcaagccgttctcgttcgtcgtcctcgcttcgtcaaggtcgctgcagcccccgtcatcgtcttcgtcctcgcctccgcgtcgtcaagcctcgcgccggccgcgtctcgccttcgtccaaggatcgccgccgaagccgtcccctcgccgttcgcctccgttgtgcccgtctgtctccgccgcgcccgttcgtcgttgtcgttcccgcgcctcgtcgcgtggtggtaaggttccctctccctcgctgccctgtcctcgtcctttcggtgtcgcccatgcccgttgtgcggttgtcggccccggtacccgtgtatcggcgtcggcagtcgttcgcgtgtgcgggtggtgaccgtgtggtgtctagtggagtccgtttgtcggccactcgcttcggttgacacacggggtccgcttccgtcgacccgtggaccgtctctgtgtactcggtctgccgcggtcctttaggttgacatgtggggtccgcatgtcaacggcgcagccttcctgtcttttccaggctagcgcttacacctgttttatagttgcaaaacttgattataataatccgcaaatctccatataacagcattaaacttcggatgatcatatctcggtcatacgaactctgaatcgacccgttcaagtctcctaatgtttgttataacctaaagaaccctgtgctttctttttatgtattgttattgcttctttataggcttgtagctttgcttgtgtgcttcgcgtagctttcgtcgttccggaggttcccgaagcgtggttcgtggtcgtcgccgaaggttcggaaggccgttctctctgagcaaggcaagtcacatcatccttgagcatattgaatcccagtttataaaattattttgatttaaattaatgcattatcgctttatttaaattcccgcgttatcactgttttatttagccaagcctatttacctttgttatgacattattattgctattgttattattattaccttgttcaccctagattaaacaaaacctcaactagtgggtactctattcatggttccactagtataaatttaggtagatgcttcgctgaataattaggcaacattaggtggttttataactttagactttgggagttctcatatcatttggacactatggaattgttgaattatggtggaattggacacacacctctcttcctctttcaaaacccctaaaacctgttttcggtggggtttgggtgcatgccagttgtgggaagtagcaccccggccactataaggactaaagctcgggcctctgttgcaaagcactaccgtacttccacatgtctaatgggtaaggcttagtttgtggctcagtctagtcataaacaaaagtacacggattggagatggatgaagtcgggcgtcgatggacattctccagggcaaatgaaggctacacgagctgcggcccggtagtcgagatgtcatacggcggagggttggtgcccaatgctaggggctcagttctgcctgcctgtcccgggtatcccggccgtaggtaggattgggtcggtactcttgtctaaggctaggatgggttggaaactatgtcacatctttacgacgggttccaaggccatggaatgcggagtaaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctgggacccagggtcgggttgccagttcggtctgaatcatcgtaggccttgggttaaggcaggttcgtgagggttcacggccttgtttaataatactgtgtagttctatgatcgtctttacaaaatggctttgggcaactaagtgacttttaaatgctgtttactgcaaaccttaatccctatattattattcccttgtacctcccttgcattaattatgcatctgccggtgtggcttgctgagtactgtggttgtactcattcttgctcaatctttcccccccttcagtaagagaagctttggagaagatgtcttaggtggagtcctggcttataccccagttgagcgcctgtgaagatggagccgtaggccgctagtccgctgctgtttatttttgcttgtcaggcctgaagtgcctttgtaataatgtaaatattatcgatataataaagatgtgtcttctatatcatgtttgtgtggtgtaccccggcttttcctgggacggggattaatacactggcgttcgggaaaaggcaattttcccggtcgcgacaagctggtatcagagccatctcgactgtaggataagccaagtggataaaacccaaggacatattttataaataaaaattatttgcgaaagttcctttttctccttcccctaatgctatttgcaaaaggtttactccgttcttccttcttcggattttcaactagtactagatggtcagctttgcgaggaagaagatgtcgtcagttgtttgccgaagctccggaagactgcaggatccgctagcgaagcgaaggaagcaatgaagccagctgtgaaggagtgaagatcttgggaacccgtcgcagaacctaagccaccctatagggtagtgttgttagtcgtgtgttccttgcttgtgtgtgtagcgcgtggtttgcatcggtgggtggtgatgtaaccatgctaggttgtttgcttaatcaacttgcagaataagtgaaacaaacaacacatcaacaaaaagagttagttcctttaaggtcttgtccctagttctggtctattctttccttgtatgcttcccctctcaacccctaccttgtgacagatggataatactggtaacaaaggctatgggaatgatggatccgatgacgcaagaacccaagccaatgggaatgagagaagcaccaacgaaacctcaccagagctaatccaagttgtggttaaccaaaccaacatgttggcaacagcctttcaactattacagaattggagcagcccagcagggacaaccaacgttcaagtgcctacagtccggcaacagtgcaagttatcagaatttctcaaaactgagcctccaacctttgccattgccgtcgatcctatggaagccagtgattggttgcgcacaatcgagaagaagctagggttgattcagtgcaccgaccaggagcgggttggcttcgcaactcatcagttggttggaacggctccaccagacgcggcgacgcttggggcggcagacctctccctgggcgatcttgagctgatgcagctgcgcctccaccgcgtctaggtccttcttgagctgcaggttctcctgacgcagctccaggatcttcatgttgttctcgaccatcccacggcgtaccatctggtggaagtcgatacgagccgcgtcgtacgcctccaccatgcgcgccaggtgcacgatggtagcgtcatcctccgagctagcatcccggaaggtggcgtagtcgcgggctcctccgcgacgagggtggtagcggtagggcgagtgctgcaactcgtccgggtagcgctggtgaagagtgccgatagcgaggagagcggcgttctggcaagcggcggggaaggaatctccacccgcggtgactgccagcgaagtccgctcgggagagccagacaggatcactgcagtgacctcccaaccagcgtggggctctgcatcgtcaccctcctgctccggaagcggcctggcctggtagtccactccatgtggataccccaagaccacgcacatgccccgcagctccaagacgaagccagtcatgtccaaaccacgacgggtgacgctgctggccatctacaaacaaaaacaaaaagaaaaacaacattttaaaggtcagattttggcgataaatgaagcagcaagacagagagagactagacagttttcacaaataacaaaagatttttatttttgaaaatattgctaaggcttgggatctacggctcgtcctagggtcaacggtggctctgataccaacttgtcacgaccggaaataacccaacgggcgttcctgacgtgcgtgcattaatccttgtcccaggaggcaaggtacaccaaaagttgatacaattcagagtttaacaagcggaagcgtaaatagttaacttattacatgggcagcgaaggcccagcacacacagagacaaacgagaaacagcggaagactagggcgacgaccacaggcgcttgacggcaggcacgagctagacaccaaagccttcatcttcaaggagctcctcttctgggcttgggaaaaattgagcaagactgagtacaaccaccgtactcaacaagacacacccacaaatgcagaataaatgcaagggagtacaaaggaattatactataaaggggttagggttgcagtaaacagcatttaaagacgtttagttgctcaaagctattttgtaaacgcgatcctagaactatacaatattaattatcaaggccgtgaacccacacgaacctgccttaacccaaggcctatgatgattcagaccgaactggcaacccgaccctgggtcccagctcgtcccaagccaacccaggccaaccattccacattttagttgttaagcaggttttaagaattgaaacgctaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagctgtgacatagtttccaacccatcctagccatagacaagagtaccgacccaatcccacctacggccggaacccccgggacaggcaggcaggactgagcccctagcagcaggacaccggccctgtgccatgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagaaggagcggtgtgaagccaattccacaataaccaaaccattccatagtatccagatgatatgaatatttcccaaagtctatagttgaaaaaccacctaatgttacctaattaaattgcgaagcatctacctaaaactaaactagtggtgccatgagtagagtgtccactagttgaggttttgtttattctagggtgaacaaggtaataataacaataacaataataataaggtcataacaaaggtaaataggcatggctaaataaaacagtgataacgcgggaatttaaataaagcgataatgcaataatttaaatcaacataattttataaactgggattcaatatgttcaaagatgatgtgacttgccttgctcgctttcccaaacgtcggcttcaacttccacgaagagcggatcttccgaagctgcagcgtctacacgaccaacggaaaagaaaaggcttttactctaataaactccatataacagcagaaacaaagcataaaaatgggttcttggcttcataaggaaaaattagagacttgaacggtccaattccgagttcaaatggccaagttatggccatttgaagtttatatgctctttaaatggatatttgcgaatttcttcatttaaattttaattaaaaatcggatttattgcgtcagccgagggagagggcgcgcggaccgggtccacgggagtggggcccacgcgtcagcctctcggtccatggtggaccgggcgcacgcggctgacgccggccggcgtcgtgggtcccacgcgtcagccgcacccgcgggcgcgggcggctgacggccgggccccacctggcagccgcgggacgcgcccgaaggcggccttgccggcacggccgacgggaggcggcgcgcccgcgccccgatggtcgccggcggcgacctccggcgcgacggagcggcggccgagagaggggagggaagggggaagtgaaacggcggtccttggctcaccccgggtcgacggcggtgacggaaacggcgaccgaagcggcgagaggcggcggcgcggctcgggttgacgaggacggcggtgctccgacggtcggcgggcgaaacggaggagtggacgaggtcgacgaggacgcggcgaagccgaaggaggtgacgccgagacgggaggaggtccggggcgactacggcggcgaaccggagctcggcggcgacggcgaagagaaaggacgacggcgcgggctcgattccgatggggagagaaagcggcgagcggcggaaacggaggagagaggctcggggagcgattatatagcgtcgggagggggagagacggccggaggggaaggaatcggcccggaaatctcggccgccattgatgcaccggcgaagatcgcgggagtgaatccggacgaatccgagggagagagagaggggaaagtggggggaaagagggagggaatcacggggagtgatttccccctctttatggcgcgcggggacggcgggatgcggcggattcggcggcggcggcggcgctagggcacgggcgggcggcgggcgcggcgcgaggtaggggatgacgggtgggccccacccgtcagcgagggtggcgggcgggcccgcccgtcagcggcgcgcgcgcggggaggaggccgatgggccgcgggggagaggagagagagggagggagttgggccgagccggcccaagagaggaaggggggggggggaaaaggacttttagggatttttctttttataaaacccttttaactttgtttatttcttctcaattattatttgtgctctgaaaatttcactaaaatttatttacgcattttaggcttttaggaaatacacaaaaatcctccaagccttatttgacttttatatttgcacattttaattgttggaggctttcacacgaattttaattattctcggcacaatttcgaggatgtattttagagtcgttttaggacgcgacagggtcccagctcgtcccaagccaacccaggccaaccattccacattttagttgttaagcaggttttaagaatttaaaacactaacttgggtacattgctaggcttgcccataaccgagggcgcggctattcgaataggttatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccaacctacggccggaacctccgggacaggtaggcaggattgagcccctagcagcaggacactagccctgtgccatgacatctcgactaccgggccgcagctcgtgtagccttcatttgtcctagagatgtccatcgacccccgacttcatccatctccatccgtgtacttttgtttataaccagactgagccacaaactaagccttacccactagacatgtggaagtacggtagtgctttgcaacagaggcccgagcttaatccttatattggccggggtgctacttcccacaactggcatgcacccaaaccccaccggaaaacaggttttaggggttttgaaagaggaagagaggggtatgtccaattccaccataatccaacaattccataatgtccaaatgatatgagatttcccaaagtctaaagttataaaaccacctaatgttgcctaattaaacagcgaagcatctacctaaattcatactagtggaaccatgaatagagtgtccactagttggggttttgtttattctagggtgaacaaggtaataataacaatagcaataataatgtcttaacaaaggtaaataggcatggctaaataaaacagtgataacgcgggaatttatataaagcgataatgcattaatttaaatcaaaataattttataaactgggattcaatatgctcaaggatgatgtgacttgccttgctcagagagaacggccttccgaacctttggcgacgaccgcgaaccacgcttctggaacctccggaacgacagaagctacgcgaagcacacaagcaaagctacaagcctataaagaaacaataacaatacataaaaagaaagcatacggttctttaggttataacaaacattaggagacttgaacgggtcgattcagagctcgtatgaccaagatatgatcatccaaagtttaatgctgttatatggagatttgcggattattataattaaactttgcaactataaaacatgtgtaagcgctagcctggaaagacaggaaggctgcgccgttgacatgcggacctcacatgtcaacaaaaaggaccgcggtagaccgcgtacacagagacggtccacgggtcgacggaagcggatcccgtgtgtcaaccgaggcgagtggccgacaaacggactccactagacaccacacggcctgcacacgtggaaaccacgcggctaccgagcgggcacactaacacagacactacacggtcaccacccgcacgcgtgaacgactaccgacaccggtacacgggtaccggggtcgacaaccgcacaacgggtacggggtgacactgaaaggacgaggacggggcagcgagaggacggatccttaccaccacgcgacgaggcgtgggaacaacaacgacgaacgggcgcggcggacggcgagggaacgacttcggcggcgatccttggacgaaggcgagacgcggccggcatgaggcttgacgacgcggagccgaggacaaagacgacgacggctacagcgaccttgacgaaacaccgaggacggacgagaacggctcgacagagggacgaacgccacgacgaccgggaacgacgggaggacgacgacgacgacgaccggggccggcgaggagacgacgagggcagccggcagcggctgcacggaggcgaggatggcgtggaacacgccgctgcgatgtcgacgacggaggcggcgccgcgagatgacgagccggcgaggatgaacggtgacgacgacgacgaacaccggcggggttcggtcgaaggggaggcgaggccgagggcgtccttgacgctgcgatgccggaggtggagacggcgacgtcggccggcgcactggcacggcgaaaggggctgccggagtgggtgccgacgagaccgaggaagaggcggcgcgcgtgacggcggtgagggctagggaccacgggagatcgcgggagtgggctaaaacgatagaacggagcgaggggattccgttttatagcggagggaagcgagccgggcatgggagagggcggaacggcgacgggaaacacggccggcagccatggaaggcggccgggaatggcgcggccgttccgggcgattgggggcgccattcaaggggaaaaacgggggaaatcaaagaggaatcaatggggattaattccccccaatcaatttggaaagagccggcttgaatggagcggatttggaggaggaacggcgctagggttcacgggagagagaggaaggaggccggcggctggaggccggggacgcgcctgacaggcgggacccacgcgggaggcgcgcggtcaacgcgcggcaacggcgcgcacgcacgcgcacgtgcgcggcacgggagggaggcgcggctcggcttgggccgggcgaagccgaggcggcccaggaggagaggagggagaggcagcccgggagggagagggtggaggagggagtgggccgagagggggaggggaagagtgggccgggaggaggaggagaggcccgggagaggagggaaagagagggaggagagggagactttggccgcgggccaagagagagagaggaaccttgggccagacttggcccaaagggaaggagagggttatttttaggttttcgttttattaaactttgataattgtttttgttgcttaataaatatttccggcgctctgaaaattcaagtaaaatttgagggctccttttagaccaaggagaatttaacaaaaattctccgggccacattcgaatttttcttgtacgtattttagtgtttgccaatttcttttcgaattttaattaattctattattccttttagaaaatgatttttattttgggatgaatttatcaggacgtgacaccacatcatgtcaccatgtgcctcaataccaccacggtacctcggaaaggagttgtgacaataacccttgcacaacataacccattacagcgcacctttcctggatcataatcacccccttataaacaaggcctggtgtcgcgtcccaaaacggctctaaaatacatcctcgaaattgtgccgagaataattaaaattcgtgtgaaagcctccaacaattaaaatgtgcaaatataaaagtcaaataaggcttggaggatttttgtatatttcctaaaagcctaaaatgcgtaaataaattttagtgaaattttcagagcacaaataataattgagaagaaataaacaaagttaaaaaggttttataaaaagaaaaaccctaaaagaagtcttctttccccccccctcctctcttgggccggcccggcccaactccctccctctctctcctctcccccgcggcccatcggcctcctccccgcgcgcgtgcggctgacgggcggacccgcccgccaccct

SEQ ID NO: 38948 - DNA, 8957 bp, Oryza sativa
  unsure (1)..(8957): unsure at all n locations
acagaaggacgacagttgccattggaattatgcaaggaatttgaagattaaatttgggaattgtcagtagaggtttcgttgcagccttagaagcgaagcccactctaattgatcaagttagagaagcccaaattaatgatcctgatattcaagagatcaagaagaatatgagaagaggaaaagctatcggtttcttggaggatgagcacggaactgtaaggttgggtgagagaatctgcgtccccgacaacaaagatttaaaagatgcaattctgaaagaagctcacgatactttatactctattcaccctggtagtactaagatgtaccaggatctcaaggaaagattttggtgggcaagtatgaaacgtgaaatagcagaatatgtagcagtatgtgatgtttgtcagcgagtcaaggcagaacatcagaaacctgccagtttgctgcagcctttaaagattcctgaatggaagtgggaagaaatcggtatggattttatcactggtttacccagaacgtcatcgggtcatgactctatttgggtgatagtcgacagacttaccaaagtagctcatttcattccggtaaagacaacctattctggaagtcggttggcggaattgtacatggcaaggatcgtgtgtttgcatggcgtccctaagaaaatagtgtctgatcgaggcagtcagtttacttcaaatttttggaagaaacttcaggaagagatgggttctaagctgaactttagtactgcttatcatccgcagacagacggacaaaccgaaagggtgaatcaaattttggaagacatgttgagagcttgtgctttagacttcggtggaagttgggataagagtctaccttatgcagaattttcgtacaacaacagttatcaagctagtcttcagatggctccttacgaagcactgtatggtcggaagtgccgcactccacttttgtgggatcaaacgggagaacgtcaggttttcgggacggatatcctaagagaagcagaagaaaaggtgaaaatcattcaagaaagattgcgagtggctcagtctcgtcataagagttatgccgacaatcgccgcagagatttgagttttgaagaaggagattatgtgtatcttcgtgtcacgcctcttcgaggagttcgtcgttttcatatcaaaggaaaattggcaccgcgttttgtgggaccttataagattgtcagtagaagaggagaggttgcttatcagtggagttacctcaatctttggcaggagtccataatgtgttccatgtgtcgcaattaaaaaagtgtttaagggtacctaccgaagaagctaatcttgaacagatagaagtccaagaggatctgacctatgttgagaaatgtcacgtcctgataaattcatcccgaaataaaaatcattttctaaaaggaataataaaattaattaaaattcgaaaagaaattggcaaacactaaaatgcgtataagaaaaattcaaatgtggcccggagaatttttgtagaattctgcttggtgtaaaaggggccctcaaattgtantggagggttcanaccnccaaggcctgcctggaggacctccccccnnctncntnagggggtaagaggaaaaatcctaaacaanaggtggtttccccccccttcccttactgggccggctcggcccagctccctccctctctctcctcctccccgcggcccactcggcctctccccgcgcgcgcgccgctgacgggcgggcccgcccgccaccctcgctgacgggtggggcccacctgtcatccctatcctcgcgccgcgcccgccgcccgcccgtgccctagcgccgccgccgccgcggattccgccgcatcccgccgtccccgcgcgccataaagagggggaaatcactccccgtgattccctccctcttttccccctctttcccctctctctctccctcggattcgtccggattcactcccgcaaagttcgccggcgcatcaatggcggccgagatttccgcggccgattccttcccctccggccgctctctccctctcccggcgctatataatcgtcccccgtgcttcgctcttccgtttccgccactcgccgcctctcctccccgtcggaatcgagcccgcgccgtcgcaccttctctccgccgtcgccgccgaactccggttcaccgccgtcgtcgccccggacctcctcccgcttccgcatcgcccccttcggcttcgccgcgtcctcgccgaccccgtccgctcctccgtttcgcccgccgaccgccggaacgccgccgtcctcgtcgacccgagccgcgccgccgccttcctccgctccggtcgtcgtttccgccgtcctcgtcgtcccggggtgagccgtggaccgctcctttcgcttcccccttccctcctctctctcgggtgccgctccgccgcgtcggtggtcgccggcggtgaccatcggggcgcgggcgcgccgcctcccgtcggccgtgccggcgaggccgccttcgggcgcgccccgcggctgccaggtggggcccggccgtcagccgcccgcgcccgcgggtgcggctgacgcgtgggacccacggcgccggccggcgtctgccgcgtgcgcccggtccaccgtggaccgagaggctgacgcgtgggccccactcccgtggacccggtccgcgcgcccctcccctcggctgacgcaataaatccgatttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgctgttatgtggagtttattagagtaaaagccttttcttttccgttggtcgtgtagacgctgcagcttcggaagatccgctcttcgtggaagttgaagccggtgtttgggaaagcgagcaaggcaagtcacatcatccttgagcatattgaatcccagtttataaaattattttgatttaaattaatgcattaccgctttatttcaattcccgcgttatcactgttttatttagccatgcctatttacctttgttaagacattattattgctattgttattattaccttgttcaccctagaataaacaaaaccccaactagtgggtactctattcctggttccactagtatgaatttaggtagatgcttcgctgattaattaggcaatattaggtggttttataactttagactttgggaattctcatatcatttggacactatggaattgttggtttatggtggaattggacatacacctctcttcctctttcaaaacccctaaaacctgttttcggtggggtctgggtgcatgccagttgtgggaagtagcaccccggccactataaggattaagctcgggcctctgttgcaaagcactaccgtacttccacatgtctagtgggtaaggcttagtttgtggctcagtctggtcataaacaaaagtacacggatggagatggatgaagtcgggggtcgatggacattctctaggacaaatgaaggctacacgagctgcggcccggtagtcgagatgtcatggcacagggttggtgccctgctgctaggggctcagtcctgcctgcctgtcccgggggttccggccgtaggtgggattgggtcggtactcttgtctatggctaggatgggttggaaactatgtcacagcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagtcagtgttttaattcttaaaatttgcttacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagctctaggatcgtctttataaaatggctttgggcaactaagtgacttttaaatgctgcttttctgcaaaacttaacccctatattatttaccccttgtacccccttgcattaatcgtgcatctaccggtgtgacttgctgagtactgtggttgtactcattcttgctctatctttctccccccttcagtaagagaagcttcagagaagatgtcttaggtggagtcctggcttataccccagttgagcgcctgtgaagatggagccgtaggcccgctagtccgctgctgtttatttttgtttgtcaggcctgaagcgcctttgtaataatgtaaatattatcgatataataaagatgtgtcttttatatcatgtttgtatggtgtaccccggcttttcctgggacggggattaatacactggcgttcgggaaaaggcaattttcccggtcgcgacaagatggtatcagagccatctcgactgtaggataagccaagtggataaaacctaaggacatattttataaataaaactatttgcgaaagttcctttttttctcctttcccctatgctatttgcaaaagggtttactcccttcttccttcttcggatttcaactagtactagatggtcaggtcagtgaagaagaagacatcgtcagttgtttgccgaagctccggaagactgcaggatccgctagcgaagtggaggaagcagtgaagccagctgtaaagcaggagtgaagatcttggagaacccgtcgcagaacctaagccaccctctagtgtttcgtttgtcgtgtgtttccttgcttgtgtgtgtagcgcgtggtttgcatcagtggattgtgatgtaaccatgctaggttgtttgcttaatcaacttgcagaataagtgaaacaaagaacacatcaacaagaagagttagttcctttaaggtcctatctctagttctggtctattctttcctggcttgtttcctctctcacctcaatccctgtaacagatgtttaacagagaaaaaggaaagaatgtcagcgggtatgactcaagtaactcaagttttcaactcaatctgccactggcctcaagagagttaaccagggcacacccttggtccattccaagcatgctgcttagttcacagctaccattggttggaagtcaagaccaaaatcagtatgtgtttgatcgagcctttgccacccaggtcaatgagcttccaatgccagaagagcaggttcccttttgtcatgattgtagagagcaaggacactatgccctgaattgtccatgggtatatgtcaaagaagccccttcccttggtttagcagggcggacatcgctaaaccagcctcctcacaccaagtcaagcttgcagcctagtgtgcaaagtagagagctcaacggagagaatccattgaatcccgggaaatgctttcctcctagcctctcgtaccacgtggggtcacatactaagcaagccaaaggcaagaagagtaagaatcagaagagaaaagcaccgatgcgaactgaagaagaagtacgtaagatgactattaccagcaccgaatggcctccagcagggataactattcctagacgtcaaagaggaaataccttccgaggtgcacgacagttgacccagcacctcctaagccgtggtggcagagtatctgatagtgaagggtcagatcaagtctcctcggatgaagaagatgagtctccccgacatctcggcgaggaagagatggaatccaaagcatgcccccgttgtggagaaattggacacgttgctagcatgtgtctcacactctgccctcattgtgaggaagaccatccaccaggtgaatgtcccacccgcaaggtcacatgttttctgtgcgaaggtacaaaccatgtgcccaaggattgccaactcagtgtgttgttgaccaagaccgcagaaatccaacgaacaaccctacgattgtctcatcagctagtcagctccaacagcaacatcgacgatatcatccacagcaccaatgctcctcccgctgcacctgactctgcaataaatcatagcgataataccttcagcaccaaccattctctgcaccgacagcctcaacaaagaattgtcatcgatggaagaagttgtgtctctccccgacctactccaggccgagccaagggcaatcaacctccggagggcgataccaagcagaagaccgttattcgcctcaaccagcaaccagaaggaaacttctcctgtgaatgatagcaatatgcagtcctatcacatcatcacagaaccaatcaaggatgcagtcactagaacaatgccagctatgtatccatgtttgtgattttcagttcgctacttatcactgtaatcgggagtttgcagcaatcatgtaataaataaacatattcatgattataaacaatgagtttgttatgtttatggatgattcatgttgaggatacaatgtaccgatgataagcaccttccctttttgtttaaggcagtgccttgtattcgtgtaataagggagaaatgtgtaatacagacaagttctgagaggattcttttggaagatgcggatatgtgatcatgtgtataattgtttactgacaaaggagacctagggtctcgtgtcagaggaactatattctaacctcgagttaataaccaacctgtggatggaaaagaaaaccaattaaactgtgttgggttaaaaagccaatgagacagtagttggggataggagtttggatacgcctcttacagatcaagataaggattgttggatgaaacccataagggtacccgccatgcctctacattgataagttcggatattcctgcaaacagttaagaagatccaggagacatcaatatttgagaacataatagtcgatggttggtaattagtctatcaggtatcagaaaagggtcaaaggtgatatggcagaagaacaatatggatgctccccatctcgaggaagcactaaagatgatcatcggcaattaaaccctagtggcatagatacagatagcaagcaatgtatttccctgaaggtggtcagtgcagcttcttgacaaaccacatcaaggtttcactgaaaggcagcaagccaaaggacctcatcgtccccagaagcgtccgcaatccacattaaagaataccacatgttaaagataagccgaaagatgattgataaaagagattggcaaagatgttctccagcatgaaagaagtaggccggaaggtgattgataaacagaaacatgctctgcatcgctcaaggaagacccctgatagtaattgccccgcaacagtcaccttgtcattaagtaagcaagatgacctaggtaaaagtgtttctatgaaggcaaggagtgaaatcttcaactcggtatcagatgctacacggagtgaaaagtgcaagcaccggttaccaggtaatgccatgtcttgggagatgatccaatgggaaggaacacatcaaggttaaaaggtgtaaaggaatacgttgaatgctaaccgaggacaacctgaagataatagtggaaagtaaactgaacataaagaaagtgaatccgagttgcttgttcgtgagagctattcccagttatgaatcaagtgatatgttcaaagataatctacagaggtcagattaaaatcacatctaacaacgaagcctcagatttggcaggataatgattagacagtaacaaatccagcaataaagccatttgggaagacgtcaaagtatgtcaagtgggataagttggttctcttgggaagcataattcaaaggcaaagttagcgacccttgcatcaaatagcagaagtacctagcaccggagaccaggaaagctaatatgagacagttcatgttgtcaatcatggtatccttagtaagcgggatatcatagtctaaagcatatggtggtaagctggaaggaaacgccaagcatggtattctcatgatgacaagcatggtatcctagtaatgacaagcaggttacgagacatgacatgaagttgataacttgtgaggttgacgccgaagatatgaatcgtgagaagttctggatctgaagccccatcttcaagtgccgcaacctagtctgagtcagctaaaaggtgcaccctggttcaagtcaggtgaagagaagattccatccgcagcaggaggtcaagccaagcagttccgagtggtgaagttttgctgaaagtttgtgaggacggagcggaagaagtcaaacaagaagagaagaccgcccaacctatcttcttgctagcctcctcgaatctcggggacgagattcttgtaaggggggtggatttgtcacgtcctgataaattcatcccgaaataaaaatcattttctaaaaggaataatagaattaattaaaattcgaaaagaaattggcaaacactaaaatgcgtataagaaaaattcaaatgtggcccggagaatttttgttaaattctccttggtctaaaaggcgccctcaaattttagtggaattttcagagcacaaataataattgagaagaaataaacaaagttagaatggttttataaaaagaaaaatcctaaaaaaagtcttctttccccccccttcccttactgggccagctcggcccagctccctccctctctctcctcctccccgcggcccactcggcctctccccgcgcgtgcgccgctgacgggcgggcccgcccgccaccctcgctgacgggtggggcccacctgtcatccctatcctcgcgccgcgcccgccgcccgcccgtgccctaacaccgccccccccgcggattccccccatccccccgtccccgcgccccataaaaagggggaa

SEQ ID NO: 38949 - DNA, 7937 bp, Oryza sativa
ggagtttgtcatcaattaccaaaaagggggagattgaagcatctaggcccccggtgttaattttggtaattaatgacaagcgctaattgtggactaaccgttgtctttgaaataatattttaagttaggtccacgtcatgtgtgcacatggatgacgatcgatggattaaaattgacggcgcaaggcaaagagaaagaagacggtaaaactagtgcttaatttagaattgatcggggtgtagggcgatcaaatttgctagtttatttctagtttcgccgtactattaagaggggtaatgacctagcaaagagatgattttaattgccacattaggtcattgcattatcacttgtgctcactttttcatcacacacacacacacattcactgggttcggcctgaccagggcaggtctgaccggccacaagttggcggtctgaccggcccataatgtcggtctgaccggcggcacatgcccggtcagaccggccccctggaggccgaaatggtgctcctcgggactgccgatacagagccgacggagccgtagtcggtcagaccgagccgatggcggtctgaccgagccgactccggtctgaccgcccaatcaactccggtctgaccggccgggccgatggggccctctgacagcgctacaactgctagttttctagccgttgcagagtagcacagtatgaccggccacatacctccggtcagaccggcagagcacaaagttgggggatttcgcccccaacggctagttttggtgggtgggagtataaatactctcccaccagcagcaaggggactctcttggcacccaattcaattgcatacaccccttgcacctctctcacactcacttgagctttgtgttcatccatctagtgttatagggttgattagccaagagtcaagtgcatttgcttccattgtagagctagtgtggcacttgatcatctccacgccgggtcattgcttgttactcttggaggatgccgcctcctagacggcttgtggagaagttgcccggtgacctctccgagaagattgttgtcacaccctgaaaattcaaaatatataaattgttgtttaaatgaaatttttagaatttattttaaaagcctagaagagaagatctaattttaattaataaattccaatataaaatggggccagataaaatttcattaaatactttgcttaattctataattcctagatttttctgggatttatttgagctaaggaagtatttttaataaatggaattgcatttaaaaaataatttaaattgaaaaaggttttgaaaagtcttcttttggctttgggccgaaagtcagcccaaaacccttctctctctcctcggcccaagtcggcccagtccgcagccgcagccgcccgcgcgcgcgtcctcgctcgctgacaggtggggcccgcctgtcggagtcgtcgtcttcctccggccgaaaccctagcgccgcgccgccgccgccgctttccaaatcggccgatcctttccttctccggccgaatcaaaagaggggaaatgatcttcgggatttcctctaccttttctcctttggaaacaccggctaaaatcgtttggaaattcgtggattcgagtttgtttcggattcgattttcccgaactttccttctcgtcgccggccgtcgtgggccttcgccgctgcctccgagcccctttaaaaggacccccgagctcttctctacccgccgccaccctcgccttcgcctctcgtcgccggtagcgccctagcgtcgtgagacctcgagccgccatcgccgccgtcgctccagccgtgcgccgccgccgttccggtcgtcgtcatcgctcgggaaggccaccgtcgggatcgccaagtcgtcgccgtcctcgtccgccccttcgccaccgtcggagaccgccggagcatcgtcgccgtcgtcgacccgatctccgccgtcgcttcttcctcgtcgccgtcgccgtccgttggtcttccgccgtcgcttgggtcgccggtgagttcgccgtgccgtccgctacccgttggtgtccaccgttcttgccgaagtgccgccgttcactggcaagcgtgcgccgtccgagccgtccgagccgccgagccgccgccgccggtggtgacgtcatcgccgacgtcatcgtcgccctcttccgtgagccggtcgtggaccgatcgatctcggtcgtccgttttggtcatcgtcgccctcttccgtgagccggtcgtggaccgatcgatctcggtcgtccgttttggatcaagtcgatctcggccgtccgttcgcgtgaactgccgccgtgcgcccggtccaccgaaaccctagcccgctgacgcaataaatcccttttccttttcaaaaataattcattattgcgtcataattcaattaaaatcaatataagtgttttaatccgatttaatcttcaaaaattcataactaattcatcttagctccgatttagttggttcaagtctctaaatttttctaaaattgagatctacacaataaaaatatccacatgtactgttcatgcttgtttatgtgctgttttggtgattttgctcttttctgcttagattccgtcgtttccggagagtccgttttcgcaggagaagagtttgaagagttccaaggccagcaaggcaagtcacacagatcccaaacaaccctttgagcatgttgatcccgtttaaagctattgtttctattcaactattgcatttattttcgaatgtcattgggtggaattaacctattgtttgctatagcccttttgttcttgattactttattccttgataccttgggttattataatttgactagttgagctttatttatattggttcaactagatattagatataattgcttagccatgcttagaaacattagcacacttttgggataacttatgattcactattatttaatgatagctcacgatggtcaatcgtgattggttaattaattaatgtgccaactaaaacttggtaatggtgggttgtgagcacatggttttgatggtcgtgctcatgacaattaaggaccggttcacgagtttcggttgtgaaacattaaccgtgccaaccacaagccagcgtgggcaacggctttatcttttgtataacatggttcattgcagggcaccagactgagaagtggcggagataagcccacgggggtcgctggggagtccatgccttgtttataagggggtgattatgatccaggaaggtgcgctgcagtggattgtgttatgcaaggggtattgtcacaactcctttccgaggtaccgtggtggtattgaggcacatggtgacatgatgtggggttgtgtcttatgggtacagtggtacacctctgatcagagtaaaactattcgaatagccgtgcccgcggttataggcgggtctaacaatgtctttcgtgattagtctcacccttctcaccatagtaaatgatgctataactggtaataatttgattagctcctggtttggaatggtatattcctggtttggagatagaactgtgcagccgggatggttattcagaatgggtgggcctatacaacagggtatgttgtatagcgttggattaatattgtttaattattacttaactgttttattaaattctcaaatgtttgctaaatgctgcttttgcaaaagaaaccctattatgccatcctttgttatcctgtgcacttgcatatttgctgcgtggcttgctgagtatgtcatatactcaccttgcaatcattcatcagaggaagagttctacaatgatgctgatggtgtggaggattaggtgtagccttggtcaagctgcttgtggagtggagccgtccgcgccgtttatcttattttccgctgcttagatctttattgattgagaggaactatctacctctgtaatgacattttattcgcttattagttagagtaatatttgtactctattatcaatttgttattgtgtgcctcggctgattcctagacgagggttcccacacatgtaagcgtttggaattttggatagaaattccgggcgtgacaagttggtatcagagcctccttgaccttaggttatgccaaatggttacccatagaagccctctaaaaatattggaaaagtagaactgttctcctccctttctcttttaaaccaaactaatggcacatgcacttcataatctcttttaatggttctcattcaaaatttatttcagtgttattagtactgtacatctattactgtactaatgactcatttaccagcaaaagttttacaatattgttttatttaatcctgctgcaataaaataaatttagcatgtcgattttataactttcttttatttctgttaaaacctgatgatcaaaagtacaaaaatttgtaacctcgttttcaactatttcaacttatcttgcaagcttggtttactttatttacttacctttttactttgattttccaactttattcacattaatccaaaaacttgtgctattaattggataaatgtcttaactccctcctttcacttgtctttagatgccgcgctacaagcctgagtacttgtttggtgtggagggttttgtccaggagttgcgtacaatgtcctttgtcattggatttgggactgcccctttttatgcccagattcctcatgatcgtcatgaagagaagtgccgagtcaaagtcaccttgaacagtaatagtgaagatattccctcagtgatgttcgaagctggaggaagaaactacatccatgcgtgtcaggaggtggcaaggatcgccataggagagcttcgcgatcgctacagtgatcagttggccgatacggagtatcgctaccatcctcgtcaaccacagggaagtgaccgtggcaattaccttgagactgaaggaattgagaatgatgctaccacaaggcatttggttgagatgctgtgggctatggatgaaagtcgtgcggagactgtattagcggctcaagatcgtgaagaccggaatcgtggtaagatttgcaagctagaagacaaggtggatcgtttggagaaggaattagccgcattgaagggagaagcaccgccgcagaaggccaggattcgtctcactgcaatgaagagagctctatttgtccctcgctatcaattggcgccaaaggttcgtgtggtggagaatgaagttgccccaaccctagcagatcctccggtcatcatcataagtgatgatgaagaagaagaatccaagcacacccattccaagattgagtgggtagtaactcaagatgatgaagacgagccgaatgagccttcaatcgacctccgatgctcggaagaactagagtgacttgttaagtcgttgtcttagatcgttgtgttagtttgcttgctttaagtttgcttgtgtgtgtctcgcatgtgatttacatcagtggtgggatgtaagtgcatgcgtttgtttgcttttgagtgttaggaagttggtgagtttagtggtgtgagagtcttcagtttgtaataatgaaactcagttaagatcaataaaagttaaagtaattccctgtcctaagtagttttgcccggtttctcttcttgtgccctgtccatgccagatggtgaacactcgcagcaatgggaatggccccaacaacaacaacaataacaacaacaacagtggagagaatcccacacttgcccaagtcctggctcaacagacacagcttatgaacatgatgatgcagcaactccagaaccagcaaaaccaaggaaataaccatgcacctccccagaacaagttagcagaatttctgcgtgtgaggccgcccactttttctagcaccactaatcctgttgaagctggtaactggctgcacgccatagaaaagaagttggatttgcttcagtgcactgattaggagaaggtctcatttgcatcacatcagttgcatggccctgcctctgaatggtgggatcactttcgcctgaacaggattactgctgaacctatcacttggcttgaattcaccgctgctttccggaagacgcatataccatcgggagtggtgtctctcaagaagaaggagttcaggtcgctcactcagggatctcgctctgttacggagtatttgcacgagttcaatcgtttggctcgttatgctcctgaagatgtgcgcaatgatgaagagcgtcaggagaagttcttggaaggacttaatgatgagctttcttacccactcatgactggagattatcctgatttccagaagttagtggataaggctattcgtcaggaggacaaatacaaccgcatggagcagaagaagcgccggattgctcaattcaagacacaacaggggaataatcagaggccgcgtcttactttaggaccccagtccgtgccacagggaggttcttcgtctattgttcgtccgcagcgtcagttcttcaacaacaatgctggcaacaacatccgtaatcaagttccacgtcctgttgcagctccaacacagcaacaacctgccaagagggagcaaggcagcaaacccgtggtgtgtttcaactgtggagacccaggacattacgctgacaagtgtccgaagccccgacgcgtgaaggttgtccctactcagagcaactctaccgcaccagcatcaaaggcccgtgtcaatcatgtcgctgctgcagaagctcaagatgctccagatgtgattttgggtacgttccttgttaacttagttcctgccacagtgcttttcgattctggtgctacacattcattcttatctatgagttttgcgggaaatcatgggatggaagtagaagatcttagacatcctttgatggttagtaccccaagtaatcaagcactctctttgcaacgtagcccctctgtcagaatagaaattaaaggagtaccatttctggccaatcttatcttgttagaatccaaagaccttgatgtcatcctagggatggactggttagccagacataaaggtgtgatagactgtgctaacagaaaagtaactctcaccagcaatgatggtcgagttgtaactgttcatgcattgtcttctgagtctttaaggtcaagactgaaccaaataactttggaagagattcctatagtccaggagtatcccgatgtgttcccagatgatttacctggtatgccgcctaaaagggatatagagttcagaatagatttggtaccaggaacaactccgatccataagagaccttatagaatggcagccaatgagttggcagaagttaagaggcaagtagacgatttgcttcagaaaggatacatcagaccgagttcatcaccatggggagctccggttatttttgtggaaaagaaagaccatacccagaggatgtgtgtggactatcgtgcactaaatgatgtgactatcaagaataagtatccactacccagaattgatgatttgtttgatcagcttaaaggtgctactgtattctccaagatagatcttcgatcaggatatcaccagttgagaatcaaagaggaagatatacctaagacagcttttaccactaggtatgggttgttcgaatgtactgttatgtcttttggacttaccaatgcccctgctttcttcatgaacttgatgaataaggtgtttatggaatacctagacaagtttgtggtggtctttattgatgacattcttatctactcccgaaccaaagaagagcatgaagaacatcttcgccttgcattggagaagctacgagaacatcaactgtatgctaagtttagcaagtgtgaattttggttgtctgaagtgaagttccttggtcacgtcatctcagcaggaggagttgccgtcgatcccagtaatgtggaatccgtaaccaactgg

SEQ ID NO: 38950 - DNA, 3786 bp, Oryza sativa
gcccctgctttcttcatgaacttgatgaataaggtgtgtatggaatacctagacaagttcgtggtggtctttattgatgatattcttatctactctcgaaccaaagaagagcataaagaacatcttcgccttgcactagagaagctacgagaacatcaactgtatgctaagtttagcaagtgtgaattttggttgtctgaagtgaagttccttggtcacgtcatctcagcaggaggagttgccgtcgatcctagtaatgtggaatccgtaaccaactggaaacaaccaaagacagtttcagaaattcgcagttttctaggcctcgcaggatattaccggaggtttatagagaatttttccaagattgctaagcccatgacacgactgctacagaaagatgtgaagtacaagtggtcagaagaatgtgagcagagttttcaagagttgaagaatcgcttgatatcagctcctattttgattttacccgatccaaagaagggtttccaagtctattgcgatgcatctaaacttgggttaggttgtgttctgatgcaggatgggaaggtggttgcctatgcatctcgtcagttacgtccgcatgagaagaactaccctactcatgatcttgagttagctgcagtagttcatgcgttgaaaatttggcgtcattatcttttcggtactcgtacagaggtatataccgatcacaagagtttaaagtatatctttactcagccggatctgaacatgagacaacggagatggttggaattaattaaggattatgacatgggaattcattatcaccaggaaaggcaaatgttgtagccgacgctcttagcaggaaaggctattgcaatgctaccgaaggacgacagttgccattggagttatgccaggaatttgaaagattaaatttgggaattgtcagtagaggtttcgttgcagctttagaagcgaagcccactctaattgatcaagttagagaagcccaaattaatgatcctgatattcaagagatcaagaagaatatgagaagaggaaaagctatcggtttcttggaggatgagcaaggaactgtttggttgggcgagagaatctgtgtccctgacaacaaagatttgaaagatgtaattctgaaagaagctcatgatactttatactccattcaccctggaagtactaagatgtaccaggatctcaaagaaagattttggtgggcaagtatgaagcgtgaaatcgcagaatacgtagcagtatgtgatgtttgtcagcgtgtcaaggcagaacatcagaaacctgccggtttgctgcagcctttgaagattcctgaatggaaatgggaagaaatcggtatggattttatcactggtttacccagaacgtcatcaggccatgactctatttgggtaatagtcgatagacttaccaaagtggctcattttattccggtaaagacaacttattccggaagtcggttggcagaattgtatatggcaaggattgtgtgttcgcatggcgtccctaagaaaatagtgtctgatcgaggcagtcagtttacctcaaatttctggaagaaacttcaggaagagatgggttctaagctgaactttagcactgcttatcatccgcagacagacggacaaaccgaaagggtgaatcagattttggaagacatgttgagagcttgtgctttagatttcggtggaagttgggataagaatctaccttatgcagaattttcgtacaacaacagttatcaagctagtatacagatggctccttacgaagcactgtatggtcgtaagtgccgcactccgcttttgtgggatcaaacgggagaacgtcaggttttcgggacggatattctaagagaagcagaagaaaaggtgaaaatcattcaagaaagattgcgagtggctcagtctcgtcataagagttatgccgacaatcgccgtagagatttgagttttgaagaaggagattatgtgtatcttcgtgtcacgccttttcgaggagttcatcgttttcataccaaaggaaaattagcaccgcgttttgtgggaccttataagattgtcagtagaagaggagaggttgcttatcagttagagttacctcaatccttggcaggagtccataatgtgttccatgtgtcgcaattgaagaagtgtttaagggtacctaccgaagaagctaatcttgaatagatagaagtccaagaggatctgacctatgtggagaaaccaatccgtatcttggaaacaaataagagaagaaccaggaatcgagttatccgtttttgcaaagtccaatggagtaatcactcggaagaagaatcaacttgggaatgagaagatgaattgaagtcagctcatccgcatctgttcgccagttcttccgaatctcgaggacgagattctgtttaaggggggtaggtttgtcacatcctgaaaattcaaaatttataaattgttgtttaattggaatttctagaatatattttaaaagcctagaaaggaagatctagttttaattaataaattccaatataaaatggggccagataaaattttattaaatactttgcttaattctataattcctagatttttctgggatttatttgagctaagaaagtatttttaataaatggaattgcatttaagaaataatttaaatggaaaaaggttttaaaaagtcttcttttggctttgggccgaaagtcggcccaaaacctcctctctctctcctcggcccagccggcccagtccgcagccgcagccgctcgcgcgcgcgccctcgctgtcgctgacaggtgggtcccgcctgtcggagtcgtcgtcttcctcgggccgaaaccctagtttcgcgccgccgccgccgctttccaatccggccgctcctttccttctccggccgaattgatagaggggaaatgatcctcgggatctcctctaccttttctcctttggaatctttggccaaatcgtcttggaaagagttggattcgagttcgtctcggattcgttctacccgagctttccttcgccgttgccgtcgccgtgggcctttgccgccgcctccgagcccatttaaaaggacccccggtgcctcctctacccgtcgccaccctcgccttcgcctctcgtcgccggaagagctctagcaccgtgtgccctagtgccgccgtcgccgccgtcgctccagccgtgcgccgccgccgttccggtcatcgtcgtcgctcgggaagaccgccgtcgtggtcgccaagtcgtcgtcgtcctcgtccgccacttcgccaccgtcggagaccgccggagcatcgtcgccgtcgtcgacccgatctccgccgccgtttcaacctcgtcaccgtcgccgtccgttcttcctccgccgccgttttggtcaccggtgagttcgccgcgtcgtcctctacgtgctggtgccctccgtttgtgccgtagtgccgccgttcgccggcgagcgtgcgccgtccgagccgtctgctccgccgagccgccgccgctgtcggtgacgtcatcgctaacgtcatcggggtcgtccgccgtgagccggtcgtggaccgtcgatctcggccgtccgttttggattggatcgatctcggccgtccgttcgcgtgaaccgccgcccgtgcgcccggtccaccgaaaccctagccgctgacgcaataaaccttcttttccttttcaaaaataattcattattgcgtcataattcaattttccccgatttaagtgttttaatccgattctcatctttaaa

SEQ ID NO: 38951 - DNA, 4337 bp, Oryza sativa
  unsure (1)..(4337): unsure at all n locations
tcccaacccaacaaaaaacacactttgctcccccttttggcatcaagcaccaaaaaggtcttcactcttgtggagaaaaaggaggacgcgccgaagtggaaggatgagaagcatcacgatgacgatgatacacgaatgcttgggagctctccaacatttggactcgagagtccaatgtacccactcgagtgtgcaatctccccacggaagcattcaagtctccaacgtccgtgcgcaagccacgaacatcctcatgcaaagcgtcatgcccggtagacaagcgttgaatgctttcacttagggtattaatagccccaagtaccgggttgaagtactcgttgggttgcatcccaaaataggcatactgaggatgaaagaaggcatttggatcatacccatgaggaggcggaggtgcagagcatgagctagctctaggatgagaggagggcgccgtcctaggagcacggggagctccaagctgtaggcgggcttgtactacttgtgcttcttcaaatttggcccagcagccccaagcttgtcttgaattaatctcatgatgtaaggggcataatagataccctgagtgaaggtccccttagagatggcaatctcttgcatcatgagagtaacaacatcgaactgacggccctgaatgatggcatcgataacgtgccaagccactcccctaatgtcatcattgttaccccagnngcgagggaggggatgnnntagctcttnnncacnanatncncntgntntngnaccncnancnnancttnntngngnngnnnatggnntnctcatcgcgggcaaccttccatgtgtgtaccgcgctccaacttcataaaactgagagaggtagtcgatggagagcggattatgggtgtgctcctcatgcaagtcatctccaaagtccaagcgaacatttaggagccgccggaattgcctcctggagatagagcactgaagggtgtcggacatccacttcatctcactatagtccccggccacccacactgtagcataaaacttccggatcaaatcttcattgtaatcttgcttaagagttaaaatccggtcaatgccaacagtcctgaagagatcctgcaagcccttaaactcggtagtctcattaatgtctctccaagagatcaacttatgttctgcaaaagctttcccagcatagacttgctcatacacactcttctggaaagcagtatgaaaacggggatccggggtgtcccgaggcctcaaaaactgatcgtggtgcctcaagatggtatattgggatggattcctcatgtttacaacaaactggatggagggatcaatattcatctcatcacttccttcatcctcatcctctccacttccactgtcatcatctccactttccccctcgctagccccctcaacattggcctcaacctcttcatcactttgagcatactcatctccgcttgactcctcactcacgggatcaggagtgggcgcacgacgaccatgacgggtgcggggaggcatagctgaaaaacaaggagcaaaggatggataagcaacaattttagaaaccacatagtgaagtgggaggaagggcgagtgctgcctatcaggggcggtcagactgagagccacggccggtcagaccgccggccctcggccgatcagaccgcgtgccctcggccggtcagaccgacggccaatggctggttagaccgcctttggtcagaccaccactgacaagagcacacccaaatccttccacaatccacataaatgattctaaaaattgctaggacagtgttgcacacgattggaactagaacatcaaggtgtgtgtcacgaccggaaataacccaacgggcgttccttacgtgcgtgcattattccttgtcccaggaggcaaggtacaccaaaagttgatacaattcagagtttaacaagcggaagcgcaattaattaattattacatgggcggcgaagacccagcacacaagaagacaaacgaaaaacagcggaagactagggtgacgaccacagacgcttgacggcaggcacgagctagacaccaaagccttcatcttccaggaactcctcttctgggtttgggaaaaattgagcaagactgagtacaaccaccgtactcaacaagacacacccacaagtgcagaataaatgcaagggagtacaagggagccataaattaggggttagggtttgcagtaaatagcattaaaagacacttagttgctcaaagctattttgtaaacatggtcctagagctatacaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaaacactaacttgggtacattgctcggcttgcccataaccgagggcgcggctattcgaataggttatactctgatcagaggtgtacatctttacccacaagacacatcttcctcacgtgtaaccacgtgccacataccaccacggtatacggacggaagacgtgacatagtttccaacccatcctagccatagaaaagagtaccgacccaaccccacctacgcccggaacccccgggacaggtaggcaggactgagcccctaacagcaggacaccggtcctgtgccatgacatctcgactactgggccgcagctcgtgtagcattcatttgccctagagatgtccatcgacccccgacttcgtccatctccatccgtgtacttttgtttataaccagactgagccacaatctaagccttacccactagacatgtggaagtacggtagtgttttgcaacagaggcccgaagaccggtccttatatggccgaggtgctactatcaaaaccatgcaccccgagcccagccaaaaaccattttgagggttttgaatagagggggaggtgtgaatccaattccaaaataatccatccattccgtagtgtccaggtgatgagaatattcccaaagtctagagttgtaaaaccacctaatgttgcctaattaaccagcgaagcatttacctaaaatcatactagtggtaccatgagtagagtgtccactagttggggttctgtttaatctagggtgaacaaggtaataatatcaataacaataataataaggtcataacaaaggtacataggcatggctagataaaacagtgataacgcgggaatttaagtaaagcgataatgcaataatttaaatgaaaataattttataaactgggtttcaatatgttcaaggatgatgtaacttgccttgctcgctttcccaaacgtcggcttcaacctccaccaagagcggatcttccgaagctgcagcgtctacacgaccaacagaaaagaaaaggcttttactctaataaactccatataacaagcaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaaagggtttattgcgtcagccgagggggaggggcgcgcggaccgggtccacgggagtagggcccacgcggcagcctcatggtccacggtggaccgggcgcacccgggctcgcaccggccggcgccgtgggccccacgtgtcagccacacccgagggcgcgggcggctgacggctggaccccacgcggcagccactcggcgcgcccgacggcggccactcggcgcggccggcgggaggcggcgcccgcgcccctatggtcgccggcgacggccataggcacggcggagcggcggccgagagaggggaagggaagggggaaaagaggcggcggtccacggctcaccctaggtcgacggcaacgacgaaaaaggcagccagagcggaggaaggcggcggcgcggctcgggtcgacggggtcgacggcgttccggcggtcggcggacccggcgagggggtggacggggtcgatggcggtgcggcgaagccggaggaggcgacgccggggcgggagacggtcccggcgagcggagaaggccggccggtggtcgtcggcgacggaggagagagagggcgacggcgcgagctcgattccggcggagagacggtgcggcaaggggcggaaacgggcgggggaggcgcggggccagtttaaatagggccggggcgagagagggcggccggag

SEQ ID NO: 38952 - DNA, 3435 bp, Oryza sativa
tatctttatggcaccatcattgtcacataggagtggggttttgggaaggatatgccatagtccaacaatgtttgtttcatccaaagcaattgggcacaacaactacccgccgaaacatattctgtctcggcagtaagagggctacggagttttgtttcttggatgaccatgacacaagggatctaccaagcatttggcaactactggatgtgctctttctatccactttgcaaccggcataatccggatcggaatagccaacaagcttaaatttagcaccttttgggtaccacaagccaatagtagaggaatgctttaaatatcttagaatccttttcacggccactaagtgacactccttaggagcggcttgaaaccgtgcacacatgcaaacactaaacatgatatccggcctagatacggtaaggtaaagcaagctaccaatcatagaacgataaagctttaaatctaccggtttacctccctcatcaaggtcgagatgcccgttggttgccataggtgtcttaatgggcttcgcatcctccaagccaaacctcttgagtagatccttgatgtacttggtttggctcacgaacgtcccattcttgagttgcttgatttgaagtccaaggaagaagctcaactctccaatcatggacatttcaaattccctagacatcatatcaccaaattccttgcaaaatacctcattagtagaaccgaatatgatgtcatcaacataaatttgatacacaaagaaatcatcaccaatgatttttgtgaaaagagtgatgtcaacttttccaattttgaaatcctttgacaaaagaaaatctctcaatctttcataccaagccctaggagcttgtcttaaaccataaagagcttttgagagtttgtaaacatggttaggatatttagtatcttcaaaaccgggaggttattcaacaaagacaagttcggcaatttcaccatttagaaaagcacttttcacatccatttgaaatagttttatatcaaagcatgatgcaaatgcaagaaggatgcaaatagcctcaagtcttgccacgggggcaaaagtttcaccaaagtccaaaccttcaacttgtgtgaaaccttgtgccaccaatcttgccttgtttctcaccaccaacccgttctcatcttgtttgttcctaaagacccactttgtccctatgacattgtggtctctaggtctttcaaccaaagtccacaccttgtttcttgcaaagtttttgagctcttcatgcatagcattcatccaatccggatcacaaagagcttcatctacatgttttcgctcaagacaagaaacaaacgagtaatgttcacaaatcgaagtgacacgagatcgagtttgaacacccttactaatgtcacccaacacttggtcaattgggtgatccttggaaagagcggtgtgtatccttggtggcataggtggttcttgtgccttctcctcctccacttcaacttgagcttgacttggcatagcggaagtagatggctcatcttgagtggaggtggatggcttgtcttccacttcaataggcttgacatctccaattgacatgttcttcataactctcatcaagccttcatcacctacatcatccaaattctcgtgcccctcttgggagccattagtctcatcaaattgaacatcggcggtttcttccacaatacctttgttcttgttgtagacccggtatgccttgctttttgaggcataacctagaagaaacccttcatcacaccgactttcaaatttggttagtctaacaccctttcgatgaatataacatttacaaccaaaaactcgaaaataggcaatattaggcttcctcccaacaattacctcataggaagtctttttcaagacacgatgcaaataaagcctattggttgcatggcaagcggtgtttatggcttccgcccaaaaggaatcggaaacaccatattcatcaagcatagtccttgccatctcaatcaatgtacgatttttcctctccactacaccattttgttgaggtgagtaggtagcgaaaagttcatgtttaataccaagatcatcacaatagtcctcgatattggtattcttaaactcggaaccaatgttacttctaattttcacaagagtgcaactaaattcattttgggccctttttgcaaactttttgaaaaggtcggcgacaatagacttatcatgcaaaaagaacacccaagtatagcgagaataatcatcaacaatcacaagacaatgactattaccaccaatgctcttataggttgttgggtcaaacaaatccatatgcaagagctccaatggtttagatgtggacatgatactcttagtaggatgagaacatgcaacttgcttgccggcttgacaagcactacaaagcttatctttctcaaacttcacatctttcaagcccataactagatcacgttttgaaaatttgctcaattgattcatgccaacatgggctagccttctatgccaaagccaacccaaagaagtttttgcaactaaacaagttttcaaatttgcttcactagaattgaaatcaaccaaataaagatttccatatctaaaacctttgaacacacaagacttgtcaagaaggctagaaacaataacttcttgcgggaagaaagcacatgacaagctaagatcacaaatttgagcaaccgaaagcaaattgaaatttagagatttaacaagagagacattatcaattgacaaatcattggagatagcaattttacctaacccaattacctttcctttgctattgtctccaaatgtcactttctcttgttcattccttcctacctcaaatgtggtgaacatagccctatcaccggtcatgtgttgagtgcatccactatcaagcacccaatggctcccaccggtgtggtagttcacctacaaaagaagatcaagctcttttaggtacccaaacttatttgggtccttggaggttagagaccaaagctttgggcacccaaatgtcattctttttaccaccgagtataggggaacccacatatctaggaacaatgctaccatcatgagccttcctaagcatataatgagaatcaaacatgcatgtcttaggaggcttaccaccggggcaatcattcaccaaatgcccaacctcacgacactaggggcaatacttaccattgctcttgacaaaacgagtggcacggtgagaaggtttcttacccttctttggaatgaatccaagtccctccttgttaaggatgcaccgttgctcactcaaaatcttgtcaagagtgttcttacccttgaagcacctctccaacctcttgttgagcttagccacttgctccttaagctcattgttctcaacaacaagtgaggcatcacaaatagatacacaa

SEQ ID NO: 38953 - DNA, 7382 bp, Oryza sativa
agccttcccttcgtgtttcacctcgttcgacatcttctctctaggcggtgaagcccaatcaggagagaccaagctctgataccacttgtaagatcgagatgtcgactagaggggggtgaataggcgatttaaaactaaatgacacctaatcaaaactaacctaagttgctaggcttggtgagggtcaactctaactatgcaactaagttaggttttgcaaacctagggtgatagaggctcaattatatctctaggaaagtaactcacactcctatgtcaatgtttagcaatcctagggtgatatgatctcaagtttgtctctagaaaagtaaattgcacaaaagtaaatgcgacaatcaaatgagacaaggagacaagagatttttcaccgaggttcggaaactcgtcggtttcttactccccgctgaggcgagcccaactccaccgctcaaccacgtagcctccgcacgcccccttcgtcaaggggtgggcatggcgggagccggcccatggagaggactacccaagcctcgatcactaggttagttctttcttcactccgaaggtggtgaactccaaaccactcacaaaccggcaccgggcctcctccacaatcttctcggagaggtcaccgggcagggcacgccggtgagaccgccactatgtggccggtctgaccgcccctggtcaggccgaacccagtgaatgtgtttgtgtgtgatgaaaaagtgagcacaagtgataatgcaatgacctaatgtggcaattaaaatcatctctttgctaggtcattacccctcttaatagtacggcgaaactagaaataaactagcaaatttgatcgccctacaccctgatcaattctaaattaaagcactagttttaccgtcttctttctctttgccttgcgccgtcaattttaatccatcgatcgtcatccatgtgcacacatgacgtggacctaacttaaaatattatctcaaagacaacggttagtccacaattagcgcttgtcattaattaccaaaattaacaccgggggcctcgatgcttcaacgtaggtgttagaacctaatatcacaagtgttgcaatacctcacaagtattacatgatgccccataggaatcatctgagaaccataggtatcagaacgtggtatcacaagtgaaaggatcttgatatcacctgcggaggggggggggggaggttgaagaggcgtttaaaactcgtaagtcaatgaagaagataaactttttggatattttggaatattttcggatattttggaatattttccgatattctgaaatattttgggatattccaaaaatctcagattttttagcaagctagaaaggcaaacaaaaagggatggtgtaacaggtagttaatgggtttgcacaaacaacgactaaactactagcggcaccaaatagcaaagctagaggagtaagaaaaagatatcatcaggattcttgcaagttgatgtgttaccaaagatcaaatccttggggggattctacactttgttgaggagcccataatgggccgggtcttttccaactctatcctcgctcttccctttcggaggtaagatccgaccttcacatactccctcggcacaccacaaacaaatcggtatctcgaggtttactcctaaccatctaggtgtcctcaaccaccaagagtaacaaatgccacagagatttcttggcgatgaatcgagtgctcaacaaatcttcacgaagtcaacaccaagcactcaaacaaactcaaatcaaccactcacgcacacacacgaaatctgagattgaagatcggtggagaggaagaagtgagaaggcaaaggctcaaactgaatctcaaatcaacacaagcccagggcaaagaataagaaatagagccagcagccctagcttgtgggtggagggggttatttatagccacagcctcagatatgcccgttgatggcaaagattaaatttttccaaaattctgaaaatcacaagaaggcaattgcatttcagcagcaatttttgtaaattccaaaaagtgcataattcagcagagaaaaaagcattttggaaataccaaaaatattttagaaaaatccaaaaatcacaagagaacaaaatcaactttcggaaattccgaaaaccattttcggaaaaatcctaaaaacaccagagagcaaaatcaacttttggaaattctgaaaaataccagagggcaatttgctggccttatcaattttgaaaattccgaaaagatctttcggaaattccgaaaatcaccaaaatgtaaaatccaataatgagaaacacttcgaaaggatttttgagcaccaaactcaaaagcagatagaaaagttgtaccaatatgaacaccttcacaccatcttctttctttgcttttatcgatactaatatggttgatacttagcaacttatgacttcctatggcctcgatcggtccattggtgtttggcaaggcattttctccttcaccactgcgtcggttcctttgcgccaaacatttgcttgatcttctcccatgcatggtccatcgcgtagcaagtcttgccaacccttcaccacctcttgccattttccgtcacttgtagaattggatgacaatgaaacctcgttgtattgcatatttttcttcatcatcttcattggttcttcatcggacaaatcccttgcttatacattcaataagtgcattaatcccttaatcgtttgtcatcaattaaccaaaacccactaggggcatagatgctctttctacaagtattgcttggtacctcgcaagtatacctaatatctcatagtaatcatccgatacacatcattatcaaaaactgatatcaagtgtatcgcctaatacctcgcaagtatcacctggtagctcacaggaatctaaagcacgactgattggagacatcccaatgcctaggtagatgaaggctgagatttgcctgattctcaagttcagagagaacccttctatgttgcatgaggtatccctggttggcttcagaaagaccttgtcacgaaccttccccgcttggctagtgagggagtaagatcacgtctcgtgggtaaagcatgcaccctctgcagaggattatcaaactattcgaacggccgtgaccatggtcatgggcaaatgtgaggtgattcctctttgcatagatttgtttgcctatactttgtgaaaagtgtttgtgggattgggaaccattactagaatcagtcatgatgagtaatagaggaccattacgtggtctgaaaatgatcttgtgtagatcggggtgtcgattggcattatagattaggcttccctagtggaagcagtgtgtgctagagattatggacaactcttggagccaaagagatgagtgatgagatgggctacccgatggtttgaaagtgaaaagaaactgatagttgagaacggagttagaagctgcttgatggcagaataatgttaaccaactaaaatttgcttcgtccgtttgagttgttgtaaagcaatttgccaacagtatctaagcaaaaacttctttctgaccccatgattgagggcacttagtggttcgcaaaatgttcttttaaaaagaaatggttgcgaagtaaacccagcctcccttcgaagtcttcatgctcacgtttctcatgacttgctgagtgttggtgatatgccctagaggcaatcatagagatgactgtatcacatactatgtttacatatttatccgacattgttccttgaaatagataactcattattggttaataaatgtttgattctttcatgagactcttgatgttgaatgttactatttctaaaggatccctgatcatatatcatatgtggaacaaatatgtttaaatgatcagcacatgtattagttgatgatcatgtctcatggatcatggtatagagataccaaattgataatgtggatgatgtgggaggtgaggtcccgaatcaacttctttgatcatccatgcattcgttatgctcggcctcttttccttcgtccaagcaagtacatctgtaaacgaaaatgtttgttcaagtatataacaagcaaatctaatatagaacatatgcacatttggttgattaatacctaaggtagtcatggttatatccgagtgttaacaaccaaatttggtaatttcagtatcggagatggagataaagtcgaagcggaatccaagatggagatcgttccgcaaacagagcaagaatcggctaaagtccgaatcggctgtgaccgggatcggcagagtccgaattggataaggttagctgattaagccgagtccgataatatggtgaggtacatgttgtcgggttaagttaatgtgcttcatgaggattgccacgcatggactaagtcctgagaaggcaattgtatctattaattaggatattttatgtaatttccttagagatatgtttgggcaaaagtctgccgcaaagacttatggtatcttagtttgttagagataaaagtcgtgtccgacacgggcatattttgtaaatcttgggtataaatagaccccgagccccatgtaatatgataacacacgttcaatacaatctcagcgcaccgccacccttttactttcattttgtttcgacgagttcttgctttcgggttgagctgcatcggtttcgatcttcaactagaggtaaaacttgttatggtggcttgcgttctcggaattagggcttccatctttatgatactctaatcttgttcatgtaattcgttgagttatcatatatcctatataatctccggcaatatcgttatctaacccccaattggctaatgtctgttactaaaaggcagccgattaggttaaataccaacgttgactaggattatataggatatccaccactctatgaaacatccaatggcttgattgtctagatattttccttcttttcatacttatagctgcatcagttgagtttgaccttgtaagtcatgattagaatctcaatctctagcctgcttttggttgccgattagtgtagcatcggggtttcagtcgatcttacctaatttaactacatttatcttatatgcttgattgacatgttaaattgccctttttgttaagatcttgttgcatttaagtatattaggctttcgtttgatatattttacttgctttgatatctcaatatagagtggtattggagtattagccgatacatgctaatctatctgatcggctatgctatgaacgtatatagtcttgttgttaatatatatttcgatctaagtgatttatactgtctcggcatggcgaccgatctgtcccaatcacttgatttaagtatatatcgacacaaggattatatattgttaatatctatagccgatcgagtagatttaattttttcttacttgttcatgattgccgatcgatctatatatgacatcggctcaaagatgaatgatatgtcatcggcaattagccgatcggctatcgtttatggatttaaccgcggtttctttgtctttatttcttgttgattgcaggatcaaatcaactggcatgctcattaacctaaaggcaagatttttggacctacactgaagttaagcagatcttccaggcctcgtttttttacatcaacaccgagctagttatgttctcatcagtggacacacgttggggaacttgttgttggatagacccaactcgagacactgcaagagccatatgtgttgtgtcatcagtgatttcatttagtgttggtgttgaattcttagacatgagattatcatggttcccaacatatgtagtagcttacttagggactgctaaacgctaccccataattgggtagttataaaagtagttttcgggtatgctatgaaacatgtagtgggatatgaataatcatagtgtgatttgcccctcctatggagagatatctctgggcccctcaatgttatagattatagagtgcatggccatgccaaaggtgattgaggagtgtcacgccctaaaaatcctaaatgtataaactgttgtttaattggaattgttagaaattattttaaaagcctacaagctaaactctaattttctaggaaaattttcaacataaaaatgagctccgtcgttccggagtagagcgtttccattgaggaaggttccgaagcgtttgcggaagcccaaggcaagtcacacagatcccaaacaaccctttgagcatgttgaacccgtttaaagctattattttatttcaacttatgcattattttcgaatgtcattgggtggtgaacctttcccagttaattgttggccgaagatgactttattttcctatgggttataatttgattagcatgaaccttatataatggattggtccagctaaatgctatatatatgtttgcttagccatgcttagaaacattagctaactaaagggattaattataaactatgttatatttttattaatgatggttatattaaatggtagctcacgatggttaatcgtgtgaggttaattaattgataattaaaacctggttaaggtgggttgtgagcatatggttttgatggttgtgctcatgacaattaaggaccggttcgcgagctactgttgtgaaacatttatcgtgccagccacaagccagcgtgggcaacggctttatcttttgtatagcgtgattcattatagtgcgccagactgagaagtggcgagaagtccacgggggtcgctggggagtccaggtgtcacgaccggaaataacccaacgggcgttcctgacgtgcgtgcattaatccttgtcccaggaggcaaggtacaccaaaagttgatacaattcagagttcaacaagcggaagcgtaaatagttaacttattacatgggcagcgaaggcccagcacacacagagacaaacgagaaacagcggaagactagggcgacgaccacaggcgcttgacggcaggcacgagctagacaccaaagccttcatcttcaaggagctcctcttgtgggcttgggaaaaattgagcaagactgagtacaaccaccgtactcaacaagacacacccacaaatgcagaataaatgcaagggagtacaaaggaattatactataaaggggttagggttgcagtaaacagcatttaaagacgtttagttgctcaaagctattttgtaaacacgattctcgaactatacaatattaattatcaaggccgtgaacccacacgaacctgccttaacccaaggcctatgatgattcagaccgaactggcaacccgaccctaggtcccagctcgtcccaagccaacccaggccaaccattccacattttagttg

SEQ ID NO: 38954 - DNA, 808 bp, Oryza sativa
ttcatttgccctggagaatgtctatcgacccccgacttcatccatctccaatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagaaggagcggtgtgaagccaattccacaataaccaaaccattccatagtatccagatgatatgaatatttcccaaagtctatagttgaaaaaccacctaatgttacctaattaaattgcgaagcatctacctaaaactaaactagtggtgccatgagtagagtgtccactagttggggttttgtttattctagggtgaacaaggtaataataacaataacaataataataaggtcataacaaaggtaaataggcatggctaaataaaacagtgataacgcgggaatttaaataaagcgataatgcaataatttaaatcaacataattttataaactgggattcaatatgttcaaagatgatgtgacttgccttgctcgctttcccaaacgtcggcttcaacttccacgaagagcggatcttccgaagctgcagcgtctacacgaccaacggaaaagaaaaggcttttactctaataaactccatataacagcagaaacaaagcataaaaatgggttcttggcttcataaggaaaaattagagacttgaacggtccaattccgagttcaaatggcca

SEQ ID NO: 38955 - DNA, 745 bp, Oryza sativa
ttcctgcttcgtctgactccgacgccgacgacgaggatgatgccgaagaatgtgatggcgaggaggaaggaaggaaaggaggaggtggaggctgtggctgataaggccgcgggtgaggcggtcgaaaccgcgccgacaccccagggtacactcctaccccaagtcctggtaacaacgaaaccggggtggagtcgaacagctccccccttcgtcggaaggatttggaaggggcgaaggccctagttgcgttctcttcgggcgcggcggcgaagggaggtcctatcaaaaaggtggctaaaacgaaaggactcgtcgatgtcgctcgcgtttttagcgacaacgagtcctccgacgggactccgacttcgcccactggtcgcagcctggatctttcggccgcccccattccgccaattggcgccgctggagtggatggtagtaccgccgctggggcttcggcttctgcgtaaaggattgtgacggccgcggcgaaagtattcggcaatcctccgcatcagccggttgcatcgccgctgatggaggcgaagggaaagagagcggtcgctgagacgtccgctttggaatattcgctctcggtaccccgcttcgcccctggcgacttcgagacgcgagcggacctccttccttttgtggagggggtaagcaatcttgtactgcccgccagtgccccaagcatgttcaccgaactgaatgagttcgacgaggggtgctcgcctggctgttc

SEQ ID NO: 38956 - DNA, 891 bp, Oryza sativa
ctagtcagacgcgctacccccgcgccaccgacgcgcggacgcgctacagtcgtcgccgccgacggagctctcctagtcagacgcgctacccccgccgccaccgacgcgcggacgcgctacagtcgtcgccgccgacggagctctcttagtcagacgcgctaccgccaccgccggcgccgccgatgctccgccgggccgccgccggggtctccgtcctcgacctcgcccgcacggcaacgccctctccttctcccacgtcgccgtcgtcaccgccgccgatgccgacgccctcccttctctcctgtcaccgcccccgccgctgccgccgccgccaaccgtcgccgctgcgccgccttcctcctctctcgcctcgcgcccactgaccagcctagtcagaggcagagaagggtgagaaagaggaggaaccgaggaggggagagagagagaggaggggaagagagaggaggctgacgtggattgtctgatatgtggggtccacgtggggcccacgctgactcagccaccacgtcggacaaaaccaggatcaaaaccaccgagggacctaaaacgaatggttttgttagttagggaacgcccagtatctggttttgtgattgagggacgattttgtatctcgataacaagttgagggaccttgggtgtactttttccttttaaaaaacactcgtctccgtcgataaaaaaagagagcaaattttctatattataaagagagtcagagggcaactcaatgataacactaagggcctgtttggcacagctctagctccagctccatccctcgctcagccaaacagttttagctccactaaaattaggaatggagctgggtggagctctctcacaaaataaactagagttgtggagctg

SEQ ID NO: 38957 - DNA, 2804 bp, Oryza sativa
  unsure (1)..(2804): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactaaacttctctaaaaaaaaagtgattgtaaagtcttacgttggcacatagcttaacatattgaggatgccacggtgtagctaaagggttgaaatcatctagtcaaattaacaattggatcatcaggagtatgcctatctaacaagccaaatcatccaaacaagatcgaagtagcttattcacctgtactgtggaaatcaaaatttctagaagaaaataacccgaatgctaatgttcatacgattgcaacacaagctaaattctgcgcagcaacaaagactccacggcttcgaaactccaccggaatcaccataaactaatcgaacatgccatcacatctcgtggcataaacaatccgagtaaaatggaaacggactgaaggaatcatgcatctacgcgattgaagccggcaacccatcgaatcatgaaacaaacagcaccataaccaggcaaagcaagcacgcacgcaggcagcaagagagagagagagaggaaggatcgcgaagcataccagaggctcccggttgcgggctcccatccttgatccgcgcgccccacccacagcaattccccatccccctccaacaagcgactcgcccgcggcgccgagcccagtcaggatcgaaccaaccctcccgcccgtcccgacccggcggcgccgcatggggtgaggggggaggagagctccacctagggttttgggggacaccaagcgcgaggcggaggcggaggcggaggcgttggctatatagcgacgaggacgaggtgcgctcgctggcgananatgtggcgtncggcgcgtgaggtgaggcgagcgagtgaggagttaatggcgggggcaagggaagcggccaagcggagagggagagggagcgaggcggcccgcgcagccacgccgctgctgctggctgctgctgcttcccgcgtggcttcttccggggaaaagggtggttggtgacggggagcgtggggaggaggagaggcgtcgtggtgcttggtgtgtgacgctgccgcgcggggaccaccgggcctccgggtgcgacgattttttatctttttaccgcttcacctctccgagttactgcgcgactctgtgagtgaagttacagtgacgtgagactctgtgggctttggcccggtaggcccactaattttattatgggctcgacttattatgcgtgagcatggcccaaataaaattgtttacacgcctgggaacacctgtaacttgccctccaacttatcaaccgcggcaaaaattaaattttacaacttcattttagagtaaagtttgatgttttttgatcggtgtttattttttaagtatttgcttttaagttgttacaaacacatataaatgttttacgtataacttttttttgttgctaacaagtgttacgacatctaattagttgtaggtgaaatgtacagattattttttgatgttgtcgtaatagatttctgtcggcaaaacgtgcaaatatcaaaggaagttttatgtaagggtggagctaatgtatttccgccaaaaaattgccctatgaagtacctttggtgcaattttaataccaacaatacaacatataacgatctctttcatttggattgcgatattcctttttcctccaaattaaattcctctgttgtaaagtgggctttcatgcctagtgtagtgtatggaaatatcttgatttcttgagcacaaatataaaaagtacgtacatattgtatgtgacaaagtgtacagatcctttgaaacacaaaaatcgggatctcaaaacacatagtatggatttgcgcctttgaatggtctatccaattgttcagtgctacagaacatctatttagcgatgtattaggattcattccccttgaactctgtctttattaataaaagtttatgagttttttttaaaaaaagaatggtctatccaattgttcaaaaggaatttagggagaaaaatatcctaaaaattatgacagtttaatcttagaaaaactgatgtggcacattgtgattcaatcttgatttttataactatccactaattaaatctgacggttgagattcttttgtgtgtaagaatttagcgtatagcatcaaattcgtacatgttgatgggtgagagggtataactacataatatgcctcactattttgtgtggggatactgtaatcccaattgtaagatcggataccgtaataaactggtaaaactagacaaaaactatcaaatatggagtttttgttttaagttttttttaatctaatctgtttctgagctattaacgttaccaaaaccttgttagtacggtaaatcatgttgcacactctgaaccgatcttgcttgatcatgactaaatacgaatattaaaccttcgtgatacaatcatctcattttttaaattcgagtaatttggtatatgatgcatttgttctactccaagtaccttctaaccgatttgaaaatgcttaccttaaactccactactcaacaactactagcgtggttgtttctcttttgacaacccgttcaaacaaaaagagatgggaaaaaaaaaaccggcctacaacctttgggccgggcgtgttgaacccttcggacccaggcagatctcc

SEQ ID NO: 38958 - DNA, 22730 bp, Oryza sativa
  unsure (1)..(22730): unsure at all n locations
ttgttcatttgctcctgtaaactgtgctaggttcgttgcccttcaatttacgaccctgctgagaagtacatttcgttgatcatccccgcttataacgaggagcaccggcttcctgaggctctcacagaaacactcaagtaaggctctgatatgagcatttcctgttcctgttgctccgttgtttggagtatctttgaatgatacagtggctgtgttgttctggtcattgctctgttatgttaatctctgtgttcttttgtttctctggtagctacctgaaacaacgttcagctgtcgagaagtcatttacttacgaggtatgtcagggcagaacatgctaacagctttatttgacacagtaatacatcagggaagaaaacgttaggctgattttgcaagcaaaactaatcaagcgtaaatgagaaagtatgcatttcaccatcatgagatatgttagcgagctggttaatcacttcgccacaatggtgacaccgtggcagtccattagtcttgcaatagtaactgtttctatgtcatatattcactttttacctgagatatatcaatatcttgtttggaatgacatttgaatcactgaatttgttagctaggaaatgcacagtgtgggagccaaacactattgatccaataaagcatttacctaaactggtgtgtcaggttgctcggaccttaaagataggactttgtatctagggtagtgatgttttgttgataccgcttgctctttagatcaattgagaccataagctatgatgcctttgcaatgcttctgaacatatcagccatatctctcaattatatcatgctctttaaacacatattatgtataactcttattaacatttgcactattatatactgcataacaccataaccagatatttggcatattattattgcagaaccttttattcataaatcctgcttaaattagctaacattggaaatcggagaactgatttgcttttactgaatttcataaaggtcttgatcgttgatgatggaagtactgatcatacatcaaaagttgccttcgagtttgtaaggaaacataaaattgataatgttagagttcttctacttgggagaaaccatggtaaaggcgaagcagtcagaaaagtgagtaaatgtaccagtcgatcccccccccccccccaactcccctcactagttcaataaacacacccaccctcacccaaactagttcaatgaaataagcactgattaattctttcccatctgtggaaaaattgtacagggcatgctccattcacgtggtgaactgttactcatgcttgatgctgatggggcaactaaggttactgatttggaaaagcttgaagcccaggtctgtcataagttaaatcaaaacatgttttataaagttttgttatgcatactttgatcgtgattggtaacatcttggaatcatatcgtgctcctaggttcgcgcattggctaaaaaggctgagtccagcctagcaccatctagcagtccatctcagagactatctgatgctgaaattgctgtttttggttcacgtgctcatctggagaagcaggctcttgccacagtaagtgccccccaccccaaaacaaaaaaccttttcaatcgtgcgtttttgttctcttagattttcatgttgtgttgtatttgtgcttttcctggcgtactgcagaggaaatggtatcggaattttcttatgaaaggtttccacctggtagttttattgacagctggtcctgggatcagagacacacaggtatgctttgcaaacataagtcgtaccattaattcatgtggacagttttgctttggtattgtgctatgaactaaattccattttcttattgctaatttagtgtggtttcaagatgtttactcgagctgctgcaaggaaactttttacaaatatcagattgaagaggtacctttgttgttatgttctctaaatattgtcatgcttctgtttatcaaatcctgtcttatttttggcgtgtaaccaggtggtgttttgatgttgagcttgtatacctatgcaagcatctcaggatcccaatggctgaagtatctgtaaactggactgaaatacctggatccaaagtgcgtatgacaagcatcctgcatatggtatttgagctcctgctgatcaaagtaggttatggactgagcatatggaaaatctattcatagaccatatgcacggtacgctgacaatcaccatagcttatcatcactggactgtataccaagcttagtctcacatgtaaaatttttccaagattttcacctagagagaatccatttgtggcgctgagtattccatcatagatttcaacaaagatatagatcacgtgtattgttcctgctgatgaaattctttaatcatttttttagcattttacgaagttgggaagaatcgaaaatttgactacccttcatgtttgatgtttgatttgacggatcgttttgtttttaaaaaattggcttgaagtactatgccttttggatggtctgaatggtgaataatggtaccgatcatataatcactaagtataccatctatatagttaaatcattagctatgtaataaatgaacaatggtgtgcttcaccgtctcggagaagactgtcaagaggttttgttgtctgccatgtaaaggtttgctgagaattacagaatgtgctccagaagccattttgtgaaaggacttgagctgatgttataggctatcagttgtatggcgatgttggtacagattcgactgcctatatacttctgacatcaccaatgcggtttttttagttttcacttaggctgtgtttagatcagtacaaagtttggattttggttgaaattggagatgatgtgactgaaaagttgtgtgtgtatgacaggtacatgtgatggaaaaagttagaagttggatctaaacacagccttagctattcgctccattcctcttcaattcattagtatttgagttgcaataaattatagatgactgaacatttacactctacaggtctaccggactttctggtagattatactctctcagattcttcatattacagtacggtatcatgtatcagctgaatatctcagctggcaacaaaagcatctcttcttttatctctttaaaatatgtttatagctgccttatagtatgctatgtacctgctctaaatagcttaataccataccattatcattaagtataccatctaggaagttaaaacattaattaataaaataaatctattacagttaactaaaggtattatacaagtcggaaagattggagtactaagggtgtgttcagttcatgccaaaattggaagttccgttgaaattgaaacgatgtgacggaaaagttggaaatttatgtgtgtaggaaagttttgatgtgatggaaaagttggaagtttgaagaaaaattttggaactaaactcggtctaaataacagttgatgtaaaagcatactaatattttgcaaagaaggccccgttgttttcttattgagatgtacagtagattctaccttggtttctattatcatgtttttcaaaatattaaatagtatgtttcgtgcaaaaactttatatataagtttttctaaaatatctaataaatttattttcaagtttataataataaacatttaatcaattataccctaatggcatccgatacaggagtactatagtatccaagagacgagtgggctgatttgcgaaaacgtattctgaaagaccaaaaccgagccgccctgcctcggcgcgccatgtgttcgagcaaatgcctcctccagtctcctccccgtcggctccgcgcctctcgccgtccgcggcgcgcgcggccgagcagcattgcctccgcctcctcgcggcctcctcgacgcccacgtccctcctccagtcggtcgccttcctcctcaagtccggcctccacgccaactcgctcgtcctcacccggctcttcgccgcctccgcctccgccgcgcccgcgctgctcgatcccctcgtcaccgccctcctccgcccctccgtcccgctcgacgccttcctcgccaacaccctcatccgcgcccacgccacctccccgatccactccctccgcctccgcgccgccgccttcttccccctcatgctccgcggcgccgtcgttcccaacaagttcaccttccccttcctcctcaaggcgtgcgccgcgctcccgggatccccggacgtcggcctccaggcccacgccgccgctctcaagttcgggttcgcgacggatcagtacgtctccaatactctcatacacatgtactcctgctttggcggcgggttccttggcgacgcgcggaatgtgtttgatagaatgcccaaggagagtgccgttacctggagtgcgatgatcggcgggtatgtgcgtggggggctgtcgagtgatgctgtcgatctcttcagggagatgcaggccaatggggtacaggccgatgaggtgacagtgattggagtcctggcggcggccacagatttgggtgcacttgagctggctcgatgggtccgacgctttgtggagagagaggggatcgggaagtctgtgacactgtgcaatgcactgatcgacacgcttgctaagtgtggagatgtggatggggcggtggctgtgtttgaggggatgcagcagcggagtgttgtttcatggacatcggtgattgatgcgcttgcgatggagggtcgtgggaaggaggctgtgcgagtgtttgaagagatgaaggttgcaggtgttccacctgatgatgttgccttcattggggtgctcacagcttgcagccatgctggtatggtggatgaaggctgtggctactttgatgccatgaaagtggagtatggcattgagcctaagattgagcactatggttgcatggttgacatgtttggtcgggctggcatggttgagcgggcgatggaatttgtccgtacaatgcctatacaaccgaacccagtaatatggcgatcacttgtttctgcttgtcgtgcgcatgcccgccttgagctaggtgaaagcatcacaaggagccttcttcatgagtacccggcccatgaggccaactatatcatgctctcgaatgtctttgcactaacacagagatggaaggagaagtcagagataaggagagagatgagcaagagaggaatcaagaaagtgccaggctgtagtatagttgagcttgatggagaggtccatgagttcatagccggagatgagtctcacccgcagtacaaggatatataccggatggttgaggaaatggcaagagagctaaggcgcgttgggcacattgcagctacctcagaggtcttacttgatcttgatgaggaagataaggagggtgcacttcagtggcacagtgagaagctggcaattgcatttgcactactgagaactcctcctggaacacaggtccgagtggttaagaacctacgtgtgtgctcggattgtcatgcagctataaagtgcatttcacaggtttatcgacgggagattgtagtgcgtgaccggagtcgtttccatcgcttcaaggatggttcctgctcatgcaaggatttctggtgatgaaattgtgttttacaaggttattctgttttggacaagatgctaatgaattttccagggagctcctgcaagtctcacacatctgcattgcaacacaaaggttttccacagaaaaatgtgatgcttattcaaggacgatggaatcagaattggaatataattcaggtacttcttcttgtaaactgagtcttcttgatacatgcttttctttttggatcagctgtcagtataattcataacttttatgcaaatgaaccgtatgcacatccccagttcttgcatcaaaggttgttctaaaaggcctagagaaacataaacaaaaatcactatgatgctaatcacacaaacaaaaatcactatgatgctaatctgtgagcagtccaacatttttatacagtaacacactcagaaagtgtgttctggattttgacagtctatctgaatatacggtgcccacatttctgatgcacaagtcttcatcttatttaggctatacacaagttttgtcttatttcaaaatatgcataagcttcatacgaaaatttggaaatttcatgatgagcacaagttaattgcaaaaaacaaattaggccatcttcaagtgcagagggttcctacctcatactcccaccgtcccaaaatataagggattttgggtggatgtgacatatcctagtattacgaatccttatattttgggatggatggagtactatttattctgattgccgttttcatgtttttctaattttgatccatgtttgctgacaataattcacttgattttgcagaaaatatcaattatcaaggttgaacttttcttttgtacatacaccaatagattggatcgatcaatcctgaggcatcattaaattttgatctctcgacagtgtgaggttatggattctgcccgccgcatgcatgaaaatgggatcttgatctatctggagcataataaatgactggtgttagccccatggcttgaacgatggttcctgctgcaaagaattccggtgatggaactttgattgaccaaggttgtggaaaaccaaggggagtgctacgactttacgacagacaagaacgttatgtttggaggggtggaattttgagactagattgggcacatttcagaagaacacgaacttttctttttattttttgccctaaacaggacagcatgtgagcttggtgggatagagttcggtggttgctggtcggaaatgagatgtaagatcatttgaagaactgagagaagaacatggtagaattgcagagagccagtgacagataaatgaagtatttcactatttcggtttaacaaagacagatggtaattggtgacaagctaaagacagatagtgacaaaagattgccatttgatatatggtggtctattattgatgcgttcaaatctatattttctgcggacacaagttaaccaggctgtcaaaatattccatatcttccgccaagctctccatggaatgcacaaagctgcggagttgatctatttcaaggtcacattccataatctctttgtcggcgatggctctgactgcatcgaggacgccgtaaccctgtcgctcagcttccttgaggacatcggcccagcgagccagccattccattcttcttatgtcaagtactggcacgatctcgacggactcgccgatatcaaccaaggcttgttggagtctttcctctagttcatggagtttccaggaatctgctccttcaggtagggaaacgccgtctacctgagcgactgagtcataattatcaaatgacaacacttccatgtcgttaaatgacaacaccccccctttttttaatacgcgaggagcatatctttatattaagaagaaataaatatatgtacaaagcggacgaaaaaaacaaagcgaaagggacagggtacaggaggagaaccaaaaaccaaaagcctaatcttctactaaaatttgcgacccttctccactaacatgggctaccaaaacagggattgcagctctagctaagccgccacagctccgcttcatccgttataacccttgcaacctccgcccaagttttgctcttctggttgaagacattgtttttttttccttccagatcgtccatgcaaccaacgttgcgatggtgttgaaacctcggcgatgttccttgaccatcttcttacgacagtcgcacaaccatgaaaataaagagtgttcattgagcggtaagcactccgaatgcccgatagctctgagcgcaacccaccacagtagccgcgactccgggcatgcgaccaagagatgatcaatcatctcttcgcattgatcacaaagaacacatcgatctgagtgcaacaaaccacagctccggaggcggtccgctatccagcaacggttaagggcgaccaaccaaaggaagtagagacggcaagggggcgccaaagattgctaaattggcttgtgctggagatgagttctaccaaaaaagagaacacgataaagccgagcgggaagagtattctcctgaggtctcccaccgctaagatagagaccggttcttcggaaagctacactgaccgaaggcaatcccaaagcttaaaatattccaggatcgcttgagtacccaacaccgaactgatgtcctggatccatcttttgtcagttattgcctcggccaccgtgcgatgattccggagacgagcagggacggctgcatagacagccaacgccagcgaccgaatggaggaaccctgcagccagcaatcctcccagaacaacaccgaattcccatctcccaccaagcatacgtggaaatcgatactagattgcgcttcttctgcgagaccggaatattaagcccttgccgcggcttttccggtgaagttctctgctgccagagccatctcaacctcagagcgatttccaacctctctagatcggggatccccaaaccaccatactccttgggcgagcaaacttgagcccagacgacccgacagacgccgccgtttgcagaagctttgccagcccaaagaaagccgcggcagatcttgtcaatccctttgataacccacttcggtgcattgatggccatgagcaggtaaacgggaattgagctcagtacaacgttcaccatggtagcccggccaataggcgtcatcaagtgagacatccaagaaggcaaacggcgcgcgattttgtcaaccagcggctgcaggtcttccttcttcaggcggaagatggacaaaggcaacctaggtatgtgcaaggaaaggaagcgacgtgacatggcaactcatcatgaagagtttgaagatccgtctcattgcactggattggagcgccgaacatttagcaaaatttgttcgaagaccagacacttctccaaaaatggcaagaatttgcatggctgtgcgaatctcatccacagctggccgtataaatgcgaccacatcatcagcatagagggatacacaaaaaggaatccctagcggctgcagcaaaccttcaacctcagccttggagaagatggaactcagcacattcatggctaagataaaaatcatcggggaaattggatctccctgacggacgcctcgccgatgcaaaattgggcagcctggctcaccattgattaagaccctcgagctagttgttcgaaacaacatggcaatccatgagcgccaccgaaggccgaagcctttgtgctccaaaacttccaaaatgaattgccatgaaatggaatcgaaagcttgggcagtatcaagcttcagcagcgccgatggagtccttcgatcatgcaagcgtttagctgattgccgcactagcatgaaattgtcctggatgcaacgtttcttcacaaacgcactctggtttttagcgaccaatgcatccaacttcggcgcaaggcggcgagagagaacttttgtgaaaagcttcacaaagctatgtaccagacttatgggccgaaagtccttgagcttcctggcatccgacctcttaggcagtaaggtgatgaaagccttgttaaccttaccaaggctggacccatccattcgatgaagttgattcaaagccgccataatgtcctccttaatgatgtcccaacagcagtaatagaactgaccagaaaaaccatccggccccggggcgttgtcacgagggctgtcagcgattgccttccacacctcatccacagtgaacggttcctccaagtcagagagctgctgcccccttggctcaaagtagtcaagatccaccgaaaactcacgatgactgacagagccgacttcagagaagaaattatgggcaagggcggccttttcatctggggctgtggcgatctgcgagttgtgctcgatttgttgcacaaaattctttcgacgccgccaggcggaatgctgatgaaggaatcgtgtgttggcatcaccttcctgcaacctaaatgacaacccttccatgttgtttgaggacatttggctacggcgccgctttggattcggcgaggcctctagctggagcaacgctatgaactccccgatgttcgccgactctttctccagcgcctccacggcgccgttcagcttcttcacttcctcgtcactggagaagagcgcgatggctatggtgatgacgcgctgtgccatgcctgatagggccttccttttgaaggacaaagcagtagcaggcacagaactgctactgctgccttcctcctgctgctgctggtggtcgctggcgttctgaccagtggcttcgtcgacgtctgcttcccgctgctggaagctatggagaacctcctcaccacgggaggcggcttctttgagcttgtcctgccactggatcaacgcggcgctcttgatggcgcgcttctctgacacctcgatcgtgctgtggattttgatcagcagcatctccagccgctggagcttctcggcggtggccgtttgctggttgaagttcttgagaatcttggacaccgccctgtctgcgaccacggcggtcactgcggtggtgatggagcggcgggaatcgaacccgtatcctctcctcggcaaggagatgttttgccgcctgggtcgaccgtctatgtctgggtcgaccgtttcattttctatttgagttttctttttattaatttaattgtctgtcaatcaattcggggtgcaaattgcattttaatgcgtctcacaatccgaataaacggcccttttttattttgtattgggctactaaatactaaacacatttaagaaatgagagaatttagaatagctaccagaaagaccagtccaatccataatgatgtaccggaaaatacaacgtttttattgtttgaccaaccatcaggagaagcaaatacaaggggtacactaatgactaagactgaggaagtcacaattaatgcaaaaacagctaattggaaagcaatagtcatatttctaatcctccaagttaccatcaaataaagttgactacatattatatttgatccctcacttaatcaaaattgtaataaaatacaagaagtaagaggggtttaatcatgaatccattgattcttctctttaaaacttattactcaccactttttttatttggatatggggttgagggggttttatgctttatttcacaagcggatatagcggatcctgtatacatggatacagtatacagaaatatatcgaaaagggacttgtattcgagatgtttctagaggttagtgagtcatttcgtatggctatgttctatttgtaggaataaaataaggattacgctgtggagagannnnnnnnnnnnnnnnnnnnnnnnnnnnnnnnnnnnntatagttctaggaactatcgagggttcgaatccctctctctccttttgctttcctctctctcttttcttttgcgtattgaatacgtttgtttctttatttgttttttttgttttgtccccttatctttctttcatagaaaggaatgaatggctcggctagatagaatacccgagccagaacagaaaaaaacagtagaaccctagattgtttcttatggccataccgcctgaaggatttaatagggacttggtgacacaaactaggcgtgccatagacatagttggtgtcatcataaggccgaccctccatttatatttttaatggcggaaatgggccagccctgcattttttttaaaaaaatggagctacttcacatcagctaagggcctaagaactcactcaaggcatataagttccatcgccattattttgtccctttatagttgcacaacactacacaagggcatcaagttagttccacgggcaaaggtccaccaagaagttgaaacatggcatgtccaatgccaacctatccacagtacgcgcaaagccgtaaagatcatctgctttctcactgccagctttgccatcgccgtcacggccggcgaagattgtgccaacaaggacgttgcctctctgctcagcctcccgtagaatagccgcccactgtcccagccatttgaaatcgtccaagtttctttcatctgcctcctcgacagccctgcccatacagatcagcacttgttctagcatttcggcgagctccttctgatcctccactagcacctctgtattttcaagctcctcactcgtgatggtctcctccgtctttttagttgatatcttcagattttgcattggcaatgtctgggtggataatagcctatgaagtgacatgacaataggttcagaactctcctcctccgtcttttcagttgatacctgcagttttcgaattggcaatgtcagggtggagcatttggttcttcggtcgaactcaatatgttgagaacgcttcatccgtttgctaggtctcttctccagcttcggtgagacctccagtataaactcttggatatctggagacagctcccccaacctctccaacgatccattcagcttttccatgtcttggtcgctcgcgaagagcgccttcatggcgctgtgcatccgccgtgccatgccagagagagcactccatgtgaagaacacggcaagggatgcgccggtggccacgccggctctgctgctgccgccgccgctgctttgctgctcatcatcggaagccgcgaagcgcccgataaccctcctcgacggcttctctgagcttctggcgccactggagcagcgagctgctctcgatggcgctccggatcctgagcagcagcacctccagccgctgcagcttctcgtgtgcggtagctggcgcctgcagcctccgcccaacggtggatatcgtccggttagtgatctggccgaccaccgcggaagtgactgcttgttctgccatctctcggtaatgttaatgttaatactcgtcgagtgatcaatctcgccagagatcgatatatatacaacaagtacgttatattctggagagaaaaacgtgagcttgatcttactagtttcatatatacacaacaagtacgtaatattctggagagaaacgtgagcttgatcttactagtttccatcgccttacggtgatgctcttgggacagaggcagacaacaactgcagattggctgggcacatagtttgtatcgggctaaggcctgcaagaaataaaatggtcgtaacgacgtgttgagtttatcagtatgacagtatctggctgtcctatttaaaaaacgccagcactgtctcatctcggcttcttggatgtactacaatgcacaagcttcttggatacagaggagcacagcctcacgccctcacgtggagtcacggttctcatagcatagcgcgcagtggacacgggtgattccttcctgctgctgctgctgatttttttggtgaacgcgtaaaaaaattatacgtcgatatattagaggaaaaaaaattttgttacacagtacaatcgctgctgctgggctgcccgctgctgtggaagctggggagagcagagagcctcctcgccgtgggaggcggtctttgtgggcttcacacgccggggtggtttagatgggccgcaacggagcacgtggaaagtgaccccgtcccaaggcctcttgtaggccgttggaagagattacgcgaaacatatgggcctcttttcgccgatgtgatgtactcaacccacggtcttacaatggggcacggcgccaaccagcaagagaacgaaacgctgctgatccagacgtcacaagcgcaagaacgctagccatctaccaccatgtacagtagtaacacgacgccaacccaaagcttcgtcaaaagccaaggggcccctcgtactacaactctctctagatcgatcgtcagttctctcgctacgcccggcgagaacaacggcgaaagccggaaagagacgtgacaccgccgttccccaccgcacggggcgttacgaccgtttcgccgtagcaaccaactcataatcacacatccatgcaaaaaaaccgatcgagctgtttcccggccgtagcagcagcaaaagtcaatccctcacttctggaagcttacttaacatgcaagtaagaaaaacaaaatccgacgcatgcatcgatccatttctttaatttacggtcaaatcagtcccatgaaaaccaggaggatcttagtagcttaattatctgttgacctactgtgcatgtccgtaatttggtggcgctggcctgaaagcttctccagttctgactttttgcaggcagagtgtgtatagctagtgctctgactaatccggctctcgatcatcagctgatctgcttcttgctggaggtttaactgtgaaatgatggtgtctgctctgcttttccctttgctccttctggaaaggaaagcataaacattgacataatgacaatttcagatcttagtgacgacttaatcttggagatcttgcatgcaattatgtcagggtcaaactttaattggttagtttagtctcgacctctcgttgtgtgcacctcacttagaatggtcagctagctaccatgcttgcatgcatacatgaattcatatatatacaaactggttgaacaaaagctagtagtagtagattagtcagacacttctcctttcgtttaattttaggtgtgtgaaatggtcgttgaacgccaaaatgtctaagtgggcttgcacgagttcaacgtacgtaccaccaaattagctttcctagtcataaatcacaaagtactgtaatgagtactaaaataagtcagctggtgtcatcaattatatattttcgtactccacgattagtccatatatttaatttcagtggctgactaaaaacgcaagccaattatagcttttccagtacacagtattataagcctgtcatatatacacatgatgttgtttcaaaatactactacaaatttactcgtatatattgaactacaatcaagatacatttgggtatttcctccgaccagttcgatttttatagcttctttagtaatagtaacccagtttggtttatgagctatagtgaaacgttgaaatcaatacaattgccagacaaagttttttattaaaaagattgagactacaacaaccaagtttatttatatacggcagctgctagcgcacgatttaaatatgcaactccatgatccacatttgactacaaatctacaaactaatttaataaatactagtagcaaatacattaactattgagtcaatccatagggagcacgcctatgtagaccttggctttgtttggaaaaaaaaaagcaatatgttttttgtttaatcccgtatgattgttatttgcatgccgacgtgaggatcaacctaatccatgttagcatgatggatgcaaaatgcaattaagtatttgattagtaggccggagttagtgggtgcttaccagtgtgcacacttggaccttaactttttcttacttgaaatactataaacaaattaaataaatcctgctcttagtaatttgaattatgggggtgtcgtcaaccatgcattgataattaatttaagaggccatcacatactagggcattgacttgtgctactgtcaatccattggattggattagttgtaacccacctgttttaaaacttttgatttgtatttctttttaggtcatcggaaagataccaagtacaacaaaaaatgttggtgcctcttgtcggctcttgttataatgtcagtatggtaaaagaaaaactatttgatttatggcagatacaaattttgagctggtgaccagctcgagatcaattgcaatgtcgtttaatatatattaaggaataatgattggaaaagaaagtcaaaacgatttgaaaatataatatgcactgtattgtatcgtacgttttcatgaaaattcaaactaatcttttacgtatctgggtcggtacatcgatctgcttaatctgtattgaataccacttgaatgttgaagcccaaaacgtccaacaaaaacagatcaatgaaaccaaatctcaccagctctgtttttttttcctcttgtacgactctaattacgtgacgtattaattttatcaacatgttaacacagagttgagaaatacacatgacgccacgatttggtaaactgcctggttggtctccaacatctgttctttgaccaggagaaaaaaagcaattaattaaagcagaacatatgcaagacatcaaaagggtaagtgagccttttggttaattactaagtacatttatcagggcatagcaaggtgaataattacatgtacttcattatgcatcgtgatgatgcatttcctgtactgtttgcacatgcatgcatgtggggttgcacatgttaggttaagatgttgcactgtaaagagccttcagtttattcaacaaattaccaccttttttttttcatttacctcccaaataacaagacaaagaacgccacagctagtaaaatatttcacggtgaattcagagtttggggcacatgcatgcatgaaagcgaaatggtaatgttttttttttactacctttgctgaccacagctttttaatctccaccggctgcctaaaaaaaattctgccctttgtcaaagcaagtaattaacagcgcagctagctgaatgtgactgtccatctgccttgctatcttgagctgtaaattactcatgcagtttacttgtctcctgtcagctggatagataaacaaaagccaaaacaaggacagcaagctagctcaaattggaaccatatgttcttagtattttcttgtgtatagctagtttgatggtgagctctccctttgttttccatgaatttgagccatggggtagttgaatgttggggaacaagtgatggcgaccgggaaagggggtgacctaaaagtccatccatgcatgcatatattcaatcccagctgatccccacgacaactgtagtaggagtatatgtttttacaagtcaacgatcaagacgagagacgggtcccattgctgctccatatgttaactcatatggtccagaacactcatcttagccatagacccgaatcagattctttgtaagaggtatatatgggcaatatggccgtataggtatcgagagatactagcaattaatcttgtcaaaatgtcaattatgttataccattttaggattctactcttctaattaagtgtcctaattctacaattctagatattagtatagaatatatgatcttatgatcgtacttagagacctgattgggtttaatttaacagccttactaacagttactagcactagaaagtgtcaaaatgactgtcactctacaaaagatgcatccttaaacactatcataaatatttaacgtttatgattaaatttagtcaaatgtttaaaatttaaaccaccatcaatttttaaatgcttagttagtggaaaaaatatggttcgatatagatttagcttaaaagacaccatctaataccaaatatttattatattttttaaaacataatacaaacacaggctttgaaacacacgtgcactgatcatcatcaaagtttcaaacttttaataaaatcttgtcctagcgtatttacaaagacggagtatattaaaaataagaattctctatcgcgcttaccgctatacagagtcgccaaagaccaaagctgtcatgttgttgagggcaacggacttgatcgccgtgcacgaacggttgggagcggcctgcggtcggagaattggacgaaaattgccagcggcggtgcgtcgtttcccagtccattttttgttgttgcgctccggttgcttgcttgcttgctttcccgtgatgcagggcagcaaaagctgcctccgtcgcacacacgaccaccatgccttgctctgcaaatctgtctttgcacctgcaccactgaatttgtctatggctcttgtctactctacgcacgcatgcatgcatgaacacattaataattttgcttctacaaatcttacgaaaagaaatactgaccattaataataattccaactaaaaccattttttttcacattaggttctgcatgtatataatttcatgaattatgtttaacatggtttgggtatatatttggaatacgtacgggaaataaactaatttatgaggcgattccgtgagatctcatggtacaaaaatacggagtacgtgtgatcgtcatgttgacttctccaaatacaaagcgtcatgcaaccggtacctatctcggtttaccgagtttgaataattaatacgaaaaggtaatccggcgccggccacggctcggaaaccacacgaacgcggtcgcgtcatgggccacagaaaaaactcgaggttattccacactcacccccatcgtgatccagtgattgatcatcagtagtaggagtacgtgccacgaaaggagggcaaaacgaaatgtcgtctcgcgcgttttgtccccgcacactgttgtgtttcccctttgacccgggcaagcaagtaagcaagcaagcaaagcgttcgcgttgccatctactcgtacgcacaacgcgttggtggtcacctgtcgtcgtttgcgccggcgcgtttctgccggtgtttgtcacgcatctgctcgtcaaattcttgcctatttccccactccccagcgagagagcgtgctgagcgaaagcgagacggagcagcaacgaaacaaacgcattcggccagagcttaggtgactcggatcggatgcctttggaatttgcaggaccagatcgttggcaataaagcggtactgcggtagggatccaattggacctgagaaaagcacgtgcagcaagtagcaccagtgtgtgactagtgcagcttgcgactggcacacagcgatatgatacagcgtgctgtgactgtgcgtagctaccaaaaatggaaagcaggttgaaaatgggcacatggaaaagcgcagctggactgttgagatcgaagtcaatactccctccgtccttaaaaaaaagataaaccgcagttttctgtgccaacgtttgactgtccgtcttatatgaaaattttttataattagtattttcattgttgttagatgataaaacatgattaatactttatgcatgacttatttttttaatttttttcataattttttttaaataagatggacggttaaacgttggatacggaaatcagggtttgtcttttttttttaaggacggagggagtactacttacgcaactactactaccgctggtactagtagcgttagatttgatatatatcgagcagcaaccaaccggcgagttccaaaagcctccgatcatccaacgccggccacacgcgagcgtacgtgcgagaagactctgaccgactcaaacaacggatcctgaaatcatctattgtggacctcatcatcactgacccccgacaattagtactaggagaagaggggggaaaaaaagatccaaccgtcccgctgacttgcggtgtgtggatagcagaaagcgtacgtacgttacgtagcagcagcagcagcagcagcagcagtgggcgtgagccgtgaggtgagccacggcccacgcccacgcgcgcgccgtgctgaagcaggagcagtcgggatgctcgcgttggcgcggcgcccacgtgaaccgagggcgccacggctctctacagtctagtacaccccagccacacccgcggctgcggctgcacggccgatcgattcggtcacccaaactgcgtggcagcgtggggggcgcgcgcggatggacaccgcgtgagtgcgtggccgcgggcgcggcgcggcgcgacgatcggctacgcgggcgttggggttggggacttggggtaaacggggaacgcgtccagtggcggctacgcacgcatggaggagtcctcttcggcgccgcggctcgcgagtcgcgacgcccacgtacagtaggccactacgacccgttctccaggctgatgtctccggcgccgagcaacttgtgccgttggggagtaatggggtgtaaatggcgcaacgtaatactgctacttgcgagttgcgatttcacaaaactatagctacattatggattattgtcgttttgtaacaaaactataaatttaagttgccacatgatcactgtagcctattgagttaataattccctgggacatactcccttcgtctcttaaaaaaaaccttctagcaatatgtagatagagtatgtacagattcatgatagaaattcgtttttattcctatgtctaaattcgtagtcagaaaatcatttttatatgacagagggtgtacaatgctatatagatagaaatactctagaatatgtatttttcatgatactattttggtgttaatatgtggttttacgatattataataattttgacgctaaattcttagttttgttactatatgtaattttacaaaacaatttttattttttttcaaattacttcgattgctaggttttgcttctataaatttattactttcacaaactatagctatatatagattgtttctactcaaacgtactcctttctgcgaaagaaaaataaaatccttttttaagctgtaaagttgattttttttatcaatataaatttacggtaagctcttcttcaccttttcttataggcacctttatattttctatattataagatttgtcaaagcacatgaatgcatcacggtgaagaagaaaataaaacaaaattacatccatatataaacataatatagtggccaaattgctttccattggtgcgtacaaatttagtcaaactatctgcattattattacaacataaaagactattttaaaaggtatagaaaacaaaaggtgaaaaagaagaacatgctattttctttctcgatggttgacaaaggaaaccaaccgatccaagcaatggcaactggcaagacaaggtgcgcctccttcacagtgtgggccacacggacgcggggcgcagaaggtcgcatcaggtttcccgcaccgaggcgcccgcccggacccacctcccaggtcccgcggctgctgcctcgcctcgcctttggcgggctcggacgcccacacgggtcaacgcctagaggtggaaaccaccttaaaacgatttttgctacttccgtttcacaaatgtaagtcattctagtatttcccacattaatattaatgctaataaatctagatgtaagtcattttaatatttctcacattaatattgatgctaatgaatctaaacatatatatctatctaaattcattaacatcaatatgaatatggaaaatgctagaatgacttacattgtgaaatggatggagtatatacttataggcaaattttttttaaaaaaaataatagacgtaaatattgtacaatactacaatcatagtgtaattatattgtgacatgtatataactataatataatgtaattcgtgcaagagagaaaataatcacaacccacacatgcgagggaattttaggtggtgttcttttcttctaaagataaagatgaagattaaattttttttatgcaaaacgaggtggtattaacgtatgcttggttgagttttaattattacacacttcaaaaatatattaatatgatattatagagcaacttttatttagaaagttttcgcacgaaacacaccgtttagcagtttgaaaagctttgcctcaaaaaatctttatcttcatctaactcttattggagaaatgaatgcgaccttagcaccattatacattcattttcacaaagaaaatatatcacctaggaatttttaaaagttacatataagttacgctataattacatatcaattttgttatatttacatactttctccgtcccaaaatataatgaaatcagataatcggatagaacatttcgtattgcgaatttggacagacagcccatatagattctacctccatctcaaatatatacgaccatgagtttctatacccaactttaatctcccgtcttatttgaattttttttatgattaatatttttatttttattacatgataaaacatgaataatactttatgtatgacttctatttttaaatttttccaaatatttttaaataaaacagataattaaaactggatacgaaaaattatagctttgcttaaaatgtgtattatattttgggagggagagagagagagagcaggagtatgtccaatatataggtagtcgcctagtccctcttaaaatattccggcatttcaaccccacccactccgcacccccgcaagtcaactctcttccttcctcctccgtgcttaatgctctccgcattataaccacccacctctcctcctccccccacctcctctctctctatctccatctccaccgctacgcttcccagccatgggcaactccctcgcctgcttctgctgcggcggcggcgccggcggccgaggcggccgccacgtcgcccccgccgcgctcccctccgacccggcctacgacgagggcctgggccactcgttctgctacgtccgccccgacaagttcgtggttcccttctccgcggatgatttggtggctgacgcgaaggcggccgccgcggcggagggggaggcgaccacgttccgggcgatatccggggcggcgctcagtgccaacgtatccacgccgc

SEQ ID NO: 38959 - DNA, 21466 bp, Oryza sativa
caatttcacccgcgcgctcctcgcgcgcaccgagaagtttcaggattctgcggatctaggctcgccggacgccgccgccgccgccgtcgccgcctgtgggggcgatccctgtggtctgcagtgggcgcaggggaaagccggcgaggaccgcgtccacgtcgtcgtgtcggaggagcgaggctgggtgttcgtcggcatctacgatgggttcaacggccccgacgccaccgacttcctggtatccaacctctacgccgccgtccaccgcgagctccgcggcctcctctgggatcagcgggagcagaacgtgcagcacgaccagcgccccgaccaacccggctcagccccaagcaccacggcctcagataaccaagaccagtggggtcgccgccgccgcacccgccgctcaagaccgccgcgtggcgccgacgacgaccagcggcggtggaagtgcgagtgggagcaggagcgggattgctccaacctgaagccaccaacgcagcagcgtcttcgttgcaacagcgagaacgaccacgtcgccgtgctcaaggcgctgacccgtgcgctgcacaggaccgaggaggcttacctggacatcgccgacaagatggtcggcgagttccctgagcttgcgctcatgggctcttgtgttcttgccatgctcatgaaaggagaggacatgtacatcatgaatgttggcgatagccgggctgtgttggcaacaatggacagcgtcgatctcgagcagatcagccagggttcattcgatggatcagtcggggattgcccgccatgcttgtcggccgtgcagctcacgtcggatcacagcacttcagtggaagaggtgattgaatcgactcatatcatggttcaatcctattggaattgctgttcttaatgttgcttaagtctcatatttgtttctgcctgaatacaggaagtaatcagaatacgaaacgagcatcctgatgatccatctgccatctccaaggatcgcgtgaagggctcgctgaaggtgaccagagcatttggtgctgggtttttgaaacaggttagttcatttgaatatgccctttttttttgcagaaagacatttttttgtgctccgttatgattaagcgttttgccattggccaagtttcaaagttgcgtatgtggatttattttttggcaagtaatatgcaatttcagaatgacacaattagtcaatgtatgaaataagtatgtgacctgacttccttccttgaatttgggatctgtattgatgataaagcatacggtccaaacttgattataccaggagcggaataattaaggtcagttttgctgctatcctgagtcaaacacataattaaggtcataattaaactaggtcagaaaaaggaaaactggatctggtctaattggtccaaagtttgaaaagtaaagtgagccactctaaattctcacttctttggggtgagaaatatgaccatcctacactgaaactgaccatgtctgacggggacatcataaaccatatgctaatttcaatgggcaaaaacttcaacgcatgaaaactaattagttaaattcttgagtcaccgcgtgtatagccagttcaaaattttgaatgagaagctgctccaagagaaaatgaagtttcttttgcttctgtccaagtacaaagaatctgcttgtgcagtactaaaatgtggccagaaaagagtgagttgagtggctttgaaggaaggtacgtttctcctcccatgcgaagaactattctctattgtcaactgcacaaatctatcttgctgctatgcaagagggaagtctctttcttggacataaagtgagctatctgatgagacagacatggcgatctgcgatattttgtcaatgaagaaatcccccaaagttaagcagcacagagaattgaacaagtgcatgaggcagccctttctactgatttagttgtcggtacaattttcagatagcctggttggaagttgcaaatagttaattttacaagcaaatccatagcgaacaatacatgcatcatttgtttttgctctctgtctgcaccttatatcataattccttagcattttgatctcacaattctctctcttttttaacagcccaagtggaatgatgcactcctggagatgttcagaattgattacgttgggtcctccccatacatatcatgcaatccatccctttttcatcataagctcagcacaagggatagattcttgatattatcttcagatggactttaccagtatttcaccaacgaggaggcagttgctcaggtcgaaatgttcatcgcaacaacccctgaaggcgaccctgcccaacatcttgtggaggaagttcttttccgtgctgccaacaaagcaggtgtgtttgcaaagaagtcaccatacatgtcaaatgtgtcgacctcattttgcagtaacttttgaacttctagaacatgatgctgaattttgtcagtcaatgacctgacctcatttttacatctattgctgttgcaggaatggactttcatgaactgatcgagataccacatggtgatcgtcggcgataccatgacgatgtatctgtcatcgtcatctctttggagggcaggatttggagatcctgcgtgtaaatagaaacaatagtaggctagtgaaacaaaacgtatagagggggttcttcccatgccttccttgagctgagaggtgttcttgcggctactctactcctcttcccccagttgctactgtacaatatcaaccaagcactgtggggggttggattcggcttgggctctcggcacatccagctgaatcgccatgaatcgcccgcagggctggccgcgtggtataatatgttgatgtaaatgaggatttgttcaattattaataatttataaaatcgaccaattggtcaactttctttgacattttgcatgtgtttttgttcatgcatttggggggtgagaatttgcatgtgcatgggagactgattctaagttggacttgatgattctagagaaagggttccttttggtcaggaaccgtttgctgtgttgacctcttaactgatgatagcaccagagctaccccaatttgacctttttttaaggcacaccatcttgaacaattcagcaggcactgccaggttgcctgccttatcagttaacacgatgatccctgggttatccttgccatgaatgaacctaagttgacctctgatctatttactacatacaatcaatgtgcccttgtgaaattaattttgtgtcttggattcagcacctcctcttctgattggctcaaagatcaggtggctgattgctcctcaccaataattgacatttctggccatgtctgcaagtggaattgtagattatttcccacttgcttgcatgcactccttggtttcaacagaaatgatatcaaatgatgaacaaagcttatgttaaaagaaatatatttctatgcaataaaggatgacaaaccggcgcgtataggcgtatatagctttgaatttttttccccataatcttaaaagtgagacatagtcatcttcgaatgttttaaatagataacactattgttaagcaagagaaagtaggaacaggtgcttttctttaaaaaatgtatgtttttttttctgattggttgctagagcgaaaagaaaggcgatcgtgcgagggcattttcctggtcatgtctctccctcccaccactatgcatactgacgttgagttccatttctgcactgcaaagttagaactgttattttccaagcaagggacgcttttttcatacggttgtagagggggtccttcttttaggtacacagaattttctttacggttttttaggtacacagtcacacagaacacatagttggtcatggagcttaccacattaaggacctgtttggtatagctccaactcctaaatttagctccaagagttagatttctagtggagttgtggagctgcttaaatccagctccatctctctagctaattttgtgagagaactccacccagctttgctcccattttaggtggagctaaaaactgtttgactgagcttcagctccaaaagaggtggagctggagctgtgctaaacatgccctaaattattggaaagtatcatacggcatagatgaaatatttcagcatgtggtttccttttccttttacatgaacacagttccttagaggataaattcatttttttcaaaggcaaaacatgctgctaatttgcaaaatcagtagtgcaaaaaagagagagagaaggggggcaaaatttgcattttagacgggcctagctaaaaaggccaagcccaccaatattgttccctttgacccataaaactatgggccatagcccttctgtgcccccgggccgccactcctacttagcagcaacccctctccgccgcctaaaccctagcgccgccgccgccgccgtcgccatcgccgttctcacactccgtcggcgtaagctcacaggtactccccacgatgacgacttgcttctggtgagttcgtgtgttcaacttttgcgcctacgggattcgatgggaagcttttgtttgtgcagggacggtaagatggcgccgccgccggcgaagggcggcgctgtttgttggtctgagatccatcggctacggcttaatggctatgactattgggatctgtaaatgagtaaggttgcccgccgccaacctgattgtttatttcttgtgttgaaaattgaaattgctatgctcgagctcgactgcagtgttaattagtaccgtaagtctttgaaatgctagcaaatcatactagtacgattgtgatgcggctgtgcttgatcagatagagacattttcagaatccgaagatgtcactgtacttctgcgattgtgcttgatcgccgcgttatcttttggtcacattagccacgatgctgaatcagttaacaatctagataccgctttgctttctgaagtatatttgtgtataattgtatactaggattgcacgatccctgaagatagtttttcccttgatggttcttacttgatgaacttggatgtgccgtgtgaagcacatattgtctgtggaaattccaatgactatgtgactatctgttgatctactgctgcatgtatgagaacatggtatgctggcttcagtgctttctatacctttagctatacttgtggtgacttgcaggtgctatgattaaccatgtccttgaaatttatttacacacttgcaaaaaaggagtattttattttgcatatatgttgttgagatcttgatctccaggatgaaaattagttgattcaatgatcaaatttttaaaaccaaaatttgctaaagcgtttaagtaagaaacgctgaaccaagtgccctaagggaattctactgttaggtttagctcatttattttgtgtcttatttccagtcctcagcttttcagtataaaattggtggcgagtcacttgtcttagaagcttatcctcttttctttttctttttgttttgcatatgttacactgttgccatgtgtaataaacatgatgcatgcatgattgagtggctttcccgcagtgtacttatgctgttcattaaagaagttattggattttcttaatctatattgttatcttgtaattttttgaacagcattaatgaaagcaacgagctttcattttccatatgaaaagatacagttgcattatgagtgtaatattgaattttgtttcagaaaactaacaagagggtcctttttgttcctacttgcctaggcaagtagccgggttagcaccacatgagaaacatatcaccgcgcttctgaaagccagaaaagaaagaaaaacgtgcagtcgtgcgctgaaggtagcaaaaagcacactagctagagagctaagacgaagcgtgaggagatggccaacgttgttaggaagatgaggtacgtttcctcctatctatctctctctttttggtggcgaagagaatgttgccaaatttctaaagagaacctgcttttgttcgaaggccataaagtttaagtatcagagctgttatgactctaactaatcatctaaagttggaccaacttgaacacaggccacctttggcttagccctttagaattgagctgtgcagcagtgctatccatacatcgctatatatatctcattcaaaaaacggtcatgtggatgatagtgtaggatcattattgcatcaatactatcagttgttttcattctttgcctacttgaattcttaactgcaatctctgaagaattgacaattggtgcaagttaaaatttatattttcatttttgtctctttgtatgctacaagatgatgttcctaaatttttttgctgctggactttgtctgccaatgtgaggttaatttggtggcagtttttctgttttgggacaatgtaattcttgaaaagaatccttttaaaagaatcatcgattcctagactcgaaattgtggcaaagcttctctttcactaaatcagtgagtataccagctattgctattgattgactaacgatcatgccattaattttccctccacttcaacaatgcgtcagacatgctgtctgttatgtaacgtatatattttcagaatctttggcagttgttgattagtttcagaactgagatttatttaagatgtgtgtgctaacacttaaagatagttgcattgcaatattctgtacacataaacagattcataacagtcataagtcatatacattgaaccaattataaactgcatgcttttcctacaattgaaatcatcattgtatagcacaaggaaaacgagaatgccttgggataaaattattgtcataaagaggttacctagtctgctaccctctactgttgtcatccatttatgtgcaaatggaggtttaggtcatgttatatatggatgtggattttcatcccttgaggggacattccctctttgtttgcatgtcatctaaatagttataaaaaaaattgaaagaaaaaatgacaacatagattaatacgaattatatcactccacaaacatgcaagaccaaattcaacttctataagttgcaacaaaaataacaaattaaagtgaaaatagttatcgcacattcgcagctatatttgttgtttttgttacaatttgtagaagttaaatttaaagttgcatgtttgtggagtgatatatttcatattaatctatgttgccaaaattttttttcatattttttgatgactatttaggtgacatgcatgaaacgaggggatatcccctcgagggatgaatttactttcccgttatatatgtccatgactctacttttcatgatatatgctgtggtgtttggcatcccacatggaagctatccaattattgtccaaagagatgcttgtatatcctgtaggatatagactaataatagggaggtgagagaactattttgggtcttgggatccagcatacatctgaattgttcctgtcaaaatctgccagtaatttttttttgaaacagacacgatgcaatgtttcatattggtatagcaggaaaaatctgacagtaatagttgcactcttgcctgaatatcctctactgtagtactaagctaccgaaaccaacaaatttatagtgcagggattgagaccaaactttgaaatacaatgttgatgttgtgccacccttgaacactttcttattggtattcacaatatactccatctgaaagtctgcagatctgctggagcttctgacaagaaaaatgaaacagtgcaacttcgtgtgaagacatgcgagatgcgaccactatggttgaaaaaaagacattgaacttcggtaaccaggtgtgttcagtataagacattactgtttttcagttagacttagtgttgatgttcgaatgttcgaccatgccctttatagttcatgagcactgctacacttactaaattctcttacgtactaacaatgatttcaaccatttgatttaactgcaggaaatcgaaaggcatgacgcatcagtattagtttttggaaattgcatgaacccacatgtttacactcatggaatttaattacagggactgatttttgtcaaaacattgtatggttaacccccagcagtgtactttagtattccggagctgcatgatagaaattaagctaacttctgcccttattagtattacctccgaatgcatttggcactttggcattggcatgttgtaaggagtgcggttatcgatcctggaacaaacagaacacggtcagtggctcgtctcgtccactcgccacttctaatcaacattctgttgcctactccatactactccctccgtcctatattataaggctttttagattatgcgacacatcttaatactataagatgtattatatgtacccaaaatcttttataatatgaaacggagggagtactatctgctatgacgctggatttctgtcacgacggagttgtggagtgcttccctgcagcgcacatactctctccatctcaaaaaggataatttctggttacgaatataaataagattcgtagctagaagttttgcttgcccgcagcgtacatactctctccatttcaaaaatgataatttctggttatgaatataaataagattcgtacctagaaatttatttattagacaatttatttattagacaggggcgtaagctcctgcctcgccatccaatccgtcgtagcacgagcggctggaaatgaacgaagacgtcacacatacaatccggcgaaaattccaaactcgaggtggtcatttcacctcacctgtttgcagaggcggccaggcaagcgatggatcgaggcgacctgtgtttgttgttgtgcgcgccaacgcgacatgcgctcgcgcggagagattccgtgtgccgtactacgcgcgcgggcaccaccttgcctgcctgtacgagcgctcgagctcgctgctattacgtacctacgcgcgcgccgggaaaaaacgccaaaataccgtgcaatcggcccgattctcccgggcgccgcgtggtggcggaatggaatcgctcaatcgcacattcgcattcaactgttctcgtcaaactttcaacttttcttttttcatatagaacttttctatacacaagctttaaacttttccgttatatctttctaatttcttcaaacttctaattttagcgtggaactaaacacagcctaaacctcatgattttttacagatcacataatcatgatatatacagtaatcgtacgacacagcgagttgctgaatgcttatagtgatagtgcgagtgtgaaggtgaagcagctggtagggtagagggcacatgtcatccatggaggcccaaagtaaagggggagacaatgcaaaggtggtgggcggattggacgggataatcccatttcccatagagaccgcgacgtcgagagagagtatcgtacgttatccccgggcgggtggggggacggtggacgagaatcgaggagggtgcagctgcagtgcagggacaggggaccgatccgaatctgcagtgcagttaaagtttgggcagcggaggcttctccttgacgcttcctcgatcgatcatcctgggcgcatgataaaaagcggctcatgtgcgcatgcatgacaaggacgcttgccgccggcctcgcgacccagagattccacggtcaaatcgcagtgtcgatcgatcaccaccccgtaaaaccacagctacttcctctgttttataatataaggccatgtttagttcgtgaaataaaaatttttggttgtcacatcggacgtttaatcggatgtcagaaggggttttcggatacgaataaaaaaactaatttcataactcgcctcgaaaacgcaagacgaattttttaagtctaattaatccgtcattagcacatgtggattactgtagcacttatggctaatcatgtactaattaagctcaaaagattcgtctcgtcatttcctccccaactgtgtaattagtttttcttttaatctacatttaatacttcatgcatgtgtctaaagattcgatgtaatgtttttgggaactaaacgggacctaagactttctatattaccaacatttatttagatgttaatgaatctagacatatgtacgtgtttaaatttattaacatctatatatatgtgggtattgatagaaagtattacattgtgaaactgagggagcactactactctcgatctggcggaataaagctaagctaatccgacggccggcccaaagcgaagcgacctgccgagaaacgcgaaggaatttcaccccgcatgcgatcccgatccatctcgcgcgcggtggatcgatcgttgtatcccacagaactcgtccgcgcggccgtgtacacgggcgccgggcgcagatggtacgtactcctacgagacgtgctgtgtcgcgcgcgatgcgttgcccactgctactagtcaataatgccaagcagttcgatcgatttgatggtcttgcattgcgtggtgatgactcgatcgatggatgtagcgtctctgcgcgcagcgttcgtcgctgtacgcgtacgtgtgggtgttgtcagactgggcaccaaaatgcatgcacgttcgtacgcacgcacttgcaggagtagtactgtagtaagtacgtcgtccatgcatgcactccatacgatatgatgggcccagattgtttgcattgcacgcgggccagtgtacgtacgtaccatgcatatatatatggagtagtactctggacgaggcagtcaaatttaattgtacgtgcggcagctagtaccattcaatatcgtaccggtcttcgcctgctggttgtacgtaccgtgtattaattcagtcaatcgatcatgcatatgtatcgtattatattgggtttgtttgaggggagcccggccggccggctagcttatctctagctagctgactaaataaatgtacactcttatacgtgcaactaggtaaagtcaaggttaccatacctaaatctacgtagcaccttgtgttttaaaatatgctccatccatctcaaaatataagaacagacgggacattttttagtacaacgaatttgcataagcaggacggagggagtagcaaatagatactagattagacacaatatattactacgaatctaaataggagaagtactagctaagttacaataatttaaaattgaggaagtaattaatttgtgagaaatacatgcaaataatacatatgtacattctcttaaacagacaaattctaatgaactgtgttttcgtcaggcgggtgtggaacaagctatctgcgcttggtaggtttgcattctaatgaagtgtgttttttcctcaggcgggtgtggaacaggttgcctgcgcttggtaggtttgcataacctctttcctgatcagcaataagcggtattccatccttggtggaagcaatcttgtggttggatgcacgagcacctcagaaaggggttcgacgactatggttacttggcagctttggttggagtgaaattctcatgttttcgataacgttattttccaagtagacacggtggtggacatgatattgcaaagaggcgactctgacatgaggtgaaacattcgcgtctctagtagtttttttttcccacttgttctctttaactagctaactcttcctcgccccttttcctttttggagtctgttccggtttagttagcatgcttttttttgcttggtcctcatcccctccataaccgttacttttgtgtcaaagttgtattcaaacttctttcttctatatatatagtagtacttcctccgtttcatattataagactttctagcattgcttacattcatatatatattaataaatctagacattaacatctatatatatatgaatataagcaatgctagaaagttttataatatgaaaagaagggagtagtatatattatagtggttgtgggttgcatctactataactgactctgaactgccctataactcaaaacatgcatatacttcattcattccatattaagtttatcttcagctctctctatttgtcccaaaataagtttattttagagtgatcatattgcattaaatttcactactagaatccaccaacttccctagagccaaatacactagggatcaggggaaaaactctagggaacaggtttccctagggtaaaccctagggatttcgctctagggatccattctacaggaacaacccagttccctagagtttttccaggaaaagctagggaaagacttcgttccgtagagtttcactccctagggacagttgtacatttggcatctgaatctgacgtgtaaagtggatttcttttggttttcagccaaatttggggaaaatattggcatttaaataaaatatttatttcattgttttattttggtttctttattttacggtcttcctttgcctcaacatcaaagctaaaatattactagttgaaataaaaatgccattctattattaatagaaaatactcaattacattgattcttcattttacattacattgattctacgacaatggagctgaaaatattcctctcacaaacatatgatggacacttcagatgtgctgatgaactgattctatcatcgctcagatccaaacgataataaaataaaatacaacacacgttcttgaaagcaaatctaaaccacttgattctagcttgcttctgcaacaacagtggaaagcttgaaacttgaaaaattgcatccgcaaagaactgaagttgaactaatcttctttgttcttccaatgcttcctgcccttgcctcttgaaaagaaaacccgaatagcatgctccacagcccagatcaagataatatgctcatgggcatgtatatgaaagaaacttcagttcgagctcagttggagcaacacttacttggatcatgatggaggctggagcaacagcaatcttgtggtgctcactgcttgccggagtgggctcttgtgctgcacgctatgaagaaagaaagtagaggaaaggagatgagaaagttggatcagaacaactaatgcaagacggagacaacggcgtgcggtgagagaggaggctccgtcgagctcgtcgagagcggtagctgttgggtgcttgctgtcgaccggttgctggagctcgagctttggttgagaaagggaaggggccgccgccgcgcgccggccggccgctgggaagaagaaaaacgagaggatgtggtttgcttgagttgtggagaagataaggtgggcccaaactttactgggcacaaattttgtatgtcgagggcacgttcccaatcgcagcaaggaaaaaaattgaagaaaaaatatattgggagtaatcagaccacgatgctgatgtggagcagctgtgtgttcttttcagccaaagttccctaggaatacttctttcccttgagtttttagtttgcaccctagggatcattttggtttcccttggattgctttaacaacctagggaacattttaaactctaggaaacccattgaattctagtagtgattatagtttgcaaaaatagagaataattgtatcgagagtagataaagtaaagaatatttgcatttggatttgataaagtaggagtattctagtcttttgtttctatattggtatgtgtgagatgggtgaaaaataaatgtatgttgagacggaggtacgtagttggtagtatatatatactataagcatcgatctgtgtaactttatcaggtcgcaattgaccaatgcaaacatcaatttatgtcgttgtttcgtacgtgtcatcaggttgtcatgcatatatacgtcgtactactgtctgcgtgtgtgcagtagtacgtttggatcgatgcacgtatatcggtgagtatatgtgtaacgacatgccacctagctagtcctttggtaaatatgggcagacacattctggtcccccattgagaagtggcctgcatgattaatttgttttctatgaattccatctagctacaagatcatcacagaacagagatccttgtcggccccgctagctagctagctatcgtgtaccttggttattttatgcaggtaggatgtattatatcagtacagtatatgtcattgtattcttaatttgttagtagtaagtagtagcacttatgttaaacaggtataaagatcgaccaccagtgcatatgctaatgtagattatcctagatgatacggtctggatcttaacctttttctctgaaagtgcgagtgggcaggatcttaatatatgggaacagcgttgtactactactcttgtaggagagaattaattgaagcatatgcaacccaatgcctagctagatctctcttgatttacttaaatatacagagtcctaaacattcgcaaattaatcgaaggaaattaaaattgatcgagtagctttactatagatacacacacaagtacaagccaatgcagtggcatcagattcttgagcattgggatctctgcattcatgtacacgccaagccgctcctgattaacctataatttagaacatacattccttggcaccttccctgggccaaaaccaattagtaatactctcctagaatgtatagagtttcccagtttgccatcactgtattatacacttatacataatgcatgtgcatgggtcatggggtgcaagcttacaacttgcaatgtatgattgtgctcatgtgatgcaacgtgagcccaaccacagtatctctctgtcttagactcgcatacacacacatgtatgcagatatatactgcacaattataagttgtaaaactagataaactactgttgttgccgcgcactagagacgacacggatctacttcctccgtcctaaaatgttgctacctaaaggacaacgaatctggacagaacctctctgcgacggaggtagtagctagctactagcaagaagatgagtaaccatgcgagtaaattatactccctctagctaccttcaaatacttgtcgatcgccagatattatttacagtatctttaaactttgcacttatcttcttttaaagaaaatatgcttatactcaagtattccatattaatgaaatgtattgtatcctaaatatcagcgacggaaccataaattattgaagagggagggctaatgtaggacttaactaatgaattgttaattttctcaaatttacatgcatggtgatttaagataatttaatcatgattttggaggcagagcctacggctcaaactctagctgtcttagagctgtctccgcccctgctatatatatagggtgtgtttagttcacgctaaaattgaaacgatgtgacgaaaaagttggaagtttgtgtgtgtaggaaagttttgatgtgatggaaaagttggaagtttgaagaaaaagttcggaactaaaccatgccatagtatggtcatgaacttttgtatatcgtggcataaccattatttaaaatctattgatgaccaaagttaaaattatattgttcaacagctggagatagttattcgaaaccggaggaattgaagtacaaaaattacaattcaattgtgtatttgtcgttcacatttcaatccatacaggtagagggccgtagcataggacccaagcagaggagaaaaaagtaagggtctctggagcttgggagggaggggcctggtgtataaagctaaagctgccattttttctgatccctctctctatgcgtgtgatttgtagtacagtctgacaggaatctgatacccctggcctgctgtcctgtgctagtacctcccatttgaagatcaccacctcaatcatctctctctccactctcacccacacatgtacacacactctctgacactgcacacacgcgtatgaaaattactctctccgtcccataatagatgacgtttttgactttttatttgcaacgtttgaccattcgttttttttgaaaaattagtgcaaatataaaaaagataagtcatatgtaaagtacttttgataataaagcaaatgacaaacaaaataaataataatttcaattttttttgaataagacgaatgatcaaacattgacaaacaaaaactcaaaaagacaagtaatatgggacggaggtaataactagcatgaatttgatgtctatactatttctgcttccagctctgaaatgaatttgtgttgttctgaaaggcacagtagcacactactgggaatttctcgattgcaggagaaaaaaatgcaagtgtctaaggccacatgcgatgttgcgccaagcgagatgagagaggccgcgacaacggcggaaagctagaggataatcgagcgccatttgattgatccaccaatatcgatacagatctgtgtcgacgacaaattaaagcgcagggcgagcgcccaagaggttagatctgactagctggtgtaacagttgaaatggatggttgtaagtgcatgcacactacactgatctttggtacggtgtatagtgatgtagtctgtcatatcattcatatgtaatcaatcgatatatcttacatcttgatcaaataatataatctaacttgtataagttacacatcaaatgttaatttgtctggtttgtctgcattgaattttttgctatcatgcatatattgatgtctgattctaaacatgaattttctactaactactaatatcttttacgctaaaaatctacatcttaatttaagttcagcccgaattaagctctgtgaaatttggggctcatggggaggcaacaagaggactgaaatggtcggtacataataaactctaattaacgaacaaaaatcatgcttcgatgttagtgcagtgagaaatcataggtacaaaatttaaataacaggtaaatccaaataagatggaaaagtggaatacagatatgctatggaagtaatttctgacctaattttatttattttatgccacttggattaccctatttcgatttagtctcctcatttcttactcaaaatattccttgacctacaataactagagagagtcttgagagaattttatgcacaagtccactagtcttcacctatacctttctttatatgaagttgtatactccatccgtcccataaaaaaccaacccagtattgaatgtgacacatcctagtgctatgaatctggacatacatttgtccagattcattgtattagaatatatcatattcaatattagatttttttttgggacggagggagtatatatctacggtagctaatcgtcggagaacaaaataggcgaacatccttattcctttctccattatacattgttatatccctttctagttgcagtgtgtattcgataattagctaggtctctgttgtattttgtcaatataaggaatcatattctatttttgccgggctcagcggaaactggtataacaaattaatatgcgtgccaagatggtgaaaggaatatatattgttctctctcacagtcgataaaatcattgtgactcgagtgtttttgacatataatgttggaattcaatgagaatctgcttgttgatttatacttcctttgcttgaaaatatgtatatatataaacctgaaaagaaattttcatttaatttccccctagctagttattctaatgagctactccctccggttctatattaattgacgtttcggataaggttgaggtcaaacctttataacttagactattaataactttaaaaatatttagtttaaagaaactagaacaatatatatagatttgtcttttaaaatactataataaaagtaaacatgcatttatttattatatatattataatagaaacataaggtcaaagatgtatcatcttttagaccgtgtcattgtccaaaacgtcaattaaaataaaaccggagggagtatttatatagaccttgaaaaatgataaggatgcaaagaagaagtgcggctgattagttttgtgattgcattggaacttcaatactattaatttacataggatcatcagtgatggtcttgtaattaatttgatgaaatccaaacatataaacacatggggtcaaggtgaggtcgtagcctttattccctctccaagaggggaagagtactgcattggactgcgcgaaagcagacgaaaacttagattccctcagacagcgacaggcaaacaaacgagagagagattgagattgaggctatacatccagcactgagcttaacactaattaattaattggagtgccaggataaatttaattacgaaattttaattttcatcgtcaatgaccactaggtggcactagctagttagctctctctttagttactgtacattaacaaggctctctctctctgctgcgctatatgagctgcactgcactgtgtggccggtgtgctagctagcttctcctgcatgaagtaatcagcttagcttctacataaacagacaaacaatcttttgctttccacattgcgttgtctattacgctttcagaattcagagatcagaaattcagagccttgctagcagcagctagcatcgatatcgtagatttatctcctaaagtggtaggcaaaccacggcatacgcatcaattttagcgcgcgcgcgaacactatcgattcatcgtgattcgtgagtcgaccatctccttaattttttcagttcgtcgatgctctatcgatcggagttagtagctatatgtcaacaattaatgtcatccacgatcaataatttgattatatcatttcaagttttcatatgatcatcgatcaaattaggtcaagtatatgatttaaccctgactggtttctcttgatggacagtttatgctcattcctgatgcatatggtatggttgttagctgtcggggaatttctgcattctggtagtggcataggcaacacatggtatatgctgcaagcttacccatacattgaaacagatagctagatttatatatattattgatcgagtattctggaatcaacagacaaatgaaaataatcgaattaattacgatacaatatatctgctgctgcaggttgagcaggatgaatatgcacactttgatgtggcattcagtcaatggccggccggttggcttcaaacctctagaaatgcaaagctactgacggccggccgttgccatgactcccatctcctctcctcgatcgagtagctaaaggtaaaaagatggcaaatggggggccaaaagaagcaaaagaacaaattctttgagcacaactaagcagattgctcgccatttcctgcacacttctgaattgcagtcagtacactagctagcttggttactggccggctggccccttcaattcattcttccttggggtgtgcatgcacatgaataaatgtctgtctctctgcctgcactgtggggacatttgccatgattaccgtggtcaggggaaaaaaaaggctttgaatggagattggtgcttggaaacctagaaacctacactatctcattcccatctcacatagaagagagatagagagtgaggagagatgtggctaatgctactagctaggaccatatatgcatgcatggagaactgggtcactatagtgcatgcatgatcactgatactgcttatactatgtgtgtatgtgtgtgtgtgtttgtgtgccgtcagaagtctgtgtgatctctcaaaagatgagaaatggaaccactagtttagagcttatatggatccctcatgctccattctttgcgttggctatagttgagccgcatttgcaaagattcatctggatagctaaaggaacacatacattatattcaacatgtgtctgcataatataatagttgcatggatgatgtcttgtgttcagtacttgcaaatatatgtgtgaatattcgatgttggttattcatcaaagtactgtatgcgtatgccggcgagagtgggtgcagaagatgattagcaaaggatcattcttgtatgcatgacctagctagctagctagcttaatttgtgtgttaacaagtactacaaatggagtctatgtgcacctatatatatgtatagatgcacatatcatctagtctccacaagacactgaaagtgatcatggtttcctaaatgtgcataatctcttctcttttttttggcaaatgtttgcagaattggagcattgccaatcacgaccttattcattctgaaatgataaagtgtgtaattcaatgcaacatcatcactgatgtgtgtgcatgtttggaaacttcttctcaacgatgcatatacattaataatactttggtgaagtaaaaaacatcgcatacatgcatgcattattatatgcattacatcaagtaaccgacaaccatatatcaaaatgcaattcagctagctcacacatatgaagagattgcatgcatcattatatatatgtggaccaaattaaattaactaactcccattgagtactctcgtagtcttgtagataaatatatatcaccttaattccaccatgaacacattgcaccaatctagtaaaccttacctagcaacagcatatatagcaagtttacaacacatattgaaaatggagaacaatatagagaggagaaatataatcccaccatcttatacgcgacaagtacaagaaccaacaagagaagcagaaagagataagaacagcgagaggaaaaactcaaaagcaaaaactagcatcgcctagcatttctctagacaaattgggtttgaagcagctcgatcgatcacgaacaatatatatggagatatatatcaatgcagccctaatcttgtacttgcaccacacacaactccttaattctcctttgatctttctcagagaagccatgactaaaattaagcttcagggctcgttagggttctacctcttttgcagcattgatccattccatcatccatttcgccggcaaatgcgtcgtgtcacagtatgttccccgacgacgacgagttgaatccggagagatcagcccatccgccgccgctgccgccgcctcccggagcgacaccggcgccgctgccgccggtggcgccgtctccattgccgccgggtcccgcgccgttgccaccgccccagaattggaggttgccggggaggcccaagaactccctcggcgagctgttcatcgccgcggactgagcgttgctgtcctccatcttgacggatgcgagctgcgtgatcaggcccgacgagccgggcaccttggtgccggccagcaactggccggcgaagccggcggcgtcggcggcggcctccgcgtcgaacgggtaaatgccggacattggcggcggcatggcgtcgttgcggctcaagaaggggaattgctgtatctgcgggaggcgccactgctctagcccgatggcggc

SEQ ID NO: 38960 - DNA, 17616 bp, Oryza sativa
ccggcggccgacgtcgacgaggacgacttggacgacttggtgcgcttgttgcggcggcacccgccgccgacggggacgttgcggagcgctccgccgcgcgtccagtagcggcggcacgtcttgcagaagtggcgcggctgcgagagcgagtagttgttgaagtagcagaacttggtgttggtggactcgcagcgcgggcacttgagccccggctccggctgcgggatcttcgccagccgagcccgttccgtcatcgagcccggccgcaccgccgtgccgccggtcgggccgccgccgccaccgccgccgccgctcgccgcgacggccgctgctaccatgtcaggccgaggcgccatgaggccgccgtgatgcggcggcatcggcggcagctggtggtggtggtggtggtggtggtggtgcgcgtccactccacctccgccgccgccgccgccgccgccgttgccgccacttggaagctgaccgtggtgagcttgctgttgctgaaagcaccaccattaattccaaatcaaacacgtacacacatgcaccaaagaaagagaattaaaggcgacgagaaatcaagatcacaaactaaaagacgagacggtatattcaacaagagatcgatttaattctcaaaagagcgtaggaatatttcctcagcgcattttatttggttttgcttttttcatgaagaagccatacatacatacatatatggccatcatcctacataaaaaagaaagaaaggagagagcaaaaaaagatcttggccaagcaagaaaaaatttcacctgctggttccaattgggtggatcaagatagacggccggaaccgaagaaaagaccatggtatagaattgatttcttttgatcttttcctacttggggccttcttttttgggttttgtttgttcctctcctctcttctttgtgagataagggtatatagctgctttaggcccaggatcatgcaaggatggggaggcggatcgataaaaggcggcgaataacacacccactagcaagctggaaattgtgtgtgagctctatctaatctagctgagctgagctgcttgtgagaagagagaaactatatcactactactactactctggcctgcgtggtgatgagttagctggtacaaagagaggaggaggaggaggaggagaatgaagagaggagggaagctagagaaagggaaagagattggggtgagagggaatgaaagggagagggaataaaagggagaaggggggcttgccacccctttattttcctttatttttttgtgtcttagtggtgtgcttgcattatatatattgggttgtgaaacatatgcatgggaggagttgaatggtgaagagtgatgtttccttagctcataagcatgtgtgtgtgtgtgtgtgatgcatggatatataatggatgtggcatggctagccagctagctagggatcagtatgagagatcatcagagaatggggttttatgcagggagaaagctgatgaaaaccctagatttctaggagaaggagaggtggccttggctgctagctgcatgcactgtttattggaagtctctgctggatttgtttgtttgctgttctagcttggctggttattagttaattatcaaccactgatctatatatctatcttggtgtttaacagtactggatcaggcagagctagctagaggttatcaaaatgatgtgagctagcagctacaggtgtctaggggtggcattctagtgtgtattttgcagggtgttcaactttatgtccattttgatgaaagagataaatcagtaaagctggtcttgctagttttagtcctcttggactctttggccagtggtgcagcaggttgtggtgtagaattctccttctccttctttctctaaacaaagtttatactgctaagtactactaattaacaagtatatagtatatggctagctatagctagctgacgtacagtagtctcatgtggtaatatatatgagtaggtaattagctttatgtgcatatagatatatgcatgttaattgaattctttggtctgtattcacaatatatatataatactacatggttattaatttcatccaagtctttctagctcctgtagcttgacatgtctgtgtgcagaatatgtgatactggtagttcagtgtgcaagtactgggaaacttcaggacatgcatcaattcatggcctcatggatgataggctacatagatgaatagatctatgcaagctttgttgccttttgttcttttttttcctccctcctccacattgtacaaactaagcaaacatggcatttgaatacactaacgatcgtaaagctttacacatttgaattgtgcaagatctgaaaagatcacagtccatattcttattctgttctggtcgtccgataactaaaatttaactgactttcatgcatggcattcccttaatataatacatgggcagaatctttcctgtcaaatattctgcttttgccaccacaatatcacatatactgattatttttctgcaaatgatgagagaacaaatgcaagctagctaggatcagtgctcattagcgcttataattaggttattattattctccctagtttagataggtagctagctaccggttaacttaatcgagcagaatagaccccacttttccttgtccatgactgattagagagattggacagaagataacaattttgattaacaataggatctaactagtgtgcccagctcatgtaccgatgagctctcattcagacattcagtcatatggggatcgatgagaaatcagatacagagacaaattaactagctagatagagtagtacgtagttgtacaagtgattgatcgatcagacatggaggactccaaaagattcaggtaatgcgttccagagtgcagctgattggagcatgatgtataagcggctaccatctagtgctgccccatttacagtatacacactgctagctagatatctgtgtgtccttgctcgctacctgataaactagggtgtcaaattattttatattaaatttgttgatctatggagtcaaatttctcaatcatgtctgcaaacccttcattgttcatgcatgtatattcaatccggattaactagtatagtaaactgcatatattttgaaggtgccacacctgcagctgtatatttatgctataaggttcttatgctgtttatgttcaaaatgtcgacaggaaagttcagatgggcgatgttgcttggctatactcaagtaatctttcatcattcgactttgtggcgaattgctttagcagttaagattctgctccgcttttgcttcctctgataatttgtatcattgtgtgcgcactactgcaactgctcatttctgctttggagattgtacgtggcgcagtgaagcctcaacactgacaaaataattaacccattagataaggtctggattcctcttggaccgagagaacagcatcaccttttgttaaaaacatgacccttgaggtattaatttagaaggaattctagatagtatcatggaatcatcagtggcaggtaattaactaacttaattagctcacgaacatgtaagctcgctagaatcaccgaaactctatgtaaagaaaaggaattgtaatttcatcttacttgactgtgtatacacagcatatgtcgaagatgtaaatcatttttattataaaaaatatatatctcaatctcaaagtcgatcttgccggtttgcatgggcagctagccatcctgccatccatgtcgaacatgtggaactctagaacacacatacaagtgattgaggcacaggctgatgggctgatcagcaagtgctcaaaatggaggaattttacgtcaatcaggcatacgtcaggactggatttccaactgccggtgaaaagcgcaaccccagaatgccgataaagtgataaacgctcgccctgcttttgtttcctttattttctcctttttaatactgacagtccatcacactgttctctgctgcagtctgcagaacaagtgcagtattgctactggtgctgaattgcagatgaaatcaatattgagcagttagattgtgtagcgaattggtaatattctttaggataatagaagttctcgctcatcaatgaaggcatctaagcctctacaccggctgatatcagggcagatacaagcctaacgcagctagggctttagacgcaggcttcctctataaccatgtttatatcctctgaattcaccactgaaaaatagaaaaaaacctacaatttattagcagagctccaggtgagcattaggctttggtaatttctggctttgtacctggctgatatgatggtcatcatgaatgtacagtgatgtttagtattaactttctaacttgctcctggtagtacaagccagagatcacctgagcaaatcatgtgttgggaacacaggattaaagaggtgaggtgatgcacgtaatgatgattaaggcagagataccgggtgtgggttctttgggcgggtaggaccagggagtggtcgctttggcctgcattattattgcttatgactcattgggcctgctgattaaagcgaaagacgcagcagtatagtccctcgtagtgtgtatgtccccagcgagatcacattgtgtgactttccttttcttctcccgacatcgcaggatgtgagcgagattccgggacatgcaacacatgtactagtaatccgagctttatcgtcggactaatccgagaacctttaggtttatcgtcggtcgagctaagctgagtacacagcttaaccaacctgcgtgagtgcgtgacgactgacgatgataattgcatcgcaacagcaacgggggcagcatgtttggagccaggggttaattaatcacagcggcacggcactaagtaacaagacatataggactatcaaggatagcattagctagcagcattatgaaaagcacaggcctggtctagctattacatgtgtttccaccccggttcaagataaactggacagtggaacactctcatcaacagatcagcaaataacgctgtttcactaacaaaacatttaaaacatttaaagcatattaaacatttaaaacatatttaagtaaccgggggccaaacccacctagcataatcaattgcaattgtaatacagcagtaaaacaaaaggggtaattctgccgcggccacctggtaaaaactgaaacatcatcacattactgaatgtctgttcgaatctgagactagaagtccaaactcaagcatcaggtgataataagtctttagttaacagaaagtacgagtagcccaagtggtatgattgccaactgggatttgaaaacaaaaggtgtatgatcaatatttttctcatcacatatacgaaggtgtattgatttagtcgacctcctcaatcttagggccagcaccactcccaccagcagccggagcatcatcgtccattccaccacccatgtcggcaccagcaccctggtacatcttggcaataattgggttgcacaggccctccagctccttcatcttgtcttcgaactcttcaacctcagcgagctggttgttgtccagccactggatcgcctgctcgaccgcgtcctcaatctttttcttgtcgtcagctggcagcttggaagcaatcttctcgtcttggatagtgttcctcatgttgtaagcatagttctccagggaattcttggcgtcaactttcttttgtgctcttcatcctcggacttgtacttctcggcgtcctgaaccatcttctctatctcctctttgctcagccttcccttgtcatttgtgatggttatcttgttcttctggccagttgtcttgtcttcggcagacacattcaggataccgttggcatcaatgtcaaagcagacagtgatctgagggactcccctaggggcaggagggattccagacagctcaaatttgccaaggagattgttgtccctggtccgtgtcctctcaccctcatagacctgaatcaacacaccaggctggttatcggagtaggtggagaagacctgctccttcttggtaggaatggtggtgttccttgggatgagcactgtcatcacacctcccgctgtctcgagaccaagagacagtggagtcacatcaaggagaagaagatcctgcaccttctcgttcccctctccactaaggatagcagcctggacggcagcaccgtatgccacagcttcatcagggttaatgctcttgcagagttccttcccattgaagaaatcctgcagaagctgctgaaccctagggattctagttgaaccaccaacaaggacaacatcatggacagtgctcttgtccatctttgcatccctcaggcacttctccacaggctccatacatttcctgaagaggtccatgttaagctcctcaaacctggctctggtgatggtggaatagaaatcaacaccctcaaagagggaatcaatttcaatagtagtttgggcagtggaggagagggtcctctttgccctttcacatgatgttctgagcctcctcaaagccctggggttcccgctgatatccttcttatgctttctcttgaactcttggacaaagtggttcaccaggcggttgtcaaagtcctccccaccaaggtgagtgtcaccagctgttgctttcacctcaaaaataccctcctcaatggtaaggagggagacatcaaaagtaccaccaccaaggtcaaaaatgagcacgttcttctcaccaacactagtcgccttcttgtcaagaccataagcaattgcagcagctgttggctcattgatgatacgcataacattaagacccgcaataacacctgcatctttagttgcctgcctctgggaatcattgaagtatgcaggaacagtgacaacagcattcttcacagttgaccctaggtaagcttcagcgatctcacgcatcttgataagaaccatggatgaaatttcttcggcagagaattgcttctcctcacccttgtactgcactacaatcataggcttatcccctgggccaggaataaccttgtaaggccacatcttgatatcgctctggacagaggcatcagaaaaccgtctgccgataagacgcttggcatctgcaaagtgaaagatgtattcagaaatctcaattggatatattggcattaatcaagaaaaggtaattgttaacatgaatagaagataaagaagttaagataataaagatgattgcaaaatattattcatgtccttgctttgagttggacgagaaaagatagtgaaccattatagtagcggacgaaagagactgctaatcttattgttcatcacaaaggttttgcctgttttgcatttatcagctagatttttttcaaaacaggaaagaagcacaagttcaagaacatcacagctgctgaatgaagctgcaatgatcataacaattacagctcgcaaacaagaaatcgtcaagtaaaaagtgttggtggaatagttttaaatctaacaacatgcaagataacattatctgaattcaataaaaagtctagtttaaaactttatagataaattaaaaataagccaattgtgactatcctggttttcatggtaatagtagcctactttaatcagcaggtaccttaaaatagagaattaaaacaacaaataaaaaattaaataataccaacaaaagcaaataaccaaacaatacaaacaaaagcagatatcctaaattatttctcaagaacagtatttactttcaatacaccagcctgctttcataacaattctaatttatgagcaataaaacgttgaaaattgagggtataagcataaatgcgaaaatatacaacgtttattggcgcttttacaaacacataatatagcttaaggtgtatgggtgaaacttaattatatttaatgcccggacatttgcaagtaatgtactaactaaattcctgtggatcaaaacaggttgtgcaatggcgtcagttacttttgggaaataaacctgttgaataacaatcttcagcatatgcagaaactaaaatgtatatatagcctacttacatgagaaaagaaagtataatcaagagcaatgagaaacagagcagcaaaaaataatctaatataatttatagctgtgcaataatcaatttaaacaaagaaaaaacagatacattccaagcggctggatccattccaagtggctggctgttggtagtgagcaactgagcatagcaaaccattcaataaagcatgaagagaactattgaatatgacgagttgcacacctaatacagaatggattactaagataattgacatgcagcttttcagtcacaaaaggacagtttgactctcatttatcaggaataacagccaactttagttccatttttttgacatcctaagcatgattcagaaagcactttcatgtaaaggcctctctgtttcattaattctaattcacactaggccctaacagcaccatagcaatgcaatgtaaaaataagtgcaagttgccacacgccgactgattcaatctttcccttccataacatcaacatatgcaaatagcagttcagtccaaaagtgacagcacaattttatagggagacaaagaaagaacgtacatgaaagaactgtacatgattacaaacaactgattcttctatccaacagttctgattgaaactagagtgattattttctaccggcaagttcctacgtggccaacaaatcaacaacacagagccatagaaattaatcgactatgctcctgctatatagatctaccttgtactgaatatattcagacgtcactatgaaattatataataatgatggtgataaaatcagtggtgtaatcttaaaaaatttcagcgcgtgctcttccccagcccaacgaaaaaactgtgataccaaatcaccagtcgttttctgttaaaaacatcgcctattttcacctacaatatcataatgcagatcttattccgcctaccggctagtacatcaagcattgcgtctctcgcattggagcagtgctaaacatgtactagacttgacggatctagcaaatcgggcatcacattacgcgaaacacagatcacacatctagtcgcaacagtacacagatcgaatcagaaacagggcaaaagcgtcgtggcgttactcaccgaagacggtgttgatggggttcatggcgacctggttcttggcggcatccccgatgaggcgctcggtgtccgtgaacccgacgtaggagggggtggtgcggttcccctggtcgttggcgatgatctcgacgcggtcgtgctgccacacccccacgcacgagtaggtcgtcccgaggtcgatgccgatcgctggcccctcccccttggtcggcgccatggctcctcctcccgctcgcgggtcgcggcggcggcgcgaggaacgagtgaacgaggagagagagagaggaggctagggtttccgcggatgcgggaggaggagtggaggagaggaggcgagtgcggctgcggcctccgtgtgcggcggcgaggcggtgcttttatagtggcgggcacggtcggcctcttcccctcccggaatcgcgggggcgtggcccatccaggcccagttcgtacattaaactattgttactgcaagttgggcccccacaggtcaaatgtccatgtagtaggagtaggagtactccatttttcacgcgtatcgagcatggtttctctctctgcaggtggggtcccagttgggctcccacaggtcaagtgtcgatgtagtaggtgtatttttcacgcgtatcgagcatggtttctctctgcaggtggggtcccgaacattcgtgtacaccagtgggtcccacgtacagcctctgagaggtgatctttcgttatgtgtggcggacttgtgggaacgagtcgtttggtcagggagtgggtgccaatatttggggaagaagtttctacggacagaggcttttttgtggacaggatcagtaatatgcgcataaagcactctttgatgtcgctacaaccatttgatcgcgttcgaagggtttggattaaccggacgactcacgcagcttgagttatcacacaacaactgaacaatgctggtatggatcatccaataagctatgttggggttacagtcaaagttccaaaggtcttcggacccatcagctgccctaaaaagaataagccaaagttaaattttaaatttaaattttaagatctttttaacatagtttctttttcaacatactccctctgtttcaagttatttacgttttgatttagtcaaagtcaaactgctttaaatttgactaaatttgtagaaaaaagtagtaacatttttaatccaagacaaatttactatgaaaatatatttaattattgatttgatgaaactaagttagtattataaatattactatatttgtctacaaacttagtcaaacttaaaacagtttgtctttgactgaagtcaaaatgtcttaaaacctgaaaaggatggagtatcttttaaatcgctaagaatgcatataaaaaagttttacatgcagttttttttaatagacgttgtggcttatagtcaccttctgcgtaatcaatgaaaccctttggctagtgtcgtgtcacgtgactggttattagaggctaccaatgatacggacgatactagcaagagttggaagtagggaagtttaatgcatcgatgtcttgggattcgtaacgccaatattttcaacggtatggtgtgctcattttcttcatgtataaattagggtggtttgaagtgcgaaaggtaaaatattggttaaatgattatcaaaacaagacaatgataataaagtaactaaaatgaaatgtactcgctttccttttatttgttaagatggtggtttgacgatcgttcgtgcaggtacaactacatatcacatatctaggctatattatttgggttggaccaagttagtgtttggtacattggcattttttctttggaattgtgagatttttttcgaaaaatttccaaccgatttctaatagatagtagtttatgtttatgagaaaaaaattcaaattcatttatgttttaaaaaatttcaaaaaaatatatctccctattcctaaaaataggacaaaagcaaatacttttcaccggtttcacgctaagcatctaatgtctcggagcctcatcggttacccatattcactaataaatcaaaactaataaatcaaaacagcttatcaagaataaaaatcattttagaagtaaaacttttatatatctatccatcaatactaataaaaataggttaaaaatatctaaaaatcaactacgaaatcaaatttaaaaaatttaatttacttattgggtgctctcgattattttccccgtcagttgacaggcagagacagagacaaggaggaggtcgtgcgagaccgcgagaggcgtgtgcgccgtgcgcgtgtcctctgccccttcccttctccccatctcgcctcgctcccttcccttctcttgcccaccgccaccgccccgcacccacccacctctgcctagatccgtctccaccatcgatctccctcccatccccggatgcgcaaggtggaaggcaagatcgaaccctaaccggcgacggaggaggagcggctccaccaccaccacctcgaaggagttgacaggcgggggatggattctgcagcgtgatttcatttgtggttggtacggaagccctaatgcagcatgcttggattgctcgtagggtaatttgttgtttgagcaaccaatctaatttgtcctgtccaatccatcctgctatttgtgggttttgttggattgctctcataccagcttgtttcccaaaattttgggggaaagtacataacctgctttgggtcgggtttccgacgattagtgggagatactctgattgtgtttgattagtagctaggtgccatattgtttggacttggtggtagtatagatggagatttttcgtcataaattgggagaactggataattagagtccccctatgttgcttggatcatttttagtattattattgtttttgctgggagatttatatgtatgatagtgctggaccgtatgcttccattgtagctagataaagatcagttatagaaccaagagaagtgacattcatatcagacaatatatccatatctcatttcaccatatagttaggaatagtcaatgaagactgttctgtttgctggtttgattcttaaaaagttagtatcagtattttttttgtttacttttctaacacctcatgctgatgggattcacttcttgtttgttttttcagctccatttcctgctggttcgatgcaactgctttgtaactgttgattgatgtggtgatacatttcaaaaccagggattagattctgtttatgcctatgcttcataaatcataacgatggccagttcaagcaaaaacttccagtcatcaagcaaaccaggcagtgacaggaagtaccagggtgcattggttgcttctccagcaaaagccatttcacccaagacagtcaagcagatcgtgccaggaaaacatttaatcttgagcggggagtctacaagtcatctggcatcttttttggtaaaggttattgccttggaagtagtaagaagattttcaaaagcaagatgcccttttatatggaattctattcaagcattgcaagttcttgggtaccctccatttaggtggattcaacagtgggcgccactcaaatttattgtgcaaggcattcaggttgttttacctctcggtccttcaaggccttaactctctttttttagataatggaagtaaagaccttgattctcttgatttcctagatacacacaattatttttcttctatcagcttgtgcttttgaaaattgcttgcttaaatgagatatatttctcttgttgcctctcaactaagtagcaattaccaataagaactgtcacttatgttgattgtagcattttatattccacttttgacacttctggttgcaaccataacatgcaccaggttcagatgcaagccacacactctgtccacttaatcatgctcaacctggacttaaattttcacggagaaatgaatataggtccagcactattattcttcacataggcttttaggctgctataattttcttttcaccattactatattctttgctgacagcaacactagaccattgtattacaggtttttacatatgaacgattccatttggcttggagtttgttttggcataggttatctatttatcatgcatgttgggctttttgaagcatgttctgggcttccacttagttaaagattaagaaactagaaatgaccatgtcttacaatttcttgcgacgtatgttagctacttactgagttaacatagtgaatcccagatcaattcatgtgaataatatgatggatatgtccatctatgctagactaaacctgcttcaatcctcgttttgaacatggttgtgggtttttactagtttgatgaattggtgcactgtgacacttctgctatgctgtttcacttgtttctttaataatttctttctgaatatttttctcctatacagaaattatcgacaccactgttgtttctttctgtcacaacaacattatgtgaccggtcctctaagcgcaatgatgaattgggtagcaatacagaagctcctgatgtaccttctgaatcagatgaaacagcatcaacttctggtataaggttggttaagactaaagaaagaaatactagaagtatctcttagctgaggaatgtgttgctagcttcttttcattgaatcatagcgttctagttctgaccatatcacatcacaataatgaaataaacttacggaaagagggctaaattttcatctagtgttttatttcttgttttagggatgttgctgatggcacaaaggataccgagccagataactggctcatatcactgttcaaggaacttgagaaacaaggcatcactttgcctgaaaggtaaatctaaaagtttgtttgtttttatgaacgatacatttctatatgtatcaattattcccatccagggtgcaggattaaaaaaatacaacatcttgaaatggattttctaatgcagctcttgttattgtgatgtatccagtactaaaagtgccaacttacatataagagtgggaagtgcacagatgtgtacagaagtgtgatataggtcaaataaagctttatatattttgaatttcatgagttgtatcttgtgggtatagctgagggtttcaggctatgtaagcctagtttggtgtatgagctggtgttgagcttatttgcattgagcttagtgttcaaacatgtctttctgtgcgattctgaagtcttgttatagttgtatatacacaccagtgccctgagctgcaaaaatgacatatagctgagagaatttaccttatggacatttcaggttcaatgaggatgaactacgcagattttacattgcagccaatggtgacttttcaagtttgctctcttcagttaagaagacaattcgttggagggaaaccttccatatacttacattgcacgaactcgagaagtggtcccatttagttttttggcatggattcgatactatgcttcggccctgtttaatagtccgtcttggtcttgcatgctctagtctagccccttctgatagacctcggtttgggcaagcagtaggtaacttctcagcctgctctatacacccattcatttatgtcctagattgtcttcatgtgatagtttttatcatctttgaactgggaaggaacatatagtgtgggaaattgctttgttgcttgcagtaagatattttctttttcaataaatatggttcatctagcaagatactgtccatcagcagttagtttgacagaaagaaggccatctttctttaacaacattgtctatccaagttttgagcagataataggattctgtccggctgatttaccaagaggatcactaatagtaatctctaacattttcttttcagtttctcaaatcgacaatggtattgtatacttgaccaacaaagaagatccgagaataactgttttgctggattgtcatgggatttctccattcagatttccaatgcaaatgatgaggtcgtttatcactatagttcaagaaaactatccaaatcgtcttggggtactatttattgtgcgtcttcctcctgttgtcagagtaattgcgcagactcttattcaggtaactttctccacctacatgtcatctcaataactatttaactgtccccactgaccacaaatgaacaagagcatgtcccacagacatttgttagggggggcatagttcattcatgagcacaattgcttgagttttgactacttggactatctgcctaaacaaggatggctacaaatcagaactagcattagttatgactgtgagatgacaaacaattgtgtcctgcttcctcaccacatctaatgttacttatatgttctttctaatctacctaggttctgaaaccatccacaaagcagaagttgcgttttgagggagaatcatataagaagacattagccgagttcttgcagattgtgccaacttttcttggtggcaaatgcagctgcccgcaatgtgagaagccgcgtaatatttcagtaatacaggcaggggaaggcagcaagagccaacctcgccagataaccattgatgatggatcacctgtcgcaagcatgaactttgatgaggcggagcttccatctccttatagctgcgagaatgccataagggctgccatcattggtgttctaatgctgtgggtcttcattgcatttctcgctgggatgaacgacccagagtccatctcgtcccatgccccctaaagggccttgcatttttttgccatgtcaaccaggatccacagaaccacctgagctgtcagttgtcttccatttgcatctgtggttgctagaggcgtttttcatagcagattttcgtggtctgtactatgtgcgccacatgctaaagcatcaaaagagtatcttcgagtcgctcactgggaggtcatatgaggtgtgcgattcagcattaccttgaaatagtcagttagaacaagacaattccttgttttgttttggtgccatcttagtatatatagtagtattagtttgtctgtaagtttgccgacttgtcagtttatcgtgggtggctatatagtatctagaagatggttcttacacttaatacttcctggaaaattctacgaacgctacttgaaaactggaatttctcatctgagaagccaggtccctgtgctatgtatgggtgaacggagaatccagtctggtgctgaactactaatgaatgaatgcacgtgcttgtcgaactcctaaataatatcttttttaaataaaatctttctacatatgattttcttgtaatctgttctaaatctatttttaacattataatagttatttgtttatttgtaccttaaataattatcacgtatccttgggctattcagatattcagctcaagaacacggccgtcagatcatgtgtggacggtcacgattaccaagaagcttaaggttccgttggtttattttgggacggaggaagtagtcgtatagactcttgtataactcgccagtgtccttgttctaaaatgtcaaatatttaggatccttatcatcaaagtttttgatcgaattttgttctaaaatgtcaaatatttaggatccggaaaaatattttgggaaggagagtataaaaatataaacactttactttatcatatatccaaactttttaagaacctgtttgataacttacataaataaaatgagatgcatatcatttctcgcaatatagctgggcagttgtaaaaattgatacagtcgaagtcaaacagccggtgatgaaactaggtatatggataacaacataggaatgttcgctgtcgatggattgtgtgagcaagccaatggtaaggtatagtttcccgcggtagcatttccttttaattggtattatttgctcaatccaacacactccaattgaacagctaggttgtccggtgtagaaaatgttacaagaaagcaccgccgaacctcccaatgcttaaaagtcaacatagtcatatatttaaaaacgaaataagtaattattttttatttgaaatgatattatagcccacttactctgtaataaaagtagagggattttactctactactcccatacagtatatgtagtgaaaggttttttcaccaattgtaccacagacaaatccaaaccaactttaaagttgggttgagtgaaagtggcaaagaagcaatttcctcgaaccctaccctaacgccattccccaccccagcagcagcagcagcagacgccagtcacctcgcaatctcacgcggtcacccgccgcatgaccgcggctcgatagcgccgccgcctcgccgccgggcgtctcctccccggcgccaccg

SEQ ID NO: 38961 - DNA, 34792 bp, Oryza sativa
tcccctcccctcccctccccgagggcccacggggtggacctccaaccccggggccccacaccgggtcctcttcgagatccgcatccgcccccgccgccgcatcttgtcctcttccccggccgccgctgttcctcgatcctgatttgctggtggccggccgccggcggagcagcccggaaggtctacggcgcgccggcgatgtcgcccagcaccctcgctgcgtcgaccagtatgaaatggagcaggtcagtttcgaacccaaaaaattgtaatccatttcatgagccggcatggacagattagggatccatttggaattcgattgatgtttctcctgtcgaattaattcatccagtttcgtcccgatttgatttactaatagcaattcgtttccattttatttacttatttgtggttcagctgaatccccaagcctcactttaggtctgccgctgttacaatgagtccatcaaggagcaggagcaacagcaggagcagaagcagaagcagaagcgggagcaagagcaagagcaagagcaagagcaggagtcgcagcaggagcaggagccgaagccgaagccctcggcgagaaaggctgcgtagtgagcgtgtatcacgtcgcagccgcagccgcagccgtagccgtagcccaattcgtagaagagaacatcgcggccacaggtgtgtctccaaatcttgcttgcaagtgatgctacattgagttgtatatttgcgtagttctaggagcagatgccggagtagggtagctaaaggcttcatctctattgcgaagctcaaataccatgtagattaccctgctaagttctaaaaaattaggaactaaaaacccacttgtgtaaaattatactagcccagccctaggtgagagctaaatctggctccgcccctgcacggggtgtttatattacctgaatggtacatccaataataacattgagttcacacaatttttgtttgcctccattattgtgttcattgtctgctcttcactacattttggtcatggacatacgttagctccattgagggaaatggattgttaaccaaaatttggcttgtggtcaactggtcacggaggtgttaggataattgcatggcaaatgtatggtagggttggcgaaaagcccagaggaagaaagagaaacatgttaatttatttagttgttctgccaatcccccagacttgacccacctcaacccccaaggtattataaagcttgtttcagggttcagtcctattaagctataactatgaagtaagtttaaacttattaaagcataatatctttgaactgctggttcaatgatccaaccattattcagacctattagacgttgaattggtcatgtaaccagtttttagaatctgtggtatggattctggaggggcctttactgtttccatcaacaaatatagcatgaaaaaaaatctaaatggtagggcttaactagtgggataaatgttgagaaattttaagaaaaaaaactattattcatcagggcctgacgttgtcatctgtagttctctggtacaaatttgagaaacaaggctaactcagtatcaggaagtatggaatgtaataaccgcaactctgttacaatgccttaacagcgccctcactgaactgtgttatatttgtgataactagcacattattgaaagtatttcaaatcagacaatgctattctgaagcaaatgcaatgatgttttcccccatcagtatgagcccttggcagttgtcccactacatgtattatgtataatggtgtgcacttgtaatccatgatccacttttcaaattccaatcacattaaagacctgagcacaaatttacttagtgcagatacaccatgtatatccactagaaagtgtcaattactcgtgtcatttataaatctatgctctcaattaagaagacacatgccctttgaatctagttatgccaaatgtgtttttttttctgtatattggagtacaatctgtcgaaccctcaagggaataaccatgttaatatgaataattttccagggatcttatatgcaagaattgcaggaggcctggtcactttgctagggattgccaatctactgctacatgcaacagatgcaatcttccagggtaaaatgagatgaaacactcacttaatgtagctgcatctgcttcattttggggggaatctagatgttgttatcattaagtgtttcgggcctagtactgttaacttgctcttgtgttccattttctgctgccatcttttagtcttggaaatatattgaagaaagtgcgctaacttctttttgggcgttattttaaacagacacttcgcagcagaatgcacttctgaaactgtttgttggaactgcaagcagtctggccacattgctaccgaatgcaagaatgacgccctgtgtcacacctgcagcaagacaggtcatctggcacgtgattgcccaagttcaggatctagtaagctatgcaacaaatgttttaagccaggccacattgctgttgactgcaccaacgagcgggcttgcaacaactgtcgtcagcctgggcacatagctcgggagtgcacgaacgagcctgtttgcaacctgtgcaatgtctctgggcatcttgctcggaactgtcaaaaaacgaccatttcttcagagatacagggcggccctttccgtgacattacctgccgcttgtgtggcaagccagggcacatcagccgcaactgcatgacaaccatgatctgtggcacctgcggtgggaggggtcatatgtcatatgagtgcccatctgcaaggatgtttgatcgtgggctccgcaggttctgatgacagccatccatacgcactgctggttctgatgctcggaatttcgcattgttccattgattctgcttagatagcttgcttgactataccgaaacggttcttttataccttttgctctctgggagttgaggaatgattctgtaggatgtatttgggtgaaacttttgcttgtgttaatcagggtgttgtagcctttcgtgggggaacaaaatgatgtatcttcccaagagagacatccagaaaaactgctttggtagaccaggccatatcaagtattgtgcatgactgtttgagctatttgactcctccaagcttgctcctccccactgactgttgcgtcgagttgtcctcattgttctgtattctcatattatcttcctggaagaaaagttgacgagtgagatcaggataatcagattatgacagttctctgatggtctttgcctttaggctgatttggttaaggaaaaaaagctcacatcttcctaaaaacattgcgtttgcccaaagaaaatttatagttcatatttgcatattttgattatgtgttttgtattttttttaaaccttttccagttcatattttgattatgttttatttgtttgtcttttcccaatttttatgcatttgcccaaagataatttacacttcatatttagataattattattttctgcattttgccaaagagaattagcactttcatattttgattatgtttttattttgtcccacaagcgcattttcccaaaatcacacatcatattttcccacaagtgaatttgcccaagaggttatcttttaatttagtcccacaagtgcatttggccaaagccaaagtcacgttgtatccaacaaaaagaggggaactatctttatcttttaattttgtcccacaagtgcatttgcccaaaccgcactttcatattttatccaacaaagaagcaaacgaaccgaaacgctacatcactcaaccttgatgaataacatagaaccacacaaatcatccaaaacatttgatatttatcaaaataaagagcaaacgaactgaaatgctgtattgcttaacctcgatgagctaacataaaccacacaatcctcccgaagcattttatactttatcaaataaagagcaaacgaacggaaacgctgcattactcaacctccatgagtagtcagaaccatacaatcctcccaaggtgtccatgagaactgagaacatatcagcaatttattctgtaacttgaacattgacacatctcaattaaacttggaacagtgcatcacaggcccatacattctgagcgcaacaacgaaatacaggatagagccatatctccatggttccatgaacaaacccacaaaccatcaagcagtctcacactaccaaatttagtgacacacaaatccataatagacaagtccatattgcaagatcatgaaaggcatggcaatgcttatttcacacgatctttgagcgcatcgagactgatttcgccggcgtcagtagcctgcacttccaactgaatgccattcagctccttcttgaatctttcgttggagctagcataaagcatcttgctcctcacttttgcattgtctggggaccttcaattcaatcacaacatatctcataagcggtaagggtaggcctacagtaaagtaactatggaatagacggggcacagaagcaataccataagatatagaatatcctgctctttggcacatcctctgcagtaaggaagtcaaagtcatagattgcaaaccggcagtccccttcaggcaggctgctagtgaaatcctcatagcttgttgtgcgatccccaatcttgtccacaatgatctctttccccttgttatccatcatgaaagttatgaagcggtgcatccttttggactgtagctcattgaacttcagcttgcaatcatcatgaattgcaactccagatgatgaatttgcctgtgtgtaatgtaacatcatgtaaggaaatctatgtcagttcatagttactcgagtaattcaaccttgaccttttccttcaaacaatataaactcgtgtgaacttagcattcaacatatgcatgcagttgcttcacctcttatagcgttgccaattataatttacatcctaaaatcagactgttcttcagtttattcaggtagagctttatcgtttttaattagttaatccgctgtagttatttgttctctcaaacctgatggggagtctcaatataaaactagactggtggtgctaccgtgctactgctacctcaacagatgtgcccccaaattaaacaatttagggattaataggaatgttcattaaacactatgcaattcaattggcatggtcgaaaagaccaatgagaaaatatccagccagtaataggcaaagaggtgtgtgccatatgagaccaaatgataatatctaaaccatcaacacacactccagtatccatatctgcaggcgaaggtcacaacaaaaaaaaaagatgagtgatacagtgtgcatgaagatgttcgattcaaaggtgaatcctgttctatgcaatccttttcatgcacattcactgttatttttgcaacagttattacaccaagtgccacatacaaagttgcaaattggcagcaaaaggacataaaaaggattgtatgaaataatttttacaagctatgactatcatgcaaggatatggactacaaaaatatggatgctgacgtactgtatcatatagtctacgttttgtgcacggtcacttgttgctggtggtttcatcagtgccaattggaaggtgtagtcattgcactaaccattcccttgttaatggcacacgtccatagggatcgcattaaaccacatttagctgtcttataccagagatatccccataagatcaatagaatcagtgggatctgaataaactgaagaatcctgatgagaaacaacatgcagcaacacactcttttcgctgctaattccagaaaggctagctggcagctatctcatcatatctggacatattgcagtggtctaacctcagtcagcatgtgatccagatacagatcaacttaaattccacgactactcgacgtctgacgatctgaatctaacaatctggagctcatcagctagaagctgccagattcccaggcttaaatctacatccacgcgaatctcatcacaccgcccccgcatgtgtgctttgacttggttccgctaatctcaagaccggacagtgtcactccaacaacccaagcgaagacctcaccgatcgacgagaagacaacatccaaaattcctcacgatccagtcggcggcgatgagaaaaacatcaaaccttaccccgccgcaacataaaggaacagccgatccacaaccggaagggccccaaatccccctcgatccacctcgattcacgaccaccacacctactatcccgcttctacgccccccaaactccaccaaaaatcaaccaaaggaacacagccacgaaccccggaaccgatctgaaacacatctaccgaaaccgacgcaaaacatcgcagacacacgggggagggggaggaggaggaagaggagaaggaaggcgtacgtaccattgctgagctcggaggggaagggaggggagcggaatcggcggcggcggcggcggaggcggcggcgcagcagcagcagcagcagcaaaggggaaagcgagacgcttctgctactgcagcgagctcgggcttttgttctcgtgtctttgtgttgtgtttgatggagtcgccgcggcgtccactgctcccaagttcccaacccaagtggttggcctacctctacacgcctccgcggtcgtcggattcccggatggacggctgagatgaggcgtgacggcctatcattgctgccgagaaaagttgtccaggcgaaatgtccttgctaaaagcgagattttttcccccgtattttatttatttatttttatattttattttacccttttatagaggacacgtcgttatatgcttgtgctgatctgttccatggacgaaattaaggtgcaagcgcgatcgaccgatcaccggtttaatcgtctctttattattcgcgtaatgtaaattaaccacacacgtacacaatccaaacaccaagcaagccgtacaaaccacacatacacatgggctgcaatgccaacgtaattacttggaaaatcgaggtaattaacggcgtgattaattaggaggtgtggtccttgagcacgtcgagggtgagctcgctggggtcggtggcctgcaggtcgatctggacgccgtcgagctccttcttgaacccttcgttggagctcgcgtacaccatcttgctcctcacgtccgccgccgccggcgaccacgacacgaagaagatcttgctgcgcggcgcctcgccgccctcgccggcggccgccgtggccgtggcgtcgctgacggtgaagtcgtggtcgtacacggcgtagcggcagccgtcggcggggaggctggcggtgagctcgtcgaagccggcgtcgcgtgggcccaccctgtcgaccaccacctgccgcatcgcgtcgtcgatcttgaacaccacgaacctgtgggcccgccccgccctcagctcctggaacctcgccttgcactcctcgctcaccgccacacccgacgtcgcgttcgcctgcacaaacacacgcataaagttctgaattctgaaacttcgaacaaactgatcactgaattatgaccaaatcagtgaagaactgatcactgaattcttggcaaattcagttggcaagacaacaacctgaattctgaagcagtgagcagctttatcatgcttaccatgtttcgttcgaagtgtcctggagaatgctctgaagaagtctgaagaaacaattagttggattctgcaatggtcgatcagaagttcgcagaaagtagttgcaattgaagatttgcactcagtagcttgtgagtgttttatcagaatattggatcctttaataggatgtccgagtccttttcgaagaaataatttagagggagatgtgtacacgtgtgagcatactgtggctttgttagttttgctctgggatagatggttccagtcttccagatggtgtcttgacgtggcagcaggaagcctaactcaagccacaaacactctcccagccaaaactgaaactacaaaactccaaattccgcttgtgcgtcgtttctctcacaagcttctcttgattaattcaaatcagctacgtcttgctgactgaactagtcatgacgttgaagctttccatatgcgatcagaaatgataataattagctctaataccgttacagcgaattcatgatgagtccacgttgtcatgcatatgttgaggatcgatgcgagaaatatgacaccatgacagtaaacaactgaaaaagcttcagaattcgcagctgttgcgtactaatcgtctgacctgtgcaaggtagctgccccgtcacactttgctgtgcaaatggaccaaatccaccgaaacaaatcggccggccggtgactttccaggacggcaccggcgcaccagttgctcgtcgccaccgtgttttctttttatcaagggaagaaactcaactgaaatgcgcccagcttggcatgtctgtactatgcactgccttgacagtgccacgtacacagactcgaacgactagccgcgtttccttctgatagcttgcgtatatgagcttttctgatctgtgacgcctggtaaagtggtaatatcatgtacggtcaattcaccgctgttaggcgttactagctgtgagcctgtgatgtctgacagaccatagaatggaatgggaaccatcggattagctaataacggacggtcatttttgttcagcacctcaaacgtacacaagaactgtaattcccagggcgaaaaaaattaaaaacggcacttattaaccatttcccacctccactgaggaaaaaaaaaagactacatttttaagcacatagaggtaccaattttagataaaagtctatgcctataatattaatatattttttaaaatataatacttataatatatcatagatgtcatcactacaagctgagcgtgccacgtggggaaaaaacgacgtgtggcatgggagccaaatatatatggttctccttatgcccttatcctcagcttctcccgctccagctctcttctcttcctctccatccgcgcctctccccagcgaccagtggtcggcctcgcaccctccccccctctagtgcttggcagctagaggccccgtttatccccagccctcttgtgtcggattctttagtgacggcaagggtggtggctccaatgccagatctaacatgtccgagctcgaagacctccagatttggccccgcgcggtgccctccaccagatctgctctcgatgacctcaatagcaatctttcctcaacaaccgccttgcctcagtcgatgctcagtggccaacggccttccctagacgtcgtgaagtgaatggtcgacgggtttaatttgctgatttgcgaaaaaaaatttgttgtctttgattatgtgtatgcccacgttatgtgattttcaatcgatcttggtgacgatctaatttggatttgagatttgaattggagttggggtaacgaggagtaactcgatgtatcagctcgatttctcaattgagccttaaatgtgctggttatggaactggcaccaatgactcggagtcatctacgccacccgtaatgccggttggaaaattcggcacctatagggatttcgcaatagacaccgatggtctttctgtaacagtggtatggtgtagattatgtgtatgtacacagaacaaactacgcttccatcatgtgagtaagatctctgttatctaaattattctggcatgtacatgtgtggtacatatataaatcaatatttgaaaacagggaacaatggacgtagaacacagccgattcgatcgaacagtctgacacagataaaattcgattggagaattgactaatgaatgaatgaatgaattagtatatccagcgtaaagcaattcctacaatggtaaaatctctatctgaaaaaagaaaaataatgaatgcaatagccacaatcgtgcaccaatatgtacaggcagcaatcgcacgaatctaaacgaagagctcgagcagaacgggcggcgcgtgcaccgccgcggcggcggcggcggcctcctcgcggtggcggcgcatgtggccgccgagcgcctggcccatctcgaagccttggccgcagatgtggcactcgtgggtcgccgccgccgccggcttctcctgcaccttcttggtggtctccttggccgtggcggcggcgaggccgagcgcgagcccgtggcggccgcgcaggtggctggtccggtggccgcccagcgcctggaacgacgggaacgcgcggctgcacgtcttgcagacgaagtccccactcccggacgccgccggcgacgacccgcgccgcggcttcttccgctcgccgctatccgcggcagcgccgagcgtgagcgacagcgagaggctgatcacctcgccgtccctcggatgcttggtcatggtcaagaaagaaaccgaacgaactggagatcgatcgaacacaagatgatcgacgagacgagttttagctagctagcttctgactcgatcgagagaatggttaatattgctgtgctggtgttgggactgggtgttatgcatggggtggctcttatatacggtacgaaaggagatgagattgtcacgtgcacgccacggcgcaggcgcggtggaggacgccatggcgagcgcgtcggtcgcagtcggcgaatcgtctgaaacgtcggaaccttctgtacgtacgctttgggtgggacgcgtttactaccttgggccggctggcttggcttggctcagatgtgcgtgtgcgctggcctcacaccgaccgcgcggcccgcggacaagacaggaagggtccacgaaatagtcaagtgggcgttaacataaacggtgggggttacgttagaactccgtataaaaaagagtgtagttttacagtgctcacatccaaagtttaaccgtttatcttatttaaattttttataattagtatttttttatttttagatgataaaatataaataatactttatatatcactatttttttaaataaaattataaattttttaaataaaacggatggtaaaatatttgacacggaaacttgtatctgtactcaaattgggacgaaggctgtgtttagttcagcgtaaagtttagattttagttaaaattggagataatatgactgaaaagttgtgtgtgtataacagattgatgttatgaaaaaggactgaagtttaaatacaaactttggatctaaacacagccgaaggcagtagctgcgagtagaaagggtgtgtggggcccactggtgctgcaccgttggatggttcggggtggtggggtccaaccgacgtttggttttgaccggtcagagtgctagtcttgcacccgaagaagaaagtgagtaaacttccgttatttggtgccttcgcgttggattgatatcgtcatgcgtactcacgtgaggtcagtactagtagtagaagtacttggcaggaaatatcaggtactagcaacctaccacttccagatttggatccgcgcgtgttctccaaacaagattgtggataaaacaaacggaacatgtaaggtgtttgtgctgtcaattgtatgatactacgtactttcccgtgaagtatacgtagcacatacaagcaactaacgcgctcaagattattcacccgtacgtactcggtactcctatgtgagaccattcaattcatacctgaagagaagtgctgaatattggcttgctgtttcttacgaacaaagactcgtttcagtttcaggttcggtcctagcttcctgtcactttccttgttccatccttacgaaacaattatactagtatatagtaatactaatactgcgaagtatccgaaggggattgattagctctagcttgattagtttaatttacagctcctttcgatggacatgcatatgtatgcatgtgtgtgtgcttgctcctgctgtgactacgtctacaagcgtgtgctcaaaaactgtgtaaattaatatctactatgtgatcgtttagtcggtgatctgtttgctagggaatcaattaattagtgaactgacgggcgcgtcttcggtcgtaaatccctgaaatccttctccttgatcagcttgaagaggtccaaatgtgttaatttcccccaactagcgtcaataattgaagaaaaatgataattcaaagagagtgttgttttctgccaagtgttgccctatgctaatattgctgaagcagtttctctctttgacaaatgtccctcgtggatgagatcaattgcattatagtttctatccagctagctagggacaattttctgttgttttctctcaaatgtttgggtaggcacttaattaatggatgagagtatggaagaatcacacatgatcgtacctatacagtggtggttaatcttgatttctttttttttcttaagaacaagggcgagatttgtctagcctgtattatgtaatttcggagtacttgaggtaaattaacagagagtggatatatgtacatacttcctccgtcccagtaaaattgacgtttcaacgccccaagcttgtcccaaaaaatgtgtcgctacacagagaagatgcactcctggacgccaaagcaagtttaattgttgattcaaatttttgaatatgttaatgatggctttgcccctttatcaaacatgtggccaaggcgccaatttgtgtactccccgtaacacgtggtagtgagttgtggttacttcattactgctggaaacatcctctagaatattcggaatgcatgtataaatgctggaaatgacagctgaatcaaatcatggggataatttggtaattttgcacaacagctaatcttggatgctaaccttaaaacatcaattttactgggacggaggaagtatcagatatgtccccccagtaaggatctagtcagatcacatttagaggttgaaagggatatgacgtggctacacgtataaggaacaaattcacagatatatgtgtgtctccgtcagattctgcacgcaacagtgcaacactgttattacgcatatcgaagctcagttgaacttggactgcaaatttgcaatcagggactgggaaatttaaatatcttttttgcttgaagaataatctggggataaaatttcggaaataatgatcaggaggaacagcgcgctgaatttatttctggcacaaacataaatgttgcatatatttacaagaggtatagctatgaatgaaagaattatattacatctgtgtgtgtatatacatctgaactcaacaaatctccaccaaacggttcaaaaactgaccgattcaaaaccgaacaacccaaacgctaatgaaaaaaaaaattaaacccctatcatagttacaagatcgatgaacctgactttttttttctagacatgtacatgaactaattaatggtgacacacactgcgtcagttcaaaacttggacgaaactaatggagaccagcggtaactaggcgaacaactccagcaacaccggtggctcggcggcgatcccctccggccgcgcgtcgcagcgccagacccagtcgtcggcggaggatccaccgccggcggcggccatctcctcgcggtggcgccgcatgtgtccgccgagcgcctggcccatctcgaagccgaggccgcagatgtggcactcgtgcttgtccctgtgctccttgtcggccgccctgtgcagcctgatcgccttgtcgccgatggcgccgaggtcgagcccgttgctccggccgcggaggtggctggtccggtggcccccgagcgcctggaaggtcgggaacgcgcggctgcaagtcttgcacacgaactccccttcccccgacgtcgccaccacgctcctccgccgcgccctcttcctcctcgccgcgccgcccgccgccgccgccgacgagtccgacgccgtgacgagcagtccgtgctcagcgccagcgccagcgacacctcctcctcctgcctcgggtgcttcatctccgattcgataagcttgtgaattaatggatcgatggattgagagagagatttttggttggggggagatcgatggatgggttggtggcgcgcgccgcgcttatatataggttttggagacgaggcggtgggggcttacgtgtttgccaagaaggtgagggggaagcgaccgacatagtggcgaggtggcgtggctgcgccaatcgcgtgcggccaacgcgacgagcggcgaggtggacggcttggatttggatggggtcggggggagtgggatgcgggcgagacggacgtgtgggtgggcagtgacctcatcagctggcacggcatggcaaaccatggcgcgtggcggctgttggttgcttagccgcgggggcaacgtcgtcgcccgcgccgccaccgcccgcggcggataatccactcaattattttattccgatcgattatattagcactagttgggccctgcttggggttgctggaagggcctagaacgttctcgagctcgatttgctgagcgatggattgtgtctatgatcgcgggattaagggctggtttggtttgaggtctaaattagccttatcaatatttatcaatttcaatagtgtttactgtttatatggtttgaaaccaaatttaggtatacctaagaaaataggtcatttcaatagttaacttaggctattttagctctaatccagacataaatttgccttgccaaaattaaccatacaaaaacttgctaaaatttagtatcgacgaaaattggtaagaccaatttaggtcacaaaccaaaccagccctaattaattaaagcacctatagtggtcaatcgaccgtgaccatccagaacatttgaacccggtctactgcagtacttttatggagtactagtattggttttactatttgttacggtgaaccgtgaatccagaccatagacacagttgtaaacctgtctccgttttgtgcggccggggatagtcaaacgtatatacatcgcgatgcatgtacagtctcgatttcctctcagacctgtagagctgtgtagaaactgtacgtatgacctgtgaccgtgatgtgaattccgtcccaccacacacgtacgggaagtcggaacgggagggcgcgtgcgattaaccgagccgcgcctttcgcggaggccggccgccgcgcgatccactccacgcacgcacgtaattacgtacgcccccggtcggtgacagctagcggcttacgcccatcaacggcaggcgggcatcaggccggcttaaccccagcgcggcgcgctgcgacgcggcgatgagattggcagcacggccgaatcgtgaggaaaaatggcagaatctaccgcgatattctcacgttctccattttccccacaagcgtactagtccaagccgcacgggcgcgcggcttccgtttgcctcgcgcgcaaggagcggtggttcctgtcgttgcgtcgcgtgcgcgttgcgcgatgatgtgtaaccggtgttgccgcttgctagtggaaactgctcgtactagtcagcggagtttggtcctactggctactagtactactcggttgcatcatgttggttcgtatctgatgccacgactttttatcttttttttccctgcattgaatttctagagagttgggggttgggtacggagaacctggccttttttttctttttttttctgggaatacagaacatcgatctctggttttgtttatgctggttccgggaggccgcctgccttggtcaacagtacttcgaagaacgaaccggcaacaacctctagagggagcattagatttgcagtgatgtcatggcaacggttgttagtgctctttcttttgctcaaatttacgtgtgccccaagtgggcaggagtctgaacgcgtactaaaaattcttaggcgccggacatgagcttcatgatcataactacagaaactagataaatggataaggacatcacatggatcagcatcggcgtctctatcctgatttaaaatataaatcaggagagagaatagcagcgggctacagatttatatccagctgtagcacggactccaagacgcagtgtatctatgacatgtgagactagatattaatagtgtattatataactattgtataaatgagctattagattggctatagatgaattggagctagtagttggctatactattgaactttctcttacatcgtcaagtgtctacgcggttaagcaggtcggtctgttcttgcgcaaaaggctaataatatctactccctccatactccgttttatattataagttgcttgttattctttgcagtagaactttatcaagtttgactaaatttataataacaactagaatatctaattagttttattaaatatattttaataatatatttattttatgttgaatattatttttttataaatttaattaaatttaaaaatattttattagaaaaaaaagttaaatgatttataatataaaacggagggagtatatatacatgtcatcgacgacatgatacctggtcgtcgaatcagagacgagtagtgcagtacggagtagtcctgaacgagtcctgaccccatacttggacggtagttcttggatggatttcgcgtgagtttcgttgattgagctccatatggtacggtgcaaattaggcggcgtgttttccttatatctgaagttccttaccgggcgccgcttgctgcgtgacagcttgagctgatcacctgctataggtttctacatgcgcctctgttcttcgtgtgaacagtgagctagcttactgctgtgagcctgtgagctgtatatatggtggatcaatcatgtatacttctacttgggttgccgacatcaacagcttccctgcctactgaggcctgtttctttcatcttaaaattattataatccagattattagaagtaaactaaaaaaacagacaacttattaaagtagcttattaaaatctggagcccagcttattataatctgataagctcatttaggtaagctttttctagattattaggtgaaaaattacccaccatgccaccccactccctctttagacttgcaaacctaataatctaggaaagaaacaactaaccgcttattctactacagattataacaatctagcttacagtaatctgactcaataatctagattataataatcttaagtcgaaagaaacagagcctgagttaaggccttgtatagattaaaaaattttagccaaaaacgtcacatcaaatatttggtcacaggcatggagctttaaatatagggaaaaaaccaattgaacagtttgtatgtaaattacgagacgaatctttttaaacctaattacgccatgatttgacaatgtgatactacagtaaacatttgctaatgatagattaattaggcttaataaattcgtctcacagtttataggtgaaatatgtaatttattttattattagtctacgtttaatacttcacatgtatgtctatatacctcaaagtttttacatctgaagaactaaacacaccctaaaaaccaaaacttgaaaacgcgttgcacctaatatccctgcagtacataggctgacaattgatatggaatcaggacatgattgtaacatgaaacttgtagtgataagaacgacgtgtatacgtgtgtaccgtgtacgtatatgcggtgtgagcgtgttacttgcatctaaatattatctagaaaaataataatatcacaaacatggctatttgtgtcgttaggttaataggaaccagaagctatacttgtattttactccgttttgttagttcagcagggtcgatcgacgaactcaaggagtgggtaatcgtatacacttatttactccataactggttgcgcgtcaacccatttatctttaatctagcttatcaaccatggttaaatttaaattttaacacttaattttgtagtagtggattttttatgtttgttttatccgagatttttttttacgttaactcttaagtagctaggaacaaatatatataagtttttactcataaattatttttaagctgctaataaacattacaatttatagcaacgaagaaactgattgttagaaagaaaaatctgacgataataagtgagccacaaatagaaaggacaccgaccaactgctgtccactgttgttagtccggtgattttggtatgctaagagcaagttcaatagtatagcctactactaactccaatttatttatagccgatctaatagccaattcatacaatagttacttactatactattactatactattaacatatggtcccacctgttatacacatattgtgtcttaaaatccatgctgcagctggctacagatctgtagcccgctgcttttcttttttattttttatcttattaaaatatgtttatagctggctaatagtattgtacctgctctaacgcagactctagactgcttagcatacttccattgcggccatctggcttttagtcggttagcatacacggttgagctcacagcgtactgacgttttgtcccatgaaaacgacgtcggtgatgacgtgttctcctgtacacgaagagatagagctcagccgacatgcttcacgttacgtgtcgtacttttattagaggcaaacaacctgaagcagtacacgttttcgtcagcctgatgacaggttaatccactgtaaacaatcaaaattcataatccgcgtgccttgcagggtttgactacgttatttactggtattcgtccgaacagaataacacatgactacgtttcagatgcaagctcctaccgccatacgctatgcgcgaaattgccaccttgaagatgcgtcatgcccttgggatacttttcctcatttcactcactcttgaaagccacaaactgcctagcctggtttaaggctcccctgatcaaaacatttctctaggcagacggtcaatttttgattgtttaataagttcctggcaaaattaaaaacagcatcgaacaagaaatttcttctctattaggacctaaatctacctacagaaacacagcacgctatattggtagagaagaacacggagatctcacaaaattcatactgtttcaaggggtattttgaccttttcccatgtaaatacgatgataattccaaatctgacaatgatcatttatatggacaagtgattttcattgcaccggaaggccataatacaaaatctggggcaactctaatgtaattaattgggtgaggttccgaaaagctctataccagattgatgttataacgccaaaacttgagatttgtgatcaatcccgttgaatataaatgttcccagcaaaggcacaaactgtttggtgaccagctggaaaagggaatgagtagttagtgcgatgaaagaacaattaatggttgtccacaaattaccgtcacgagatcaaaacacaccttaattacttcttgggatgctactccgccaatgaaggcagccacgggatgaatctctgcacccccaaaccggcacatttcagtaatcaggtcttcagacaaaggtgccccgttcatacccatctcactcattactgaaacagcagctgtcttcagcctaggcacatcctcatcaatctcactaccgaatccagtgtattattagtattataaatacatgtacgatgttataatgttcaccgaaagtgaatgaacattttactcatgcttacctttcaaagattccagggcatctgttatagttggctgcaagtcgatcaacagcacgtagcagaacatagaagttcattgcaaagctgcagccaaatttgcttgtcatttgaataacaaataaatcaataagaacaagataacaatggctagtcattctaacaacagttccggcaacatacaaagcaaaggaagaaacaatagctgacttctccacctactccaaagttgcactgcatgctacagtgtgaccaactattggtttgaaagaaaacttgtgtttgcaacaagacgatgaaaccacaattcgaagcagaaaaagtcttcaataggttcaatcaaggcatcttgtaatcctggtattgcattacaattcagtttaacaggtattttcaatttctatgatttaggataggctgatattctaggatgcagcaacagcagtactacctttgtaacagctgcatggagcttgaaaactaaagtaaagatgccaaagtatatgaacagagaaagttccataacattaaaaaaatgacaagcacaaaggagtaaaaggtactgaccagtagtcttcatcggtgaagtatatttgaacttcagaaagaacaggagagctaaactcttcctccatactgcggtacctacagacctagacagcagatatcacttactcaataactatcaggtatagttctacaatatttatcaatcatgatatttaaagtgagagataagaattagcatgttatgtcaaatagaaaattgaacacatgcattccagtggaggaaaataaatcaggagtggcatagtttaaaagggacaattgcacctcttgtacaatttaattcttttgaaacaagtgcaaaagcaatgatcagtactagctagtagctagtataccatacacatacaatcagctttgtctttatcaaatatatggaatatggatagggtacaaaatactacaaggttcttctcaattaaaactagttagatcaaatgattatcaagcacatcattgtagccatcccaaacaggtgttacaatgtatatttaaagaaagcagcttactctgagttttctagcatttttgcaaaatgtttttatgtatgcccgtgaaatagaatcagggtctctatcaattcgcttcaagatatcctttacatgatgctccaaggcaaggcagtcagattcagccttagcttggtaaatcttttgcaggctaacatagtacctgtaaggttataaaagagaaacagctgcattcatgtgatagaagaaaatagttcggcagaagttgactgaatctgagatcattgcaaagctagatgactgcagggcactaactcagtaagtgaagtcatatcaggtatcgtcccctcaagaggtagctcaccgttgccctcatttgcaataaattcctgtaagtagcaagcgagagaaagaaatccaaattgagacatgaatgctaataaaaaacaataatttcaaccaaaaaaagaaagcataaagtatgagtaagtccatgttacacccctgaactctcaaagaaatttaataccctccaaaataatatcatatattcagaagctatatacgctttcttccggtggcactcaagagtcagactcactaccattggaaatgtcaatgctgtatttctttttcttgtttggatggtttagacaactaagcaagctaaccttttgaattatacccatgatgttactgtcgatatagcaaaagaacagagttttttttaatcagaaagaacaccttgagttggattcatgccagcaactgcggctcctccaaaaacactttgggttgaaaatttaccaggtttactaaatttttggtgctcgataatcaattttgtacttgtcagtgttcgatatatttcctgagaagttgaggtgcgtttagtagacttcttgctaagctgagggatgtaaaatggaaacattcctaaagggatatatggtgcaactttacagatggtaagtgtgaagatagttcataaacaacacattatttcaggctttttaatatacattcattatgaaagcagcttcagacacacaaagcttctagagcttttttgttctaaatgagcattctccagggagagaactcatatgcagctttagcataagtatcaaaattccaaagctacctgacatttgcttcaggttatatgaggcatctggctagagagaagattaaccttttggatctgacttgttattttagcccaaaaaataaaactagaactgggtgtctagatcatgcaggttcattgaatatcgcagagacacctcaactaacatatgattcacttttttaaaacaaagaatcattgaatagcgccgagagacctcaacaacatatgatacacttttttaaaaaagaaaagtatcattgaatattgctgacacctcaacaacgtatgatactttccaatttggtttcaacaacaaactttatcaagagtgcctggaacctcagataacagctcagtggtatggcatatcagacaatagaagttggcattccataattgtaaatcacaattataactaccttcaaagcagccactaaaacccagaaatctgaagaagatgaattcacttcagcggagctatcatcaattatctgacggatctcatcacctagaagaaattaaccactaattagaacttgcagttctgcacagaagctatgttatattgtgtacacgtgcatggctgcaggaacatacaacaagaatacaacagatatttataaataagttaaaatatttatgggttcaaaaagagactacggctgtgttcggtatccttagttcccaacacctcttcctcgtgttccgcgcgcacgcttttcaaactgctaaaccatgcgtttttttaaaaaaagcttctatacgaaagttgcttaaaaaatcatattaatccatttttgaaaaaaaaattacgtaatacttaattaatcatgtgttaatggaccgttctgttttccatgcgcaggataagtgttcccaaccctgatgtccgaacacagcctacatgtaagtacaagacccaggaggtgtttgttaacacataggccacattcattcattatgtaaactagagtgacaacttcaagttaattcaagtagtttttactagtggtatttaagaaaggaaatagtcaagcacacaaaattatgtctgcaagtaaaattatgctgatagaagaacatttaaaaataaacttactgatccctggagtaacagagactttatacgaggactccactgcttctttgtagttttcttcatctaaattaagcatatattctcgaatcagtgcctgaagaagatattagattagtcaataacctgacagtccccaaaacacattagcaaccactttttactgattggggcaacaacccaaaacacgtaccttgaattcatttttctcttgcctagtcgaaggtaagcgcccatcatgtgcatctgcccatttttctgcaagcctcacaaggataacaatgtagggagtgtgcttgtgcacaacaggatctttatcatttatatcaattgactttgcaaatctgaaaaacataagcattaagatcaacagtgatttcatctagaatgagaaaaggatcatgcaacttgctatgccaacatgtaggtacaaataactcttactgcttgagttcaacccatggattgtgaaggcgtaaatcatccaggaagtggtccggttttgattctataacattgtgctcctgctcaatagttagggaaacagttttcagtctggtgaaaatgctttggctcatgactactgtggaaatgaaaaccgccaagcaacattaataagtcctaaataatgaggtcaggaaacaagatgcagtccaccgctaaaagtcaaataaagaacaactcagaaactcttgcacagatcaataaaggtaccttaacgctgatcctgactagaccagttagaccatatgaacgtgcagcaaccaacacaatatttgctttcctgcagatatcatctagtttcagtaaagatctctctggaagctgcagtagaaaaaactgggtatcagcaaaatttggccgcgagaggaaaaactacgtgcacattgttcctaacaatccatgtgtagtaaatagctaaaataataaaagtttgactgtccacactaaaaaagcatctcttactagagggagtatatctatgaatatctaatgcgcctgtgcgattataaaaacttgccaattctcatttccttgacttttaaatcttcttgttaaatgttctggctacgcagagaagtcaagaaaatcaatcactgattttgcatcttaccataagagtaaacacacacctgagtagcaatgactacggtaaattgggaaaagaatgaagggtttgtgtctatgagagccagaggagactcctcgacaaacttggcatttacagcatcattcagctcttgcaggaacgaacatacagattttgctcttgattgccccaagcattctgcatccactgaacataaacagagtactcggaacatgagttccattgctttactggaaatttatcgaaatggaacaggaataaacgcggagcacagaaattacacaggaaattgtttcccatgtcagattgttcaactttggaaccatcaacaacagtaacactccctactcctccaagcacaaggttcttcatcgcttcagttcctgtagggccacaggtaagcaagcatatgctagccttctccagtgcagcctgtccttgatcaccccatatcctgtactttgcattaacagaatcataacaggtagtttttagtatgtgggttgcttcttcctactcggatgcaaaataagcagagaataagaagaatacacaagtcgcaggctggaaaaatgaaggtcaaattttataaagtaaaactgaactgtgctatttatatatgcaactgaactacccatgtgaagcacaactacagctcagataatcagatgcacataagaaaacacccaattaagccacagactagaccaccaacaccaattatggacccctaacataatccactagggtcttagtaatcagcaaagtgctatcagtcggtatccccaactacatgtgaacaacgtaaacaatatttcaaccaaccaagctccaatgcatgaccggcagcgttcgaaacaatttctgtcagagaaaatccctccagctcttgaccacccgtcacccgaacagaaggagctccaaaaccctagatcagagaccgcgcccactcgaaccgcacccgaacagcggtgccggaattccaccaccgcgaagagccctaaaccctaggatcgaacggcaagcgcccggaatctacccgtcggagatgagagagcgcagatgcgcgccggttgcgttacctgagctggcgatcgtacttggtcttgggctccgcgaaggcggcggcggtggcggcggccatggcttccggcggcggcgtggtctcctctccgcgtgtggagtgggctctgccgctcttccgaggttttgctttgcttcgccttcgccttctcctcctcctccctgagcgaggaataaagcggtctcaagctaagtggaggcggagcaaggagaaggggatcgtgggctttggaggccaatgacatgggcctaatcgtacgccccaatattgtagctacttgggcctattgggccgatccagtttagttagcatctaccatctctacaccaactaaacaactgcacttgccataaacaagtgggattagcgacatgatcttacttgtttgacttaaagtgttattagtggaagataattaaggattaggaaggttcgttagtcgttgggggagacgaccagacatggctagattcattgtaccaattgggccattaccagacagcagtacagcacgatactactgaataagcgttgctggatattgaagatatacgcaattggagctcttgctctgattggttccacgcaaggagaaaactacacataatagctccgcttttgaattttaatttgagctaattagtcatggcttacgatcgattgagtcgaacatttacgtgctgtcctttctttctcagcactcttttctttttaataaacagtgcataaacttaacctggttttcaatttgaactaactgctcgattatggcttacagttaaggttgatcggttcagccattaaggtgatctttttttcgccatttcttgtttattaaactggatcaatgaggtggttgcagatgcttatagttgaaaaacggatttcagcgcttgttaaatgttaattatgcgagtccaaactcaaaagtcagaattgttagacagtaccaattcggaaattagtgagtcaaatgatataaaataatccacctcgaccaaacatgagaagttcagcttgcaaaattaacaattcattgctctatgatgaagtttatccgactaataactactcctaactagataagataaacaccaatattttactaaacagcaacatagctagtaattaaaaacaaatttgatttccttgctgaaagaaaaatacatcaacccccggaatgccgcggttacacgccaatgctctatttgatttttaaccatgcaacaaactgagattgaaacagtacttaattagcactagcgtaatcaactaatcgttgtcaatgtacacgtgagctcgacttagattacatggctagcaaaccaacttttctctagtttaaaagtccatctttctgaaattttaatggaacaaccagtaacagaagtctacttgtacctagtttattattagtacaactagatgaagcagcaagtcaactagtagcgcacagccaaagtcgaacaccactcttcgttctcttcgcacccaagaaatccatttttgcgagcttggtcatcaccgaaatctcattggccatggaagaatcttatataaatagatggaacacctacctctcccacgatcgcaacgaattgaagcatttcgtctcgaggcgcggcacgatgaagaggctgacattcggcgcggaaccggagatggtggacagcgcaagcatagctcaggaggtcatgctgctcctcgcgcggagcggcggcggcggcgccggctatgtcgtcggccacggcggcgaggctccgcgcgtcttcgagtgcaagacgtgcaggcgccggttcccgtcgttccaggcgctcggcggccaccgcgcgagccacaagcggccgcggggtggtggcggtggtggcgcggccgccgccgtagccgccgcggcgggcgagggggaggcgggtgtcgcgctctcgctcgcggcggggacgccggccgtgaaggcctcacgcgcgcacgggtgcgcggtgtgcggcgtggagttcgcgctcgggcaggcgctcggcggccacatgcggcggcaccgcatcgccggcgccgaggccgacgaggcggtgagcgcccgcggcggcgagccggcgcccgagcggaatccacgcgaggcgaggggtgtggttggcttggacctgaacgctgctcccgccgacgacacaggcctcctgctggtagactgcctgtaatggcattctgccctacctaaccatgtgatcgtttcttctttttatcgttttttttggttttgtaaatttgaaaaattggcagctgttctccaaaaaaacagtaggatcaatagttcaaaatacaacatgaatacgatttgattacagacttgtaattacagaattgtagtttgcctttcttgcatgaatcgtgcaagatcattctttctttgtaataaaataaaataaaataaatactatgggtgatactgggcttgcagcgggcatcggccaatagacaaattctggagttgattatgttatagttcgtggtcttcgatttcttctacgttctacgtgatcagtaacccagtgtcgcaagtaactgtagttgaacactgcagaaacgcaattaactacataaaaaaatttgcatacttctatgttatctactggctgtagcctcaacatcagcacagccaacccaattctatatgcgctcatcattatcaagagcaagagttactttccaccaatattcaaagtaattgttctcacttaacacccatttgtccaaatcaagacaattgcaataagttaaataacgcacaaagagagtagctgacaaagaatgaaatgataaaaattacaagcaccatttcaccaccattttatccatgtagtgagaacccttctaagatccacagcaagctgatttctgagccgccgctgcctcggcttccccttccgatttgatcttgatggttcggtcctgcaatcaaaagaacacaataaggaaaggcgttattgaaaaaaagtatgtcaaaccagttaattcatacctcaggcttggaatcagtctctgagagtctttgtttgatatctcttgctatagaaaagaaaacctgctcaacattcaggtttgtctttgcactctgcagtagtcataatgaaacgaaattatgcatgggattggctacagaggttcgggcatcaatgcttaggagaaagcaacatttattgtcaccaacaagttacgatgaaggaataccagaacagaagttgtgacttcgcactaaccgtttcaaagaacttgattccgtattcatcagcaagagcctgtccctttgaagtgggtacagcctgcacgaatgaaattcagccgatatgaataagagagctaagaaatattccaaacatacaatttgagaaggtcattgggaactgtaatggtaggtgcataatgtcgaacacgttttctattatgtttacgctttgacacaacataaatatatctagtgatgaccatgctagatggatcagagtaacaccacaggatgcaaatcttattcacgaaatgtttttcatactgcatatgaaactaaccattccagagcatgaaataaaaatgagatgacagaataaacatgtggaaacagctaagccaagtagattatacccttttgctttcatccatatcagctttgttccccaccaaaattttgttcacattatcagaggcatgttgttcgatgtttctgatccaatttcttatgtctgaaatccagcaacaatggaaatattcagaaatttttgagcttaagtactatatcaaacaaagcatctgaagtaaagtggtcaatactgttgaatgaagattcatcggtgacatcataaacgagtaaaatgcccattgctcccctgtagtaagctgaaacaatgaagcccatttcagaagcttgatcaatgcaattgccagaagcaaacttagctttgttgaaagtaaacaaacataccagtggtaatagttcgaaagcgttcttggccagcagtatcccagatttgcaatttaatccgtttaccatccaactcaacggtccttatcttgaagtcaatactgtttcagagaattcagtgaggacaatatataaggtgatgctatcattcagatgtttcctttggggactttttacaggacatacccaattgtggtaatgaaactagtcgtgaaagagccatctgagaaccgtaggaggagacaactttttcctacacctgtataatgtatataaaccttttaaatagaatgtacgtgccactaaacactgaaacatagtatgaatatcaagtaaggccacaaaaggaaatacaaatacaagaaaaaacattgatgtggaaacaaaatcaacatgagttaaagggctcccctaggtacacagaaccagacagatgctatttactcactccgcttcatattataagtcgctttgactttttttctagccaaacttccttaagtttgaccaagtctatagaaaaatttaacaatatctactgcaccaaattagtttcatcagaactaaaattaaatatattttgatagcatgtttgttttgtattgaaaatgttgttatatttttctataaacttggccaaacttaattaagtttgactaggaaaagaaaatcaaagtgacttatattatgaaacggaggtaccagtttcattttattgtcaaactagaagaccaccataccgtaaatatggaccaggccacataagcacaaggaagatagtttagttgaactctgcttgcaaagctgctagtgagtgggaaggaaatgttattgtatgatttttacacatatcctcaaatatttactctttcaaggatgaaaatgaacaatgctttcacatagtagaaaacaaacagcatgattacagaaaccctttagtaaacttttatgtggtacaaatattattcgagcctcaaaatactgtggtgggagggctgggctgggtgaaaatatcatagaatatacttggagcctaagcctgcgcaaaattctaaaacatatgaatctcagcagctcccaggcctgagacgaaccacagccttgaacttggcttgcctcaacggctaaaaaaaacacagagcgaggttccaacagtgcacgtcaggtcatcaggtgaaagtgttgaaaccattgtcagttctcttataatgacttaatgagaacccttacaacaaacaaaagtaaccacaacagctacttacaggcgttagtttcaccaataaactattcatgacttcatatggcgatcaatctaacaataccagcattttaatgtgtgtctcagtttgagaatatatcaggtcataatcacatgattgtcgcaagcaggaacagaatcgctattacaaaacacttatgcgtagaaaactgaaacaattgttgccaacggtttcgcatgcttcgattcattcacccattcaaatttcacacacacacacaaaaaaaaatccccacaaactgatccagataacagatcccgctcgaatcctcggatcaaacgaaacaacacacttcacgccggaggaaccagatctcgcgcgcgtagatcgagggagtgagagagagaggaggggcccgcggttactcaccgctgtcgccaatgaggagcagcttgatgagataatcgtagtcggcccgagccctagccggcggcgccgccatcgctaccaatcaatcccccaagccctaacacacaatcaacatcgatcagatcggatcaagcaacgaaacagcaagccgaaaacgagcaatggcgagccgcaataccgtggtacacgcgcggcgggggggcgcggccgtccgaggcggcggcggcggcggcggcgatctcctccggcgtcgtctccccctcacgagcagcggcagcgcaggcggcgagttgcgtgggggaggggaggagattcgcgaggcggagagggggatcgaagcaccgcgccagcctgggttgggtggtcgtctacttgggttgggttggctcggtcggaagcgtcgtggtggaaccggtccactcgtctgacttttcacaggtgtcgcgcgcgtgcgcccgactgggtcctaggcccggcccattcaggcccattaggataagggcccagtgcgaagaacgaggcctgaatgctgtgtgggctgtctggcccgatgaaacatgatggattttagtttttttatttcaaaaatgaattcggattttttgttcaactaaatgccaaaccatgtgtggatttgagcaaataaacattttagacatagaaaatctccacttgtcaggggggccgaaactatttaaatttcgcggcgcgcgagtaggtctgcggtcgcggtcgatagtcgacttaatttgcttatcagcaaacgttgcgcgctttgcgtaagcactgtctttatcctagtgaaccacaacacgaaatttcaagtcttctcgattacgccatttgcaattcgaatttcgaaatatttagacttacagttttgatgtctgtcccgcgcatttttcggtgcaaatgcagctaaccaacaaatatctagcatattcggtgtgttgtctttcatgcttgcttgctgtcacgccccgaactagtaccgaccggaactagcccgtgacgctccaatttaacctgttaatcgataccagtcccaggacacagtgctgatatcacaggaagacagattatcacagcaacagaggtctctttattatagagtagatgtacagtcatgttgggctgcggacagatcccgatctcacaactgcattacaaaagggaaacggaagccgggacttggaccaaacaacacaggcgcgacttgggaactaggccgaaaccctaaaactcatcgtagccggcttgctcctggaagaactcctcatcagcaggatccgcttcgtcttcttcagcgactgggggggattatttatatagagcaagggtgagtacggggagtactcagcaagccaagggaaataagtgtttaatgcaggcttcaaggaaaggccgttgtttttgcaattgattttagttgaactcttttctgaaaacaactaagtgagtgcttctcaaacgacacggttgtgacagtgcgtctcgtccggtcggagtatgtgcaatgtatcagtctttagaattgaaacaaggttggcacccggccaacagcttttcaaacggccacccgggccaacaactttttaaacggccacccgggccaacaaccttcaaacggccacccgggcctagctgatcccatcagctgcagatttttcaaacatcgaacccctttccacaacagcaatttcacaagcagtagtcaaacaaaactacgctaggaatcacctcacatccgcccatgaccgtgggcacggctgttcgaacagtttgttaacctctgcagagggggtacactttacccacatgacattactaacccggatcacccagcccgtggggatcagccacgtcgggagacctccaagctttcatgacaaggcatttccaaagccgatacaggtttaccatatgccgacgagaggggtcccagaccaacaacaggttaggtcccagaccatactgtgccaggaagcccaggggtcctccccgacaccacaccggcgaatccacatgtctctcgacatcaaggctcccctgataagctagttactcaaccaggggtgtcccattccacccatgtggtcttacttgtcttatgtttggatgaaattccaaggaatcggtccttaagtgcgagagcgggaaaaccgtacacccggtacgttccccggtccgcggttttggaaattcatttagttcacaagcaccgacccaggtgtcgggttttccaagtcttttgtaaaactcaagttttacccaagaagttgctcagattttaaatttgaaggcgcccttcggtactcgcacagattgcacgatttccgaggcgcaactgggtggttacaagggaacatggtataacaattaacaaaggaaggatcaaatgcaacaaactaggtagatccgccaatctgccttgcagacgggacaacagattaagtgcgatcctatcaatgcataatattttgcaagcaacataattaaatttcaagtataggctcaagatgttcaaaggtggcttgccttgctcgagatctggagcttgatcctcgaaatcctcgcactgcgggtcttcgggctccggaactacacgcgaaacgggacaactcaacaaacggcgaaaatgaagccctaataatgacctctaagcgtgccatttgatagatctcgagatttgaggaattttggaagttgaacggagtcaaacggatctacggttggaagatattgaatttctaagattattggatttttggtctaaaggaaaaggatttaattaaatcctttttggaaaagaaaaagaaaataaaagggaaagagggagggattatagacttctcctcgggcggctagggcgtggcccaagggaaaaggagcggaccggccgagctaaatgggccggccggcccaaggcggcccaagtgcgcgcgcgcgggaggggaggagagagagggccggtggaccgggctcaccgtgcgcggtcccgggtgggacccgcttgtcagcggttcggctcaccgtgcggagggagcacgcggcgcatgcgcgcgggcgggggagggacgcggtgcacgcgcgcggtctgcggaggaacggatgcggtgggcccacgcgcagcctcacggctcgcggtggaacgcgcgcacgggaggggctgaccggggtcggcccgtcccgacctcggctgagctggcgcctacgtggctgccacgcgggccggtgggaggtagacgacgacgccggccggaacggacggcggacaacagcggcgagcggcggagcgaaccacggcaataccggcgaaagcgagcacaccgggtggttgcacgagacgaggggagacgagccaacggctcggattcgccggaggaaacttgacggcggcgaatcgcggcggcggcaaccggcggggagggaagagggaaacggcgacgaggtcacgaggggccgattcccggcggtgagagcatctacgcggccacgggaatccgatgctagcgtcggattgggcggagctacgccgagcgaggctggcgacgagcgggtgctacggagctcgtgcggcgacggcggcgagcacacggcgggcgacggcaacggtcggggcggcgccggctagctacggggaggctactcgtgctaccaccgaaaactaaggggggagatggagcgaggaggaagaacggagggaggcatcaccgaggtgaggaggggcgctatgacgagaggccgacggcgcgggagggatctctccggcctcgggccggggaagaggaggaagacgagcgcccggagtccccttccgcgtcctagtgcgcaccggctcctccggcacacacgcgacggctgcggtcggcgagagggacggcaatggcgcgggcgagaaacagggaagagtgggagaaaagggaagggagggcgtctgggtttatagggggcggcaat

SEQ ID NO: 38962 - DNA, 1689 bp, Oryza sativa
aggactatttgctttggggttgacttatttcctgtgctgccatttcttgttatcaggaacaggactttcgcttgtgggcaaacaacgatgtatccgtggagtatcaaatttcagaagcaacactggatccacaaccgaaaatgattatgtaagttattcataacttcaaatcgttcagtgatctcctatgagaaatattaatactattagtacactacaaacttggaaattttctatgccgtttcttgtttctgaaacatatttgttgctacagatttgttcagactctagggtattcaattacagaaattctagtggcacttctacaagatgttctgccggtgaacaactgaaaaatggaatgggaagttgtcattcacagccttctgtgttggcagaattaatgcatcttgatacagcaaaggcagaaacttccttttcgagttcaagacggagcaaattctcttacaattggaaatcgcttcatggaagtagtactacctcaagttatggatcaccctgtcatcctatgttcaacctcagcaaacacagtactaatccgaagccacctccaccattaaagaactccgcacggatgagtaatttcagttatcaattggttagaagtgctgaaagtccaaagaatgcaaaatattccctatcagagaaaatgtcacacttactaaaaccacctaatagtagcagtcatcagaatggaaacttcactgttggtgctttaaagaggcgtcataatattgcacattttggaggagcaatcaacaagcttttgaaaaatgaggttcataagaaggccaccccatcagagggaagacattggcagactttattggataactcattaatccgacagaataaattgtactgttcagagccacgcaatgaagaatcaactgaacaatcatggagctctacagacagtgagtctgagaaggctgtgtgcttttcctccagtggcagcattgctgatttgcatgcatcggtttcaactgacaccagtgactcaagtgaccactctatgtcatcttcgtgcctatcagtaaatgatcgatggaagatgacttttaagaaggtaaatattggaaaatgttcttttagaagaactcttcaattgtgataacattcttgacaggaaaagtttagctagtattagtatttgtcttctctattcaaatagccatatttatttagcttttattattgctttccttcaaatctgctagttatgttgagcttctcaaatgttatgtgtcaggtacactgtgcccttgctgcaaatttagactctatgtatgtcactaaccacaaggagctagagcagccaagtccagtatctgttcttgaaattccagatgaggatttctctgtcactaaaagcatcaagctaggtacagaagatcctcttgatctgatactgttcacttcctatgttacactttccttttattgtagttaactttattttctacctctgtattgcagatctccatccagaaagtgaacttgttagatgtccatctgttgagagtacagctgaggtaggagaaattggaatcagtgattatgctttgggggtggatggactaaatgctagtctgaacggtgaagcaatacagcttgttgaagatatctttgaagaatttggagatgaaaagaaagataatttcttac

SEQ ID NO: 38963 - DNA, 10186 bp, Oryza sativa
  unsure (1)..(10186): unsure at all n locations
tgtttctggcattcatggcaccgcggaggatcagctgtacaaggtatgccaatctcttgattgtcccgcaggctatgatgtgtttgagaagcttgaaaagaagtacatgaaagttgctgaatggtcaagatcagacaggaagcttatctttgatatggttaacaccatattatcagaaattcttgcaccatgtttggacatgcacccgtgggtgaaatctgctagaaaaatggcaccagtatggggttcagagggtctcctggagaagattttgcagatgttggttcagagacgggaagaacttgggctaagtaagactaagcctgagaagaaagcgttagatcggaagtggccagatttatcggattgcattgacagggtagggagggatgtggagaacatgataaaagatgatcttttggaagagatgcttttggatctgttcagttaggctgttggctgctttcagagtttcaggtttccatggcacaatacacttgcttcccccttatttagtttttgatttttcttaggtacttctcagcttgtaatgtttcttcgttggttcataaggtcaaaagttttttttttttttggtttgttgaagcagtggttgacgagttttttagttgagtcgccgtgcttgaggtatagagcaagttgtaaattttgttagtttagatcaggtccgtagattaaattcttttagaacgagaaagggcatcccataggttgtaagtctttggcggaatgtataaggagtatagtggctctctatttgttggattttctcagttgaaggcatttaagtctgtaaatcggggaaatagtaccctgccaacatttgtattgttcattggagaataaatgaagtgtgtacttctgagttttggttgagagaaacatatcgggcaagagtaaaaaatagtctgcttgaatgtgattattgtagtttagtatatgtaacatagagctgtttagatgatgggcatgtctctattgaaaaatagatcctgcatggctgcatccctaattcctctggttcttgaatgaattgtgtggttagcatagcatgcgaagctcctgattaattgttaagttcgacggcatattctctcttcgatttcaaacatagatgttttggactttataacttgtctccacacccaagtcgtagaatctttactgattgaatgctatcactcgtcatttccacaagcctaacctgtaggaacaattaattatgtttgacttaatttgtgatatactaaaaggaagcttttgtataaatccaccttataaaatgactaatttccacgtcccaattgctcccaaccatcctaaccatgcttcgtatggaccgtaataaaaaaaaaacagccttccaaagtgaagacactcgccaagaatctcaaggaaaataccagtaccttcttatagcacacaaaacaatactcaactctagccaactactcctccgttccaaaacaaatgtaatttcgcactattcttatctaatgtttgacatttcatcttatttaattttttttatgattagtatttttattgttattagatgataagtcataaatagtattttatgtgtgactaatatttttaaatttttttataaatttttttaaataagacagacggtcaaacgttggatacatataccctcggctatatttattttgggatggatatagtagtaacaataaagtaacagagtccaacgcaaaaatcaacttgatataaaagtggcatgatagctctaatttcacgaacacatgctattgttgtcaaacttgccaccaaacagcacggcagctccgactacacagtgatagcatcatcttggccaaagatatcatcaaaatgaacaaacatcaccgatttctcacagtcgacattagaatcattcttacctgtaaaattctaaacaaaacattgcttgtaaaagtgcaagaaggcttgcaggccagagatagagacaagacatccccgttcaccagcagcacaaaagaacgtagcaacgatcagtggcagcgttgcaattacggaccggtgtggcggtgttgttgcccatcccatcaatttagcagctgcgatgtcaccaccacaactattcattatagccacccagctaacaccatctcgtgcgctcgtggcccttggattcaactacccccgcgccttgatatttgcaactgcaaatttgtctatatacaaaatttgtctccacgttttcttggatagttagttgctcacccgatcctgtatccatggcggccgtgtcggaggtggaggtcgacggcgtcgtgttcccgccggtggcccgcccgccgggctccggccacgcccacttcctcgccggcgcaggtttgtttgtgtttgcgttgtgtgttccgtgtcagtggagaagtggaaatgccgtgcaagcgaacttgcttgctggtttgatcgatccgtcgtgcaggtgtgaggggagtggagatcgccggcaacttcatcaagttcacggccatcggcgtgtacctggaggagggcgcggccgtgccggcgctggccaagaagtgggccggcaagtccgccgacgagctcgccgccgacgccgccttcttccgcgacgtcgtcaccggtaactcatctcgctaaatttgttgctcgtgtcgacgggcggcgcgacatgacatgggcgtcgtctcgcgttgcaggcgatttcgagaagttcacgagggtgacgatgatcctgccgctcaccggcgagcagtactcggacaaggtgacggagaactgcgtcgcggcgtggaaggccgccggcgtgtacacggacgccgagggcgcggccgcggacaagttcaaggaggccttcaagccccacagcttccctccgggcgcgtccatcctcttcacccactccccgcccggcgtcctcaccgtgagcaccaatccgttgttgccgattactccgatgcgtgatttgcttcgtgatttggactccgtttgattcgatttgcaggtcgcgttctccaaggactcgtcggtgccagagggcgccgtggcggcggcggcgatcgagaacagggcgctctgcgaggcggtgctggattccatcatcggcgagcacggggtctcgccggcggcgaagcggagcatagcggcccgcgtctcgcagctcctgaaggcggaatccaccggcgacgtggcggcggcggagcccgcgccggtgtccgcgtgaaaatcgagctgcgaattaaccgcgcatctaagagctcctcctacacttcttgtacacttctactgccctcgtgtttgacaatgaaataaaaggaaaggagaaatcgcggctgttcttccgttccatctctgaattgcctgtgcacggctcgccacggtagaggtgaaaatggttacgaaaattctcgatcgacgccatttctgtataatgggtaccgttttcgatcttattatttttagctatttataatattttatacattatagtattaattaatataaacattaaatagtttaaataataaatatagttaattatcctgatcgaacgtcgttttcaaaagatgctaccaattcagatcgttttcacttatacgaccggtgagtacgggatattttctgcgattaggtagacgcgaatggctgatgtgagtggctacgcaattatgcgaagcgagcgaatgcgagacacggctttccgctaatggggcccggcccaattggcttaagtagatagggtgggccagtcaagggaggatctttggttgggccggcattaacaacggtgctgaaaccgtgagaaataagtccatcttccaccctcaactaatgctctttgtagggtttcataatgtctataaaatgaagacacatgactatggcagatgtgaacgactatgcagttacacgaagcaagcgaaagggggcagctaatgggcgggtgataagctactctctcacttcctcctcccctcttctcttcctactacactatatattttttaaaaaataaaaaaataaaattgtaaaaattcatgtatagaaatactatgtataaaaaatatttgaattcaaattcaaatttgaaactgtatgtaaacttttgacctataaactttgggtctataaactttaggtgtataaactttacatgcatagaaatactatatataaaaaaatatttgaattcaaattcaaatttgaatttgaaatataattcaaattcaaatttgaaatcaggtatataaacttttgacttataaactttgggtctacaaactttaggtgtataaactttagatgtatagaaatactatatatataaaaaatatttgaattcaaatttaaatttgaatcggatatataaacttttgacttataaactttgggtctctaaattttatatgtgtaaacttgaggtgtataaatttaataaaataggaaagtaatttggtgccgaaaaaggaaaccatctgaagagaagggggagcgcgctggggcgatcgctgggggcgatcaatcgccccttagcctttccgaagcgaaagcgggcactgtttctgctaatatggtccggcccaactggagcagtgtgggcaaggcaagggaggatgtctgcttgggccgacctttacaccggtgccgaaaacgaagggaaaaagtacaccgaaggtccctcaacttatcatcgagtttacaagatcgtccctcaaccacaaaacagatagctgacgaacctcaactaacaaaaccgttcactatacattttttggtgggtactatcccggttttgcgtggcttgagtcaacgtgggacccacgtgggccccacatgtcagaatgccagttatctctctcctcccctcttctctcctttcctcatgtctatctgacttctcccgatttgacggcgacccggttgcggtggtggcggcaacgggcgacgcggcagcagtggggggaggacctgcgggcgggcagtggtggaggggcgcnggggtaggancngntcncgggctcctcttcggccgccacccacgaggcccacgaccacgaggcggcgtgtgcagcgtcaagttcggctgctccaccacgacggccggctcgttcccggccgacgggctggtcgggctcagcggcgacgcggtctccctcgtgacgcagctcggcggcgaggcgtcgctcggccggagattctcctactgcctcgtcccgcactccgtcaacacatcgtcggcgttcaacttcggcaccctcgccaacgtcaccgagctcggcgcagcgagcacgccgctcgtcgccggggacgtggacacgtactacaccgtggtcctcgacttcgtcaaggtcggcaacaagacggtgcatcggcggcgagctcccgcatcatcgtggactccggcaatgcaaaaataagctttgttactcctgcaaattgcaagtgaacaaaacaatctcaagctaagttgttctttaatcagaagaacggtatatgaacatgcagaatttcaagatattttgtggcgccggtttcgctttcttacctcgctatagattctgtgagagatcaaattacatgacccataaattgtagagcaatgcaggagtaacactcccagctaagaaattgattgatgtataacactccgatcttctatcttcgttgggcgatgcaatgagaattcagaattctcactaacagccagcttgctagaatagagtatgagttactgatcttgaatgacctcatgtgtacatccagcaggaagcaaaccgaacaagcgagtccggacttgacgctggagttcggcggcggcggcggccgcgcggcggtggcgctgaagccggagaacgcgtccgtgacggtgcaggaggggacgctgtgcctggtaatcgtggcgacgacgaagcagcagccggtgtccatcctcgggaacctggcgcagcagaacatccacgtcggctacgacctcgacgccggcacggtcaccttcgccaccgccgactgcgcggggagcggccggccgacggagcagacgagcggcgggcaggcgcgctgcgggagaggaagagagcgccgacggggagcggggcggggggagcgaggacgtcgccgccgtcgtcatccatggccgcagttctcgcgcccgcgccgtcagcggcgtcgccggcgggagtgtgtgagcgcggggcagcggcgggcgaagcaggcggtggagggcagagcgggcacgacgccgaagacagcttcttcccgcgccggcgccaccggccgcctctcccttctcaagcgtcgccgccgccgccgcctcccgggcctctccgacggtccgaccccgaggtcgcatgcgccgccgccggctgccggacctcctccctacccgccagcggccctgcagagaggagagaaatgagagggagagatgaggaagggagagaagaggagggagagatgacctgtcattctgatatatggggtccacgtgggttttacgctaactcagccgccaccttagataaaatcgggtcaaaatcaccggagtatctaaattgaactgtttcgttagttgagagatgtcggtatctggttttgcggttagggaacgattttataactcgataacaagttgagggaccttcggtgtactttttccaaaacgaagctcaggtaagccttcgagtccatgtcccatgggtttcatcctctgctgtccaaattccagtatgctggatgctgcacgcctgaaccgagctgtacttacgtagtgtttggatccatgaacttagctttaatccctgtattttgagtattaaatatatactacttacaaaactaattacataaataaaagctaattcgcgagacaaattttttaagcataattaatccataattagataatgtttactgtagcatcacataggctaatcatagattaattaggctcaataaattcgtctcgcgaattagtccaagattatgaatgagttttattaatagtctacgtttaatatttataattagtgtctaaacatccgatgtgatagggaattaaaagttttagtcctatctaaacatggtcttattcgttgatgattggtcaccaataaaacaacataaactgcccaatacactacaaactgccctgtatacagtacacattccaatcggagcacactctttcgttggaagaaatagaaaaaaaaaacgttctaggcttcatgttaccgctgcatccagccattcagatgggcagaactagttgttgttcggcttgcacggaagatgatgtgccgtatagagagatctcctgactcactcaccggcatttaataccttaccttcgcgactgcgacccagttttacctgggacccttggatcttctcgtgaggttactgcaacgagccgttggtggcgtacgggacgcacagtttgggacgagcagctcgcgcaggcggcacccgcggtttttaccccgacacggccagcgccactcacgtacaacacgacgagccctcccatcacgtgcgcgccactgacacgcacgcaccgctagcaacggctcgctcgctgctgccgccatctcgtccagtagccaaatccaagtagccgagtggtttcacggttttcacctcgcgagccaagccaaagccggttgtgcacttgtgctttgtgctcgcgcgcgcgaccgcgtcaaaacctgcctcatctatcgctaaaaatcacggcgtctcgcggctctctctcggcgtacgtgcgtctcgctcgctctcgcgggcggaatccgtgacgccgactcggcaactgttcccccccggtgaaaaggggtggagaagttgggagaagaatctgatgctgctttgcgcgtgcaggcgatcgatcgcgagaggccggccactgtgtctgtggctgtgcgcgcgcacacacagatactcctcgctttaggccacatttacaatcatacatgcatggtacatacagctgctgaattctttcttattaccagagacaagaaggtactaccatgatttgtgtacatctgtggtagactctagccatgcaaaatgatgattcatggattcaaacgagaacaacaagtacagtaacttgcaaacattgcgctgcaaccgtctcactctccatgtcctcctgatttccgttcgaattattgtgaaaggaaaactgttgactcttcatcattaagaaattcggcatgcctttgttctgtctaccaatacgctggtttcttgacaggttttgatactcctggccatggattgctatcggatagctagctttcgtccaaggctttatttttcttttggacgtgtagacattccttgaattattcggagttgtaccgtttcagccaccttagcaatcctgcctcatcctttgtcgaggaaaagaaatggagaatccttctacacttttagaagctgttcatgaaagagcaaggaggatatatctagaagaaagattggaacaatccatgtttcttcaacttgaaccactagcttaactgaggatcagataacctgtttgatgctacgattagtactataaaatctgaacctgtttgacgattcggtgttctgtccagattcgttatcctagaatgtgtcaaatcccattaaactagattcattaggtagcaacattttaaaacgacggaggaagtaatccattagtgcttgttacatcaatctcaactactatattaatttcttgacagggctttctgtggtggaaacacaagagtcatcatgcagctagagataagcaactgaagaagtgaaccatacgacaacgtggctgaaaccaggaaagcctgaacacgccaggaccatcacggtaatctggcaacttagcagtaaagctaaaaacgagccgtttctctgaagccaacatgtgtaccaactcttctttttttttttcttgtgatataaaaaatcgtacacaccctagctattatgcctaactttttttttaaaccgcattatgcctaactttgcccagaaaccgcattcatgacttcttgtttgttttaacctccatatgtttttgtttctcttggtagcaagggtgtgtttagtttcacaccaacattagaaatttaactaaaattggaagtttgaagaaaaaaaagttgaaagtttatgtgtataggaaagttttgatgtgatggaaaagtttgaagaaaaagttattatttcctccgtttcacaatgtaagactttttagcatcgctcatatttatattaatgttaatgaatctagacacatatatgcgtctatattcattcacatatatatatgaatatgaataatgctagaaagttttacattgtgaaacggagggagtagtaactaaacaagcgctaaatgggaaaataaggggaaatttaactatttgccactcttgtgacatggcaattaacgatttgccaccccctgtcaatgatatgtgggccctcatgtgtctgtgacatgtgggtctagtgccaaatcgttaagcattatttgtaagagtggcaaatggttaaaagccccgaaaataagagcattttttagcagttagcacagcttctaccctaccgtagtgctaaccatggatagcaaagttgtcttctcctatataagctaagatactcttccactcttccttgctccatcagtattacaccacccaacacaagctcagccagtttaccactcacactagctgagctagaactcaccactcactgcagttgcagcatggcgcctttgctgttcaaggacatgaagagcctctcgtgctcgtcgccggcgtccacggcgatatgcccgagcttggagcggcagccgatggtccggccacacaagggcggcgccattgctgcgagccctctctgccaggtccccggtgagccaagaacggttcacaggcaagactgcaggagagggcagcagcatcagcacaaggcggctgccgcgaatggcggcgagctcgtcagccccgccggctcatccaggtacctgctcagcagccgcgccgccgccgccgaggagatccaggaggtggaggcttcggctgctccggccgtcgatgccaaggtggtcagggaagagcaagctggtagtgatgtgaagaacactctgacgcaggagcaggtgagtaat

SEQ ID NO: 38964 - DNA, 8802 bp, Oryza sativa
ctactcaatagatgatgcaaataattagtactaatatcaggatttgtatgctatgattttctattagatactgtggaacttccacctaaagaaaggcaaatatcatgatgacgaattgacatacatgctaccttcttgatttcagtgagatttgtacgtatattaaaattgctggataactgactcgtaggctcgtaactaagcatgagagattcagaccaatccatagaaaaaagaggagattcagcacgtatcccttaaacaaagagagattcagaacatgacagtattttaagactacaacatgacaacttgctacaaacatgacagcactgcacatctgcatcgtttctgttttaaatttcaaaaagccaacacatagttgctttgaattaattaaccaccggcatttgcattgggtatctttttcaggtggttgtactgaaggtatcactgcactgcaaagcgtgcgcgggcaaagtgaagaagcacctcgccaagatggaaggtgagcctatctatctatctgctagtatctcggagcaaccaaacacagaaatcaagatctgacgctttctcttcagaaacactgaagataaattaaagatgcccattgtaatatgtatgcatgaacagagaaacccctagagtttttccgactagctctacaatgggatgggctagacgacctggattcgaagcctcaccctttataattactctctccgtcacataatataagatattttggttgaatgtgacacatcctattactccgaatctagatatagagtactaatatctgcgtcttttatatgtatgcatgaataggagtgacatctttcaacatagacttcgcggcgaagaaggtgacggtggtcggcgacgtgacgccgctgggggtgctgaacagcgtgtccaaggtgaagaacgcccagttctgggcggcgccgccggcgatagccgcctgatgagagatgaaaacgcataggatcctctctggttaattaggtgcggaagcatgtgggtcactgatgctggaccagctcgctctgctgtctgtgtgatggtggtggtggtgtctcctagatcgatgagagcatgcgtgtgtgtgcgcgtcgtcctgactgatcctgaagcaagcatgcagatgcagctttgcttcttactgtgatccttttggtttcttgtggttggcaccatgctgagctacatgcccgtcactgtgcttcttcttccgtagactgatgagagtgtttgtgactatatatctgctctaagtgtaagtggtggtgttgttcttttgcatgctcttactgtaatataaacgtttcactgcaagtctgcaatactgcattattgttgtgtcgtactgcaactgtaggtggtgatcgcgtaggttgaggtgggatcgagatcctctgccttcaaaacaccatacttttattcgttgaaaggtgaacctatgattcatcaagttcatatgtcagtgataaagacatgtacatttgaaggtagaggaacatgatccgttgtggtggtgagtaaacagcagcatcagcctaatttgcttgcaaggtcaataacattttttagatcaataacatgtagtagcagaactctcaaatggaaaataatgatttatccctagtacaataaaatgcttgtatgtgtactgctggaagaaactttgagccaaccgggagatgatgaacacatatgccgaagtaacagccttctgaactctgaagatcgatgccgtcggagaggactccaacggcacatctgacttgggagatgcggcccatttaaatgaggtctgaacgggatagtgacttgcatatagcccatttgagttggcccttaaacatgatagtggtaggagagtgttttcgcgaactgattttggatgagcctcaacgatcttgccactaaactgtgccaccctcaagctcccaacaaccgtagaattcaattcgctaatggatccttcgctccggcatatacaggcagtggtggtgacctccttaggccgcctcctgtcgtcggcgtgctgcccgcggctgcagacgaagctaagcctgaatgatgtaatggggttcacggagctaaagctcgacgcgggccgggagcccgggacgatgtagctgtgttgtcagggccggttctataattttgagggctctagggcaaacttgacagcatgagccttaacgcgctctcccctacagagagacgtgttatatacatactcacactttttagggttgttcagattgatgtcatttcaaaccataccaatttttagtaaaattgtcaaagatgtatattcatttagtttttttacaaaactttagtaaatatataagaaatcctgctaaaacttggcaatatgactaaattgtcaaaattttgacattgtcaaaatttggtaaaatttattttggttacaatctgaacaaccccttttatttttaaagtgtgttttcaaatctaatcatgaaagaaatgaacatatataacatttcatatatatgttgttagaaatagaaaaaaaaatcgacacttaaactgaccttatttatttttcccctttacttagcgaaaaaaagcttctagagtaaaattacaacttttcagtacctaaaaattttagaggaaatatatattatcaacaagaatctatctatacatacaattttgattgttgaatctacaatctttattaattcactaatcagtactccctccgttccaaatttatctacatatttcataggtacaccaagatcaataaaagctaatagctctctcatactatatttactctaacaacaaactcaatgcatataccatccccactatttcctagccaatagtaaatcaagatattgtatgtgggttataaatacttgtatgcatggatgcatgcatcaatgtccatttactctaatgcacaaataacgaatagaattaatgaataaacacaaatatgtagatcatttaggaagaataaatatgtagatactagtagataagccaggagtagtagatagtacggaattattcactagtcttaaataccactttagctcatacagtactcatacatatttaggcatggcccctagccaggacgggccctaggccatcgtcctctttgccctgcctcagagccgggcctgcagttgttgatagtatctttttctcatattttatttccatttcagaaacaggttacatgatttatcgtacaattttctgaactaaaatggcttttcatatcttcataactcctaatactagaataagttagatgagaaaatatcctgacaatcgtaggctggagtactcagttgtttgggctctcacggctaattgttggttttggcaagaatgtccacacgcatgcatcgtctaaggatggatgtgattagttaggtgcatgaggctggatgagtttggtttgtgggaaataagagttcgatgattggattcggcggatttaaccggatatagccattcacatgtggcctattctgattgcttatggtgggtttaattttctgttagcaagctcaaaatgttttttctcctaaaccttttttctaatttgtgatccattacaccattatatttattacaattatctttaaaataagatctcgtatggttatatttcgatgaatatatatatatatatatggtaaatggacacttaatcccatcatgctatagcacttcaaccaaacaagaaaccggaggcaaactgcagtgcaatttagtttgcttatcacttccacttgcgcccaaacttcttgtgcttgccgtacttgccatgcttgaactttcctttcttgaatttgccaccatggtggccgaacatcccgtggccgccaccgccgccgggtcgtaccatgtgagctcccaccgcagcagccgccaccgcggcgcctccggcgagcagcgctccatagccagatgcgcctgcaccatgcccacctcctaacataccaccacctattacaatatggaacttggaagtgggataaattcaattgcatatactcgctccgtctaaaaaaaactcaacctagaagagggatgtgatctctcctaggacaacgaatttggacaaataatagtccagattcgtaaggttgagtttttttgaatggaggaagtagtgctttgcatcattcaccaagttacatgatagttacacaggaaatgcaagagagagcataccttgcatgggtggaccatggccatgacctgggtaaccagctggcgggtagcctggttgttgtggatatcctgatggtggatacgctcctggagggtacccaccttgtgatggagggtaaccgcttggtggatattgtgcaccagggtacccaccggctggtgggtattgtcccggtggtgcactagggtatccaccgggagtcggatattgtccaggtgaattagggtatccttgcattaggggatatgcaccagggtaaccgcttggatacgctccatggaaccctttgtcggcatttgaggagtcatgattgtcctttctgcctcccatttttgtgacctttttagcacttgactgaaacatagggaaatcaagattacaccatgaccattttgtcgtgcaaaatatatataagatttgcagagacagagagtacctggatatcttaggtgaacatgcagatcataaacttctcaagaaggtggcaccaacagtgacctacctaagacttgaaaagaatttttgaacaagattcaagttgacctatggcttctcctctcatgccatgggcttgtatacatacacacatgaggtggacactaaagcaagcctcctaccaaaaccagattaccacgagctgctatgtttagaagtgctaagctatttgtttggtgtggttgtacatgaagataggaaaggcttcttcccggcccccgcacccttcggttctttgcatggtcatttgtaattttgggctaaataagctccataacacacagcaaaatataatcaataaatgtctaagaatatagctagcaaaatccgttgtagtctagctggttgggatactcggctctcacccgagagacccgggttcgagtcccggcaacggaagttttttttcctagcactttcatttttacacatagatgtacacagaaaattgcattgggaaggcacaacaactcataggaccaggaaattttgatgcgcagtcacaattcacaattgtataccgtcaggacacagttttgagctcccagtttttcccagggttactccagagagcgataatttatgaaactactagtgagcaacaagtcgataaacatcaaatgttcttcctactttaggttcagcaatatataggatatataaaaggataggtttcggcttagccatgcttcgagaggatgctctctgcgacgctacgagcgatgggatgatagaattcatgcgcctctgagaagatcctatgggcaagcatcttctcctccccggagcatcgagccagcgagctgtagagcgggcgaaggtacttcatcctccccacttgcttcaagcatttctcaacctcgttgaagtagcatctgcagccggtgggaattgcaagctggagaaacgcgactttgacctcgtagtcacagctttctgatagcttgtaccgctcatcgagagcagtgacctgtataaggaacaatgaatggccatggaagcagttaagttaaagacatacaaatgtgttacacaccaagctcccacagtataccatgtaataacaaaaatggcaaatactgaccaccaacagtgttgattgaaaactacaaatgatcggctaatagccctgaacaactcccaagcataaatagctacagatttcctttcaacatcttatagtcagtagacagctttcaactttcatttgtactccaaagatgacagccacaaatgatagcccatctttcattgtagatgctcaatcaggaaaagcagcgatgtgttactaattagtgattaactgattattgagtccaaagatgattttcatgtatgtcaccatctcttctgacaaggcccatggttatcatatgaacactgaaatattgggttgcaaagtacactgaaatgtactagggctgtaaatgcaatactgatctgtacctgcagataggagaatgtccaaactactgctagtctgccccacccttctatgatggcaaaaagtgtccaccatgtccatataatgtccccctccgaacaagtgatgtttgagctagagactgattgactatgcgataaatccattcaatccatttcaaatccaactaataagcagaacctggttctagtatcgttcatgagtgaagcataatgcacttaagattatgactgcacacttttgccactttgtacagtgtaatttacatctgattcagggtccactttcctcggtaaacaaaagtctccagatttaatttttttttgtggccagcatttcttaaaaagcatgactatgacatgtaggggaattcataatttgacaatggatacaccatcattggtctcaggccagatgcacctaaccaaacttcatgcaacagaactaagatcatataaagactggtaaattaaacatggattatatgtccgtagaagtattgcttaatactattggcctgatccatatatgtaatagtataataataatataaagacaaaatcacagcagaatgtaaggatagtccttattttacaaacacatggaagcagaaaacccaaccatctaaactgatcagcacgggtgatgcaacattctgctatgcttgagatttgtgattgggtgaaatagcaaattgcaacctacaaatcactggtgctgaactaaaccatcaaagggaacagagaaaattcaatgtataagtctacatgacaggcaaccaatttcagtttcagcttagctgatctagaaaccacaaaaccagaactaaacagtgggtaagtaaaaatatgcagtaagcttatacgaacatggaacaaatcaacaattatagactggaggtatgaaaaagaagtgtgagaactgagaatagacgagaattcatacctgtgaagcttcaacatctgtgggtaagttttccaagtaaagttcccattcctgtccactccagtctgctacctcatcttcacttggaagttttccagacttaaactctgcagctagggagcaaatctttttataaatagctgactctggttccatggcatccggagggataccagtcccctcgatccacagttgaaggtcaatttggttttctattccaggtacattggttttcaggaattcaaggaatgtctctgtgtctatcgacttgaacttaaatgtggatatgtaattcttcaggaattcatcaaatgcaggtcgaccaatctaacaggggaaaaagaatgaaacatcacgacaagtcatgaaaaactcattgattttgattaaagaacgttgcaaaacagttgaaacaaatagtcgcaattttgcactcacctgacgctcaatgcgccaaaggaattggaagcctttctcatagggaacttctgagtacacatcatcagggtcaatccctgccatctttggcttcagcttagtatactccatgttatctttaaacctctccatcattctgttcaaaccccgccatccaattcccatgtttaaggctgcccgctcctccccttgcaccacctcaacaatcctccgctccgcatatgttgtgaaaccctgtgcgcgaaaacaatagtatggttacatgacagcaagagagttttagttgaacgcgtgtgcctcatttctaacagttgggacaaagaggatgtcaaactattataaaacacttttagctgaatgaaattgcaagtgaggtaatctgatgtaactgaaagttatatcgcttaaggcattcaccctaagtaatagttggcattgtagcttggtgccttttttttttctaattgatgttttatactaatccttgagacctttgaccatgcaaagtgtacccccagggtttatgcacaggttaacaggtagtagtgacagagttcgttccaaatcatttgttctaccctattgttaaattggcatgtgaatgcaaagtacatagacacaatttcaaatttcaccggctttaacaatcatctaagtacctaaaagcacatctagacgacaactagaacaaatggagggttcatcacttcacctcatttagccagaaatcttcattggtcttgttagtgatcaggttgccagtccagctgtgcgcgagctcatgcgccaccacttgcgccccagcagcgtcccccttgatcaccgtgggcgtgaggaacaccattctagggttctccatgccaccgtaggggaaactgggcggcaacaccagcagatcaaacctctcccactcatacggcccaaacagcgactccccaaccttgaccatctcctcgacgccggcgaactccctcgccgcctcgtcgagaaccttgtcccctccctcggcatacacccgcgtcctcgggccgaggtccctgaacccgatcccgcctgcggcgaacgcgaagaggtagggcggcacggactgctccatctggaactcctccacgatgcggcccggcgcgcaccacagcgcgtcgtcgcaggcgccccggtggtcggagggcaaggggtcgcggcgggaaacgtggcgcgcggcggcgaccgcggaaaactgggtggggacgtt

SEQ ID NO: 38965 - DNA, 2699 bp, Oryza sativa
aggtggtgtcggggggcagggtgagcgtgaggccggagccgaggacggggtcggcggcgtcggcgagggagaaggggatgggggagggcgggccggaggcggtggaggcggagtggacggcgagggcgcgggtgtcgaggaggaggtcgccggagtgcggggcggagagggtgagcagcgcggaggcgtggatggtggaggcggcgaagtcgaggtagaaggcgagggcggccttggcggtgaccgggtggtcgccgtcggtgtacgagtggggatccaccggcggcatggctgagctgcagcggcggaggaggaggagatcggagtggagggtagggagggagggacagggtttggctttggcctgtgtggatttggtcgaactcgaatcgagacaggattgaaagaagcaatgcaacacctcttcagggaaaaggagcttcaaacctcgaattgaaagaagcaaatcacatgcttaacttttttttttaaaaaaagaatacagtactccatccgtccagaatataagaagatttagagttgacacggctattaagaaagtatgaataattaaatggtgaaagattgggattggttgaaaagtgaaggtaggtggggaaattaaatggtggagggttgtgattggttaagaaaaaaatgttagtggagaagttgttatattttaggacaaattaaaaatactaaaagttattatattttagaatggaggaagtacattattaacttttaaattatatactcacactatatctatatatagtacattattagtttctttaatatactagtagattgatcgtaagtaatgtgtatacgttttttctacgtgtcggtccgagatcatacaacatatactatactcgcactaagtcaaaacaatatactaatagattgatcgtaagttgtcagggttatggataccacatatctaataatagttgactaaatctcgacaagacccaccacataccatgtcttatacggaaacaaccttcagatataggaggagttccgcataaggaaggatgaatagagttatacatggaaacgataaggactactcggatggtaccatattggtttccctagttctacttggacaaggggacacctatgggtataaatacaaggccccctaggaggaagggggagacagaacaatagatcaagacacaagatcaacatacaagccaacatacatcaagacaagacgccggatatcgacttcagagataggcatggctgatcccctacggtgcctatggctactgtcaggagagatatagcgttgtctctgatcttgccggatgcggattcgaggaggaagactaccctgttgtcgactacgagtcaaaccttcagatcgccatgtcgacaacagttagataggctatcccaaatattgtactggtgtgattatggtgaataagagcaatgacggcttcggccaacaggatgtagggttattacctgacaattcaggggcccgaacctgtataaaaatcctcgttttcatctcttttatctaagtctcgcatatatcctagtaccaacgatccccgtactattcaaataccggaatcgcgacatcaaacgtcgacataagtaatgtgtacacgtttttcctacgtgttagtccgagatcatacaacacatactcgcactaagtcaaaaagaaataagtgatactttcgtaatccaaatttgatcaccaaaaaagaaacaaaagggaaaatgatcagcgtgtaacgttgagaggcctttttttctcaataggatgcaatgtgcttgggcatagagattgttcacattgtagtaattttagtcaaaattactacaagattgtcaaaattttagtaatttaataatattgctaggttttagcaagatttcttatgtatttatcaaagtttaataaaaaaaactaaatgtttgcgtacatttaacaacttttttaaaaataggatggtttgaaatgatgtcgatatgagcaacccataatcgtgcgagtgagtacaaccttgtagttccttcaataatgggaagttatttgttctccttgatcttgatacccctattttatgtggtgatcgatatacggaacacttaatttttttaaataagacgaataatcaaacatcatattaaaaaaaggcaacgtctcatctattttaaaactaagatagcatgttttggtaaataggatatattttcaactatctcaagatttattaatagaaaatgtctaagtttgagcgtatgtagtgttgggtgataagcatatattgtcgacgtttgatgtcgcgattccggtatttgcatggtatggggatcgttggtactagggtatacacgagactaaggtaaaagagacggagatggggatttttatacaggttcgggcccctcaattgtcaggtaataaccctacatcctgttggccgaagccggtattgctcttattcaccataatcacaccagtacaatatttggggtagtctatctaactgttgtcgacatggtggtctgaaggtctgactcgtagtcgacaacagggtagtcttcctcctcgagttcgtgcccggcgagatcagagataacgctttcttttctcctgacagtatccggagacaccgtaggggactagctgtgcttatccctgaagtcgatatccggcg

SEQ ID NO: 38966 - DNA, 22426 bp, Oryza sativa
ggtgggtgttgattgtgtggtcgtgcgtgtcctcccctctcctcctagggggtcttgtatttatatccataggtgtcctcttgtccaagtagaactagggaaaccaatatggatataatccgagtagtccttgtcgtttccatgtagaactctggttgtctttccttattcggaactccctccatatccgaagtcagtttccgtataggacatggtatgtggtgggtcctgccgagatttagttaactactattaggtatgtggtatccataaccctgacagtagcccccgacttcaatgcaaatgaacgaattcatattctcgaccgcagaccatggagtaactgttatcgagctcaagtgaccgttctcggtgagttcagagataacgttagacttcctttatcagcctcgtgcgggcacctaaagggtttgtctgagtcaatctctgacgtcaaccaagaaagtacagagcatacaactaagtctcacgtcttgccgtaatcgagaatttggattgaagtcaagaaattttatctcggcgggtacaccatctcttcattccgtattccttgtcgagatccaccaaaccattctcgagtgatcgagaaggcgtagagtctgcgacggagccttgtcaacatttgtcgtactcgccttagtcgatcttggtgtggaaccatagagacatggagtcttcgataatgtcgaatagaattttcctaaaatcaatactcagaaaagaatattagatagaaatagcccccgagcgaatgctcaaagggtgacatgttataatatgacagactagtgaattgaatgtacagaccagtgttttgtatatgagcgtcttctctcttaccgactccgatcagtcagtttgtagagtcatacactccccctagcccccagccttgtcgtcggagaatcgttctcggatgataaggctcttggacctttgacctgcttcggttgaacaagcactaatcctagcccccagccgtgaagttggaaaactcaatttccgattacacggcttagttaatacgcacggcgagaactcttacacgatcagatcttatatggtcttttatctctacaggatccgacaaggccttatcggctctgggcgtccccagccgaagtttccttaggttcctcggaggccttgtcaagacggcgtcaagggacagtaggataggtttcaacgctaggtgtcatcgtggtaagggatctctgggtaaaacacttggcgatcttgtgtacctgatatcaactttgttggagtagaggtaatgggagaatcgctatacctctggtcggggactaggtagtagtcgtaactcaaccacttgaagtggaaatagtgggagaatcgctacaccgctggtcgaggacctggtgtagtctaaacccgaccactagaagtaagggtagtgggagaatcgctacaccgctggtcgagaacctggtgtagtctaaactcgaccactagaagtaattgtacgagagatcgctacgattgactggttgagaactagtgagtaggtgtctctcgatcatttgaagtcgtctgaagtcgtagtgcaaggaccgctactctgctggtcgaagaccagtcatagtcgtacctcaaccgtctaaagtcatctgaaatcgtggtgctaggaccgctactctgctgccggtcaaagaccagtcgtaatcgtaccttgaccatctgaagttaaggcgcgagagattgctatgatttactggtttgagaaccagtgagcgaatagaattatctctcgaacgccaatggaagtcgcggtgtgagagattgctgctgtcgaatggttcgggaaccagcgagttgaattatctctcaaacgccaatgggagttacggagcgagagattgctacgtactggttcgggaaccagcgagcgagcagaattatctctcgaacaccaatggaagctgcagtgcgagagattgctacgtactagttcgggaaccagcgagcgagcagaattatctctcgaacaccaatggaagctgcggtgcgagagattgctacgtactggttcgggaaccaacgagcgagtagaattatctctcggacaccaatggaggtcgcggtgcgagagattgctacgcactggttcgaggatcaacgaatgtgtagaattatctctcggacaccaatagaggtgttgcggtgcgagagattgctacgtactagttcgaggaccagtgaacgtgtagaattatctctcggacaccaatagaggtgctgcggtgtgagagattgctacgtactggttcgaggaccagcgaacgtgtaggattatctctcggacaccaatagaggtgctgcggtgcgagagattgctacgtactagttcgagaaccagcgagcgagcagaattatctctcaaacaccaatggaagctgtggtgcgagagattgctacgtactggttcgggaaccagcgagcgagtagaattatctctcgaacaccaatggaagctgtggtgcgagagattgctacgtactggttcaagaaccagcgagcgagcagaattatctctcgaacaccaatggaggttgcggtgcgagagatttctacgcactggttcgaggaccagtgaacgtgtagaattatctctcggacaccaatagaggtgttgcagtgcgagagattgctacgtactggttcgggaaccagcgagtgagtagaatcatctctcaaacaccaatggaagtttgcggtgcgagagattgctacgtactagttcgagaaccagcgagcgagtagaattatctctcggacaccaatggaggttgcggtgcgagagattgctacgcactggttcgaggaccagcgaacgtgtagaattatctctcgcacaccaatggaggtgctagagttggtttattacatgtgcgtctcatgtggccagcatgactcacacacccaacttgtagcatatccggatgtccgttcacaatcatgtcgggtgatcaagccgacggcgttcgcgaggaattatccgttaacaaccttttctcgagtagtccagccacggccggtgctatgagataggtcgtcggtcttcgttggtaggttcggcgcgacgactctgcatttgtcgagatcgttctcgataatgcggtgtactcgaccacgacctaatcgagtgcttaattgttcctgaaaaatattttctagaaggcaagatatatagcagagaatatcgagtatgtaatcaaaaaactgcatggatcttctagtattatcaggatataacaagcagatgtaaatatcaggcattatgtaaaccgtaaacaagcatgatttatacagaagagaacagagcgagcccccagcgttagaccgtagtcggttttacgtcggaaacattcgcgcaatagatattgtataaaaaatatgctctaggtaaacataataaattatagatctgacaatgctgtatgatctgaatagatacgataaattacgtataaaatattacgtacctttgtatatacataccggatgtatctacgaaattagtagatcaatttaaaaaatcaatctcataattacctttgtttatgcctgctacagtcgacaagcatgtagtagagttggacgtgattactttgttggtcctgaaaaacatgccgacctgtcatatgcttacacgtgtgtgtttgtgcacgtgacatgtctaggccaatatgctttgttgaccatctccgggcaaaacacgtgatagcacaagtgcactggtactcggatgaatcccggcggtgcggcgttgcattgtgctcggcttggacatggtggcgtgttggatctggactcggtcagccggtgcttgcgcagcagccataccagctgatgtcgtaggcggaggtcttggcagttgattctccgcggcgttgatgttggatgatctcggtagatcaaattgttgatgacgatgattccgatcttgtcgggggacatactccggtcaggttagatcttcccacagcgaagtcgtcgagtatcttgttgtcgaagaatctatcttttgaactcatctcgtcgaaatcctagagcaccaaagtcccctacctggcgcgccactatcgatgtttgatgtcgcgattccggtatttgcatagtatggggatcgttggtactagggtatacgcgagactaaggtaaaagtgacaaagacggggatttttatacaggttcgggcccctcaattgtcaggtaataaccctatatcttgttggccgaagccggtattgctcttattcaccataatcacaccagtacaatatttggggtagcctatctaactgttgtcgacatggtggtctgaaggtctgactcgtagtcgacaacagggtagtcttcctcctcgagttcgtgcccggcgagatcagagataacgctttcgtctctcttgacagtatccggagacaccgtaggggactagccgtgcttatccctgaagtcgatatccggcgtcttgtcttggcgtatgttggcttgtatgttgatctatgttccgtgtatgttgattgtgatgggtgtgtattgtccctgttatctgttgattgtggtgggtgttgattgtgtggtcgtgtgtgtcctcccctctcctcctagggggtcttgtatttatatccataggtgtcctcttgtccaagtagaactagggaaaacaatatggatacaatccgagtagtccttgtcgttttcatgtagaactctggttgtctttccttattcggaactccctccatatccgaagtcagtttccgtataggacatggtatgtggtgagtcctgccgagatttagttaactactattaggtaggtggtatccataaccctgacatatgtatttatattttttttaaaaaaaagatgagactgtacacgcatttccctgttttagtgttttatcattatgggggtgctctccttccggtccaaagcaatgttctctttgtcgtcaaacaatcaaattgatctatttaatctcttaattatgagatgcactcctttgagttcaaatcaaattgctctatattatctctttcttagaagatgctatcttttgtccttcacttgttaaagaaaaaatactaggccactaggggggtcagcttcatcttcaaggtcccccgagcgttatctttccgaaaagttgttcatgacatgggttagatttgttttatacgcacaaccgaaggccaaacaagatgtacctttcctctcgtcgaatggtactcttctggttttgttttcctgtctcgtgcagacttcaacacatttgtccagtgaaaaaacagctccttcagaagaagaacgaaagtgtcaagctgcgaatttcttcatccagcaccctgtttcccaagatatcgactcagatttggtttgatgaatttgatccaagatgttattttgctcatatattcttagagatggatcgtacactaactcactgcactgataacttgctccctcttgatagtttgcttttccaggattacattttctagctaatgctaagtttgggcagcgggatttttgaaaacacgtacggaaatgaaaatctcacatgaaacagttggttggagcatagaaaaaacacaagatttttagaagaaaaagctatacacgaaggaaaaaattttagcgttttagctgacaataggaatcgttcaaaatttctatgaaacatataattccatataatttttaaaggaattatagtgtctcgatcctttgtttcaaagtaaatcatagggatttttttctactggattcaaattatttaaaaaatcttatatgtttcctttgttctcatatgcatatcacggttaatactcaaaccttttaatctctaaaattttggggtttccacctagcttcatccagaacctcgtatctgaccacaaacaagaaccggcacgacaaccattagcggacaagaaccattagattgttagaacatgtatgtaagaattttattttttatttttaaatatgctatttcgttttttcctccaatatactaaaagcaaaggttaaaaataaactacaataaaaaaaaactttaaaatcaacttaaatttaaatttaggactaaaaaaattaaaatttagctaataagggtctgtttagttcgtgaaaaggaaatttttgggtgtcacgtcggacgtttgaccggatgtcgaaaggagttttcgtacacgaaagaaaaaactaatttcataacttgtctggaaaccacgagacgaatcttttgagcctaattaatccgtcattagcacatatgggttactatagcacttatggctaattatggactaattaggctcaaaatattcgtctcgcgatttctcctctaactactgttaacgaccaaatttggtaatatcagcatcggaaaaggagattagatcaaggtggagtcgaaggcggagattgatccgagaacagagcaagaatcggctgaagtccagattggctacgattagaatcggctgggtctgagtcggactaggtgagccgatgcggccgattctgacagtataatttgatgtatgacattgggttgaattgaggtgcttcaagatgattgccgcacatggataaagtcctgagaaggcaattgtatctattaatttggatgttttatataacttccttagagatatgtttgggcaaaagtctgccgcaaagacttatggtatcttagagttttttagagatagtggtcgtgtccggtatggacatatcttgtaattctcgagtataaatagaccccgagccctatgtaattttagaacacacacgttcaatataatttcggtgcatcgccacatttttgctttagttttgtttcgacgagttcttgctttcgggttgagctgcatcggtttcgatcttcaacaagaggtaatacttgttatgacgacttgcgttctcgagattagtgcttccatctttataacactctaatcttgtctatataattcgtcaagttatcatatatcctacataatctttggtaatatcgtcatctaacctacaatcggctaacatctgttaatagaaggcaaccaattaggttaaatagcgacattgtcctagattatataagatatctaccactttatgaaacacccagcggtttgattgtctagatattgttcttcttttcatacttaatgctgcatcagttgagtttgatctattaagtcgtgcttagaatatcaatctctagcctgtcctctggttgccgattagggtagtatcggagtttcagccgatcttatttgatttaaccatattcgatctatatgcttcaatgacatgttaaatccgccctttatgtcaggatcttattgcatttaagtatattaagcttttgtttggtatatgatatttgttttgatatctttatataaagtagtatcggagtattagccgatacatgctagatctatctgatcggctatgctataaacatatataatcttgttattaatatatatttcgatctaagtgatttatactgtctcggcatgatgaccgatctatcccaatcacttgatttaagtatatattaatataagaactatatatcgttaatatctacagccgatcgaatagatttagttccttactatctatttataaccgccgatcgattcatatatgacatcggctcaaagataaatgatatgtcatcggcacccagccgatcggctatcatttatagatttaaccacgaattctttgtctctatttcttgttgattataggatcaaatcaactggcacgctcatacattcgaaggcgagctttggacctgcactggagttaagcagatctcccaggcctcgtgttttctgtcaacaactatgcaattagtttttttaatttatctatatttaatactccatgcatgtgtctaaagattcgatatgatgtttttaggaaaaagtttttggaactaaacagggcctaagtactccctccgtcccaaaatatagcaatctagaaccagatgggatatatcctaatactacaaagctagacatgtcccctatccatattcgtagtaatatgatacgtcccatccggttttagggtgttatattctactctctccgtttcacaatgtaagactttctagcattacccatattcatgtagatgttaatgaatctaaacacatatatgcgtttagattcattaacatctatatgattatgggtaatgctaaaaaatcttacattgtgaaacggaggaagtaggacggagggagtataaggtaaaggaaaagacaaggctattcgttggcatctcggaagtcgaaagcacacgaagcaaggcaaagcattttaggccacaaccacaacgaaaacgcttcgtatcgagcgtccgatacgagacaaactccggacggtcgatggggcccacctttcccccatcttatcctcttccttctcatccccaacctctcgtttaacttcttctcagcgtctccacgctgcacatgcggccgcggtgtcatcagccggtgccgccaccgccgccgcagacggcggggctgccgtcgcggatggccggattctggcgccgccggcgacgttcgttagcggcgtcgtgtggcaggcgcggtggccgtgttccgggcggcactggtaatggaggcgccgggcggcgtcaaacagcgacgaccgcgcgccgctgttcttcaccttctccctgatgacggatggaagaggaagcgtggggtggtgctcgtcgccagcgaggactaccatgcgctcgagcggtggccggtgcagcagttccggcggcgggatgcggtgagcgccggcacccacgttggcagcaacggggcagcacgacggaaatgcttgagacgccatcacctgagagggttctgagctcggcgacgaaggtgaggaggctgcacactacatgtttttttgttgcacatagtgtgttcctaatgttgcaatccgttttttctggatgtttcttaaatcggtaatggatgttgcatttagtttcttcggatgttgcatatattggttttttttgttgcagacaacattatcgagtgttgcattcgattgaaacatcttcgataaagtggtgaaacattttttttcgagcggtgaaacattcaatgaaagatgaaacatcgagaaacaatttttgttgaaacattttttccgagcggtgaaacattgcaatattcattcaacatactgtgaaacatcgtctggagattttatgttgaaacattacaatattcattcaacatacagtgaaacatcgtccggaaacgtccaatgcgtagctttctcctaaccacaaccgctgccgccgtcattgcggcacaccggataggaggtgatccggatcggagccagtgccatgggacgggccgggtatgttcatgggcaaattttttactggcggtgggcttggtctcaaaagccgagtttgactggtactgtgctcgcgtgggccacgggccacggcctccactcttcttgcctctctcactgtgcccaaaaccagatcaaagctactggtctcactctcacggtctcacctcaacatatgttttccctcttgccgcgatggtcgctcgagttgttgatgctattgatcagctagttattccccggataaaatcctttccattgacgctgcacatataagaattctcactactagtagtactactactagtactactacagtactacctagcagcatggtactagtataaagtatgtgtcctggtatagaattactacatgtgcaaattggcactatgatggtacagtgcacgggacgaatcgccaaaccagaactagcataggagtagctagatgcatggtcagctaggcatggagtatggtcctccgatcctaggagaggtgatcatcgagcacacatcgatcgatccatcgatctagcacgtttgtcttgagttttactcctacatgcacatgtcgtcctcggaatgaataaggtggctccacgtactactactcatctcccttctccaactccaatcgatccatggcaataatatctgcactgaaacgaactgtcacctgttgtgttgctgctggtacgagtagtaggaccagcaatgagcaaaatggtacagtactactcctccaatagctaacgctactagtactcgtgctacagcactggatgtcatgccggccaacgaccaaaatggtacagtaccagtgtaccacttccaccacaaatcaacagctacagtatagtataggctgtatagtcatgcatggaaatcgttggattaggagtacaattaagggggtcaaaaggagaaagtcagggctcgtttagttggaaaaaaaattaccgttgcatgtcacatcggatatacggatgtacatttaaaatattaaacgtaatctaataacaaaacaaattacagattccgccagaaaattgcgagacgaatttattaggtataattaatccgtcattagcaaatgtttactatagcaccatactatcaaatcatgacacaattaggcttaaaagatttgtctcgcaatttcctggtgaattgtgtaattggttttttttgtctacatttaatactctatacatgtgtccaaacattcgatgtgacagcgtgaaaaattttgtttgggaactaaacaggccctcactctatccatccgaaaataaactaactcttaccttcgtaagtcgagaaaatttattacttcaatatcccttacgtaccaactaatactagcatacaatatttacattaaataaggatattgtggggtttttttctctccttaaaattactttgacatgctagggttcgagattttgggggtatattgggagtgaatccagaggccgggatcagcatggagagacagcactgctgagcaacaaagcaagcatcccagcacagcatctgattcccctgcccatccgatgaaacattcgttgcagcgaaaaaacacaaaagtcgtcgtcgtcgtcgtcgatgaaaaggcaccggatcgatcgaggtatgattgcatggtggtcatggtcaaatgctgcttgggcatatgctgctgctagcggcgggagggccccggccggccgtcgatcgactgcagttggaacagcggccgtgagagccacctttacccaccacacccatccagcggcaaggcaggggatcgacccggacagacagccgcggaaaaggttgccggccggtgagccatcagccatatggacaccaccaccgtctgtcactctctcactctgtcatcagtctgtgtcactcacactgtcagtcacttgccactccaaacaagcatatggagttcggccctgtttaaataccacctaaaatttttcatcatatcatatcaaacgtttgaattattaaacacctaaagtattaaatataggttaaaaaaataactaattatacaaattacgactaatttgcgagataaatcttttaagcctaattgctccaagatttgacaatgtggtgatacagtaaatatttactaatgatatattaattaggcttaataaattcgtctcggtttaccgacggattctataattatttttttattaatacccaaatactcttatatgacatcttatgtgacacgataaagctttacactcctgcgtcaaaaaacacccctggtagaagtactagcagagtaatgtagtggtagtagtagcatatgcacggatcaccaaaagaggtggatttgccagcagagtggtacacgtctcctgcagctgagctcgccgttggactggacgcccagctactagccctcgccattgtcgcgcgcctcggaagtcgggaccgagtaggagtagtgcgggaatcccatgcatgcatgcacgcgtagccggaggccggagcatatgccgaagagaaagccggccggggaggagggcgccgacgtcgacgccggctggccgcagtactgtggttctctccccagtcattggccgataaaagcagcggcgagcgagagcagcatgcctgggatggttttattaacgcatgtttaattaaatattagtcataaaaataagagaatggataaatataatttttacaagtacttttttttataaaagattttctttttaaaaataaaaataagagagaaaatttctaacatagaacacaccttaagttgtgttcgtttttttttttgctgggaactgattattttccacataccttattagcacacgattaattaaatattaattttaaaaaacttaaaaaataaattaatacgattattttaaaatatatatataattttttatagaaaaatatttaataatttggaaaacgtatgctcaaaagacgagtgagtgaagttaggaaaggtatccaaataacacatgcttatgctccgttttgagatctcatttaacttttgctcttttaccaccgcagtacaagaaatatgattaaacttgaaaaacagatttatttgatttcttttttaagaaacttaaaaacattaaaaaagggggagaatatattagaaaacgcacgaaaacatgttcattaaaaaatgagggagttgcggagaacgcaccgtgtgctacactaccagtcagtaggcgtctagtaggccgagtataggccattgccagcggcgacgatgcaacagcgctgtcctaggctcctagtgctagctgcgcaagacgacgatgatacccgaagagctttcactgcactgtgctgacttaactctgacagtagcgctgcgtttcacagccccatcaatcagagttctttctcctttctcccctaaaccaaacaatctccgtcagctggtagctggagagtactccatccgtcccaaaatataacaactactccctccgtcctataatataagagattttaaatttttatttgtaatatttgaccactcatcttattcaatttttttataaatatataaaacaaaaatttatgcttaaagtactatagataataaagtaagtcacaaataaaataaataataatttcaaaaaaatttgaataagacaagtagtcaaacgttgcaaacaaaaactcaaaatcccttatattatgggacaaagagagtaacttttagctcttaaaatttgtcctgaaatataataatttctctaccaacattatattcccatccaatcacgaccctcaaccattcacttttctcacctacctccactacccatccaatcataaccctccaccacttacttttatctattttcttaataaccgtgtctaattctaaaatttattatattctgggaccgacggagtactcggtttcacccggccaaacatgtcagtcacacatgaatgagcacaacttgtcaagctccatgcccatgatgaattcattaattatattcatggcacgatacgtacagtagcagcagtattaacacggagaagacagagagatcaatgagctgtgggtgtcaatgcacctggctagtactacctcactgccttaatactgtatataaatttgcaagaacagttaatggtgtttcaccggcaaggcgatcgatccgaagtcgaacgccgtgcaaacacgtgaaccgcgatggtctgtcaggcggttggcgggaagtagaaggggtgatccgccgggaacggcggctgccggcgggtggcggcggcgacgccggcgccggcgccggcagagaatcctgatgatgctgcagcgtggagcaatggcaagtgagaaggggcctgcatttgccaagcctgtgttgggaacggcatgggacccagctcaggccttctgtccattggcctctcctgcagttccattgcaatttgcaacagagcaatcatctatatgagctttttttttttcacattgcactgtatctttcatgctatcacagcataggattcttaatgctataatgcttctcctgcagttggaacagtacatattctaactaaataaaaatttcaaaaggaacagatggcacaattgattggttgttcgttacattaaccttagttatgcatgcgtgcagtgtgccagcagccagcaatataaaggatggaaaagcaagatatagtagatcactcagagccgtgcaagcttttaaacagtatctgaatctagagcatcttgagggttaaaagctgcgccaggtgatcagtgtactaacttgaagttatatcagaactgtaatactggaatgctttttcaaagaaaaaatcatgctgacagaaccacctgacgaaatactcaggtatttatctacccatcagaattcacaagggaaacggtatctaacaactaatagctgcagataaatacctgtactcgaggtagaagtactaacaaaggtagtaaaaagtaatgtttgaacttgctagatgactgttcttaaggcagaaagcatagtattcagttatagaatcctaagctcgttaacgataatttatttgacaaacccattagaattggtaagcaaggggtgttgataataatacctgtaggttcgggaggaagccaagacaatgagatgggtacaaacgttgatgctgagggggcagtggtgtgctttggtgatgcacagtccattggggagacgagcccattggctacagcaacgccaaaaggttaaacaaacgttataatatccggtctttcagaacttggatcatcgacaacgtactgataaaaacaagaagtacagtccatctttataggaggttacatggataagagaaagctacagttgtttccattctactaccatttttttttttttgcatgcactttttttcgacagatatatacttgcagagaaaatcataaaaacaggaaaaaaaattgaaactaaaaacagaattgagaatttattactttctataagcattacggcattacctggtggactgtaatatttgaagattcaggggaatcacaagttaactggaggccagttgtggcgacatcgcttttggagtcacgcgcattaggttgcgaaatccgcaaatccaaatcaagatcgccatcaacaattgctaaagaaaaaaacagtgatggctatgagaaatggtgtttggtgtgcttcggctgaaacggaaaattcgatggtgagactgattgtagtaccctcatttccggcgtctggtaaagcatccacattgtaggatgcaggctcgaagttggtaacagcttccctcccattgaagcgaatagctgccctgtcatatgctctaccaaattcaaccagacatgaatcgaaagtgagcgagaaaccaggaagttcatgactcgtcatgcatgtcacttcatcaaaggaatagtaccttgcagcttcaacttcggtgtcaaagagcccaaggtatatgtacctgcaagaagatatttctgaattctgagaccacttcagatcagaaaagcgtagtacatgcctaactgctagctagactctttgatgacaatactgtctctccagctgagaaagtacatgtgttttccccaatattggctgcgaattgatgcactgagaattggagatgtggacctctcacccgaatcatattaagacgccccaaccggaaacaacttgtgtcacactagcatggccatggactcaattaattagcttaaactcattatcattcctaacctgaacatctcacatctgtactttcgtttgtcactcctaattatacggttgtgaaattgaagtattgatgaagggggatcactagctagctagctaattaagcttacttcttgccaagaagttggcccatgcgtgcctcccagcggccgcacttgtgcagcgtgacgccgcggaacttggagctccccctcgcgaatcccgtgctctgtcgccggagtatgtgcacgaactcctccttggtccagttcctcatctgcagcaacccagctcagttcactcacatgagatcgaaaggtcgagacgagctagctagctagcatggagtatcatactacgattagtatgtaatcatatatctagatcacctgcttcagatcgtcctcgtagtcgctcaggttgaagttgatgtcagcctccagtccccggaacttgatcgcagcgcgatcgtaagccctgcgtaaacatgatcgatcgatgcaaatttagcaacaagtacatcaacctcgatgaatcaatatgattaccagttaatccaacaaggttaattaattctattcacgcgatcgagcttaattaatacatcaccttgctgccgcgtgcgccgtgtcgaaaccacctgatgataaatttcatcagcgttagcacaatactacaagatagagagctatagccagcaatcgaattcacagcaactaatgaaactgataattagttgaattgctcatcacctaggtagacttgcttcccgcaatccctgcagagattaggaggaagaaagcgagggattaatggcggtaatcagctagacacggatgtggattaatcagttgatgattagttgattgattaattaccatatgtgcgactcccagcggccggtcctcctgtagaaggtgacgcccctgtactgcgagctccgcgacctcggcccgcgccgcgtcttcttcgcgaccaccggccgctgcgcgagggcggcatcctccgccgcgcggcgcggcggctgccacgccggcgccggcgacggcgccgcgggaggcggaggcgggaggagctgacgcgtcacgatccccgaggcggccggcaactgatgctgctccccggagcactcgtcgtcgtcggggctgctcgcgaggaggtcgaaccggaataatcctccgccaccgccaccgccaccgccgcctccggcgtccccggagtttagcaccgaggagctcgacgtgccggaccgttccggcgactccacattgagatccaacaacatctccaatcctcaccacaccggcaacccaaccaaacacttccaccctctctcgctcttccgacttcgatcgagttcaactcaccaccaactctcctcgccttctgcttcaccctggctatagctcagctcgatcgttggcgcctcgactgacgacgactcactcaccggcttcgagcggtggcgaggcaggagcagcagcaaccacagcaccaggtggtggtcgccatggggggttggatgaagaagaagaggaggaggagagagagaggtggggagcagcgggagaaaaggaaatagagagagatggatgggacgtcgaagtggcggaggagggtatctcagggaggagatgagaaactatcgcacaggggattagaatttcgctacggccacacgcgcagcggacgcctccggtggtagggacggcggcggtggctaacgtgtcgcacggcgatcggctcgccggagatggccggtctccactcccaagtccccaacctctggtcctttgggagagagacgatgatgagcgggtttgcatttgcgtgggtttttctaggcgcttatactcgataaagaactactgtacccaattggggcgattttgtatgcgacaaataggacaccacatgggtgttagtttattcaaagtcggcagattctgacgttaattatagcatattaataatccggatgatagttgggctttgggttgagtttttttttaagacgttactttatatataatcataggctagatttgttgtgtactagttgtgtcaggtgaattgttattataaaatgaaggacgttgtcaaggtggttatatgactcgtgcgatattacttttattcgtgaatgtactatgaaagtataagtgagtgatgtgatttacaaatcatgtaaaccaaagactacaggtggaatattctaaacgttctttagagcttccgatatgttattacatggtggtaggataaagtaaagtgaaccatataaaaaaagtcaaagtataagtctattgaacaataatgaaacctttttataatatacatagcaatatttaacaccatataatttactagtataataagtattataagatgtattcctaaaacagacagtgtatagtgtatgggacacatggccattcatatcttattgtactagtagctaaaaccaaataaacttataaatatcttcatcgcagaacaggttttctttatcgtaaaaaagggaacaaccgtaccctcttgttggatagtttagccatttgaggccaccagccaagcgcgcagccgggagagggagcacggtccagaccgtgcacgttggatttgacagccacaatcaggaatcaacaacagcaacaacaacgcggaaaagtgcaccgggtaagattagttaggctacgttacaccagtggccaatcagcaacgaaccatatgtgcattgcatgcacactggcgtgcaccagacaattccattgccctccacttcaactttttttcatttttcacggcaccgcgcgcgacagccataatggcaggcagcatcaaaactcctgtggcatccaacacgctgaaagcgccgaacgccgtacagcctcgggcgcagccgttttaggatgtgtttagttcacgcaaaaattaaaagtttggttaaaattgaaacgatgtgattgaaaagttggaagtttacgtgtgtagaaaagttttgatgtgatgaaaaagttgaaagtttgaagaaaaagtttggaactaaggccctgtttagttcccaaatttttttcccaaaaacatcacatcgaatctttgaacacatgcatgaagcattaaatatagataaatgaaaaaattaattgcatagttagggaggaaatcgtgagacgaatattttgagcctaattagtccatgattagctataagtgctatagtaatccacatgtgctaataacggattaattaggctcaaaagattcgtctcgcggtttccatgcaagttatgaaattattttttttcattcgtgtccgaaaaaacccttcagacatccgatgtggcatccaaaatttttcttttcataaactaaacaggccctaaacaaggccttaggccattctcaacccaatgactagaatggtgtctatagcattaaataagctgccacctaaaatgaaaaatgatgtagcaagtgaataaatgaggaatgagaaggaaaacatatcttgcatgagacatggtttctacacaacattcaagacatcatgtgagataagtggcattaattgaagtatggattagtgatatttacattggaatagtagtgtctagtactaatttcttgatgatgtggagcttacagaaactatgtctagtgtcatgggttgagaatggccttagccgcacttgtacaggcaaagtggagtatatccatccatcacgcacggcacggtgagtggacttagccgcggcgggccgtgcagttgcagtcgctgcccgcgccgcgagcgtggaggtcaaaccgcccgtgcgccaccgcgcagccgcccgctcgtgccgtcgccgcgcgcggcgcgcggcgcgtggctggctgtacgctggcctcggttacgccgcgcgcggtctcgcggcgcgcacggcgcacgtttcttcgtttcaccgcggccgcgcggcgcatgctgctttgcggcgccgaaattataactcgtagtaactcgtaacagatcgatggatgtgtgtacgatatggatcgatcggctaagtctacgtcgcgttgatgaactcaacacgttaggccaactgttactatagtctaataactgggcccgtgtatagctgtgtacatgggcgaaaattatgctatgtacccggccggcccatggcgtgccatggccgtacggtgtaccggctctccgatcctggacagtgcagaggccgccgtacgtgcacgatcgatcgatcgatccaagcggggaaacgttattcgtttctagaaaaagcttttattggcgtagggcgacccgtatagcgtatgtacaggtttgacgtgagaagtgagcgaatacgtagctcgctagctggataagccgcgttttgtgccgtgcgcacgaacgactcgcgcgtgaaactcttttaatcactttagtcgacgtcaacttaataattacatataaacttaaacagggacggatctagaaaggattaattaataaataagagggcttaaataaactatacaaaattatatccctcttctaataaatatatgacagaaaattttaataagatcccatggttaaaatcgccccttggtggagaaaccatctttcgtcggtcgggttatttccacaatagtcccggttgcaataaaaaccgggactaaagaccggttaaaaagggtaacaggcaatttgatttttagtccccgttggtaacacaaacggggactaaagatgatcctagtcctagttcaaatgttatcagggcttgtcaggcctccccaggaaccaaccgggattaaagatctatttatagtcccggttgataacactaactggaataaaagatcggcatgcgcaacatgggcgccggagagtacgaggctagatcgaagaggaggaggagcagttaatatattctatctcctccctggccttatctcttcctcctccatatctcttcctcttcctcctcctctcctttgaacttctctcctccttttcctctttctcctctacgagcgccgacgggcggagggcctggtggccggcggcgtgccggcgcggcggcgcggcgctaggcgatgcggcagcacagcggcctgggcagcctcttgggcggggggccgcgcgcggcggcggcggccggcgggccgcgccccgcggcgacgggcaggcggccggcggggccacgcctcccggcggcggcgccccgcggcggcgggcaggcggccgacggccggttgggccacgcccggcggcagcgagcggccgtttttttttataatctgtgattattgagatgtataattttgtgattcattggacatttgtatagatctgagatgtataatctgtgatgtattttgtattgtttaggatttgggatgtatttgatttgtgtgtatgagtaactttaagatttgtgatgtgagttgagatgttatttgatttggggatttggggatgtgcatgccactcgattcgggagaaaataaaaagaaaataaaagaaaagaaaaccatctggactacccgctactctctctttagtcccggttgataagaacagccgggactaaagatccctcttttttactccggctgttgttatcaaccgggactaaagatcaatctttagtcccggttattttaaccgggactaaagatacctatctttagtcccggattgctactctcggttgaaaacccgagattaaaaggggttaccaaccaggagtaaagaaggtttctccaccagtggccatcgccatcgtccttacgacgtcgtggtctagttcactgtggggattgctattcaaccaccttatcctggtcctcgaaaaagaatggacaactgttcgggattagctaatgaccattatcattcatgaatagcactagtacttggttcgtggccacacgtccatatatattctactccctccattttataatataagtcattctagcattgtttatatttatatagatgttaataaatctagatataaacatatatatcgatttattaatatctgtatgtatatggacaatgctagaatgacttatattatgaggaaatactgtttttaaacaagtgtttggttctctgttactcatgttagagcatgttagcgtaccacatatactatttttagcgtgctccatgtgtgccaatagtcccggtttttcaagtcaattttgctgtcgaagttgtggtgccgtgcaccaatggaaagaaggatttgcagccaaatgtgtcattaccttagtattatccattcaactgcactatgactatcactcaataaaataatagttaatttgcaaggtcggagataaacttcagagtgcaatagcaaacggtgagtggttttaatcctgagatttatgttcaatccctaacacgcttacaatttctttttaaaaaagtttggagcgctcacaatttctttttagaaaagtttggagggatgtgtctccctccaaatcttgttttaaatttgcaacgttgtgtttgctaccaaatttgtaattagctcggtattattaccagttgcacgctgattatataaaatagtgaattttcaagtttgtgtttaataccaaatttatcattagcttacggcctgtttggtagagctctagctcctaaatttagctccaggagttgggtctggagtggagttg

SEQ ID NO: 38967 - DNA, 12151 bp, Oryza sativa
  unsure (1)..(12151): unsure at all n locations
tccgccgggccgctgccggtgtctccgtcctcgacctcgcccgcacgaagtcgccctctccttctcccacgtggccgccgccgccgatgccgacgccctcccttctacccgtcaccgcccccgtcgctgccgccgccacggggccgccctcctctctcgcctcgcgcccaacggccggcctagtcagaggcagagaagcgtgagaaagaggaggggagagagagagagaagggggaagagagaggaggctgatgtggattgtttgaaatgtggggcccacgtgggtcccacgctgactcagccgccacgtcggacaaaaccaccgagggacctaatgcgaacggttttgttagttgagggaggccagttatctggttttgcgattgggggacgattttgtatctcgatgacaagttgagggaccttggttgtactttttcctttttaaaatcggtcatgcctacataatccgattggaaagcaacggaagggatggtttatgggccttttttgggcagcaaaaggcgcatgtatatgggctgccagtccacacaatcgaagtgtcttactgggcctaatgcttatggcctcaaaacataagaaaatatcagaataagtccacctttaaaagtgacccgaatctaattcataaccctaaactgcaaaatctaattcataaccctaaactgtaaaaccggatgtcttgaccacccaaactgttgaaaccggtgcaatttgactcctttggtggttttggagggcggtttagctgacgtgacgcttatgtggtggtgttgatctagtcttcggggttgacgtggcgcttaggtggcatttgagttaaaaacgtatacgtgggacccgtttgtcattcacacacataaaaaattgtggggcccacagacatgtgggccccacatgtcatacttcttctccctgccactgacatgcggcgctgatggcattgaaaccaccggggcgtggcacgggacggaacacctgcccgccgcttccgcagctgccatggctgagctcgctacggttcaatcccgttgggctctcgggccgggggctcacgtacttgcacggttggttgatctcgccgccgtcgacgccggcgccgacctccatggtggtggcggtggcgagcttccgcttgagggaggagttctagtgattcttgacggtgttgttggtgcggccggggaggagccacgtgatggtggcccaccagttgccgaggcggtcaccgtccaattcctcgtcgtccaatccctcgccccatgccactccactagccgccacagcgcctcatcctcctcgggacttcatggcccctttatcctatcacactctccttccacccccatatccaaatgatttcctcctcctccttcctcgagctgctctaatggcggcgtgggtgattagcgatgtggatgtctcatactcgccatcaccactttagctcccgccgccgctgccgcttcaactcctgcccgtgctccctggctccccgcagccggccgaaggactgagaaagagaaagaaagagagaagggaggaagaggggatggaaggcccgcgcgacgagctattagctcagtggtagaagcggtggctctcccttgggaattcaaatttntggccngcgttcngngtntggngtnaccnnccantngnggnnnctgtgnanngggcttctcnnagccacatggatagttcaatgtgctcatcagcgcctgacacgaagatgtggatcatccaaggcacattagcatggcgtactcctcctgtttgaatcggagtttgaaaccaaacaaacttctcctcaggaggatagatggggcaattcaggtgagatcccatgtagatctaactttctattcactcgtgggttccgggcggtccgggggcactacggctcctctcttctcaagaatccatacatcccttatcagtgtatggagagctatctctcgagcacagattgagggttcgtccctcgatgggaaaatagagcacccaacaacgcatcttcacagaccaagaactacgagatcatgttggggaagaagaaagagatgatgacatgtggggccacatgtcagtgtgtcccacaattttttaatgtgtgtgaatgacacggatcccacgtatatgtttttaattcaaataccacctaagcgccacgttaactaaacatactaggtcaacaccgccatgtcagcgccacgtcagcgaaaccgccctccaaaaccacgaagggagtcaaactgcaccggtttcaatagttcggcgtcgaaatatctggttttgcggtttagggtcatggattagattcgggtcacttttaagggagtccaagtggacttattccgaaaatatctggtcatttagcccataaaaaacaggtccataagattctctcctaagctaagccacttatacttgagcacgtatcgtaaggaaaatccaccggtcgtcgcaagcccgcatcaacgagcaggagggatataaaaccctccgccccctcctcccccaaacccttccgccgccgccgtcgccgtcgcctgctccagcgcgctcgccgccggccgccctactcccgctccaggcccgtcaccgccgtcgccgatccaacatggggtaatggatcctctatactctgcatctaatcgccgtcgctctatcccttgcgatttctagcgttcgtcagctctgtaggaatagtgttttggggtattcaggtctacaagcgcgaagttaggagtcccatccaatttgtccaaccagaacggatttttccttctgttttatactatttcgttcatctaacgatgcgctgttgtgattttacttgtctgattccattccagagactttgtttgatgtagtttcaaataatttagtggcatattgagagatatacgtgtccatgagctataagatgcctcttgtggctggagctgatttagttgctgttcgaaattatgaattaccctccaggtctccctagtcattagcaatctatacatttttacgttttgctacggcagtgtacactatatgctgaaatatggatcataatctcatgggtgtagtaactctttctgatgaaatgctctcaattcactggcttaagcaatcagcatagcattcacccctaattcaatatttccatggctagactccactggagtgtaaatatagcaggcttgttaacattttctgtctgctggattgtgctctactgatttaagtagtagtcaccacaaccatatctagttgcatacatctgtttgctatgctattgccttgtaggagtattgcatagtggatgcatattagacgcatagtgtttcccttgggaaatgttttccaattggaggcgactataagaggtggtgggacatttgcgtttgcccttagcctgatcgaacttaaattgcactgtcgaatctcttttgctgctttccctttagcaaattggttgttcatgagtgatgcttgcagtaaactggttgttgagtcctcaaaattcgtctcatacttttgggtagttgaatcttcttcaatggagtgatctgtcagacagagttgtacctatgtacttttagaacaaaagcaattacactcatcttaatataccactgtgctaatatttctagttcctttgatgctcatgttgaaactgtttgacgtatagctttagaactttattgatgcacttggtgtttacatatatttcttggatgcaattgcagtaagacacgtggtatgggagctgggcgcaagctcaagacccacaggagaaaccagaggtgggccgacaaagcatacaagaagagccatcttggcaatgaatggaagaaaccctttgctggttcatctcatgcaaagggcattgtccttgaaaagatgtaagtgcaataaacgtagagcaattatttgctctgaagaacattcaataaccaacatgcattactttatctgcagtggcattgaagctaagcagccaaactctgctatccgtaagtgtgctcgtgttcagttggtgaagaatgggaagaagatagctgcctttgtgccgaacgatggttgcttgaacttcatcgaggaaaatgtatgttcaactgctgccatacagagctttcttgttgcttatcatgttcttaccattttccgttcgggatatgcaggacgaggtgctcatcgctgggtttggtcgtaagggacatgctgtgggagacattcccggtgtccgtttcaaggtggtgaaggtctccggcgtctctctcctcgccctcttcaaggagaagaaggagaagccaagatcttaaatcctattcccctccattgcaagcagctggagcggcatggcggctataagaagtacaattagctacattcagctaatgaattctggggccttccttttctgcttctggcagctaatctctctctgaaattcagactcgatgttgtggtgaacatgtcaatcgtatttttaccccccctaatcacctgaattcaaattccatatagaagtagcagcggatttggtttccttcagcgcgattttaaaattcaaacctggaatgtcgtggagtgaagtagtgtcatcatatgcttgtgaatctctgcaagttgcaagcagcctattttgttgttttcttgtggcgcggtttgaatcttgaatgaagtcatcattttgaaatctctccctctatgctgaaacggaacggatctgatctgatccacgtgcgggttcatctgagccgttggcggcgagatcggacggcccaagaaaggcctcgcggccgcaacgaaccggataaacccgggcctccgtccccattggacccggttgaaaaccccacgggccatcccgatctgtgccaggtcagcagcctatccgggcccacacgcataggacatagctccccctacccatcaactcacaccaatacttttacccaaccccacccacttccacgtgggtcccatgactcgcctcaggttgtgggcccaccatgtcagcctcatttcacctgccgggtagagccgcgagtcgggaccaaacaaaaccgggccccttttacatcggcccggtgtaataaagaagcgaaggaagcagccggaatccagttttctgtgtccggctcggctcgtcggcgacgcctcgcaccgtcgccgctcaccggcgctcctccgccgccgctcgccgccggaggagggatagagtgctcgtcggtgcggtttgatggaaatggcccccgcggcgcaggtggcgtcgaacccgcggacggtggaggacatcttcaaggattactcggcgcggcgcggcgcgctcgtccgcgcgctcacctcaggtaaggtctccccgcgtccgcgtccgcgtccgcctccgcctcctccagttcgtgcggcactgactccctgcgcagatctaacgctaggcttcgcgtctgtctgtctctcgtgtgctgccgtgcagatgtggacgagttcttcgggctctgcgacccaggtgagttgagtgagggggtggattcgatttccgctcgcggcgaggtgttcgtccgggtgcgtgtgggcggcggtggatccgggtggtggtggtggtgggggactgagcggatcggatttgccttttgtagataaggagaatttgtgcctgtacggcctcgccaacgggagctgggaggtggcgctgccggcggaggaggtgccgccggagctgcccgagccggcgctcggcatcaacttcgcccgcgacgggatgaaccgccgggactggctctccctcgtcgccgtccactccgactcgtggctcgtctccgtcgccttcttcttcgccgcgcggctcaacggaaacgaacggtactactcgctcgcatccgcaattccgcataccttccccgaattcaatttcttggctggaaaaaaaagaaagtcagtaaaattttcagtgtctctttcctgacagaaagatttgtgcagttcaaagctgcctttcggtacagtagtttgcttgattgttaggtgaaggaggattcgcgtgatcgatttcatggtctaatttttgtttcagttggcgcatgtgtctgcatgtgcacatgtatcccgtgctcttctttttgtttcctttctttgctttgagtgaattggagtcatgcgttctggatgtgctggctgtagtgtactggccgttctatgtgagttttacatccttacccttctttcatgatagaattatcaattcatactctagggttcatattgattcatggtagctgctcgtaagaatttagtgcctatcctatcccattttagtttttgaattgaaaaacttttccagaacttgatttaatgagtcgcagagtctagcaaatgcaggctttaaagattgaagtagcacctacaagactcttatattaaatgaagggccattcatttctgcatttttctggcatgtcaactgcgccacaacttactccatttcattgtggttggagaaggtgtacatttactagtactagttgatataggagtaatgtgtatacggagcaaatatgacaatacgtgtatatgcctacatagtactattcccgtcttaaaataagttcacttttatacataaatctagacacttattttgggacagaggtagcaagccattacttgattccttggtcaagtgctatgcaagtaggtctctattattctccttttagagcttttggcattttagctggcatgatatatcatatatgaccaaattattctaagattttcgtagcatttgttaccagaaattttagattagtagtggagtttagcacacaatgcatgccagaaaaatatgctttccatctacttatgtacttcatgatgtatctgtgctgaagttaaattttctttactaaggtgaataaatcaatgaggtcatgacaaaaggagtacttgatgctcgcatcgatgttaagcatcaaaatgccccttatttcagctttcttgttcatcccatcgttgttcatttgtctagagacagttgtagctaattgcgggtatgggatgttatatctagaacttaggagcacataatgacattttctgctagacataatcctaccacttttattccaatatagtctactgctggtatgtcgacaatgcaatcaaagggattaggcaacatatttaggctttacttattgttcaactctgcgcatatagtttgtggcagaggtgttctgttgataaaagcgataacttgtttcttcttagtttaagaagtctgcgtatgctatgtcctggtatgctattagggtcgtaatccagaatctcgtgttttccacatcaatgtatttctctgtactagtttagttttatgttattcatttttttcttcttatttttcaggattagatgtgtattttaactgaagaaatgatgtatagtatttctgtttatgctactgagctactctattatactacatgttagtcacttagtctcgtctttggcatgctatccatgatggtgtgttactattctcatgtacatgtatctgccccatcaccttaaaattcaatgtttgccaaaaaaaaaaaagttccgcaatgcttacgagtagtttctttgctgctgactgtatgttgactttaggctgttactgaatactctcccgggctaataatattagtcattttgaacaagggtaaagtcaaactttaaaatctttgactatctaaaatatttatcttaaaaatatggaaacatatgtgtagattagtcttaaaaaatacttcaataaaattatatatttgttgatatttctatatatattataatagaaaatagttgctaaagttactttttggagaccatgcgcttggagggagttacaatattgctccttttgtttctcaggaagcggctcttcaacatgatcaatgatctacctactgtatatgaagcattggttgacaggaagcacgtcagggataggtctggtgtcgatagcagcggaaaatccaaacattcaacaaaggttagtatttccctcccccaaaattcagaaacttcaaatgcagttacttcagattttgtaacctaagctacaatacacagagaacaggcgaagggcaggtaaagcgctccagggttgtcgcagaggagtacgaggacgacgacgaagaacacaacgagacattctgcggaacttgcggtggcctctacaacgcgaacgagttctggatcgggtgcgacatctgtgagcggtggttccacggcaaatgcgtcaggataaccccggctaaggcggagcacatcaagcactacaagtgccctgactgcagcagcagctcctccaagaaaaccaggctataggttaaattgtggtgtgtgcaatctcctctgaccaatctgatcaaacgacaatctgtcctgccactaggaaaaaaaagatggtgaagctgttcttcggtccaatgtcgtagcttagctagatgtgaagtcatctagacattgtgctgtgtggtagatgaggcaaaaaagagtgaactgaaaagacgggaaaaacgtattcgatctttagctttgttttataaatgttttcttcattgtcaccgatgtgctttgggttttttcagacttcagagcatgggtatcgttgttgaattgtagctgcatgcattgcatgatatatttgtcaagtgctcaacaactggagcattcccaatcatagcgtctctgcacatttccattattcataaacacagagtgcttgctgaaaatggcataataacacattaacacacgagtaatctactcaggcagaaggattaatgcatagaaggatcaagagatgaagcctctgctcttgaggctttccactgaatccctgatgatcttctccatgggactgaactgcaaacccagcgcgatcagcttcttcgacgcagcctctgctctcaccagcccaggctgcgtttccttgggtaatctgccacacaaaaaccaaaaataatttatcagttagtgatatttgcaattgcagctgcatcattcacagtttgatatagtcatggaagcatttggagatttatgtggtacgtctaaggtttttgccgggaaggccgaaggaggccatccgaatgtattaagaaggtacgtctaaggtttggcgtggcaacctttggctgcgaaccaaacaggccctacagtccactaaactcactttggcactttgtactcggggtagagctcggcgactttggaagcgaaatcgctccagtgagcaatggactgcacgcagaggtgcctcccggatgcagatgggttctcgtacagcagaatatgggcaagagcaacgtcttccacatggactggccccatgtaaaaatccgcatactcctctgtgcaacctgcattgtcacaatggtgagcatgtttaggtgtttccttgcagtagcaatcacagctggaagaggcaaccattcaatcaagaatttctaggcacacaaaattgccattctatccctcacactgaatcaaacaagagaagtttttgagtagcacatgcatggtcatttaggaatcaacggttctcttttatgccaactgaactgaagaagcctatttttcatgtcattacatcaagtgttgagggatagcaaaacatgcggtttcactctctggtgatactaatcactgtgacatattcagtgcagcactatcagcttcctagtattctcagtatttgtggtaattttttttttggaacaagtatttgtggtaatttacctagagcaatcaatcttaacatacttgatactttctgagggttataagttcctagtttgtgcaagcacatgaatcagtttccctcttccacacattaatcacattgattggaaacaatatcacttgtcctagaatagtactattcagacttaactatggttaagatcagctacatgattgatccaaaatgcataccttcgagtaggcgaacaagcatggccatgctagcattgatcgtcggtgggattaccaggcccatgacagttcctgggttaaccacaaccacatccaatccattctcctctgcaaacttccatgctgccttctctgccaatgtttttgaagcagggtaccaaacctatgcacaaccaaccaaagcgtgcctcagataccagcgaaaaggttcatataattgcagcgatgtgtgggctgcatgatgtaaattctgcagtccttttccatgttatcattgactgaattttgttcccattgggtctaggagaatcaaatgcagaaagcaacatgtaaaagaaattattgatatcattttcatctcaccaaacagcactggcatgcatggagagtgcagccttttcttgtcttgctagaaacttatttcccccctctaaactgataataataatagagtaaatttcagaaaactacaactattttgtcaaaagtatcaatttgctacaattttaattttagctaagcatttcagagaactgcaacaatagtgtccgattttatcatagaactataactttatttgctcgacaattttagacccgcatgccatacacacacgaggggataaagttgtagcattatgctaaaaatgtttgctattattgcagttttgtgaaacacgttgctaaagtcccagcaaaatgatagttttaaccaaacagttgcagttttgtgaaatttactcgttataatatcatcatcaatttgcacttcgcacactgtcaaataattccaatgagaatggaagaaaaatggagatgccaagacacaagactgctcaccccgttcttctcgcagtagtcaaggtcagtccagcagcgctcgtcgcgcacctcgccggccggccagccggggctgggcacgatggcggagatggacgaggtcaccaccacccgccgcactccgccggcgtccttggccgcgcgcagcacgttcagcgtcccctccaccgccggcaccatcagctgcgcctgcaaacaacgggaacacggccggaggcggtgagcctggagcccgccgacgccgacgccgacgaggccggtacggacgtcgagaggagaagagtcgccggccggtgtacctgggggtcgaggacgcggtccacgatgcagggggaggcgaggtggaagacgccggagcagccccgcgcggcggcgaggagggcggcgccgtcgaggaggtcgcccgggaacacgcggaggcggcggccctcgccgccgccggcggcggcgagcgcgtggaggtggtccgtctcggccttgtcatctgcacagcacaacaccattgtcttcatcacctcctccgccttgcaagcaaacaagcagcagtaatggcggtttcgcactgaccggggttgaggacggcggcgtggacggagtagccgcgggcgaggaggcggcgaacgagacacgagccgatgaagccgctcgcgccggtgaccagcaccgtctccccctcccctcctccgccgccgccgctcgccattgtcgccgacgagagagactcgagctctcgtgtgagagagctgtggcttgtgagcctggagcttttattgtcgatgtggctggtacctactagtagcactgtagcacagtacagtacaaagcttgactgacagaagcagaagcagatgcagaagcagccaactttttggatctttcacagcctcacaagtgacagtcacacggatgatttgtcatgattcatctcgaattggggatctcccaaatctggattgattgagctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 38968 - DNA, 3818 bp, Oryza sativa
  unsure (1)..(3818): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgagcttgagctctgatgaatggatggatggatggaggcttgggtttggaaggggaggtggcgcgggcttttatatagggtttggtgatgcactggagcttaggtgatgagctaggccagttgagttggggcccaagtaaagccgcgcaccgggggaagaagcatccattcgtccatctctgctagctgcatgttatgttgttgttggtagtaatattgtgcgtgcatgcatgcatgtcttgtctagctgcctgctggctataggctacatatgctcccttttgggctgagctagctagctctcccataactggggaatctccaggattgatgggacttgtgaattctctgccaattaacaagtgtgaataaatgaattattgaaaatgaataggagcctacaaggtcaggcctttgcctttccagctttgattatctttggttatgtgcatgcatgcatggctgtgtttatatattcatgtgagggatagaatttgtggttgttgacatggagtaaatttagtaaaacggcgcaaactttcacaaaactataaataaattaatcaagttatacttcctctgtttcaaaatgtaagatgcggttgttttggagtcaaacttaaaaaaactgacttacagcaaaaactaaaacatcttaaattttagaaaaggggatagcaatgttgaaaactatatatttagccataaatttagcaaaactcttgagatccatggaaataatggtggataaaatctctaattaagaccttagtatttgatcataaatgttcgctttaggtatatagtttggagtacacatttcactttgaactaaaaatatattgacaaatgttacacacaactaatggatcgatcaagtcgtgcccatgtttttacttaacaccaggttttctactttattgattggaccagagttcatgaataaaccccaccacgatggcttcagcgcaagtacgggcaaggtgtaggtgacttgtagcattgctccacccctgctaggtcatgagatcaatcaatcaatgttctaacctattccatcctctcttttgctctagctaccaccatgaaaaaaacgagtaggaattatgcgccattaatgatggctagagcaggaagttgggatgggggaggggttgggaaaaatagacatgcatggacacatgaatgaatagtctaggcatcttgcccatcagctatggtgatggtgctttgtctgaatttaggaactgaataatggttccaattcctttcaaaagtggagggttgcttgatcaaatactatctaagtacttcctccgcgtcctaaaatatagctacttgtagtgtttaaattttattttaaaatacagctacttctagagtaagaagagatatttgtagtgatgaaatgtcaaaaatacccttcttcttcaccataccgaccaatcaggacaattaatgaaggaaaatttagtctttttacctctttttttagttatctctatgaaaaactctagaaagtaaggtagatagtatgagatgattcttctaagctatatgtttaatgttatgatttatttatagaataaactaaattaatatgtgcttatatatccaacagtaataaatatttgtattggccaatactcatcccattcaaatcaacattgagatttaacttgcctttccacatctattatattggcgagtgatgcacaccatatataaaagaagtcacctcagcaatacgtgtcctatttttccttggtacattcaattttcctgacaacagtcctttaactctcgtaaccggggacatttgaccatgaaaagcggaaacgctgaattgcaaggtaaaaaagtacatgaaaaaaattttttttgcgagaaaaaagaaaaaaatgttttatggttatccgacacaggaaattacaagtctctaaaacctaagcagtgaattaactttcttgcgggcgattgtcaggaaatctggtaggaatcacagtacacttcgttgttggttaacagttgacaaagtaaaattcccccttgcaattgcagattatcctaatgattcatgcatgaggatttaccatatatatctagcaaaatgtttcatgatagagtgaactatatattaccatattttgcttcctcggtagatagaattgagagaagactctctgctacctcagtttttctatcttatggaaataaacttactatggttaattcagttttctattcctaccaacctactatatgtgtactttgaagttgcctaaaacaataattgacaatattgatcgaggaaggagacaccgtctttagagaggttatgatgtcaattccaataagaagtcattggctgtttgggacaaggtttgcaaacctaagacaaagggggttcttggggttatcaatcttacaatccagaacctccttctaaagtatctagacaagttctatgatagcaagaatttgccccgggtcaatcttatttgatcctcttattatagaaacggagtgcctcacttatccaccctcaaggggtcttttcggtggaaggatgtttgcaatttgatagatttcattggaggcattgccagatgtttaataggagatggagtttcatgctctttttggaatgatggacctcctctttctatccatatgccaagactgtcttcttttgttttgaatgcaaagatcccagtcacaattttctttcaatttagttggaagataattttcacttgcccctatctcaagaagcttatcttaacttgtagtctttgaaagttttgcttaaagaggtaagcttgtcacaggaaaatgatacatgggcatatatttggggtaatttgaagtacaggtcacagaagttttacattcttaattttagagttttgcaaccacctcagcatttcctttggttacggaagagtaagacaggtcaaagtgtttggttggttactactcatggaaagattaaatataaagtatatgctggatcataaacattgtgctcctccaaactgtgacctccaatgcgtgttttgttcaactcaatctttggaaatcttaatcatcttttttttttccaatgccctttctcagtgagattttggaatatcttagatattgtttgggacacctctttgacactagatagcatggtggtggaagccagagatagataccatggccattactttatggaaaaattcttatttgagacatgaaatatttggaagcaaaggaatgggtttatttttgaaaatactcatccttgtttgtcttcttggagataactccctaaggctgatctcctccttttgttgtttaggttgaatgagagagataagaatgtagttttgagttgaattagattgttgtaatttttttcttttttcctgtacttgttttctttctttaataaaaatctatttaacaacggggcctcctatgctgtaatttctttaaaaaaaactatatattgccatgaaggtctcactactagaaaaatcatttttcccaacgtgggagtcttattttcgcaggcagacatgacccttagagccaaatgaccgcctacaaaaatataaatcgagatgaaatttgatgtccgcctgcgaaaatattttcacaggcggaccacttaagcggcgcct

SEQ ID NO: 38969 - DNA, 22375 bp, Oryza sativa
ccgcatcattttcgtaggcgccaccttaagtggtccgcctacgaaaaaaaacttgagtataaatagactcggcataggaggagattttttctaagtctccacacctcaccactcacggccggcaagcttatccattcaacccctcagtccctcagctctctcatcccctccccctcacctctcctcttctccccacctcaacggccggcctctcccctcccctcacctctcctcctctcccggcggcggcggcgggcggtggcggcggagggcagcggcggcgcgctcccggcccctccctcccagatctggccggaagggggcaggggcagcacggcggcgggcggtggcggcgaggagggtcgaggcggcggcacggccacggcggcgagggcagttgaggcggcggcggcggctcccggccgcccctccctcccagaactggagtaacgacggcgggccgtggccgtgcggcggcggcgcgaacgatggcgggtcgtggccgtgcggtggcggcggcggctcctggccgcccctccctcctagatctggagtgacaacggcgggccgtggccgtgcggcagcggctcctggctgccccttcctcccagatctggagtgacgacggcgggccgtggctgtgtggggcggcggcggctcccggccgcccctccctcccagatccgcgttgacgacggcgggccgtggccttgcggcggtggcgcggacgacggcgggccgcggcggacgacggcgcggcgcggacgtgcagcggcggcggatgatggctaggcggcggccatgatttcttgaatgtttttatttgctttcttctagaattgattcggtgattttggatgaaccgtggatgaattgattcggtgatttttggatgaactggatgaattgattggattggatggggaatgggtgggaactggattgggaacgggaagctaccgtcggaaacggcggtggctgcccattttttttagctctcgaagctattttcgcaggcagacctgttgcgcgcctgtgaaaatcaactattttcgcaggcgttgaggtgcaggcggatggcttgtccgcctgcgaaaatatgattcggccgactgggaaaagaatttttctagcagtgtctctccctctacaaataatgatctgtaagtctgtagtgcctcagtcaacttagaaactctagcttttccattctttaatatttaactagttttgattgtacaaacaacagttttaggtacactttcatatattctctgacttgccttgttaatttaattatacacggaactagaataagaataaccgaccatgcatgcatatatatatatatgcacaaaaaagttttccatgcgtccaaaaatgaacatatatccaaactgaattattacctatatatatatgtatgggctttcagctttctcgtgcatatatgtgctagctaggcatatgtatgcatgtgtttttcatggcacatgcgtgcgtcgcaaacaagcaaactaataacccgcagtttacacatgtaatgtaattaaaaaaaatatacacagcgcatatgcgtgcgtcgcaaacaagcaaactattaagctgcagtttatccacgtgtaactaaaagaaaaaaaaatcaaagcatgggatcgaatcacaccgtactagaaatatcagacatgaaaatatgcacgcagttcatgctagttctcaaccgatatatttataggggtaaacgaaatttgatgaaatatatttattttgaatgacttaagtattgtggatactgataagcattttcatatctttgatttagaaattttagattatatagatttgtgaatttcgttatagtatcttgcaagatactaataatagggcatcatatttttgtacaccacactagtcacatcgtattttatatcaactcctgaattgggcaggatatttaaaattgttaactatattagggtatatcacctttataggatatgattagatgctttttggctatagctagaaaattgccttattctattcgtcgtatttagagcaccatatatcacgtaatttaaacggcaacatatcctatgcacacaggccctcacgtgtacacacgtgcacaccaactaaaaaatatcacaaaaaaatctagaaaaaatcatacacatactttcaattgtattacacctagggttaaaatcttaacatcaaattcattatattttagccgtaacaaaaaaaacaaaaaatctaacagttttaaggttgcaattttgtcagaattttatcttttttgttattctctatgtagaatgaatttgaagatgcgactttgcacgtagatgtaatactattgaaagtacatgtatgaattttcctagaattttttgtgataatttttagttggtgtacatggtgtgtacacgcgagggcctgtgtgtataggatacgctcccaacttaaacagctataaacttgggctccttgcctttagaacatatggattttaaataaattagatttgttcccataaaatttctgcaaattcatctattccaaagaggccttagggtgtattctacactcctattcccaagtcccaactctactccctcattttccatgcgcacgctttctgaaccgttaagggctcgttcggttcacaagatttttaaaacgtagaaataggaaaaacgtaggaatactataggaaatacatgtgtaaacctatggattgaaaaacacaagaatttttcctatgttgttgagcaagccaaccaaagaaatgcaaacattagattggagtggattattttttcctatgcttttccttcaaaaatgaaggaatagaaaactttcctatagttttcctatgttgcattcatatgaaatgaatggtagtttaaaacctatttctattcctatgtttttcctttgcaattcctttgaaacgaataagccctaaacggtatgtatttttttcaaaaaatttctataggaaatttgatttaaaatatcatatttatccattttccaagtttttagctaatatttaattaatcatgccctaatacattgttccattttgtatgccggggaaagagttcccaaccctcagcgcccaacagagcccaatgtttctctgtctccattgttgatttatgaaaggcatgatagtatcactacttagtgtatattgtgttgttaatatttatatacaatatgtttgctcgcatttataagataatggacataggaaaaacactttcaaatataaatacagtgatagtactttggttaaacagaacagatatacctttggaatagagaaatatatacacgtactaactagtcgactgtctgtcaggggtggacacacccactgggtagggtgggtcaactagcccagctacaaagggccggagctagaacgaaatagaggagggtatcacttgtttaatttactctactttaaattgagtttaaactgatgtaggtgtcaatgtttatattaaagagggtgcatacatggtgaaaatagatgagatatagctaaagtagggatacaaatatttatggaaattcatgaccaaataaatgagcattatttctatacaagtggtaccatttttgtcgttctgattttggccaaacataaaatttgatttttttttctctttctttagaactatattacagtctactaaatagttaatttggtaaatatatatataaaagtttattttactccccaaaactattttggcggagcacttaaccccctaaatactttttttggggggtttatttcacactcccaaactattcaaggtggatcaccttactctgtaacaatatttcttaatttctttaatctctctatgcaaatcgtatttgcactgaaattatgtaggattggtatatccattataacctacctcttgaaatcttattaagaaatttttatcactgtttacataggttggaagcactaattgtgaaaatattttgaaactttgataatggtgttatttatgagaaatgttgttaagcagtaaagtgaaccattattaatagtttaagggtaaaatgagaaaaaaaatacttaaggagttaaatgatccaatgaaatagtctgaaatagtcttggggagtaaaatagacttttcaaaatatgaatgttttgtaaatcatttctaaattaataatttttgggttcgaccattttcatccctaattctcaatatgaggcttccattgccatctcatcttcatgactacgctcattgcctcacctatctgacgcagacgtttgttcgactgttaatctttgttaacttgcttgatgttcgtgagatgcgcctccgtgccagtgccataagctggcgattatggcttgtgtgcgatgtgccatcatccaattagggctagcgccttgctagatatcgccccatctatatattttaaagctgtgtctgccactgctgcctgtagaatataaatattcaatgaatcaacagtaatcatctcttcgagagggatctcgttcttctttctatataggcttaatatttcgagagagctgttctaaaatttttattcatagcttgtagtataacttaactattctttgcagatataattaataaatttaaactgtgggggacttccaagcagtattttggtaaaaaaaaatcagcagtaataataactgccagttcacttgtgtgctaagtttacttatacaccggtagtgacgtagggtttatagattcttggttctaaagtaatgcaaacgtaatttgaacaacttatattgactttgaaaagttggaaacatgtctttgacagaaggtagtaacattataatctatttttatctccctccaatcctcaagaggacaaaaatccttgtcaattattagggattggcagcatatattgtccaccaaacccatctaggttgccaagtctcccagcgacagagatgtcgtaaaacacatgtggtatagtataatatttgatgctcctgggacaatgagccccgcaaattataccggtgactttatgtgattcccatgcatgactccctatcctttaatttgcacactttgttagaaagggccttgagagatggatgtgaagctgtaatgcaaaaaaaggcgaagaggatcgatggatgtggaggtgctggtgtactgtcagaatgttgtaatgcaaaagaaaagccatatatgtacaaaaatgagtatgcaaggaaggttttatgtgggggttgtatattctctttactcacaatcatgcagccaaggtccatggccaaggccagcccagccatccatccatccattgtggtttagatgccccttccatcttgcaatgtccacacaatccgctggctagtgtacatgtaagatacacgcatgcacacatttgaacgtgcttcatcggtcgatatctaagtttgtgttactatggattcatatcctttgccactataatcagataaaaatatcataatagtctataacaaaacctccggttaactaaaattgtactatatatatcatccaccctcattgattaatcgtaaggtgcagatataattgtgcggacttgtgaatttttcctacatagacagagcacacggtagctagataaccgtcaacatcatcaaatgccagtggaacaatgcacatgcttgctctactatagcaagccagagagctcggatagatggctgtctagggtcgccgggttctcaatccaccactgatgatattatatatatgctaatataatatgaatgtaaggttctctatataagtccggagaacttgggccgttgagttgtcgatcacatgacggtcatgctaagcttaagatagagggaatgaattgagacacaatctcgtagctagctaactactcccttcatttcatattataagtcgttttgatgtttttcataataaaactttattaaatttgactaagttaaaaaaaacaacaatattttaaacaccaaactagtttcattgaatatatttatatgtctgttttatattaaagagtaaattgcatcggcggtatacaaacttgtcgggtgggtggaatctagtgtatgaacttgtaaaatgctcgttttggtatatgaacttatcttgtgcgtgcgaactaaggtcaaaaggacattacatgactaattttgtttatttaggtgctgattaggatactatataaacatatatatgcatgagaaggtttctacttagacatactccctccgtcgtataaaaaattaacctagtattagatgtgacacatcatagtactacgaatctggacatacctcggtccaggttcattgtactagaatgtgtcacatctaattctagatttatttttttatggagggagtacacttattcaataaaaagatagagtgagatatagtgattgtagagaaagatataaaaaaccgagcaataatataaggagaaacatacgaaattcaagataaagtagagaacaaatttataaatatagcatgttttatgcatactcactatacgcatgcacgccacatcctaatcaacatcagctaggtaaaattaaccttgccaagccattttggacctagttcgcatggattagataagttcgtgttcgtgtatcaaaacgagtattttacaagttcatgtactaaattgcacccacctaacaagtttatataccaccaatgcaatttattctatattaaaaatgctactatgtttttctatgaatttagtcaagcgtaaaagagtttgactagagcaaaacgacttataatattaaacggagggagtggctaggctagcactgctcacacacacacacgcacacaaaaaggcaagctcagccgccagctctcgccattattcgatcgatcggcaaacgccgccatgagggatcgatatcgttttcagtccagcctagttgcccagctacatcgatcgattgatcagctgctgccgatggatggacgcatggacacatctatatatctctgtcagtgtcaccgggcggctacagcaagcattagctatagctgcaggcatttcccgggtttaatccgatcaattcgctgcactgtgtgtgtgtgatgtgcagtgggcgttggcataaatgtcatcaccatacattgcgtcgtgtgtgtgatcgatcatgggaatcaaatctttcattctgctccatccgcttctcattcctgtcggatcgatcatccatatatatacataactatatatcttctttctatcaatctctgtcattaaatttttccatatgcatcatcaatctcaatttgcacatataaatcgtttgcccccacactggctccataatttaaagttcacagtggagtattcgattgatccgggtgtgtttgatttggactgcgagcccccgaccatgacatgagctgttttgtgtgtgcgtattcctagattcttgccggttggaaagatcgtctcatgacgatgaacaaaagggagggttgatgtaggattggacatgcatgtgtgaggccggcggccggctggattctcaagttgatcaatttgcatttgggcactacttggattagggcaatgttggaactgagaaattcattgtaacacctcatgcccgtttgaagcctgtaaaagtggtgtcgtgtttgtggggtttagaccgatatgcccagaagtgatgttctgatagtggtttagtaacgccttggaagtttagtaaggtgatggcggttaacacttaaatttagcacctaatgtgaaaatagaaaaatatggccaaattttaaaaggactcagcttgccacgtgaagccgatctggccaatcgccatagtgctagtctgtccggcagcatgtgaccgatcagaccggcatagtccaactctaagtccaattaattttcttgcttgggtccgagatttttttagtccaaattgatccctaagcctaatgggatgtgaagaaggcccttggaaagaagaccttctcctttataagagctatatatggttgatttgattctaacccccgactttagctcttatcgaatagttcttttacctttattttttagccatgttttctactttatcgtgtacctagcattagtttgtccatctttatcgatttgcactgtaaatcattcgccttcgctgcaacagtgtgataccctttataggtttgtcctataaaactttcgattcgctcacgagacgggtggttatcttcatatcgatctaaattggtctagaggttaatttgatctctaaataggcccagcaagccggtttagctgttttctaaacccatattgatttggagctttctagatcgaggttgttggtgactccgtcaacatcgcaatttattaggtgagtcctatgttggtcggaaaaggcgccaacaatggcttgtttataagcctgtgtgctccaaccataacacctccgggttaacccctttacacaaagcaatgatgaaagtttaagtggggtaggagtacatcgaaccgcttaacgtgtaaagcggactaatgcagattttggaggccaggtatatttgttggatccatcagcaaattaaaaccaaacttacaagggcacgtaccatggtatctctcagtgtttcaatatgaagatagtgctgaagaaatttagcaaattagtgctagaatgttagtgtctcataccatttcaaagaccttattttactacaacacttattttcaataacacacactgcctctgtacattattataaatgcaacttatatatacatgctagaaaatgcagcttaattatatgtatactagaaaaatgttagtatgccgaaatataaattcaaaataattttagaatagattgcacgcgtaaattctccattagtaacagagctagtaaactttttgttttcaaaagtaatgaaagaaataaacatgatattataatccatcaaccatatatatttagaagcctgctgagaagtaagtcaaaattaagttctgtggtactctcttcatcttcaaatactgtcactagatactattcatcttcaaactttcatttgcttggttgtttaaaaaaaatatgtgtatataggcccatatggcatgataataacgaagtgttgcatcttaaatatcacgaaatctgtgcaccatgatctaactatttaaaatttattatttatggtgaatattaaattgtaagcatatatttgaaacagttctggatttttgatattttagttgatgacgctctctctcgtggcccgatcttctggtgagggggataactctcgctttgatcgagtgcgacgtttgcgacgtggctaccaatcagaacaagttcaggacgccgtgcaatcgctacaccacaaacgatgtcgtatcaaccgtgacgcgcggttgatgatccctgcaatgcaaacgagagaacactgcaagaacaagataagatgcaatctaaatattgcgaatagggaattaagcacaaatgaatagttgcgattgaagtggtagatctaatcgacccggcaaatcaacacaccaagtattgggggctctgaatctatagtcgccgactaatcgagcgaggactagagacaaggtgaatggcacttggcaaaattcaactaaacaaaacccaaatgtttttgaggatgtacaaagctatttatagaggaaaataaagctagggttcagtgctaattcgtggaggtggagggtgacacttccgagatgggcctagtctattacaaggcccaaggcccaagttcggtttcagcaacaacactgtcttgttttggtgattcccgttgactcgagatgaatttggacatgagaccagatgcatttgaaaggtagcgagataagctttccacgaagtccaagatcacccaaatcgagttggcatgaaggcgctaggtccgtttgaagtcagtgctgtctctggaggccgaactggacttggacttggaattatcattggagtgtgtgaagttatgagcgtatccaacgaagtgatgtcctcatcatcctcctcttctagaattggagtcgtcctcgactcaatcccatcttcttgattgtgtgcactctctcgtccattggccatccttggaggtatctcatcgtgaaaaacatcctcatattcctgcaaaaggttagtaatagcgggtggcaaagaatataaagtactaggagcagtagccaatatgagtatagaatcttggcaaaatagagcatagcaacaagaatctggctcatctagtgcacaaatattatatttagaagccaacaaagcacccttcaacttaatttcattctttgtggtacttggttctattttactagttggagcaggatgtttagcaataatttgattttcacttttcgctttcttttcacattgaagtcttgcaagatcatctttcaaagcagtggctggagtcatagaatgcaaaacaactcttttaccatcgaacataaatttatatgtattagtcctaccatcaaaaacaacttctctatcatattgccatggtcgccccaaaataacataacaagcttgcatatgcacaacatcacattcaatttgatcatggtaggagcctatagaaaaaggtattttaaccaagcgggttaccttcatcttaccacatgtattaaaccactgaatatgatacggatgtggatgtggatgggtagtcaagccaagcttcttgaccatctcttcacttgctaaattgttgcaactcccgctatcaataatcattttgacggtatggcctttcacaagaactttgctttggaacaaattgtgacgttggttttgctcttcacacttctctttagcactaagtgctagcttgacaattaggctaggatactgatctagcgactctggatgcaattggacttcctcgatgtcatcattatcttgtccacctgcgtggtcagtggcagctaaagcatattcatcatcataatcgctagcagaagtatactcaccatcagcattcacaaatagagctcgccgatttggacagtcgcgggcaatgtgtccaatgccatggcacctatgacatgtaatatcacgtgtacgtctagtggaatctactgaagttgcactcttggctggagtctgaactgaagcgtttttgcttgtttcttgagcatgggatggcgtggaggtaggtggacgaacagcagtagtagattgacgtggtgttgactgtcgtgtggaagtagcacctgcaaaagaactcctatgcttgttgcgtccctgcacttctctttcagctttgcaagcaaaatggaataatctattcatggtattgtattctttatattcaagaatatcccgaatctctctattaagacctccatagaacctagaaattctagcatcctcagtttcttgcaaattacatcgtgacaaagcaatcatcatctcttgatagtatgtttctacagaattggaaccttgtcttaaaagttgcagtttatttaacatgtcacgagcatagtaagaaggaacaaatctagacctcattgtacgtttcatatcatcctaggttctaggtctaagtcctctaccacatatatcattccaccatagagatgcaaaggaggtaaattcactactggcagctttaactttcttattatcaggaaaatcatagcaagagaatttttgctcaacagctagcttccagtctagataaacagaaggttcaaacttaccatcaaaagaaggcatagtaaattttaccttagataaaggatcatctttgtccctaattcgacgtcgtcttctatttccaacactctcatcttcctcctcatcatcagcaacagattgctcttcgtctttatcgtcatatctttggtgtcgatgagcagtggcacctgcaccttcttcacctgcagcctcaagtaaaccaatgcgtcgcacaatattttcatgtccaataattatattctgaatgttttcagttaattgtttatgtgatcgatttatttgctcaatttgatccactactttcaccaggctttcacttaaagtttttaaatgtttatctgtgctttccttgtatgatttactattacgcatcagctcttaataccaattttccatgcccttcagtttatgtgctagattctccagtgttggttcgtcggaacttgtacctgacatcgttagcaagcaaaagaaactcacaagaaagtgtcagttcctaacaatctatatatatatggagcttttgaaggcactcaacactcaagcatataccaaattcttataatgttctcaaagaatgcaaatcaggtcaatcaccgtggctggttcgtggcacaatgacacgcttgatgagtggagcgattgcaaagccggacctgtaaaggttagtagtatgtggatcttggtaggcttaactatatcacaaggaatagcaaaaatcaaacagatatgcgaaattgaataataatccaaagtattagtcaaaattgctggcctagcctagactcaatcctagctcaagcaagcaaatgttcacactcggaccaaaacaactcgctatgtcaaccaactctctccaagaaatccacaatttaaaaaaaaaaattccaccctttctttttttttctgattttttttcttctctttttttttctgattttttttggtgcggctctttttcttcttcttttttttcttttttttttgcaccttctgccttttctctatttttcttttttttcttttttttttacttttctatttcacaaatggcagctatcaatcgaattggataacatgtgtgtgcaccgaggaattaatctgcacaaggaaattctatgcatgtgtacacccaacaaactaggaggccgagatttgcatgcacatggaatcaggaagagacgatggaaattacacaagtactcatgcatgcatgcatgcgcaatcaagtaggacagcagattctgttctatttttttttctttcggcgtcacttggttgcacgagaaaatcaaagaagaaacaaaaggaagcagattttccctaattatctgacacatgcaacccaaaaaaatctcaatgaaacaaaacctcagctctcaaaccaatctgttactaatcaatctactgcgcaactttctctatggcggcggaactgcgcgactttctgaaacaactctagagcaacatgcaacccacacttgcaaactaaatccaagactaatctagggcttaaaccagcacttgactcgacagtggatcaaaactcaataaagcaaaaactgaatgaaattgcgtggctcaaaactaatgtttggtgatgggaaaaaaatattgcggctgtatggtagacgatgggaaaaaaaattacaaaactaaaatcctcaccaggcaactaaagctctgataccaactgatgacgctctctctcgtggcccgatcttctggtgagggggataactctcgctttgatcgagtgcgatgtttgcgacgtggctaccaatcagaacaagtccaggacgccgtgcaatcgctacaccacaaacgatgtcgtaccaaccgtgacgcgcggttgatgatccctgcaatgcaaacgagagaacactgcaagaacaagataagatgcaatctaaatattgcgaatagggaattaagaacaaaggaatagttgcgattgaagtggtagatctaatcgacccagcaaatcaacacaccaagtattgggggctctgaatctatagtcgccgactaatcgagcgaggactagagacaaggtgaatggcacttggcaaaattcaactaaacaaaacccaaatgtttttgaggatgtacaaagctatttatagaggaaaataaagttagggttcagtgctaattcgtggaggtggagggtgacacttccgagatgggcctagtctattacaaggcccaaggcccaagttcggtttcagcaacagcactgtcttgttttggcgattcccgttgactcgagatgaatttggacatgagaccagatgcgtttgaaaggtagcgagataagctttccaggaagtccaagatcacccaaatcggagttggcatgaaggcgctaggtccgtttgaagtcagtgctgtctccggaggccgaactggacttggacttggaattatcattggagtgtgtgaagttatgagcatatccgacgaagtgatttcctcatcattagttcttttaaaaaatattttacaaagagagatatggacctctagctttgtgtgccagggtggttggtacccaggttgaatgtctcggtgctaggggtgaaaacggatcgtgatcggtcggatctcatccttcccatatcttaacccatattttataatcgaaatcgggtcggacacggatagtgccgaatacggatacaaactcatataatgtcgggcaaaaatacggaacaaatacgtaccgatacgtacactatataacgattacggatatttatttagatatcaagtcgaagcaacaatcttatatatcacatagacaataaccatttaacaattccatgtatctataatacgattatattaggcctttaggaccttaggaaataaatagggtacaatacatcatagtagaaccaatacatagtaaaaaagtgcctcacaaaaacataatacgggtaatattcgtataattatccgggtaatacccgaattttttactggataatccgtatccgtcggatactacgttcccgaatccgatcttgtatctgccaaaaaagacccgtattcggacctgatatccacgaaaggtcctgggtacccgaattttcgaccctactttgtctcgaaataatgtggccaggcgggtgggcaggaaatacccgccccgttttcaccccaatcggtttgcggaaactctaatgggcgatcaatcgccttggctattggctagcgatcaccccattcccccctccctccctccacctggttttcttttttaccaccacattactttcctattttagtaaatttatacacttcaagtttatacacctcaagtttacacatctaaagtttagagaccaaaagtttataagtcaaaagtttatatatccgattcaaatttgaatttgaattcaaatatttttttatatatagtatttctatacatctaaagtttatagacctaaagtttatatacccatttcaaatttgaatttgaattatatctgattcaaatttgaatttgaattcaaatattttctatatatagtatttctatacatctaaagtttatacacctaaagtttatagatccaaagtttataagtcaaaagtttacatacccgatttaaatttgaatttgaatttgatttcaaatttgattcaattttgaatttgaattcaaattcaaatttgaattcaaatttgaatttgaatttgaattcaaattttttatatatagtatttctatccatgattttttctaacttttgtttttttaaaaaaaatttatagtgtactgtagtaggaagagaagatggggaggagaaagggggagaagagagaggaatcggcattgggggaggggagtgcgggtgatcgctcccagctatcacccgcgcattagcaggacccatcggtttgacgccaacctctaccacctaagaacaacttcatgattgctattgatttgttgtaaaaatttggaaacactaacatatcaatgtatcctaattcatttttatttataaaaacttaatctgagacaatgtggatcctttcattctccctcacccctaaatcctgttgatttgccgtcaaattttgaggaaaaaacaaatcaatcgatttattttaaaatttaatagcaaattaataggatttagggattggaacgagtgaggaagccacattttcctcccagattattttttcttaatgcagaataaattaacggagagcaaaataaattatgatacatagatttaccattttttttcacaatttaacagagaggaaacgaagttattctagatggcagatcggcgtcaaaccaactagtggcgaggtcaggtgtcggcgcttgcttatttagcaccgaaacattcaatgctggcgtcaacaaccctggcagggtccatatctgcaataagagcaagtttaacagtagtttaacagtacaacccactactaacttaaaaaacaaaaacaagaggtgctttcagctttcatcgttggtcaaagaaaccgaacgaaaaaaccgggcagaaaaaagtccgatccaagaaaaaacagagcgaaaaaaccgggagaaaaaaatgaccgataaaaaaaagggcgaaaaaaacaaatctggacgatccaaaaaatacgaaccgggcaaaaaaaaacccggctaaaaaaacgtccaatccaaaaaacggagcgaaaaaaaagggagaaaaaaacgtgcgatccaaaaaagggagaaaaaaaagggaaaaaaatctgtccgatacaaaaaaaaaatacggggcaagaaaaggaaaaaaaacgaacgaatcagtaaaaaaaggcgaatttttttaaaaatccgataaaaaaatagggcgaaaaaaatcagtccgataaaaaaaggcaaaaaaaagaaaaaaatcgaaacgaatccgactccatcgacgcggtaaaaaaaggcgaaaaaataaaaaaaatgtccgattccaaagaaaaaagaattatatgtgacgcggtagaaaaaatcgaatcctactgtatctataaaggttcgacactatggtggaaaaaaccgttcttaaaaaaaatacacgagaaaaaaaataaaaagggcgaaaaaaagcgcggcagaaaaaaagtctaatttcattttagtagtccgtttatatatcttatttatctctaatctaatctaatctaactatttaaattcagaagtttctaccgtatattaaaaaagaaaaattacgtgagaaaataaaaacggttttaaaaaacgcgtgaggaaaaaaatgtcagaaaaaagcgcaaaagaaaacacgctagaaaaaaaagttccgtagttcgtaaaaaaaaacacgctagaaaaaaatatttccatcgtatgtaaaaagaaaaaaaaagcatacaaggaaaaaactattagaaaaaaacgctaaattgatggacacttggttggataggctccatcgacttttttccatctcctacacaacttttgtttcgtcatctattctcctatattggagaccctgcacatttttgtaggcagttatcataaaaaatatttctgtgaaatataactattattcttgataacatattatatggaaataatcttagaaaataaacatattttaattgctatttagagaagagtgcatagtgactctattttgtgtagacttgaccatacgaggtagtgtaggatttgattggttgcaagaatgagattaaaagaatattttagattatatgcatgttgttatatgaataatccaattattttaggtaaagcaaacatcgtaaggttgtcatcatcgaggttgggctattatatttaagatgttccaattttctaattttttaattgtcatcgacatggttatgcatgaaaaacgtatattattattacgttttttcacccgttgcaacgcacgggcatatttgctagtcatctataaccaatgtaatagctaattcatataatagttgcttactatagtattaatatctgttcccacctgtcatacacacattacgtcttggagtccgtgctgcagctggctacagatctgtagcccgctgcttttctctctcttcctttatctttttaaaatatgtttatagctggcttatagcctactattgtacctgctataaggctgtgttctgattcaacggatgggaactaatccctcccgcacgaaaaacggagcggtccattaacgcataattaattaagtattagctatttttttaaaaaaaatggattaatttgatttttttaagcaactttcgtatagaaacttttaaagaaaacgtgttgtttcgtagtttgaaaagcgtgcgcgcggaaaaccgggttggaaacatgggattgcaaacacaacctaagttttaaggggtctatttgcaaaatatggtctctaaatagattaaaatatcaaaaattcagtgaaactcaatggtatatatggtcagatacaatgtacgcgatagtgtttttttgacggctgaagcttcctctctgagtcgtcgtccattccctagcacagcagcttttagagatgcatatgttgccattttattattctcttcaacgggcataattaacaagaagaatgcaactaggcgaccagactgtgtactaggattgaattatcatcaaatatattccatcgttgaccatacaaatcaaaagcatgcaaagtattgagattcacacaaaagcacacacagtaatgcagacatcacgggtgatgtaagctgcaaagattataccctatttgcttagacttttaagtcagcttatgagtaaaagaaaatctaaacctaaacaatcaatcaacttttccatttggcttttctaaagtcataaactagttttacactgttaagctaaaaactatattgaagtaacttttttggcttatgtggagattctaccattagatttaacgcttccaagctacgcaccaacttataaactatataaagccaaaaggtcagcttataaaagcttaagcgaataatcctaaacttaaacaaagagagcctttggactttcgctgactaataagcataattaatttgcattaaagaacacgtgatttgagaacattctactaattttcactatgacttttgatctctcttctttgtttcaacatcatgaagattgatttgtctcttctagaggctcctttttcaaaactagatattgataatctggtaaagaatcttcccacgaatagagcacctggccaaatggttttgatgatcttttttataaaaaagtgtcggcctataatttgccatgattactacaagctatgtgctgattttcacttgggatctctaaattagattctatcaatcactctgatccctaagaagttgaatcctatgtatatcaatgattataggccaattgctctcatgggaattgcccttaaaattcagactaagctcttggctgacagattacagaaagtcattttgtctttgataagttagaatcaatatggtttcattcaagaattaaagaaccattcaggattgaactttgaattcctacatcagtgccatcagtcaaagaaggaaattgttcttttgaaattagactttgagaaaacctttgacactatagaacatgaggctatgttacaggtgatgaaagcaatgggattcactgatgtttgtttaaattgggtatcaaaactgttctcttcttcttcttcttcttttgaatggcattcctggaaaaaatagttgtaaaagatgtgttagataaggagatcctctttctcctctactttttgtgcttggtgttgaattgttgcaagctgtcagtaataaatcacatcaagtgggtcttctttcaagaccaatccctctggtcgatgatcataattttccaatagttcagtatgatgatgacactcttctctatgtcaaggaaagtggtagagaattatttgttttaaaagctcttttgcaaacttttgctcaaggtactagtctcaatgttaactatcacaaatcttgcctcattccaattaatgtagataaagataaggcacaaatgttggcaggagtgttacatacctaatgtagtcagattggttcattgacttttacatacctaggcttacttttgggtactacaaggccaagagtggttgattttgctcccttgattgacataactgagagaaggttgtctgttaactcatcttttctctcctatggagatagacttatcctggttaattttatatttttctctttgcctacatattatgtgtacttttaagttgcctaaattggtgatagagaatattgacagagcttggaggaattgtctttggagaggatctgatattaattcaaatagaaaatctttgatagcctgggatgtagtttgcaaacctaaagtcaaggggggacttggtgttattaaccttatggttcaaaatcaagctcttttgatcaaatatatggacaagatctataataagatggatcttccctgggttagattaatctggagctccaattatatgaattgtgtgcctcatctggtcagagtttccttttggtggagacacatatgtaaatcgatggtcatttttagaggaatttctacgtgctctttaggcaatggggccacttgttcttgttgggaggtcctcttttttggttcagaatgccaagactattttcatttgccgctgacaagctggtttcagtccagaactttagaggaacaaacttggaagataatttccttttgcctttgtctcagcaggcttatagtgaatttttggaggtgcagagcttgatgaatgagattaatgcttcccaacagtataatcaatggggttattttggggaattttaaatatacctcccaaaaattctaggactttgcaacctccacaacatctcttatggctttggaagagtaaggtcacttcgaaggttaaagtttgtctgctggctacttcttttggatagattgaataccaagggtatgtttgatcataagtgtgctccagttgattgtgatctatcatgtgtagtttgtcatcaacgacctttgaaactctgatgcatctcttcttctaatgccctttcccagtcaattgttggagcattttgggcttagtatgaaacacttcgatccatcttcagaacaagatgctacaaaacaaagctgcctataatggaaaatattttatagagaaatttctcttgggatcttggaacatatggaagcaaagggatggtcttattttttttttatcatagacacccctccttgtctctctggaggcaactccttaagggagacctcatttttctcttgtttagacttaataagagtgacatagatgtagtgaaaaattagtttatttctttgtaattctttgtatttttcatcctttcaataaaatctttccaacaacgggggcttcccctgctgtgttcatgtcaaaaaaaacattctactaatttagtcaacttacttgggaactttcatcgatgtactccctccatcccagtttgatcatcctctacgcaaagggaaccaaggccaaggacaccaaaatattcatcattatcaaattaatacttaacagttaaaggtgattcattgctttgttccccgtgaattgctcatgttttaaatattgcatgacactacaccaatagaaattaatcttaatttgctgcatgcaacacattcaaatgatgcatgtttactctttgcataataaataaagagatacttgttaaatgatgatcattttgagaagacctcaaaaaacttaggggatgatcaaaatgggaaggagggagtattatcactctcacattccaaagcatttctagatgtagcatttaatctctagccatcataagtgcagtcattcatagcggttaatcaaagttaatgctactttgaaaaacgagtagaatatagttaatgaggcgtaacaatgatcatttgccacaatttccttgtttggtagtatgaaatttgctagaaggtaaataatcggaaacgaatggagagtaggacaggaggataagatcccgtggcatttcaagagattaatatgataaagaaccaaagatgagttaaaattagttcaaacttgatcgtctccaatatttaaaggtaaaatttgctacaggacactcaaagtttgtgatctttgttgtgggacacccaaagaatgtatatcttcttgtggacactgcaaaaatatggtaattagctgctggacacctgaggcattatttttattatttccggtgaaaacggagagagaaagagaattgaaagtaccaaaatgcccttggacacttttcttcttcctgcatcagctctcttttctcttttcttttctttcttctcatctcttctcttttcttctcttctcttcttcagcaagcctgggaggtcaccggcgacagaggacggaatggcggcgagcgaacgccacagcgggtggtggagggagggtaaacaaccggtggggtagcggcggtgggcgtagtaaggagggg

SEQ ID NO: 38970 - DNA, 2610 bp, Oryza sativa
  unsure (1)..(2610): unsure at all n locations
gggtgtccagcagctaattattatatttttgcagtgtccacagaangatacacgttctttgggtgtgacacagcaaaggtcaaaactttgagtgtcttgtagcaaatttttccatatttaaaatgaaataatctcacgggaattttgtaagaatcgaactaattgcgatgaaatggctgtgaaatttctatgttccaaaaacaccacgtgatctggtgggagcacaaaagcaaggccccgatatttgtgctagggtcgagctcgatcagctagctatatatgagggtttttgcagggaaccgacacatattgtcggttcccagttggcacctatgaggatttttcactagtgatctccttatttggtatggtatttgctagaacaaggtaaataatacaaggtaaataatttaaaacgaatggagagtaggacaggaggataagatctcgtgatatttcaggagatcgattaactatgatagagatcaaaccaaacatgagttaaaattagttcaaacttctctctgatatttgaaatgaagggatttcacgggaattttgtaagtgtcgaactaattcccatgaaatggctgtaaaattcatttctacgtacgttccaaaaacgccacgtgatctcgtgggaggagcgcaaaagcagggccccgatatttgtgctataggatcgagctcgatcagctagctgctgcaagcgtacgtacgtggatgagccccagcgcttgatcggtcgatcgatcgataatatcctgagtgttcttctgagattttgacgtgatcaagctagctagctagcctttagctgattcgctagaacactcactcaatagtcaatactactgcagtgtgcaggttacagataagagaatggacgagagctgcgtgctgcaccaacgatcgagaggcaagcagatggcacgcctgccggcggacgaggtgcgcacctgtcgaaatgccactagcactctctcagattccatgatgggaggggtgggacgggttgttccaaatttactatttcatcccagtatgttcaaaagataaaaatctcagttttgtatttagattgaagggtaaaaatttttatcgtgtcacatcggatatacggatatacatttgaaatattaaacgcagtataatattaagagtgtgtttagatcccaaaaaatttttggtcaaaaatatcacatcaaatgtttggatacatgcatggagcattaaatgtggacgaaaaaaaaccaattgcacagtttgcacgtaaattacgagacgaatcttttaagcctagttgagccatgatttaacaatatgatgctacggtaaacatttactaataacggattaattaggcttaataaattcatctcgcagtttataggcggaatctgtaatttgctttgttattagtctacgtttaatacttcaaatgtgtgtcagtgtacttcaaaaaaaattggccaaagaactaaacatgacctaaaacaaattacaggttccgcctgtaaactacgagatgatattattaagcctaattaaactatcattagtaaatgtttactgtattaccacattatcaaatcataaagaaattagccttaaaagatttatctcacaatatatacacaatctgtgtaattagttttttctatatttaatacttcatgcatgtgtccaaacattcgatgtgacagggtgaaaaacttgccagggaatctaaacaggccctcatataagctcgaagaaatacatatttaattataattatatatttacaacattaaaacattaaagattaattttaaccaataacataaagaataaatttttactacttatttttcctctcacatcctcataaagcaaaatttctattttatagaggccaagtgtttgttggtaaccgtagcaacggtgtttgtatcatctatttatttttttctctttttctgccaccaagtattcccaataggcaatgctaataataattgcacataccctaatcacttctgaaatttattgaatacaaagattaagaaagagatgaaattaaatgataaatggttgtgaacttgtgattgtggttgagataagaaagcatgggtgaagaaattaaataagagatggttataattagttgagacaaggaagtactccctccgtccaaaaacagctaatctaggagtggtgttcagattcgttgtagtaacaggagtaggtgtagaagttgctatattaatttcgaaacaaaattcagtttctatattttaggatcgagagttgaagaaagttttttttttatactagttctttgttcttacaattcatgggtgtgcatcagtgagatacccggggtgggtggctttgcagagtatgggatgcggcttatcgatcgtgcatggagaacgcaaaagtgaggataaaaaagaagctaagggagaaaacgcagtttgtttttgtagtgatatctggaaagtgagattagcatgtttctcttttgacatgcgatcccttttttgttgtctggtcgtactagataattaactaagctagatcacagtataagtctatcgataaactctctagttaaaagtgaat

SEQ ID NO: 38971 - DNA, 6773 bp, Oryza sativa
ttgtttgtacatattatgcaactcaatttcctgtagtaatgtgacgggtattcatctagttaaatagacaaatccttctcagttatcacaaaatctggtagtgccaataattccaacctcgctaagcgtggattaaagattgcgagcctatttatctcataggatataagtagaccaatccggaaacctattttaatttacagatcatttttgcaaaccaatttataaattgatatgctcgaataatttataaataggttcgtgggtcaacccatttacaaccataatctatacatgtgcattgaccacctagcaaacccctctcctgacagctggccatgatgcatggtagtaattactaggatttgccaaaatattggttgggaatttatttgttagagattggaattagaccaagtgcctactgggaagagagatttaacaaagtcagaggcgcctaccagtagtccacttgtccagcattgacaagatcacacacttgcttagcttggcccatgacaccaaattatatatagcctaattcatttctctagctcttcttcctgtagggcatctaaactttaagccacacatgcatgatcatgcctggccagtggatgctgctaggagtaggagggtagcaaaatggtacgaccaagagtaggatgtgctctctgcacagataattagccccttgttttgagttctaccatgatggatttctagctatgtgtctaacagttgttaaaaggaagacagcatcagaaacatgaagaaataaaaggccacactatatatagatacttttgggattaattaaattaaattaatggtgtccatagtgaccctaactcaagtaatggtgttgatcacgttcaatgaacatgatggaaagtgaccctaacttaggttgatagtgtatatgtatgtagggctgtaaaaaaagctcgagactcgcgagtgctcaagcttggctcgtctaaaactcgattcgagattggctcgagctcttaacgagcagagcatgaacttaagctcacgagctttgtcaagccgagctcaaagcctaatggtacatgcatggaacttttatgttttatttgatgagtaggttatgtatatagattattatacatttatgtgaaaaaatagtatgtcttgatatcacatattctcctttattctttcttctttctataatatgattaacttaaaattattgtttcaataaaaaaattcaaatcatcaaatgtacattatcatatactcgagtcgagctcttgagcctaaccgagctcaagccaacctgcttgaaagctcgaaagctgattaggctcggttcgagcttctatcgagcctaagttttttttttcctaaaatataacgaatttgaggttatttacatgtaggtataatactattaaaagtatatgcacattttttgtttacacgtaggtggatacctatatagggaggacgcgagcaagggaggcgaccgtgcgcgcattaattacccagtcccagtcccctcactccctcagcttgcaacccctgacctcccggctttacggattgggaatgcgatgcccacttgcggggatcgatctgccacgtttgtcgatcgatcggcctccaacggccgggattgggaagttggtggtgtgacaggccacagccggtggtgcgatttgcccctgcagatcgaagtgatgctgatgctgcttcgcatgcgtgctcatggagaatttcctttttggcgtgggtccagttgacctctccccatcatcaatcctccgtctttctcctccatccggccaagctttgcaattgcaatattgcatgccggccttgatcgatatccctctccatggctccattattgcctcaacataatatgttccttgatccatgagtcaccatcatgtagacataatgagagggacacgcatggaatactctttgattatatgtagcctcaaactaaatgtgatgcaatgttcctaggtactgattggtagggttttcttttttttttcttttttgtccgcggcttataatccgaagacacgtcacataatcaatgaaaaacaacaatgtaaaactttgagtaaattgtattagaggctacgaacttgataggtgggtataaccttgtacacaatacttatagaaccagggccgtgccgtcaaatttgtggccctgtacaaggctctaagtgaggcctaaatcaagtaccaaatatatctaaaataatgtatatactgcagagcaaatgccactacactggccaaggtcacctgtgacgggcccaaaccctcatctttgacggcttcgcgcatggtcagtgatcagtggtcactggtgagtccagtcacctttgacgggtggccggccgtcacaggtgacacccacctctgacgggcaagttactagaaggccgtcagaggtgttggtctccgctagccttgagcgagttaggacccgtcacaggtgactcatctctgacggccctttaaataaaggccgtcagaggttgaggtctccgtagttagaagctgtcacaggtgatctacctgtgacggccccaaaagtaaaggcccgtcacaggtaggtcacctctgacgggcctttatttactagtccgtcacaggttatgttacctttgacggatttttgttccgacccgtcactgataagttaattccagaaaaaaaataaatgctaaatattggctagcctcaggatttgctagccatgccctctgaaaaatagaaacatcacaagatatattccagtcacagatccatcacagatacatcacccccccaatataacatcacagatccccaacaacacatatatgcagttcaaatgccacaattttgcacagcaaattcacaccccttgaaagccacaatttcagtcgttgctcatagaaccgcatatatacttaccaaatggattaaagccataatgtcatcgacctgcacaacctgtcaataaggaaaaaaaaaggagaaaacagatgaatagtacaacataaatcgtagttgatcaaatgtgatgacaatttagtaaagtaacataaatattgcacatatgaaagtaaattacattgaactctataaaaacataattttttacatcgccagaaattataaaaacatcttttttacatcacaataaattatctagccaagttcatgagtctatttggcatgaaaacgtcctttcttgttcattatttctgcaagaataaaggcgcacaattcgcctctgatagcgggggggttgatgggtgagatcttgaagccagctctacctttctgtttaataaataagaggttaattagcacgttttgaatagcaatgtagatattgaaatgagcttattcgccattagcaacaacctcagggtcgaaatctttcacctctcttagaagtgttgacatgttgtggcacacgtggaaaccacattggtctccgatctgttgtgcgcatgcaaacttggtgtcatgataaagttcattcttgccctccttgtgcctaccacccttttccacgtatgggccccaagccatatttaaggccttggtgatttcactaaaatcataatctttggacttattggagttaaggtaggtaaccctactccacttaggtacgatgactaggagaatccaatgtcgcctgcgcagtggttatgtagcgttagtactaagaaccttaacttcaaaaacaatatacacgaagggtattgtcctcttactcttggttgtgtgcgcacatgatgtactccttgtcttgatgggcccataaacaccggttgacatagtcaaccacctcagtgaagctctgtcgtaaattaacctcattcaccatggatggatcaaggaacccaacctgattaccatggcgacgactctcgatccaacacaaccttaaaatatttacgtattagaactaatttaattaggagatatagtccagtcatatcacaagtatagaaggtatgcacttacaaggagtagcattttagaagaccagtgtccaacttccggatcctgaaaaggtcgaagaggtcatcaaagcctatagttatataggcaggcgacgataggaacggctggtggtcgtgatgtccaactatggatgactccctcattttccgcttggcattgcttagctccatgtattgcttatgtagctctcggcaagcaatacccatcacagctaacacattgtcctccaccaatggcatgcctagctcaaattgggctggcgccctcacgaccttccccgatttgctcaccggcatcgacgtcgcagccttgcccctttttggctccggcgccaactccccgaccttccccttgcctcgttcacgcttctggcccttgacaagtggtggggagctatcggcctttcttgtggtctttattggagccaagctttgagctatatctgccaagtccatatcagctccaccgggagaatgaggtactgacaatgccggtccacggggagcctcaattgatagcttagacttgggaggtgtaagctccgtcggtcgacttggacgaggagtcatcttcacaactatgtcttctttaggccattgtatgaacgtcttgcgcgcatcgcccaaagtcatgatttcatcatttgggggcacgggcagcggatagcctgaccaggtgtcctttactgtatcgatggacaccttggcatacccagctagcaggtctgcgccgtggaccttgtctgtaaccgagggcttgaaagccatgccctcagcgacttcaggagcgaaagttgggtggactctcgctagtaggacacactgtgctgcgccctgcataaggtgaaagtttgaatttaatattggaatgtgtaaatgtcttttattagatatggatcggataacaacaattacctcgatgtggtccactgcagctagtggtgcgatcgggagaccaggggccggcacctctgtggatggacaactactcctatgctgtgacggactcgcgtcgtgttgtacacgaggagttggttgcacagcaggtgttgtgactcggggtatattcatgtcggcgagcaccttgttaaccctttcttccacccttgcattcatgctagcttctagttcttgaatgacctcaaccttaagttcggccttcaaacgagcgtccctctcttccttggagactttccgtttcctgtattgggagctgtactgagggagtccatgcttccagggcacatcgctaccaattccccgagttcggccaggatgttctttggttccgagcgcctttgttccgtccaagctcgctctttctcggcttctgtgaccttcccgatatctttatggaggatcccgaagttctcacgtgccgctatcccgcagcagttagaccatcttccaatgacagtcctgggcgccgtgggcctaccactagcgtcaacctctcttataacttgcactgtggtcggccatatattttgtgaccgcggatttctactagacctacttgcacttgtctcgcccgacatcgacgtatgttgttcctgcggcaattctgcagcacaaacagaaggcaatatttgctaaggggtgctagctaaaatttatgtggtcatgtggtgaaaatttatcctataaattaccatgaatttcgggttgttggaccgccgttgtcgcgggatgaccttcggcaactgcctctgtggctgggtttgcttcttcctggatcctcgcaggtgttggggagggcgggtttgcgccgggcgttgacatggtttaactttcgcgaaaaagattataaatttcctaccattagactaaatagcattagatccaatgtaatacggggtatactatgaaagatatggcctcagttttgctgagaaatatgcatcaattacaatcatttgcatgaagggataaaaagaggaaatcataacatcaaaagagcaagtgcagaaaatctgttcttatgcataaaaaaagaacaagtgtagaggtatataaccaatgaatcaagcagaataaatttaaaaaacagcagcagcaagggtacagaatttgcatgattgacataaaacagcagcaggagaagtataataaggaacacattgggcagcagcagcaagggtatataaatcatcaaagaatgacagaaaacaagtgtatatagtctcctcttatcaatccagaagaaaagagcaagtgcagaaaatctgttcttatgcataaaaaaagagcaagtgcagaaaatctgttcttatgcataaaaaaagaacaagtgtagaggtatataaccaatgtatcaagcagaataaatttaaaaaacagcagcagcaagtgtagagaatttgcatgattgacataaaacagcagcaggagaagtataataaggaacacattgggcagcagcagcaagggtatataaatcatcaaagaatgacagaaaacaagtgtatatagtctcctcttatcaatccagaaaaaagagcaagtgcagaaaatctgttcttatgcataaaaaaagagcaagtgcagaaaatctgttcttatgcataaaaaaagaacaagtgtagaggtatataaccaatgtatcaagcagaataaatttaaaaaacagcagcagcaagtgtagagaatttgcatgattgacataaaacagcagcaggagaagtataataaggaacacattgggcagcagcagcaagggtatataaatcatcaaagaagggctgcaggaat

SEQ ID NO: 38972 - DNA, 2036 bp, Oryza sativa
tctcctcttatcatccagaaaaaagagcaagtgcagaaaatctgttcttatgcatacaaaaagagcaagtgcagaaaatctgttcttatgcataaaaaaagaacaagtgtagaggtatataaccaatgaatcaagcagaataaatttaaaaaacagcagcagcaagggtacagaatttgcatgattgacataaaacagcagcaggagaagtataataaggaacacattgggcagcagcagcaagggtatataaatcatcaaagaatgacagaaaacaagtgtatatagtctcctcttatcaatccagaaaaaagagcaagtgcagaaaatctgttcttatgcataaaaaaagaacaagtgtagataatttgttcttattgagcaattcatcactggccatttaacaaggaacacattgggcagcagcaacaggggcaaagatactccacaggggcagcaacaataggggtgtattaacataaaacatcactggccatttatctagttaaaatcatgcaaaattcaaccaatgcagcaaaattaatcctaaaatcatctaatacaaaaagactaattcatctaatactgcatatatttcatccacaaatagtccaaattcatcacctcatatatttcacatctcaaatatgcatatatttcatcaaaaaaaatgagacagtactactaacttcatgtaaacagcaattcatccattcaattcaatcaagtgtagataataaaacagcccataatcatttatgtggcagcagcagcaagggtatataaatcatgtatataaacaacaattcatgcaattcacctattcatagacaaaaagggtatataaatcaacaagtttagataatctgcaaagttccttaatcatcaaagaatgacagaaaacaaaatgcatggagaattttggtgtctaggtcggttccgtccatggactacactgaccaatccaccaaaattccccatgcattttgtattctgtgatggtttgataacctcggaacaacattaaatctgcggccaatcaatcaattcttccatttgaactaaatttcaaaccctaaacctaataaagttccttaattatcaaagaatgacagaaaacaaaatgcatgaaaaattttggtgactaggtcggttccgtccatggactacactaaccaatccaccaaaactccccatgcattttgtattttccatttgaactaaatttcaaaccctgtatatgctttatttaatagttctagcaaaagggaacaaaacaacatataaagcagtacacactccatgaatggttagatatctcaaggtactttcttaaggaccataaaatttctctaaatttgatagacaacataaatgaattatggattcaggaggctagtgcttaagtaaatgtatacacatgttactccagtgctctcagatttatggtatccctccgagttaccagaaaaaagaacactccaaaataaaaaggatgcagaaaccagagtgatgcgcctatctaaaagaagtcctgatatcccaaccaaatactaaaagatatcatcaaggtgaaaaaagagagaaggtcatgcttgtacacagaaaactgaagatgtataactctatcggattggcagatcaccttaactcatagcttatcaaaacatgcaacaatctgaacggaatgacaaaattcatcgttcatccaaagttcatcattcatccaaagttcatcattcattcatccattccattgcatcatttattcatccatccactgcaccattccattcatgggcatcagagagagaggggtacctggagagggggtacgacgagtcccggcaggcgcacggcgcacggcttctcagcacggcggcgcggcggcacacggcgacaacgagtcccggcaggcgcacggcttctcagcacggcggcgcggcggcggcttcttggcacggcggcgctgaggaggagaagagggggttaatcggcgaccaatagtaaacgaggggaggcggggggagtgggct

SEQ ID NO: 38973 - DNA, 3222 bp, Oryza sativa
tgaagtgtttcactaggcaagttctgcaacctggcaattcggttcttcagccactcgttgaaagaagacatgtgcttattcctgacccaactctctgatcggcctgggttctcttgtcggataactgcaaggtgttcgtcaacgtacggcaccacctcagtcatatgctgtagtaccgtgaaatgagctttatcgtacaccttacgatccaacctaatagtctttcttccaacagtaccaacaccgtcaagcctcccttcgtgatgagatcgtggtaatccaattgaagatgtttctgacatgtagtccacacaaaattcgatggcctcttcggtggtgtaactctcgatgatactcccctcggggtgtgaacggttccgtacataacccttaaggatccccaggtacctttcgcaaggatacatctgcgtcatgaatgctggaccacagcactttgtttgcctcacaaggtgcaccggaagatgttccattatgtcaaagaaagttggaggaaagtacatctcaagatgacatagggttctcacaagttctgcctgtagttcatctagtccctcgggatcaatgatcttctggccgattgcatggaagaaggaacacaaccgctggatcgtgtgtcgcaccttaggaggcaaaatattccttattgcaacgggcaacagctgtgtgataagaacgtggcaatcatgcgacttcattccaaccaacttaagatcttgcagtgaaacgagcctactgattcttgatgagtaaccagatggaacctttataccactcaaacatgttagcaaatcaatcttctcttctttcgagagagtgtaccaggctggaggaaggtaaaccctgccggattccgtggttatgggatgtagctccgaccgaacacccatatcttccagatctcgtcgggcgttgagaccatcctttgtagtacctgggttaagtagtaatcccattaaactctcgcatacattcttctcgacatgcatcaaatctatgcagtggcgaacttcaagatccttccagtatggtagtctccagaatattgacttctttttccacatgctcctctcttttgtcttttgtttttccacatgctcctctgtttttccttcgatgtgctcttctcttttcgctttccaactttcctcttttttccaaactcgttggttattcccatcactaagttgtgcacctctgtccctgttagctctgtcgggggtccggctgtatctctgtgtccattgaaattctttctcatattcctatacgggtgataccttgggagaaatctcctgtgacccatgtagaccgtcttgtgtgaatgcttcaaccatttgcttcttgtttcctccatacactccgaacacgcccatttccctttcacagtttggccagaaaggttgccaagggccggataatcgttgatggtacaaaacagcatcgcatggaggttgaaatactcttgtgcatatgcgtcccatgttcgtgtgccctcattccatagcctttcgaagccatcgattatcggcttaaggaacacatccatcccgttgccacgttgcctcggtctcttgaatgagcatggcaagcataatgtactttcttttgaaacacaaccagggaggaaggttatagttaacaagcagaactggccatgtactgtgacgactgctcaaatcaccaaaaggattaatgccgtccgtacacattgcgaaacgcatgtttcttgggtcatttgagaattcctggtaaatcctatcgattgtcctccactgtactgaatctgctgggtgcctcagcatagtatcgactttccgttcttcggcatgccagcgcacaagcttagcttgttccttgttcgcaaacattctcttcatgcgctccgcaattgggagataccacaccacctttgctgggcctcccctctttgacttacttccttcaccttcactctttgctcgtttgtatcttgatgccccacagatagggcagacatccaagtcagcgtattccttgtaatacaaaatgcagtcgttcggacatgcatgaattcttctgacctccaggcccaacggacataatacttgcttcgcttcatatgtcgtctgaggtaaattgttcccctctggcaacagatcctttaacagctcaaggagttctgtaaaattcttgtccgaccagccattactagccttaagcttcatgagttccaacacgcatgacaacttgctgtgcttcgacttgcatccatcatacaacggcatctggcaatcttccaccaacttactaaacttctcataatctctgtcgttgtcctctgagtcttcaatgtcatgcaacattgtagacagacattgagtgtccaaatctatggtctctccacctaaaggagaaggtacgaacatgccttctcgagctgcggcggtgttctctacatcctgatccaacacttcttcagctgcgacatcaggcgcctcttgctctccatgcttggtccagcaggtatatttcttcatgaatccattcattatcaaatgagcatgcacttcatccttgtcttcgatcatctattcattcttacagtccctacatgggcacaacatgtgcatgctcatcctactttttctgtcattatccgcaaatgtgacaaattcagtgaccccctctctatactcggtagacgaacgatgcgcatagtacatccatctacgatccatctgaaatcaacaacatacgaagaaaaataaatgatgatcgatatgttgagaatgaatggagaataatgtgttttttaccttgaattttagtaaaaaatcgccccctttgccctcccaaccgatttgtgaacagtacaatggtcgggatggaaagcagttggcagtttgggggtatttatagacccaacacacctcaaacgggttagataaaaaaagcccgtcaaaggtattgctcatacctttgacgggcttctattcaacggcccgtcactggtatccgctcacctgtgacgggccagaaatgaaagccgtcacaggtggcggcccatcacctctgacggcttctaatgtatcggcccgtcacaggtgaggggatacctgtgacgggccggaagaaagactcctcactggtatacctctgacgggttttcctttcggcccgtcacaggtgaggggatacctgtgacgggccgccgccagatgc

SEQ ID NO: 38974 - DNA, 4999 bp, Oryza sativa
gatcagcgtcccatattatacatttgactgagcacatgcatatctagatcgcatcatgctgatatgtgtacctatgtagcaacctgataaaggttcaactcggtaagattaaacatagcatactcatttggcttggttcggatgcacaagacgtgtaccgaaataagtgttccctaagtttacgtaccaagtttctcctatctattaagttactgtaccatcgatacaatttactctaaaacttttatatttctattcgtagcagtctgaaagacaaagctgctaaattgaaaaatagcaaaaaaatcataattaattctaaaatcagtatttacattcaaattttctagtgatatatacagataaatgtttcttgtttgtttagagcatggccaacagtttcccgatactcttcccaatatcagttttgaggagttttgttggaaaaaatcgctccaacagtagacctaaatcacccctaaaagcttggcgtttccaaacccgcatatttcgttctccacttgtagggaagagactcggcgcccaatccttcaaccgcatgcacttcgcgcgcgctgtgtgaaaattttcctaccaggttcttctttgtgcgttcgtctacctgtgagtcaatccatcacgccagcagcctcatcttccccgcagctgtctgggaaagcagccatggctcccccaagcttccccagcgtcgacatttttttctcagcggcagcgccagacccatctccaacccaattgggcggaccttcgtcggcgctcccccagcaccaccaccgactcgaatcggccgtcgcccctattcatctccaatcgtccctcgaccctaccgcatcctgcagcacagcctgtctctcgcgtcagactggcgctgcgctccccccggtaatgtgcaggcgacaaaggccccatgcgatgcgaccagcagccggcgacaaccggaggtgcccagtcgctggccttcatcgaatcatcgtgcacctcggtcggagtcgatttctgattgttgctgctgctcaaatctggagcttgctattgctgagaactgcttggtggtggtactggaaatttgttgtttgctggctgatgaaaactgttgttctttgctgctaaaaactgctgcttgctagtactgaaaagtactattgcagctgctgaaatatcttgctgcttgctgctgaaaacttcaagttgttaacaccgttcacactaaaaaagctgaaattttttttctgggctgaaaaccccattgttgatgattgcagaaccaatatttttccatgtaaaatacaggagatcgtggtaataatcaagtgaaatatcattttggggcaaatactcagatcgtacctgaagccaatggaaacattgttcaatgcttaaactgtcagttatgatgtcaaagagattgatcactgaatgtcctgaaaggagccgtgaggaggatgcagcattgcagcgtgcgcgagcgtgagtggaggagaggaatgacgattctgttggtagttgtcgatgtggcctactttttttgttttgaggattaaattttgggaatctcttggagataaaaggtattctcataccttaaatcctttttagagatctaaaaaaaatgatttaggggattgaattttgggtggctgttggtgatgctcttacaagagaaataaggctttggtttagattattgggcgaattattgcctaaatcatctacttaattataggaataaatttaacttttaaaaaatatatttacgagtaattctaaacaagtggtttaagcaatacagtaaatgtgtacggggcatcatggtttctttaagtacatgtacggtctttaaacttgtggatgtgtgtcatctagggtcctgtttggatccgcggactaaattttagtccctgtcacatcggatgttgggacaccaattagaagtattaaacgtagattaatgataaaaaactatttcataaccatggactaattcacgagacaaatctattgagcctaattaatccatgattagtctatgtgatactacattaaacatgtgctaattatggattagttaggcttaaaaaattgtctcgcgaattgtaagtagtctatgtttaataatccaaattagtgtctaaacatccgatgtgacaagacctaaagtttagtccctggatctaaacaccacctaggcaactgaactatcaatatatattttttccccaaaacttattttgggtgtcatagatccaaatgaattccagcatgtcacagtgcacctatgtatcgatgggacctacatgaaagtcatataaaaataaattaaaagagagaagagaaaatgatgctttttatttttgaaaaattaaaattaaaatagaggagagagagtaaaaaatgtttatatttttttctacatgtaagcaccaccatggatgccatgtcagcacatgtagcaagttggagcccgttttggtctatatgacactcatgataagttcgaagatctagaaattcattttaagagttcagagatctaaataacatacccatgtaagtttaaggaccacccatacacttcactttttttttcttccttaatatctatttcctccgtttcataatgtaagtttttctagcattgctcatatttatatagatgttagtgaatttagacatcattaacatttatatgaatattagcaacgctaaaaagtcttatattataaaacgtagggaatataaaataaactaaaatattttatatcatggtgtggaggtagtacatagctgacacggcatgtagaccatgtggtcactcgcttgggttggctatgcatgtggttggtgccaccaaggaccaattttgccatgcatggtgaacggcaataactgggagagaaaaaattagaacaatggacattgacgtgtggagagaaaaaaaagtcatatctagccagtttgggaaaacatcattgatgtggtggtacaccatgattaaatcctcatgtctacaaatataattgtgtacattcttggtacagaagtcttaaatttatgctttcatcgttcaaagggaatctatacaatattcgacaattttgaaaaacttctaatgtctattatataattatagtatcattttattataatgataatgtaacttctgaattataatgtaaagtatagatgcatattctagactaaatatcatcgttttttttcttatctactaaatatctctagcaagatatggcaatgaaagtatagatgcatattctagacttcggtccttttggccttctatatattcatcaatcgtcatggtctgattggatcactcgacacagataaaaagattctagcttgcgttagctcacggaaaggtttgatgctagcacttagtagtttctgtaagcaaattaggggacaaatttgctagcacattttatagggtgtatttggtttgctccccaacaagttcaattcctcacatatagctacgaggatcccaatctcatagatacccatattaataattgagtaaactttacaaaactccaagtattattatttaagttgcacaaaatcacaatggtttcatagcaaccactagtacagaacactccataagtgttggtagggaataatctcacttaggtatcgatttttcaaccggcaccacgaagatggaactaatgagaagaaatctatcatcgggagatactcatagaccagataaatagggtattagggtacgttggtacgaggacctacacgatacgacatcaaaacaaacaaaagacaaggattatactggttcaagcccctcgtgaggtaatagacctaatacagtttatatgagattgatatgggaaaccacatagtacaaagagaacagatgaatccgatgataccggcgagatccttgtcgatatcgttcgacaagatctcccagcggctttggcttgtgtccttcggcttcgtaaactatggtcggtatgatggcgctatgattcgatgatcctgaacccctccgacggtgtgccttttataccatgagttgccttagtcttcaagtagaacttggagacagtgaactctgcacgatctagaataatccatgtcctctccgagtaggactctgttaatcaccagcccgtgaggatattttccataatatcttgtatacttccttatcgcatacgaaaatatatcgtatagaagatggtatatatgccaatcttgcatattcggtaaatcgtaggataggagatatgccttatccgtaaccttgacagtagccccctacttcaatttaaatgaactcgcaatgtcatccatgacttctctgccaacgttatcacacccttctgatcgttctcgatgggaaccgagaagacgccgaattcttgataatattgaaagaagttcaacggtccacaagtgaatttaatttgaagtctaatcaatctgtcagcaacgagcttcagaaattttcggcggcaatctctctccttcccttgaaatacgaaccgtctggtagtgcgcttatataaagcgatttactggaaacatttcgagtctgctcgcctctgaagctttccaacttccttgcgcttggactctcggtttccccaatcctcagaaaaaaaaccctacctttcttcttcccctccgttggtcccatcgacggcgatagatctttgggcatccagcaccgatgccgtggcgatgaagaagctgcaggtggatggagcactccccggccgcgaacgcccgaagagagaggacggaggtactgttccccaacccattctaggtcagatggtagtggtagtctggtagaggactttgtgtgaagtggtttctgttagaataattgggctaggcccaacttataatattaaatctcaaaggcccataataaatgttgaggataataataccaccttaggatttaagcgagaaatatctcaaccta

SEQ ID NO: 38975 - DNA, 3956 bp, Oryza sativa
ccgcaacagcgcgtccacgttctttttcctgatagataaggaggccgcgagtccgatccgttttcttcgcttctttcccggtgttagtttctccttctccgcgcctgagttgctctcgcttccccgcttctgatctcttgcgcgcacgagagattggaaggagcagtgcctctgaaaccacaccttcgcctgagatctgcaccgggtaggcgggtgatcaggtttttggggagtgcctcccgcacgactgctcatcgccatgtctggagttgccgccgccactgctggcggaggtggtacgccgccgccgccgacaggagctggatctggatctggagttggtgcgccaggaggtgccgtgaacgacaacaacaacggaggcaattctgcctcaccatccagcggagggccattctcggggtataatcttctcctcctgctactgttgttagcgctattcctgttcccattgttagcgctatcgctatattatgtgcgctatgttcttgttcctgttctacatgatgcctctagcatgttatcgcgttactggtatgttcctgttcctgacattcatgatgcgcatagtatgctactggttatgttaagatcaccctacactgcttatgccatgatcattgtttcaatttcttggattaaaatatgccgattaatgactatatttccaacaatccaaaaacctgataggtcattttcggtagttggctttgctgctgcactgaaaccacatgcttttgatggttcaaactataagagatggaaagcacgtgcactattgtggttgacagcgatgcagtgcttctatgtttcacggggcaaacgaagtgaaccacctctttctcctgaggaagaggccaagttcgaggcttcggattgcctgttccgtggagcattgatcagtgtactcgctgacaacatagtggacgtgtacatgcacatgccttctaggaaggacatgtgggatgcacttgaggccaagttcggagtctctgacgccggcagtgagctgtatgtcatggagcagttctatgactacaagatggtcgatgaccgttctatagtagaacaagctcatgagattcagatgctggctaaggaacttgagaacaacaactgtgagttgccggacaagtttgtggcgggtggcattattgccaaactaccaccttcttggtcggactttgccacttctctaaagcacaagagacaagagttcagtgttcctgatctcattggctctttgggtgttgaggagaaggcgagggcaaaggacgtccggggcaaaaaggttgagggaggttctagtgccaatatggtacagaagaagaaccctcatgcatcccacaacaacaagaaagtcaagcctgatgtcaaacccaaggctgcaaccaattttaagaagaagggcaagggaaaggcaaagggagactgctttgtgtgtggcaagtctgggcattgggccaaggactgtcctgagcgcaaagacaggaagtctgccaacatgatcattagcgagggcggaggaacatcggggtacggtaaaatattacctacagttctctctgtttttcattcacctgattggtgggtggatactggtgctaatattcatgtatgtgctgacatttctttgttttcttcttatcaggtcgggagaggttcctctttgttgatgggaaacgggtcgcttgcggctgttcatggtgttggtacggtcgatctgaagtttacttcgggaaagaccgtgcagctgaagaacgtgcagcatgtcccttcaataaagaagaatctagttagcggctctctattgtgtagagaaggttttagacttgtgtttgagtccaataaatgtgtcgtatctaaatataggacttttgttggaaaaggttatgactgcggaggtttgttccgcttttctttgaatgacatgtgtaataatcataatgctgtgaaccatattagcgagaatgatgagtctaatgtgtggcattcgcgactctgtcatgtgaatttcgggtgtatgacgcgcttagctaacatgagtttaattccaaaattcactttggtcaaaggttccaagtgctatacttgtgttcaatcgaaacaacctcgcaagcctcacaaggcatctgaggcgaggaatttggcacctctagaacttgttcattccgatttgtgcgaaatgaacggcgtgttgactaaagggggaaaaaaatatttcatgacactgatagatgattgcactagattttgctatgtgtatctattgaaaacaaaggatgaggcattgcattactttaaaatctatagagctgaggtagaaaaccaacttgaaaggaaaatcaaacggttgaggtctgatagaggtggggagtatttttccaatgagtttgcatccttttgcgaagagtttggaattattcatgagatgacgcctccctattcaccccaatcaaatggggtggccgaaagaaagaaccgtactctaactgagatggtgaatgccatgttagacactgcggggctttccaaggaatggtggggtgaggcagttctgactgcgtgtcatgtcctgaataaaattccaatgaagcataaggaggtaacacaattcgaggaatgggaaaggaagaaattaaatctctcatacctacgaacatggggctgtttggccaaggtaaatgtacctatagccaaaaagcggaaacttggaccaaaaactgttgattgtgtgtttcttggttatgctatccacagtgtgggttatagattcttaatagtaaactctggagtacccgacatgcatgctggtacaattcttgagtccagagatgctacattctttgagaatgaatttcctatgaaatatacacctagcacttctagtaaagaaactgtcatgccccgtgagcactttgcaccgatagaacacaatgatcaaacgcctgaggaaaatcctgaggaggacaacattgtagatactcgcaagagtaagagacaaagggttgcaaaatcctttggagatgactacattgtatacctcgtagatgacaccccaagaaccatagaagaggcatattcatctcctgacgctgactactggaaggaagcagtacgcagtgaaatggactcgattatgtctaatggtacttgggaagtcgttgagcgtccatatgggtgcaagcccgtaggatgcaaatgggttttcaagaaaaagcttaggcctgatggtacaatcgaaaagtataaggcaaggcttgtggccaagggttatacccaaaaagaaggcgaggacttcttcgacacatactcaccagttgctcgcttgaccacgattcgagtactacttgctctggcagcctctcatggtcttctcgtccatcagatggacgttaagacagctttcctaaacggagagctggaggaggagatctatatggatcaaccagacgggtatgtactagaaggtcaggagggaatggtgtgtaaactattgaaatccttgtatggcctcaagcaagcacctaagaaatggcatgagaagtttgacaccacgcttacatctgcaggctttgttgtgaacgaagctgacaaatgtgtatactatcgctatggtgggggagaaggggtgatcttgtgcttatatgtcgatgacatactgatctttgggaccagccttaatgtgattgaggaggtcaaagactatctgtccaagaattttgaaatgaaggatttgggagaggctgatgttattcttaacatcaaactacaaagaggagatgagggtgggattacacttgtgcaatcccactatgtggacaaggttttgagtcgctttggatatagtgactgcaagccagctcctactgtcgcgaccgagaaaattaccttttcccaaacgctagtgtattaatccccgtcccaggaaaaggccg

SEQ ID NO: 38976 - DNA, 2238 bp, Oryza sativa
agcttctcttactgagggggggggaaagattgagcaagaatgagtacaaccacagtactcagcaagccacaccggcggatgcatgattaatgcaagggggtacaaggggtaatgatataggggttaagttttgcagaaaacagcatttaaaagtcacttagttgcccaaagccatttataaagacgatcctagagctacataatattattaaacaaggccgtgaacccacacgaacctgccttaacccaaggcctacgatgattcagaccgaactggcaacccgaccctgggtcctagctcgtcccaagccaacccaggcccaccattccacattttagttgttaagcaaattttaagaattaaaacactaactggggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagcaccgacccaaccccacctacggccggaacccccgggacaggcaggcaggattgagccccctagcagcaggacaccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgagcttaatccttatagtacccgaggtacgactaaccaaacccaaccacgcacctcgagcccagcctaaaaccattttgggggttttgaatagagggggaggtgtgtgtccaattccaacataagccaaccattccatagtgtccaaatgatgtgagaattcccaaagtctaaagttataaaaccacctaatgttgcctaattaatcagcgaagcatctacctaaattcatactagtggaaccatgagtagagtacccactagttggggttttgtttatcctagggtgaacaaggtaataataacaatagcaataataatgtcttaacaaaggtaaataggcatggctaaataaaacagtgataacgcgggaatttaaataaagcggtaatgcattaatttaaatcaaaataattttataaactgggattcaatatgctcaaggatgatgtgacttgccttgctcagagagaacggccttccgaaccttcggcgacggccgcgaaccacgcttcgggaacctccggaacgacagaagctacgcaaagcacacaagcaaagctacaagcctataaagaagcaataacaatacataaaaagaaagcacacggttctttaggttataacaaacattaggagacttgaacgggtcgattcagagttcgtatgaccaagatatgatcatccgaagtttaatgctgttatatggagatttgcggattattataattaagctttgcaattataaaacatgtgtaagcgctagcctggaaaagacaggagggctgcgccgttgacatgcggaccccacatgtcaacctaaaggaccgcggtagaccgagtacacagagacggtccacgggtcgacggaagcagatcccgtgtgtcaatcgaggcgagtggccgacaaacggactccactagacaccacacgggctgcacccgtagaaaccacgctgctaccgagcgggcacactaacacggtcaccacacgcacaagcgaacgactaccgacaccggtacacgggtaccggggtcgacaaccgcacaacgggtacggggcgacaccgaaagaacgaggacggggcagcgagggagagggatccttaccaccacgcgacgaggcgtgggaacgacaacgacgaacgggcgcggcggagacggacggcgagggaacgacttcggcggcgatccttggacgaaggcgagacgcggccggcacgaggcttgacgacgcggagccgaggacgaagacgacgacggggctgcagcggcacacttgacgaacgcggacgacggacgagaacggctcgacggagggacgaacgccacgacgatgaggacgacgagaggacgacgacgacgacgacgaccggggccggcgaggagacgacgagggcagccggcgg

SEQ ID NO: 38977 - DNA, 16937 bp, Oryza sativa
gcacgggagagaggggacgacggcggggaggggtggtgcggccacgggggagctcgggaaggggctaaaacgagagaacgcatggagggggttccattttatagcggagggaagcgagccgagcacgggaggagcggggaacggcggcggaaatggcggccggcggccatggaaagcggccggagttggcgcgtccgttcccggcgattgggggcgccattcaagggggaattaagggggaaagagagaggagggaaaggggattaattccccctaatcaatttggaaagagccggcttgaatggagcggatttggaggaggaacggcgctagggttcacgggagagagaggaaggaggccggcggctggaggtcggggacgcgcctgacaggcgggacccacgcgggaggcgcgcggtcaacgcgcggcaacggcgcgcatgcacgcgcacgtgcgcggcacgggtgggaggcgcggctcggcttgggccgggtgaagccgaggcggcccaggaggagaggagggagaggcagcccgggacggagagggaggaggagggagtgggccgagaggaaggagaggaggcccaagagaaggagggagaggaggaaaagagagggaggagagggagactttggccgtgggccggaagagagagagggagtggcccaaaagaaaaggaggattatttttaggtttttctttttaataaactttgataattgtttttgttgcttaataattatttccggtgctctgaaaattcaagtaaaatttgagggctccttttagaccaaagagaatttaacaaaaattctccaggccacatttgaatttttcttgtatgtattttagtgtttgccaatttctttccgaattttaattaattctattattccttttagcgaatgatttttaatttcgggatgaatttatcaggacgtgacacctactccttatgatcccagcgtgctattaaggaaaaaccgaagaatagcaagggatcaactaagatactctcaaattattggttcattgatgtacttgtatagcgcaacgaggcctgacatctcatttgctgtaagcaagctgagccggtttgtctcaaatccgggagatgatcattggcaggctctggaaagagtaatgcgctatctaaagggcactatgagctatggaattcactataccgggtatccaaaagtactagaagggtatagtgactcaaactggatatctgatgctgatgagataaaagccacaagtggatatgcgttcacacttggaggtggcgctgtttcctggaagtcttgcaagcagaccatcttaacgaggtcaacaatggaagcagaacttacagcactagatactgcgacagttgaggccgagtggcttcgtgaactcctgatggatttgccggtggttgaaaaaccagtgccagctatcctaatgaactgcgataatcaaacagtgattattaaagtgaacagttccaaggacaacatgaagtcatctagacacatcaagagaagactgaaatctgtccactccggagtgatagcattggactatgtccaaacggctagaaatctggcagatcagtttaccaaggggctaccacgtaatgtgatagacagtgcatcgagggaaatggacttgatacccacctaaggttgcataatagtggaaacctgtccattgtgatcggagatcccgtgaatttggatggtgaaacaaactattgtgtgactgagagaagagacccttgaaaagggcttattttcatgatgtgcttctcttctttcctgcatggtaggatggcttatgtcttaatgtgatccgagtggcttttccaagcagagatgttgacctgcagaacatctcagaaggaacacacctatatgagttcgactgctagtcacagtctatgaggtttgggcgatctctagatactcatgaaaggcctggagtttgacttatatgctccaaacagaggggatgcgaacggcagcccagtaccagtcaaggttctgagtgaaacctgatcacacaaaacttacaattcaaggcatagtccattgttcagttgtggtctgatgtagctcatttcctaggtggaagttcaacataacagtctccaccaaaactctggtatatcaaacaggcacaacattgagaacatttcttatgagccttgaaatttggtggggattgttagaataattgggctaggcccaacttataatattaaatctcaaaggcccataataaatgttgaggataataataccaccttaggatttaagcgagaaatatctcaacctaaatagggagttattggaggctccctgttgaccagttgaggtgggggtcggaatgccacacgcgcgcgcgcgcgcgccgggccgggccgggccgggccgtggccgtggctggcggcgtgcgtgcgtcacgtcacgtcgctatccttttgcagccactaacccacgttcccacgattccctccgcaacagcgcatccacgttctttctcctgatagataaggaggccgcgagtccgatccgttttcttcgcttctttcccggtgttagtttctccttctccgcgcctgagttgctctcgcttccccgcttctgatctcttgcgcgcacgagagattggaaggagcagtgcctccgaaaccacaccttcgcctgagatctgcaccgggtaggcgggtgatctggtttttggggagtgcctcccgcacgactgctcatcgccatgtctggagttgccgccgccactgctggcggaggtggtacgccgccgccgccgacaggagctggatctggatccagagctggtgcgccaggaggtgccgtgaacgacaacaacaacggaggcaattctgcctcaccatccagcggagggccattctcggtgtataatcttctcctcctgctactgttgttagcgctattcctgttcccattgctagcgctatcgctatattatgtgcgctatgttcttgttcctgttctatatgatgcctctagcatgttatcgcgttactggtatgttcctgttcctgacattcatgatgcgcatagtatgttactggttatgttaagatcaccctacactgcttatgccatgatcattgtttcaatttcttggattaaaatatgccgattaatgactatatttccaacagtttcttgcctccgccttctgaattccttcttttgatcttgaacttctaccggctttccctaatgcacatcaactccaactccattgcttttctgagcattttcgttcacctttgcgaggcctacgttggtgtggtgccttgatctcttccgctactactacaagctccggtggatggaatccaacagaatatcaggatgttgtggatttcatcttcctgatggtatgaaggcggtttacatccccttccaatgcccatcatcccggagccaatggtggtcgaaatggttttattttgagataaaaaacctcgaccctgtactgatgttcccggaggacaagcctgagcattctcaggattggaccaccaagccttctctgacctcctcactcaagagtttgtcaatacaattagcagcctgcgagaatggggattgactgggtatgaagtctctcaagacttcattacccggtgtatccaaccgctccaggcccgtgctcaccctgcctttgactacatggggaaggatgacgagacgcggatctcgacgcggggtactcgttctcgtgtcatcgtctatatgtttcttttgctgtcattgtactcatatttatcctgaaatggtcctgtctccctttgcagatcttagcaacaagacggtggctcaacgcgtggggcgggtgctgataagcgttccgtcaggtgccgatgagccgacgagtgtcgtctgcgagttcaccaacgccgagaagtccgccatcatcaacataagtgtctgactccattttgttcacttgtctcctcttgatttgggaaacgaagtgacttcatcttgtacaggcactacccttggcggatgacattgggcccctcgccgaccgccaggccgccgcctctttaaaggaaaagatctccctgtagacgacgacggtgacgggatccatgacaagcggcaacggcaccaaaatccctaagaggaagtgggccctcactgctcctagtgccggttctcattcttgaacgagtggctctgaggtgagtgccttttctttttactctcggtatatcttgtttccggcgagaagtcagctcttatttgccttgttacttagggtattggcgatctccatctagctcccagactgctgaagagggccaaaaccaagtaagtgaaatctcgagctcttgttctcggagttataacttctgattttattctgtgttcaatcagcacccctttgtgtttttattgacagggcctccccagcgtcctcagctcaaagcgaggaccgtgtcgcgaccagcgcgtcgcctgtggccgccgcagtgcgcacttgatccaccgtcctcgtgccgtctccgactccgccaccgccagcctgtagcgaccctcgtattccacttccgaggtagaataccggtctacggctcattccttagtaagaatcaacttaccaagacctgagcacaccagagtagcatagcaaaaaacaattgtagcgaaacccattaaataaaaaccataagaaattagtttttatcaaaataataacactaacagtaccttgctcttctatatcatcatcaccttcatcatttagttgatgtagagatatgcaacacttgatcaatttttgcagaatcttctcgtcacctaattgttagctcaacactacaaggaataatatataggggatgagtacgaatggtactcaacaagtccaactatagcaatccaacaaatatatgcccataatccacctgcataatacatatatgtccaaagccaccataatccaacaaggaattttatgcatgttcataaaacagtgttgtaaaaactcatattaagtaattataaaatctactgcatataaggcaccaaaggtattagaacctccgataggttcctttcctaccgcattcgcggtttctacccaaaacagggagtgacatatcacacttcatacactctgcagaggtgtgtctctgtacccacagacgccttaaaccttttaatgcccacgcccgttggtgcttgaagcacactttatggtgtatgccggcaaggctaaggtcataagcttttcatcaatcccatctatcaattatctctgcgggtgattcccgcaacaacggcgaatcattggatcccgcaacaatggtgatccacatcatctaatcggattccacaacaacaacaaccctcatcactaggccacgctcacaggattcgcggaagtccttaagcccgcaggataaagccattaagaaagaactactaagctagcctatcccattccaggtcatgtggttgatacgatcgctacagcacttgaatgccatataacaattgttatttaaccttacgatgataaatatatacagctgaaccccgacaaccatggcaagttcagaatacacctatatatgaccgactgctccaccagccaatccaatccatcagcatatttattttaattatagaaagtataatttaatgctaggtgatacatatagattgcaattacgaaaatataacaagagttggtcaaaggtgttggacttgcttgcgatacccaaaattgaagatgaataaagagagaatctattctatgccactgagtttatcccaattcaacgattcaccagtgacattgtctctttctacaatataccgatgactttattaactgtctacaatatgccattgagatggggctctttttaaaaaatacccaaaatacccttagagacatacatggttaacagttaatttatctcattagaaagtttcaaaaaaataaaattttttatatggcctcctcacataacagggaagtatgtatacatattttcaattttttttggtatttttttagaaaaaatatttttttgtgtggtatactagagagaaatagcttacacaaaagataatagcaaaaaaaatcttatgttgcatatgaaagataatttacattaaaaaaacaacacaaaaaaatgttttatataggatataacatatatgctatattttataaaaatataaatagaaaaaaattgaaacttatatactgtgtaaggaggccacataaaagtttcacatttttttgaaacttctaatgagataaatcaactgttaatcttatatgtccataagggtattttaggtattattgaaaaataagcctaacccaatatcatattgtagaacaattgataaagtcaccgatatattgtagaaagagacaaagtcagtggtaaattgttgaactataacaaacttagttgtatagaatagattctctcatgaataaatcaatgaagaattccaagaaatccgatataaacgcccaactgaaagaaacaataaaacacaacaaaacacgagaatgtttatatgaatgcgatgcacatgatatgtctaaccgtaatgcacatgctggatatatataggttatggacttacttttattaacttttattttaagaacgagtaattattttacttaaagaaatttgattcactatagagattttattcaacagccctaagatatattgctttcatagaactaaatatatttgttttcttagaaaaatagtttataagatatatttcaagaaatacttttatttagatttataatatgaaagatttggttgcatatatatttaattcaaaaagacacactttaatttaatttaaaaatcatctgaagtgaattaaaataagtagctgtaataatacattagaatatgcaagaattaagtttgaatagtttaaagaatttaaatgtcatatattaatttttctttattttctaactctacctctaaattttattagcccaactactaaatcccaataaacacaagccacttagcccaccatcttcatctgagtcttttatccctatgccattaagaaagttgctgcttacctgtgtgccaccaaaaagtttggagttacttgtatgccatgagcccaactttcgttgacccgtatgctattttagatggatggagacataacagaggtgttaggggctctgtaaagacagttttgtccttgtgtacaataatgggtttaaaaaatcagaaaagtgaaaaataatttagaaaaggcgttaaaaatcaaaaaatggaaaataattttttaaaaaaggtaaaaatcagaaaaaagtgagaataaattttaaaaatgtttaaaaatctgggaaaaattgggaaaatgtgggaaaaatcttcttgatggcttgcttcttccttggtgtctccactgtccgtggagagacttcataggatgcaatgtcgtcatgaacaactggagggtgttcaatttggagagcaaaggggttattggatctagttacagaccttgtgtgaaagcaagaaaaggagatcagtgaggttgtaaatgacaagatcaggaaaagtgaaagatcatacctgctcgtcaccgaattgtcagtacttgctgatgttggtggccccttctttttggcggcgtttttaactctctttggcttctgtgtagcactggccaccacctcattgtgtgggaataccatgcctgatccaggagtggccacaacaatgctagtcactgtgttactggaagatgctttcttcagccttttttttggtggacccctgaaataaagtttgggaaattgttattttgcataggtaaacatcaagtgttgtaattgtgtagctatgtctaggaagtctacctctcagcctcatatgcagctatgtcatctggattgcctttcttacatgtgtaccaatggtgccctaactagtggcatattgggcacttatgttgccttttgccagtacctcccttagtgcctaatttcttcctactactacctccctccaaagctgatttcatcatgttcttccttcttcctcctgcagttgacttaagcaatgaaggatgcatgaagaagccatgggtgggtttggaccacatggacttgtcaggaatagagggcacagaaccttcatatgcaattttgaatttctcaattgaatagcactcatccacatagtcttcaagattggccccagggattgatgtgatgtaggcaatggcatgtttgcatggtattcctgaccattgccaagctctgcaagagcatgtcctctcttttatgttcactacaaacctgaaggtactagcagaatttcccttagcacaaacttctgcaatgccatcaggtgagcttgtgattacttcaatgtcaaggttatagctagctcctctcaacttctgcactatatgaggcaagatctttccttcaaacttttcggcaaccctttttcaattattccatttaatcaagatcatctgtctaatggtatccatcaagtcatccagatgcaggcccttctgatcctttacctgccaacatagcaatctaattgttagtaaacatgaaaatcaatgcaaagaaagtgttaaacaagacaagcttacccatttattgaatgcctcagcgaagttattggtaacataatccacttttgacaaagtggaaaattggctcctggtccacaatttcctgtgattttcctgaagatatttcatagcctctggtttggctacagccatggcttgataatgtttatcaaacatgcaaggactccaagaatatgcagatgcccacaggtgatcatcaaaaatttgtccactatgtctcttcttgaaattctgtactagatggtacatacactctctatgtttagcatatgaaaaaaccacactcaccccatacatcactgcttgcccacaatcagtgctgaatgtaagcccaactgggttgcctatagcttctttcaacctattcataaaccactcccaattctcatttgtttctgagtcaatgacaccaatagctactgggtacatccaattgtgaccatcaactgcacaagctacacacaaccggcccctgaaccttccatttaaaaatgtactatctactgcaagatatggcctacaacctcataggaaaccatcaacacaagctttcaaagcaaaaaacagcctattaaaccttattttgttgttgatggtatggtgatcaattacaacaaaggatccaggattagtatcctctatctgagccttaaatctatacaggttgtcaaaactgcaggaccaaggaccataaagtttatccatagcacgttgcctacctagataaactttcctgtaggttacctcaactttgtggctctccttcaacctcctcctcagctctttggcacccaatgtttcatcttccttcaaccaatcaagcacttgttcacagacccaaaactgtgtcactcctacacaagtgcctgccctcctagtgctttgacaattctcatgatcgtatgggttccttgtgatctgccaatttagacatcaatggttatttactaccaaaaaaaagacaccaatgcatatagagtgttacaaaaaatttaccttcactatgacttgatcactcaaaagagtggtatgaattctccacctacagcccacattcttgccactgcaatacaccctgtaccgagatttatcactcttttcaatgttatattggaactcatatttggtagcatgtgtagctaaagccaacttaaaagcattcatgtctgaatacatagtgcctactgccataggaggatcattcttgtcatagtctgcatcaggtttctgggaaggctctctatatgtaacaatgtcatcttcctctatttcatcttcctctacttcatcatctaacaatgtgtctggttcagattgactagtgggaatgggaggtgcaggaccaatgtcaatatacaagcattcatcatcaacactcacatgctcattggatgggtttgggctagcaagggattcactatctgcagatttagtatggtttagttcaactgattgcccactcccaatttcccactatgaaatgtcaggaggctcactatccaatccggcgtccatcctacagatgaataatcccccactgtgaaatgtcagtgttgaatggacaggaaagaatagaggttttacctcgctgcttccatgggcggtgacctggaggtggcttggaggcgacgtgggcacgggcggcgaccaggagccggcctggaggcggcttggaggcagggggcgccggcctgggggcgagggcgcaagggcgcgcctgcctggacgcgcggcgacaggcgcgcggcgatggggcgcgccacctgggcgcgcggcgacggggcgacggggcacgccggcctggggctacggggtgacgaggcgacaggccgacggggcgacggggcgccggcgaggctaggcgacggtgacggctccggcaaggtgaggtggcggcggtggtgtgcggctagggttagggtgcagcggcgtgcggcaaaaatgaggagagagcaagagaggagaaagtgagagtatagagctgaaaatagagtaggggcaaattagccattttcatacttgggtcccacatgtcggggatatggactcgttaagttctaacataaggtggacggaatggcacacgggtcaatgaaagttaggctcatggcatacaggtgactccaaacttttttgtggcagacaggtaaggagcaactttttttaatggcataggggtaaaagactctcttcctcttctctccctttctcgttatctttctttttctctcgctctcccctacgctgccacatcctcaggtctcgcccgccgctgttccctgcctccggcagccgccccgcagccgctgctggcctaaatcggttctgtggctcctcatgagtctgaccccaagctaaacctaacttccaacctcctcaaccctagatgcagctggcagcaaaactccggcgaggtaaggattcaggggaagttccctggcttccaccactgctacaaccacaactcctctcttctacttcctccttctctaatctctagtgttttgtactatcaaggtggttcttgtcacacccagaaatttagcccaaatttccagactattttgtgtattaaatccctgtccagtaccagccagggtacacaaaatgacaagtaatatacagttccaaacgtaaataaagcgtaaatacttacagaagaggcacttaatcctcacaccgaaaagaaagcagcagcagcagaaaagacgatcctagcagggcttcagctccactccacaggcaaaactcaactggggtctgagccttggtcttctaacttcgcctccagctcagaagcactacacttctgaaaaaaagggagaataatagcaaggctgagtacaaccaccgtactcagcaagccacaccgatgatgcagacgtgcaaggggatacaaggacggcttgtggctatttgcataaaggtggttgtaaaacattttattgagcaaaacagtaaaactattgagtaattaaagtaacattaaatctccactgatcaacgctacaccacgttgaacaggcccaaccaacccacctgaactacagtgcattgagtcgattttttaaggtgggactaatcacggtgaatctggtcgaccgcccataaccacgggcacggctattcgaatagttttactctggccagaggtttacaattgtaaccacaagacacagccccacgacatgtttccgtgcgccgacatgccaccaccacataccggaaagaggcagtgacaggacccttcgcataaccccctctaaccaagcacaccacacctcaggtttcacccccactcctcgcaaggcagcgggcagtcccctctcgtgccatggtgaatccggaagccacataggccgtcgcagggcccatccaaactccatcatgcccacccttacctggatgcgtcagctagaggaaagctacactacaagcccagccgttgcccacgctggcttgtggaaagtacgaggaattcttccagggtttcccgcgaaccggtccttaactgccatgggtgcgactagtaaaaccatgcacccacagcccaccattcagtcgcattttagttggataattacgaccactgaaacatggccgggtgtctcgagcacgcagctcgttctgatgctaaaaaggtctaatactgcaattatcccatcaactgagctagttgtaattaagcatggctaagcatatagttctagctaggtcacataagtaacatgagctagtcgatttattacccaatgttgacaaatgacatatatcaagtaaacatagcacaagcaagcagataggtaatacccggatcccatgtaattagcaagacatgcatgtttatttgcaaacggtaaaatatttataaattgggatcaacatgctcaaggggaatgtgtgacttgccttgcttcttcaaaacaatcttccgaactcttttcctcgcgaccgcgaacttccgaaacgacggatcctacacgctagcacgcaaaacgaggaaaaactctaataaacaccaagaaaacagtacatgaaaagtaaaaaaacatgtagagcttaattttagatgaatttttcaagttgaatggctcaaattggagttcgtatgaattagatatgaattttagaagttttgagccatttaaatgaatttctggaattaataccaatttattgcgcaattattatttatttttacaaaggaaaagcggactgctgacgttagcaagagggaggcgcggaccgcgtccacaaaaggggcgggccccacacgtcagcgacacaagggggtaccggcccaccgtggaccgagtccacggcggcgaccggccacgcgggcacgcccccgatggcccagatcagccaaggccgatcggacggctggggacggccgggtggcgcggcctggccatcacgcacacaaggccagcggcggtggcggcacacgggccgagcggccaccggcggcggctgcgcgacgcgagcaagcatgggaggcggccggcgaaggggagaaagagggaagggaaggggaggggaggcggttctcaccgtgggctaacgacggaagagggcggccggtggcgatcggaaagactcctcagcggcgagcggcacacgggaaatggcggacggacttcgcctcgacctaaggaaggagaagacgggattaggcgaggaaggggaggcatgaggcggcgggaaaagcggccggatgaagaggaagaggtggggcttaccagtgcgcgaggggagtggaactctggcggaattccggcgaagaggggcggcgaccgaggagcggcgatgttggggacagccacggcgcggcccggagtggttgggagcggcagcactcggcgaccggaggtggcaaaacggcggcggcctcgggttcgtggtggagaggtggttgcggcggcaggttggggaattagagcgagggccggtgtgcggcacgaagcggcggagctgatggtgggggcggcgcggcttgaggtggacgggaacagtggcaagcggcggccggaggtggcaaaacagtggcggcctcgatcttgatggtgggaatggtgctgcgggggtggaaggggagaacggagtggatgccggggcgcggcacgacgcggcggagcttttggcggcggcggcgcagcgcggcagcgacgggagcggcgggaaacggcggcgagcggcggagcgcgggctcgcgcggggagtacgggagagggtgtgagggactcggggaggagggggaaacggaagaggattgcccggggaaggtttatatagctccgggaggaggaaatcgtggccgggcggggaggatttgaaggaggaatgggcaccagtgacgtgggcgaggtggagctcgaataggcgcgaaaatttggggaaaaatgggggacggggtggaggagtgggcggcgaccacgtccgcacggtcggacgtgcgcgcgggaggctggaggcggcggttttagcggcgtagtgggcggcaatggcggttgccgctgggtggcttgaggttggggatgacaggtggggtccacaggtcccacctgtcagggagggagagagaggaagcgggatgggtaggaaaaatagactccaagggcgagcgggccgatggagagaggcggcccgagagggagagaaaggaagggggaaggggacgggccgcggggaggagggaggaggattgggccgggagcggcccaaagacgaagaggggagttttaaattgttttccatttaatttaattggttaaatgaactttgtgctattaaaattatttcttgagctccgaaaattcacagaaaaatctggaggatattttagggcacaaagaatattacaaaatattcttggccaatgatttttaaaggaaaattttaattcttccaataatttcacttgattgaattgatttaacttttatttaatttctaggaaatggattattaaatgatttttaatcccgaacaaaaatcagagcgttactgttctcccccttttctactactgatttatggttgtgatgcactgttgatacttgtagactaatcctaatggtcaacttgatgactctatgctatggattgtaattactagttctagggttctaggtcaattgatttgctagatttgatgatgcctatatgcccatgatgaatgaatgctcagatgaataaacctatgaattttattactgaaattaaaaccacactaacttgattatatccttatatatgcttatgaatgaattgaatgaatgagtgcgcatataaacagattaatgacatagttatgcaataatttaatttccactaacatgattatgttcttatacatgctgacatttagaagtaactgaaattatgaaatagtaacacactacatgaacagatctttataactgtttcactaaataacatattaaaccaccaagctgcatagtttgataattataataaaatatatataccatggattattgactgtagtccataaagcttgttcttgaggttagcagataatgatttgtttcattggacgatgtactgctactatctatgccttatagatcaacaactcaatttatgcaacaatttattaacatagttgatgaggggaggattaaactgttgatctgataataaacaattgctccaactagtaatctattttactggaatatgctactacatgttcctttttattttaatctgaactatcgatgtctttagaacaattcagtaaggtttaaactaactcttaactatttatgaaatcaggttcatggtaaattttaaaatatgagctagggttcaggtattaattcctaagtctaagatttgatttgctctatgcatcaagtatgatatatctgtatgaacaagatctgaatttctagatttgataatagcataagtctaatcacatacacacatacacatacacgcacacacacatacatacatacatacacagacacatacatacatacacacatacatacacacacatacacacacacacaacacacacacacagacagacagacacacacagacacacagacacacacacacacagagacagacacacagacagacagacacaggcacacacacagacagacacacaacacacacacacatactctctctcctctctttatatatatatatatgtatatatgtatatatatatatatatatatgttactacatggcgtaattgtaacatcgtggtgaaattgtagtaaactaggaatcgaaacaaaaatatacatgctaaccatatttttgttactacacaaaagtgtaagtgttactgcatggcagatacatgctaccacaagtttatgcagtaacactacaaaacttataatatttaccacactttcacaataacgttatgatggaattgtagtaatgtataatagatagtaataacacttatgatatagtattactacttgtggagagttaaatttcaaaagaccaatctttgaaggttctctctatccttgccccatgagtaaactgagccaattcatctctctctccatattactggaccttttttttcttactatacatattcttgcagtaacgttatcaagtaatcgcagtaacacattatgttactatgaaacttataatcgttactacatcttgtagtaacgatattacgtgattgcagtaacgcatagaagatcagcagtaatacttatgatatagaattactgctcggggagagccaaatttttaaaaaaccaatctttgaagggtaatatctctcacatcatgtactacttttaaaaaccgtttacaccatgatgttagaaaaggagtgcttatcgaaagtagatccgtcatgactatattatgaatacattccaatattgttactgcaagtaagacatggtgttactgcactatgaacatcgcgttactacgtcgttcatatctgatcccttccccctcccgatatagggtaagactattctacgttactacgtcgttcatatctgatcccttccccctcccgatatagggtaagactattctacacccagggtatagaatccccatcccttctcatctgatcccctccccctcccgatctccttactacgtcgttcatatctgatcccttccccctcccgatatagggtaagactattctacacccagggtatagaatccccatcccttctcatctaatcccctcc

SEQ ID NO: 38978 - DNA, 16035 bp, Oryza sativa
caggaatcaaaacaaaaatatatgggttaaagcctcacatgctaaccatatacttgttactgcacaaaagtagaagtgttactacatggtaggtgcatgttaccacttcaaagtagctatgttactgcacgataattgtagttttactatgtcatttttacgagatgaagattaaataggtgggctataggtaatgtctgtaggtcactttgagcgaggtctgattgatgtaggagtgttttgaacaatttcatacatttggtaaaaccatgttactgcatgtatatgcccttgttactgcaagttacccattctgttactgcacgtggagggttaaagttcaaagtgccaatctttgaaaagcaatatctcacaagatatatattattttttaaaatcgttcccaccatgatgctatagtgttactgcatgtagagggttaaacttcaaaatgtatctacgtactcccctcttcaagaaaccgttcttcctccctcttctcaagaaaaccggtctcctcccaccaatatagtgttactacattgttgacagaaaacacgtggcctgggagatctgcttaactccagtgcaggtccaaagctcgccttcggatatattagcatgccagttgatttgatcctgtaatcaacaagaaatagaagcaaagaaaccatagttaaatctataaatgatagccgatcggctagatgccgatgacatatcatttatccttaggccgatgttatccatgtatcgatcggcagtcatgaattagtaaagaagaactaaatctactcgatcggctgtagatattaacaatatatactccttatatcgatgcatacttaaatcaagtgattgggaaagatcggtcatcatgccgagacagtataaatcacttagatcaaaatatatgtcaataaaaagattagatatgtttatagcatagccgattagatggatctagcatgtatcggctaatacttcgatactactctatatcaagatattaaagcaagtataatatattgagcaaaagcctaacatacttaaatacagcaatatctcaatataaagggcagatttaacatgtcaatgaggcatatagaacaaatgaagttaaatcagatacgatcagctgaaactccgatactattcaaatcggcaactagaaggcaggctagagatcgatattctaagcacgacttaatagatcaaactaaactgatgcagcattaagtatgaaaagaagaacgatatctagacaatcaagccgctagaagtttcatagaatggtagatatctcatataatctagatcaacgtcaagatctaacctaatcggctgtcttctgcatacagatattggccgatagtagtctagatggcgatattgctagagattatgtaagatatatgataacttgatgaattacataaacaagattagagtgtcatgaagatggaagcactaatcctaagaacgcaatccatcacgacgaattttacctcttgttgaagatcgaaatcgatgcagctcaacctgaaagcaagaacccgtcgaaacaaaactaaagcaagaagggtggcgatgcgccgaaattgtgttgaacatgtgtgttaaaaattacttgggactcggggtctatttatacccgaggattacaagatatgcccataccggacacgaccattatctctaacaaactctaagataccacaagactttgcggcagacttttgcccacccttatctataaggaatttacataaaatatcctaattaatagatataattaccttcccaggactctatccatgcatggcaatcatcctgaagtacattcacttgaacccgatgtcgcacacaagtcgtattgtcggaatcggctatatcggcttatttagctcgactcagactcagccgatcttgtcgtagccgatctagacttcagccgattcctgccctgttttcaaactcgatctccgcttccgactttgcttcgatctaatcttctctccgacgctgatgttaccaaatttggttgttaacacatgccccccaagtccgagatatttgataatgttccggatttgccataagctgactccgagcaagtttcgcactccaccattattccagcgctttaaatactaaccgttacccccgagaaatctcacgccgtgacttccgttttcaccgctcaagcgaaaccttttctctcttttcttggcgattcctcggccgcaaaggcgattcctaggcgacttccttcccagcgagatctccgcccgcaccaatgtcgtcttccgccaacccacttggtgcaccatcggccgaacacgctgaggtaagttctcatcggctaaatccccttctttagtagcaaatcgatcttctccaatctgatatcactctctccctctggattgctttggatttgtagcacctttccaacctagttgcgattcccagcctggcgcatgaaaatcactactttcttggcccagtcggcaatccagaccccactgagtttattattggtgaaaccaataggatccccttcagattaaccaacccggatctaggtcactggaagaacaccttcaaatcctggccatccctagagaaagttccaccagaaaagagctggaccacatggttcaaacgtgtatcagccagcaagagggttcactgggatgaaattggaatcggccaagcacttgaccttactatagcgaactcagccaaagatgaacacctgatggcagctgcttcttacttctggtcaaacactaccaatgcctttctgttcaatcaaggaccgatgactccaactctcatagatatcagtatgatcacaggtctggatgttacctcatcggccaaccctatgagtttgaacacaaagaaccaatatgacttcaaaaccaaaagtatagggggttggtcaggctatgtggcagcatacatgggccaaggctcggtcacccctcgagaacatgtggctttcctattaatgtggctagaaaaatttcttttttgtggatcaagttgtggccccacaatcaactggcaatttctggctgaagctctagaaacaaagagacaaattctccttgggcaaaattctcctcggctatctataccagatgctgagcaatgcatcagctaagatagcagtcggctcagtagttagagcaggtggaccctagtggctactacaaacctggttaaacctgatagtcatgaaggttgtcaatcggccatccgtattagaagctgaattcccaagactagagccaattgtagatgatgatggagaagagcgtactcatcggagatgcacatcatatggagaatacgcttctacaccaactaatgccggagcaaaactatcggctgaactgctcaaggattagttttgtagcttctatgaagactttcagaaagatgctagaatctggttcctttatgaagactctgcacaacttgagcacccagtggacttcagattcgaagacatcaaccatgaagtataccaatcatgcagggaaatcttctcggctgcaatcagcccatgtatccttcctgttggcattcatcaaggaagaaacatccaagcttcttatgaattctatcatccaatgagctcagctagacaactcggaatgggccaactcccaattggcttgttctttgctgacaagatccaatgccgaggagggatttcatcaaccctgatgatggatcggctgcttagccttcaaggaccccctctgggcagtattgacaacatagaactggcaacattcagaagcaaaagcttcgataggtggtggggtgaatggaaactgcatttattccaccaaccagcttcaatatatatgacagacctctttccagatgttgtccctcaagtaagtctccaacttttcccaattttagctaaataactgtttggccaattaatcttaaccaatcgtccttttggtttgcagacaacggaatcttcccctcctcatcaaagcaacagtggcaaagacatccaatatgccccaggtttaattcctaacggaggtgggctatcccctccagttatcggctatgatgcccccaagacctcagctcttcttcaagggctcgttagagaaccagccgatgccagcaaaaagaggaaaaccagatcgtcggctgtaagcatcgtagccccaattaagaagaagaagacaaagaaatccaagccagctgatgatctgcctaccctggatccatccatcgaacaagctctggatgaagaggccattgaagacgaggttgatcaggccgtagccgaggtaagtgacactgaaagaacaccatcggcttcgcataaacaaacctctccaactccttctgctccggttcatttctcaagggtaagtgtttcttgttaatccctttcatgattattttgtcttatagccgatcactcccaaatcttataattgtagaaaaagaagactgcggtgaagaagaaatcggctgcagcaacatctaaaccagctccaccagtaagatagttttaactttcattagttaatttttagccgattctatttgacacttgtttccttttcagccttcacctcctccttctccttctgttcaacaatcatcaagtgatcagactccctcagctgcgggaagtcaccacgtcgaggaagaagaacaaccagctgctcctgctaccctagtaagtttcttttatcataacaagcattcaaatcggctgtaatcgtttaacctctaatctgcttctaaactgtcactgcaggtattagccgatcttttctcttttgacatcagggactaccttgatgaaggagaagaagataccacaagcaaagccttggctcctttatctgatgatgtgaagaaaactctaggaagcattttagatcggctagaggcatcatcgctaaacagcttggtggttgactgtggctcaatcaaggctcggctacatgagattcaagctttaatcctagatgagttagccgatatccttactccagccgtttctcttgagcaacaccaattcaaactggagaaagccatgttaagattagccgaacggcgagaacgtaaggatattgaggccactatccaagccaaccgacaacttgtgcatgaagagaagtccaaacttgatcaactatctgaaggcctaatcaagtctaacattgatcggcttgaggctcgcaagattgacctcttaacacaacttgaagaatgtaacgctgagctggatatggaacacaagaaactagccgatctccccaagtctattgaagaacagaaagcgagactcaaatcggctataaagcatgttgctgaactgaccaagtccctgaaagttatccctcgaaccgatgctcaagatgcccaagccatagaggaagtagagcagattaggcagaaggctatatcggctatccagcgatacttatcgcggtaatctttgtgtaataggacttagaatttttgtaatcggctaaaacattctgatactgtactgttggaacgatcctttgcgccgattaatatgactttgaaatttgcgcaaacaaaattgaaaattttactgcatgctgatatatatatgcccccctagttttacaatgtcgagagcattaataaaattatgaaataactaagggcgatataacaatatcggccagctcaaggctatgtaaacacatcggctatcatggatcggcaaaagtagccgatcatgcgttaacccaaacacttgggtaatatttcttcaaatatttaccattgagtgctcgcccataaacttcgccgtcaagcccttgcaacatatatgctcccttagacacaaccttatgaatatggaatggtccctcccaattcggcgaccacttgccgaatttactatcacgagtaccaatcggcaaaatcagcttccatacaagttctccttccgaaaaatatttagatataactttcttattataatgccgagcagcacgttccttatccttagtaacctttgcaagggctcgcaatcgtgactgaaccaaatcctccctctcatcagccataagattgtaatactcatcggctgttaaatcgttttgcagctccgttcgtcgagagccgattctaacttcccatagcaaaacagcctcatgtccataaacaagtttataaggaggaacttgaatcgatccatgacaggccatcctataagaccacaatgcttcggccaaccgagtatgtcattgccgaggataatcagaaatttttcgcttaatcaatttgatcaaacttttattagatgcctcggcttgcccattagcttgtgcataataaggtgaagaattcaacaacttgatacccacgctatcggtaaactgaacaaactcatcggacacgaagattgaaccttgatccgtagtaatagttcctgaacgaattgaatagcatccccagaatcaaccttcttcaaaggaatcgcctctacccacttggtgaaataatcagttgccaccaatataaatttatgccctttactcgatggtggatttatcataccgatcatatcaattccccaacctctgaacggccatggtttaataataggattcatagccgacgccggtgctcgctgaattgctccaaacttctgacaatcttgacatcccttataatatttgaaacaatcctccagcattgtcggccaaaagtaccctacacaccgaagcaaccacttcatcttgtgagctgattgatgaataccacaaatcccatcgtgaacttcactgattgcaaccttagcctgatcggcactcaagcacttaagtaataccccatcaatcgtctgataataaagctcatcatccaacagtgtatactttaatgccctataccttaatttcctggaagccgattgagatggattactcaaatactgatgcacatcatacctccaatcatcggctaacattgctgcaatctcaactttaacatctttgatcatcggcttataccccgatgccccttgggccaaatcattagcttcaagattttgttctcgagatacatgcttcaaagtaaccagctgaaactctttcattagttccaagcacttctcattataaaccatcaatgtatcattcttgcattcatattctcctgccaattggctgattactagcaaagaatcccccatgatttcaatagtatcggcttcaacttccttgagtaattgcaaccccttaagcactgcctcatattcagcttgattattagttgcatacggtttaatagtataagcgaactcgaaacatgcccccctaggggaaattatgactaagccgatgccacaaccatgagtacataccgatccatcaaagaataaagtccatggcactatctcaaccgagccgattgaatcatcacgatgttctacaataaaatcggctatagcttgtcccttaatcgcctttggtgattcataccgaagatcaaactcagtcaaggaaaatatccactttccaactcgtccctttaatattggagccgacagcatgtacctgactacatcggctttccatataacggtgcactcgttagataatagataatgcctcaacctcgtacacgaaaaatatagacacaagcataacttctccacaggagaataccgagtctcagcatccaagagccgtcgactgagataaaatacaactcgctccttcccctccaactcttgaatcaacaccgagccgattgacttctcaccagccgataaatataacctaaacggtattcctttctgtggaggaatcaaaacaggaggagagctgagatactccttaatattatccaaagccctttgctgctctgctccccaagtaaattgctgatcggcttttaacctcaataagggtgtaaaagattccaaccttctagacaaattagaaataaatcttctgacaaaatttatcttgccgatcatctcttgtagctccgtcttattttctgggggctgaattttcttgatcgcattaacgctcctttgggtcacctcaatccccctttcatgaacaagaatccccaaaaactggccggccgacacaccaaaagcacattttgttggattcatcttcaagccatactttctggttctctcaaaaactttccttaaatcggctatgtggtcctccacctctttagatttaacaaccacatcgtcaatatagacttcaaccgaccagccgattaaatcatgatatatataattcatggccctttgatatgttgctccagcactcttcaagccaaaagtcatgacgacccattcaaataagccgattgcaccaggacatctaaaagccgtcttatggatatcttcctcagccataaagatctgattatatcctgcattcccatccataaaactcaaaattttgttccctgatgcagcatcaactaattgatcggccactggcattggatattcgtcctttggtgtagctttattcaaatctcgaaaatcaatgcacaccctgaccttccattctttttaataactggaactatgctagaaacccattcggcatatcgacagggacgaataaaaccagcatcatacaatcgtttgatctcagctttaaccggctcgagcatatcagctttgcatctcctcggaggttgctggcgtggtctaacccctggcttgataggtagccgatgttcgacaatcgatcggctgagtccgggaatctcgtagtactcccaagcgaagcaatctctaaactcttttaggagctctatcagcttggttctaaactctggagacaaatttttgctaataaatgtcggccttggccgatcgcctggacctatgtctatttcctccaaatcatcggccgacataaaacctggaccttgcttgtcatcgagatcatctactgtatccttagcgtagacattcgaacccttcacaacgccctcaaagtaatagcttgggttctccatcttcgattggctgtatatcagaatcggacacttttagaaaatctccatcccagacttttccagataaacaatcaaggccatccatctcccaaagggctaaatcggcactggcaacgttaactgacctgtcggccggcacgacctctatcttgtcgccttgccattgaatcaagcattgatgcatagtcgaagggatgcaacaattggcatgaatccaatcccttccaagcaacaagttgtacgaacccttcccatcgatgacaaaaatcgtggtaggaatagtcttgctgccaaccgttagttccacatttagaacacctttggtttcagacggattaccaccaaagactttaagcaccatatttgtcttgatgagatccacggcgttcctacctagcttctcttcaatactctgctaaaagatatatatagagcaacaatgagtacaaaagtactcagcaagccaccacaaaaaatgcaataatgtacaggataatacaaggagtggctatggttactttgcgtaaagctgagttttcaaatatcatttcacaaacctaagacctagtataaactgatcaagttttaattccattgttcattaaacagcgacggttctgtccaccatccattgtgttcccaaggatagcttcccgccactggtcgtcatggttttctggggtttaccccttctcgcctctcgagaagttgatccaccagtacaaaatcatcatgcaacatcccacccaaccagtttaagaatttagagtctagcctagtataatacacgtctcggtgctcaataaccacgagcacggctattcgaatagatttagtttactcacactgcagtgaatgtacactttacccgtactccgcgacttgcccagcacatgagcctaagtcccaacgaatgagacttgccatggcaaagcctttcaacaacctcactttggcagtacccgctccatgaattttagtcctcatgcactctaggcgtccaaggtttctagcagtgagaggagttctggcgctcccgggaagggaagattcacacatgcattaagttatagttaagtttaggtttacacatggcagtcctaccgatggcgacaccactgtaggcacccacccctcgcggtcctaccaatggctgccccaccgtaggccctgcctcacacacatcaagaaaactactatgcagggaaactgcctccgctcggctatttactctgctaggtctatacccatacgagaagtacggttgtacgggggtcgtttcatgcttagcttcatggctcggtccttaactgaccagggacggcactagccttttccggacaccacccaagtcctccagccgccctagtcgaaaatatttgtttagttttcattttctttcacaaatcatctcatcaatgtcatggcaatgtggcactcatgtctccacatgccgtatctcaactacctccccaaggtagtttcccaagcatgaagcatttgataaatatgagaatgcatgaatctaaattagcattactaagcatttgtcataagtgactagggactcatacgtaattatgggtacaagggaataatgagataagtaataatcaaaggcatggcataataacaagtaggatattcattactgcatgcaattttatttgtaaacaaaacaatttcacaattgggatcaacatgctcaaggaatggggtgatgacttgcctgcttaggatagttcttattcttgatatgatcttgatcaaccttcacctcctgaaagctgcatacgttgcctcacgactaaccgatatacaatttctataatatgcgagaaaaccaatattcaagcaacaatcaaatatgcacaaacaaaatataattgttcggaatatacctagggctattcatatcactcgtgcttgctaatggattgtaaggtgctacgaagtctaaactatggctgctcacatacagaactcaatactcaggactacggaattatctatcaactattgctatgtggagttcatggctaaactagctttgatcgtaatttaaatggtgacaccctacaggagatttaccaacgctcagtggataatttaatcataacaagcgttctaacaggatggattatctaagcatggctctacaaatattactgtattagggttccaacgaattacatgctatgtaggttagattagtgtggtccataatattatagttaaagtttatctcaatgcataattttaccataaataatcctaagtcacggtcaaactataattgtgtgaggtcaagatttataattagtgttttatctactatacacgcttatcatagactcctcagtttaatatatgaaaaaggtaggttattgttcttgtgtatgatttaaatggactgtatagtagttgtgagtgcaataacatactaatattagatcatttactaagcatgagctatttactgtaagctatacagtatatgtgatgcaggtggatttggcgagttggtactatttatcaacttaagattgattaccaacttaaaagatactattccaaggaacatgacattaagtaattaatttcgtataggtgatttaatcacactagctctgttattatttctcataaacaagtttaagattcatctatgagtattaatattttagtaactttatgtaactaatttttaagtcatgaatttaattatatggctatcgaatattaaataagcactagtattttcctatacatccattcatttgagacatcacttatacttagtttatgtggttgctacagtgacaaaacatgttaaatatatttatttgacatctactctactgtacaatatcaattttatttattagcacatttttaagttgaccataatctaatcatttgatattaatatattttattaaatagtgagttatataccattggaaagcttatgaatttagatgaatttaggttcaagtttcactcgaatcggagctaaaatgaataagttatactaatttaaagattcaaatttgagttaatccgagaaattgtaaaaatgcactgttcataaatgatttatttttaatcggaaacattatccaaaacccactgtggttgacatgtgggaccggccctggttgacttagggtcaaacctgcttgtttaattaccattgggtcccgcctgtcataggaacaaaatatataattgtgttttcttagattttaactatagggaccccacctgccattgagtgggataatcaccgttagggataggattactgtgcgctaatcacatgtgggtcccacacggtttctctctctcctcatcttcttcttcctctcgcccgttaccgagcgaggcagaggcacggctcggcgcagccggcgtggccggcccgagccgggacggcagcgggcggctcggcgacggccggggtgaggcgcagaggagctccgacgatctcccgccgatggcagccggcgcgcgaggagacggggacgcgcggcgccatcaggcgacgccatgcccgagctcggctacaaggggcttcggtgctagggacatcctccggccgaattgaagggtgcgggagcatctacggcgtatggggattcgatttcacaaactatatggagaggggagctcccgggatagcctacccacggagggctcgccggcgacgaaacggcggccggggcggcacggccatgggcgctaatcgccgattttggagccggcgctagcaattagatgtatggaggacgctacgggcacgagggtgtaccgcgagacggcgagatggcaaaacgcggcaaagtggagctcgacacggtgcaggacaggggcagacagcggcgacgtaaggtgcttgacggcttttcttgatgtccagcggctacccggcttcccctatggcgacggcggcagcacggctcttcctccactccctccaacctccagctccggccggggagcctcacaatggtgatctgtagcggtggtgagagggtgatcgcaaggtgttcgatgaaatgcatacgagaagaaggctgagagggatggggattttgttgagggcttcgcttaggatgcaagcaaactatggggataagatcaccagcacatgcctaggcgagctagagtactaatggtgatcggataagagcaatgaggtggatgacgcggctgagattcatctccttctccattaaggttctgtggcttaatcatcacacctataacctatagactgcaggtctgggcgctagctggaggagagggctccattttatccattgggcgtggataggggcgatgggacgcgcgtgtctgggttatgaaggcaggcgtggtgacggtgatgcgcgcacatgggcgatggcgcagctccgtgtttcctggagagaatccaggagagcggttagaagtgcggcttggcgtggcacgggccctggcacgacgaggtacggaagggacgacgcgggcgcgggcgtgggtccggcgcgatgcgacgcacggcgcgatacaacgcgatgcggttgcggagcggctagtgcggtttggctagggttggggtcggacgcggctgaggggaaggaggcgcggttgcggcgcggcacgggcgtgactggcgcggccggaagcgatgtggtgcacgcggtagacgggatcgaacggttggcggacagtgaatagtggcggctgagaaaagagagaaaaggaagaaaaagggaaagaaaggaaagggaggggctaatctgcaaaagtgaatgggattgaaattgaattgaaatgtaatcaatatattttggttttgagaattcaaatgtttgatttcaatatttatttggttattcattagttcccaaatgaatttgctttccattaaattatccaaaaattatccaatataacctataagctttgatatttcttaaaaactaattaaatattctaatgtgaccttaataatacaatagcacattggtcgagtttatttgtataacaatgtattttacaaggacacgtttaatctattattccataaaagtaaattgatacttggtacaatattgacctaaatgtttaattaaacactcacataaacatattttatatataaagttcaatttatttgcatgacaaattattttacatgagtgaatccatcccatgagagactcaatgaaagttataaatattaatttaattattctagtggaacactcctatatatataaaatcattgtagtggcgactacttcgtggttacttagatgtcatgacacttgtcgacatggttcaagtatttaacatacaatttgtaattattaataattgacttgtgttttatttggcttgctatcatgtacacaaatatttataggattaataataattatcttattctaattacttcttagttgtacagctttagcttaatcttcaatcgtgacaatttatagtttggcaagcaatagcaaccataacatccagcatgatgcaaaagttttaaaaagttcgaaattttagtgatttttattattagggattttcaggatgttacactgaacgtagcatagggcatcaaattcaccgcggccccaccatcgaccatcatcttagacatcggcttcccattaacgtagtcgtttatatataatggtttaagatgccgattctctgtcccctcgggtttctcgaataccgcctgttctggtgacaggaccaacttagccgattcctcttccacttcatcgacatcggcctgatcgatcccgaactcagctggcaatgtaaagaccatattaattggtgccgctataacactcttcccttttgccaacctcttcacctcgtcatcttcagcatcattggctacgggaacctgattccagacacgccactcctgtctgtcttggttttggtttcctcagccgatgattgatttccttttcaacctcctgaaaacgctccctgctcctcaatctctggaccctccttttctgattcttcgtgaaaataccagaaggacaccattgattcttcctgatcgcctcatccccttggccacaatcctgattcatcggacccagtctctgatgaacagggagtctcgcctgtctcagccgattatccctattgtgtggtcagcttgagctctcgatgacatcactgcatccagggcaattttcgatagatggcaacctcatcccttcattccagcagaatctgaaaaactcgtaaccccaatgaggatcaccaataaatgctgctgcactggatcaccaatagatggaggtggcaaaaacatggcagcaacttgatcttgggtcggctgattcgcgatatgcccagtaggctgtggatgctcccttattaacaaccgagggtttatcggctggcctggcgtcatagctgctacagcaggtagaggagatgatgttggcgccgtcggctgagttgtgggtgcaacggagggaaccgcctgagaagatggctaaacatcagtgatcaacgatcgataattcgggaagacacctccttgcaaataaaccgggcctgcagcctaatgctcagctattgagccatcggctattgtcttcatcatgtttgacaatgtattgactagcactcctgattgattgatcaaagcatgatgcacagcgtaatcgacccgatcttgaaaattattgaaaaagtcctgtgctagttcattgttacgattaagatttcctccttgtggtccttgagcaccatcaccttgagcctcatcaccttgtgctccgtggactccttgcagattgtcgccttgatcgctcggggagccgtcggtagcacctttagcactcggttgggccgagccgcctggagcttgtttcacttctccatctttagaggaaccggtcccaggattatcagcaaccacttttatcttatacttctgaacaagcg

SEQ ID NO: 38979 - DNA, 3317 bp, Oryza sativa
caatgatgtcggtcaatcccggcttcggcgccttgcctttaacggaacctgggcttgatggtggcggtggctgtttctcggccatgaggagggactgacgtctgacttttaatcaggtcccaccgggcgtgccaaaagcgtgttgacagaaaacatgtggcctgggagatctgcttaactccagtgtaggtccaaagctcaccttcggatatattagcgtaacagttgatttgatcctgtaatcaacaagaaatagaagcaaagaaaccttagttaaatctataaatgattgccgatcggctagatgccgatgacatatcatttatccttaggccgatgttatccatgtatcgatcggcagtcatgaataagtaaagaagaactaaatctactcgatcggctgtagatattaacaatatatactccttatatcgatgcatacttaaatcaagtgattgggaaagatcggtcatcatgccgagacagtataaatcacttagatcaaaatatatgtcaataaaaagattagatatgtttatagcatagccgattagatggatctagcatgtatcggctaatactccgatactactctatatcaagatattaaagcaagtataatatattgagcaaaagcctaacatacttagatacagcaatatcttaatataaagggcagatttaacatgtcaataaggcatatagaacaaatgaagttaaatcagatacgatcggctgaaactccgatactattctaatcggcaactagaaggcaggctagagatcgatattctaagcacgacttaatagatcaaactcaactgatgcagcattaagtatgaaaagaagaacgatatctagacaatcaagccgctagaagtttcatagaatggtagatatctcatataatctagatcaacgtcaagatctaacctaatcggctgtcttctgcatacagatattggccgatagtagtctagatggcgatattgctagagattatgtaagatatatgataacttgatgaattacataaacaagattagagtgtcatgaagatggaagcactaatcctaagaacgcaatccatcacgacgaattttacctcttgttgaagatcaaaatcgatgcagctcaacccaaaagcaagaaccccgtcgaaacaaaactaaagcaaaaagggtggcgatgcgccgaaagtgtgttgaacatgtgtgttaaaaattacttcgggctcggggtctatttatacccgaagattacaagatatgcccataccggacacgaccattatctctaacaaactctaagataccacaagtctttgcggcagacttttgcccacacttatctataaggaatttacataaaatatcctaattaatagatataattgccttctcaggactctatccatgcgtggcaatcatcctgaagtacattaacttgaacccgatgtcgcgcacaagtcgtattgtcggaatcggctatatcggcttatttagctcgacttgtcgtagccgatcttgtcgtagccgatctggacttcagccgattcctgccctgttttcaaactcgatctccgcttccgactttgcttcgatctaatcttctctccgacgctgatgttaccaaatttggttgttaacatgcatgtgtaagatgtgatagtaatattgtggtgaattacagtaaatcaagaattgaaaacaaaaatatataggttaaaagtctcatatgctaaccatatacttgttactgcacaaaagtaaaaagtgttactgcacggaaggtgcacgttaccacgtgtttatgcagtaacactacccaaaaaatacagtaaaacgcagtgtagtaacatcgtgatgtgattgtagtaacgtacaacatacaagtagtaacaagtaatagtatagtattactacttgtggagagacaaattgcaaaaaagtcaatctttgaagaacaatatctcccaagtgatgtaaggttttttaaaaccgtttgcatcatgatgctagaaaaaaaagagcttatcaaaagtagatccgtcatgactatatttcaactatattttaacgctgttattgcacgtaagacacagcgttactacacagtggtcgtcgtattactacaccgtcctgggacgagagctgagaagaggtgggtggtggggggagttagttggcgggtttgaccggtgggaggggcctttgaccgaggtgggaggtgggttttgggccttggtaaggagggggaagtgggtgtgacccttgggagggagggaggggggtatagaatagctattctatacccagggtgtagaatagttcatatatatatatatatatataataggtgcatgttaccaattccaagtagttatgttactgcacgatcgataatcgtagttttacaatgtcagttttacgagatgaagatcgaataggtgggctataggtaaagtctgtaggtggctttgagtgaggtctgattgatgtacgagtgttttgaacaattttatacatttggtaaaaccatgttactgcatgtatatacccatgttactgcaaattacatattctgttactgcatatggagtgctaaagttcaaaatgccaatatttgaaaagcaatatctcacaagatatgtattatttttaaaaccgttttcacaatgatgctataatgttactgcatgtggaggatatatgggttaatgtctcacatgctaaatatatttgttactacacaagagtggagtgttattgcaaaggcaggtacacgttaccacatgtttatgcagtaacactatctaaaaaattcagtaaaacacagttactgcaaaaacttataatttttactgcactcttatagtaacaatgcgatgggattgtagtaacgtgcaactgacagtagtaaaaagtaatgctatagcattactacttgtggagagtcaaattctaaaaaagccaagatttaaagaacaatatctctcacatgatgtactattttttaaaatcatttgcaccatgatgctagaaaaaaacgcttatcaaaagtagatccatcatgactatattttaacaatatttgagcgctgttactacacataagacgtagtgttactgcacgttgaccgtcgcgttattgcacagttccgcgagacagagccgagaagaggtgggtgataggaggagttagcaagtggtttgaccgcagtttgactggcgtgggatgcttttgaccgacctttgactgaggtgggaggtgggtttggccattgggagagaggtatatatatatatatatatata

SEQ ID NO: 38980 - DNA, 4429 bp, Oryza sativa
  unsure (1)..(4429): unsure at all n locations
ctctgtgcagtaacactgtgtcttacgtgcagtaacagcgttaaaatatagttcaaatatagttatgacggatctactttttgataagctctatttttctagcatcatggtgcaaacggttttaaaaaaccttacatcacttgggagatattgttcttcaaagcttgacaattttgcaatttgtctctccacatgtagtaatactatactattacttgttactacttgtcgttactacaatcgcatcacgatgttactgtaagtgtgcagtaaacactataagttcagtaacaatgcgttttgctgtattttttggatagtgttactgcacaaacacgtggtaacgtgtacctgccgtgcagtaacacttttacttttgtgcagtaacaagtatatggttagtatatgacacttttaacctatatatttttgtttcagttcatgatttactgcaattcaccataatattactgtcaaaagtgcagtaatgtcatatacaagcagtaacactatattggagggaggagaccggttttcttgagaagaggaaggaagaacggtttcttggagaggggagtacgtagatacattttgaattttaaccctccacatgcagtaacactatagcatcatggtgggaacgatttgtttaaaaaaatgcatatcttgtgagattttgcttttcgaagattggcattttgaactttatccctccacatgcagtaacagaatgtgtaacttgcagtaacaaaggcatatacatgcagtaacatggttttaccaaatgtataaaattgttcaaaacactcctacatcaatcagacctcgctcaaagccacctacagactttacctatagcccagatactcgatcttcatctcgaaaaaatcacatagtaaaactacaattatcgtgcaataacatagctacttggaagtagtaacatgtacctattatgtagtaacacttctaattctgtgcagtaacaagtatatggttagcatgttagacttttaacccatatatatatatatatatatatatttgaatttttatttacggaggatgatacacgcgcgctgagctacgggttaggagcggctacaacaatccgaataagggatagtagatatatttactaattactgcacactaagtatatcgttactatatttgattgacaatgttactaccgggatgcagtaacacatggtacaattgacaataatgtgtgaaggtaaatgctagtatagtttaggaatgattaattgctgcacgtcgggattaaatggcaatgcgtctcatatgttgctgcaataatctataattatcatgatcatgttaccgtagttgagtagtaactgatgtgcaatggtgtagtaacatgcatggtttgaagcgtacaataacgaccatcacaatgtaattactaatgtttaagtgcagtaacggcttatgagttctctcgtctggtggaatgatggatgttatacatttgaggtgtggagattatgggtaccccatacccacacggcatggttatccgactagttataggggataacttatatatatgaaatatgtaacagatcatgacttgggtattacgtttccctgtatattatggaacggcctaaagtcctggtttgataagattgtaaagtagatttaggaaaccgataccgtcttggttaaggtttctatcttgtaaccctgccccccaacctatataaggagggcagggagcccctctaggggcatgagacaacctgatcgtcagatctatactacacccggcggattcaaatccccaaacaggagtagggtattacctctcattgagagggcctgaacctgtctaaatcctttgtctccacatccatccacttttaggtctcgtgcgctaccccgttttattattgccgaattcatgtttcgacagttggcgcgccaggtaggggtgcgtcgaattacctgtcgaaaagtgcgatggaatcaacttcagaagaaaccccgagatcaatctcatcaatttcgatggctcaaatcttcaatcgggtctaccgttccaatttaatctctattagattaatttttaatcattgtttgatttcctgatattttgacgaatttcatatactggatgagatcgaaacacggccatcatcgtcgcctacttgggtgcccttgccgtgtccgagtgctcctctcttcctttcctggcagatggacgtgttgcaggagtggcacaggccgccaggattcgattcctgtttgcatgtatgatggttgatgggctccgccggctacctccgatgatggcatcatgccgaaagaacatcgagttagctgttagttgctggggcttatacatgttgcatggcacgtcgccggctatcactcatgatccagcctcactgctcgacttgagtttttcgtttcaatttgttatcaatatatattagattgatttctaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccaccggcctgcctccgtcgccgccgactggtgtccccgcctatacggttggttggcctattatgccaccgctgttgggcgtctacgactacaccgccggcctgcctccgtctccgccgactggtgtcctcgcctatacggttggttggtcacaccaccgttcatgggcgtctacgacttcaccgccggcctgcctccgtcgtcgccgactggtgcctccgcctacacggctggcctattatgccgccgctgttgggcgtctacgacttcaccgccggcctgcctccgtcgccgccgagtggtgcctccgcctacacggctggcctattatgccaccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgactggtgtcctcgcctatacggttggttggtcacaccaccgttcacgggcgtctacgacttcaccgccggcctgcctccgtcgccgccgactggtgcctccgcctacacggctggcctattatgccgccgctgttgggcgtctacgacttcaccgccggcctgcctccgtcgccgccgactggtgcctccgcctacacggctggcctattatgccgccgctgttgggcgtctacgacttcaccgccggcctgcctccgtcgccgccgactggtgtcctcgcctatacggttggttggtcacaccaccgttcatgggcgtctacgacttcaccgccggcctgcctttgctggatgtctacgtcctcaccgttggctcaccttcgttgccgtcgactggtgtttccgcttacacggctggcctattatgccgccattagtgggcatcttcgctttcgccgtcgaccgccttcgtcgccgccgactcgtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagtaaattctgattcgtgaaactttgttccattaatgacgaactcatgtcactcatatgcatgtttgggaagtgcctaggccgactcccggtgcttgatggttatgactagtcggacagagtgtttaaacgtacagagtcatctgctcggggaaatcaaaattgacaagaggagaaatacatatttataaatatttcaaaatacttgattttttctcgagtattatatttatatcagatactactcatcctatatgtttgttctgcaggatccagatccagatatgcataaaagggattcatggctttnnnnnnnnnnnnnnnnnnnnnnnnnnnnnnnnnnnnnnnnnnnnnnnnnnnnnnnnnnnnnnnnnnnnnnnnn

SEQ ID NO: 38981 - DNA, 18001 bp, Oryza sativa
  unsure (1)..(18001): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaaaacttttcctacttcatattaaattatttttatctaatggaattaaaggataattaattatatttttttttatctttttgaccaaaggtcactgcaattttatttcattattattatttttgtccaacagtatgcatgattaaaattaccttaatccgttgcaatgcacggacgtcattgctagtatattttaaaaaatcaacggcaaaaacgaagggtgtacttctcacccgaactcctcgaggggatggcgatgaggtttatgttggtgccaattattggttcggtttcgacttgactgatgctaattttggcttatgtagaagtctacggtaagattcttctttttttaggtttcatgcccggcagtagtgttatcagttatcacttatcacatcccgtacgtcattatcttcaacagtgtcaggccagctgaataaatgttcttatgccagtatgcctaattaatgtacttgggtttcacagaaatgctgctactatggtttgtctaattcgacgtactactccacttattattgaaatattgacaattaatgacactatattcatgattaaacatttactccctccgtcccaaaaaaaagaccaatcctagcaagcatgtccagatacattgctaggattggtctttttttgggacggagggagtaccatttttctctctcttttttaaataaatacttgaaaatatattatactactgaaatatgtagcatgaaaaaaattaactataaaacttttattcattataatataatcatctaaaagtaatttgtggtcaaattaagtaaaacagttgtaacaatcattcgaaaatagataattttaattttacaccttttttgagggataatttggtcctgtttggaatgagattttattatccttgagtggatgtagtactaaatttgaaccatccacccaagggctaatattgttttgtactgagtggtaccgctcattggtaatttcctaggcctgtgagtaagcacgacttgaacccctcactaggtaatttcctaggcctaggagcaaattcaggcctagtttagttcgcgaaattttttttttttgtgttacatcggacgtttgaccggatgtcggaaggggttatgaacacgaatgaaaaaactaatttcataattcgcctggaaactgcgagacgaatttattaagcctaattaatccgtcattagcacatgtgggtactgtagcacttatgactaatcatggattaattaggctcaaaagattcgtctcgcgatttccatacaaactgtgcaattagtttttctttttatctacgtttaatgctccatgcatatatccaaagattcaatgtgacgtttttggaactaaacaaggcctcactttctgcatgaatagaggaaataagagtctccgtttggtatagctccgactcctaaatttagcttcaagagttagatttggagtaaagttgtgaaacagcctaaactcagctctatctctctagttcattttgtgagaacgctccacccagctgcgtttctattttaggtggagctgaaattatttagttaggctctaactccaatagagatggagctggagatagagccgtgtcaaataggccttaagtttgcctaatgtatactcatttaatacttaaaaaggtggtactagtagtgacaaaatctgtcagccacttacttcctgctgtaagtttgtaatttaccctatgaactttataatattaagaaacaattagatctaaatggatagttgcatataaattaaatttgaaaaatggataggtaacatgttttatggaaaatatattttattttatccgtagtaaagtatggtatttaacaagtattacaaaatatctctaacctagatgtactgttgctacactgaagactatctcaaccatgttgctttagagcgataacaacccaagatcgtcttgacctatttggcactattctattatcatatactacttttttagtcttaaaatatattaacctagtaatagagtacatatctctgtataggcatttcacatgactaacaaaaccgattaaaatgatttttcttcataaggataatgtaacccagtttttacaatgttattttttatataaaaaaaagaaagatgtaggagtccatttaacactaacataaatacctaaatcagcttgagattgcagctcacctagtacaaacacataattagattggagagcaatgcacgcaacataattaacgatgtgtgttcattgtatctatttgtacgtgtacgttgtgctgcaagccaaagcaacccagggaagtccaagcagagtaggcgacaattttggcgccaagcacatggagagggaaacggtttcaactcagccagccaatcagatcacctcgttctgctggtactctaggtggcgatcattaataatccctccgtcctaaaataagtgcagtcatggttttccacgtccaactttaagtgttcgtcttatttaatttttttttaaaaagattaaaaacataagtcacgagtaaagtactattcatgttttatcatcctataacaacaaaaatgctaattataaaaaaatttcaaatatgacggatgattaaaattgagcgcggatactcatggctacgcttattttgggacggatgtagtaatagaaaaagacgacggctaattgattcgtaattcaactcatcagaagaaaaaagatgtagaaatccaacggaataattgaattgctatttacacacacacatcattatcatctaaacacataactaatccctcttacatatatcgtaattgctaaaccatgttcaattgaaaaattgagataaaatcttgcgaatttctaacctttagagtttcacaagatatatatatatactccctctcttttttaaataaataacgtctttaaacacatgtttgatcattcctcctatttaactttttcctacaaatacatcatacttaaactatattttataaaacaactaaaaaataatatttacataaatattttaaagaaagtcaaatatgtataaaaaaaagggacactctgaatctactgtattaactaactatagatcagccggcgtcgtcccgctagtggccaacgccggggctgggcaccgacccgagcatcctgctgctgcgagctccggtggtcgccgccggcggcgacagcggcagaggtggtctcctcgggagcagcatctcctcctccggcggcgaggacgacgccgtgcttcttcttcctgcgacggcggcggcggcggcgccggcagaggatcccatcatcatcgtcacggcctcctgaacaatctccccgccgtctcccggcatcatcctggcttgcaagaacggagccgacgatgtcagcagcaagaagaccaggagcaggacggcggcgacggcggtcatggacgccatggttgtcggtcaagaactcagaattggatcgatcagggctagctatggctgaattcttgtgtaagattgatcaggttgtacagctgaattcttgtgtttggctcgtgcaggagaaggagatagcagagcatatttataggcagaggaagaggaggatgaagaggaggagatgctagtcgttgccccagtgcccgcgaatctagccggcatttcgattgttttgccacgtcattatggtcccgtttgagttcactgaatataaagatttttttacgaacacataaaacgagaaaatcgttaatgtacgactaattaacttctagttattataaaattaaaaatagatttaactgatattttgaaaagtaacttctacataaattttttatatgaaatataccgtgtagtagttcaaatatcgtgacaacaaaataccgaggtaaaaggtttatcttaattagaaacagagctatgctaattgattaggctatgtttggcaacctgggttaggaacccatgtgctgcgcacggaaaacagagcaatctattaatatgtgattaattaagtattagcttcttttaaaaaaaagggatcaatatgatttttatgcaattttcgtatataaacttttagaaaaacatattgtttaacaaattgaaaacgtgtacaaggaaaacgagagaagtgagttgaaaaaagaggggaagaacatagcctaaagactattagaccctgacttgttaacccaaaaatcatgcaaaggaatagcaagtacgcctcggctctattagacggaccctgacttgttaaccaccgtcctcgtcaaaaactagtgcttagtactaccccctacgtgtgcgacaatggtgcgtccccgtagaacaggggaatcgagtcaaacgagaggggctagagtacaaaatgtactaagatgctactgtgtaggaaaaggaaaacgagggggaatgcgattcaaatccgatggaaatattgaaaccgtgccggaattgaaatttggagttcggtcgccgtcgccgccgcctgcctgccggccggacggacggcgagtttaattgccggcgtatttggaaacttcctcgacagagatcgagagtcagaggaagcttctagttctgcaagttgcaggtggctgtgcctagttgctttcagggtatatttatttctgtttggcaagctaatacccagggcgaacacatgataaaaattgacccgggtcatctagtgcatgtatattgtactcgtagctatatcgagtgacgtggtgcatacatattgtactcatagctatatcaagtgacgtggtggtgagtaaggaggggattacgtcgaatcacaacttgatagctaatggggggttttaggatttaggcacaccaagtaagaactagccgactagaatgtggcggtagatatcggccacaacgtacgacgtcacctagtggacagcgagatacactgctgttgtcggacagagagtattggaaggaagtaccaaggtcgctagcatccatgagtggcaactcctccggcggccactcgttagacacgctgctcctcctctcgaaggtgatggctggctgcatggaagcgcaagaatttttcggtgagtgtaggacgacgcatcaatttctcgcttcccatcctgatttgttgttgattgtaaattagatcgagaggattgggagcgaatggttcgagtattggtagtgacacctcaatgcatgtacaaagattgcgagaaaagtaacgagtaaaaattgattgggatcctaaaccccattggctatatggtaaatccgtctatgatattacctgctttctccgttttttaaaaaaaacaaccttatattaagatgtgatatattcgttatattagaatgtggcaacaagatttttttattggagggagtaactctaatgctagcttaattaactactgtagctgattacctgatcatccagtcagggttgatgaattaatgaatgaaacgcatgcataccgggttgattgcaattggtcgtacgcaaggaataggtttaaatactttcttgaatttttacgttttacttttctgtttcacaatgtaagtcattctagtatttccacattcatattaatgttaatggatctaaatagatatatatgtctagattcattaccatcaatataaatgtggaaaatactagaataacttacattatgaaacggaggaagtagataataacacgatcttcaaaataacgttattgactatatttttttatatataaatttatttctattgtagtaatttgcaagacaactctatatatgttgttatagtgcctttaaattaaatatttttaaagatgttgatagttaaaattataaaagtttaattgactatggaacgggatggtgtaggtcccaactggcaggggaaaaccaacatcacaacatgcatgcatgcatgttaccgacatgaattcttgtgttaaggatgttgctggaagttagaatgctagctaactacttctcaggtcctggctttatggattagtcgtattcaagcaatcaaaatagcttctgcattattggcccactatgctctatgctgatctatcgtactactagctagtactgtattaaagatttaaaggtggtaacactctcaggggtgaaagtcattttctcaacaaatgcttcaggaaaacggcgctcgctacttgctaacctaacacatctgatactatatcctactgttcagggatcagtgtatccgtatgatgtttcagtaaacaatccagtattccagtgggtcactagctaaactacatgtcacaagttggtatatatttgtgacacatatgctcactatatgctgctgatgatttcttagctcattcatattgcatcaaccatatatagtattaccaactaaggctctaatcagccaaagaaaaagccaaattttaaatttttaagcttaattttgatattgattttgagatattttcaacgtagtttctttttcaatattagcttttaagtcaccaagaacacatttataaaagtttcacctacaaatttatttttatttcctaataagtcgttttgacttattagaaaataagccaaacgatgagtacctaaactatcttatgatgagctaattagagataatcactcaggaaatgatgtacgtgttttgtctgatctgctgtgtcaggggcaaagagtggctcttccttccaagccaagcctcccttagtacttacttctccgttctaaaatgtaattacctagtataagatgtgacattacctacttcatccgtctaaaaaaactcaacctaccctcctaggttgagttttttttggacggagggagtagtaatacgaatctgaagtgttctgtccagattcatagtcctaggtaatatcacatcttgtattagatagctatattttgatacggagtaagtatcttatattctctcaagagactccaaggagaaatgccacagatgaaccaaccaactaacctcatgctgttgcagtggcgcctcggagacatactccttctgcatcagccatctgaaaacatatacatgcaatttatacataaaaatgcagtggcttgtgttgctcaactgtgcatggagaattggactcttggaacttggaaggaatccaggagggtgtgtatcagtccatcttgttgctgttccttcctgccaatgcttctctagaaagaactttatttgatttagattattgaacagattaaacttggttatagaaataaattagatattttaagaactaaacttaaactaaataagaccgacagcaaaagggaacagctgaactgaagaacagagttgcaacttcgcaccattttatctccactttatagatccgaaaataaacacagctctcgtactgtcttttaactaacatattcgcgtcaagattatgcgtcgacgtccaaatattcaacttcacttttgcctataaaagtaggatgagcatatcatcagatcactaatatataaatgcgtttcatccaatagcaataaaacgacgcacgactggggctcattcaagtcaaaatctgcggaaaaagttgcagtttggcatgttgttgagagctgtagcgatcgacccggagaaattctgcacaaggaattaaggcctgtttattttgtgaaatgaaaatttttggtgccacgtcagacgtttgaccagatgttggaagaagttttcggacacgaatgaaaaaactattttcacaactcgcatgtaaaccacgagacgaatcctttgagcctaattaagccatcattagcacatgtgggttactgtaatacttatggttaatcatggactaattagattcaaaagattcgtctcgcgatttacatgcaaactgtgcaattattttttctttatctatatttaatgcttaatacatgtattcaaagattcgatgtgatgtttttacgaaaagtttttgaaactaaacagggcctaaaggcttgaatagttgaattgatttagttgttatcagctgatcggcgcatctaatgctaagtagcactgtagcagccggtgcagggcaatgtgctgtttatttcttctccggttcctgaacctgccctgatccccggtcgagtctgatgtggcgccacctcttcgcctcggacaaatctttccaagcatttttattcgtgttcatgtcctttcgatcatatttatacctacgtgaatcagtttattttaaaatagagggagtaatcttagtcggtgatgcactgattagtaagtaggcacctaggccaactagttagaggatccaatatagtagccgtaaaaatattttccacggaatagatacgctactccttctggatcaaaataaaatgacacatctaattgatcgagggttgtttgagggagtttttggtagctgcaacttctcctagcattaagagctctctcaaactgttaaatatgtgatctgaattttgggaccacaatatattcggatttgttttctagtaggagtttctattaggtgtctttcttttatcccctatatatactcttgtaagccgtacgggaaggggtgacgtttccattgtgattcccttagtttgtaatcatctcctctatagtgattattgccggtcggcgcccatagttttttcccgcaagaatttttcatataaaaatttgtgtttccgttgtgcatctattttcataacacaaacaatctattttttcatctagatttttagaagatgtggttataaatccgtaaaatgatgtgtttttcagcttttctaaattattagaagttaaatactaatcgattttcctaagaattttgaactccaaacaacacttaaatcacatactaaagccgactagaccgactttaactgattaatcggtgaaaaccgactaatccacagattaccttttgattagggcggtctacccatgtctatcaagtatcaactggccattgactcgtaggtcgaccagtcaattgagccagtacactcgctttcgtcaattgagccagggttgggagagttcatttgcgggtgcacgtgcagtgcagtcttttcgaatttcgagtgattgaaaaagaaaaacacacacaaccaaatgagagaaacctaagtgtacaaattcgtgagaattctgtggtgtttgaatctcctaagaatgaagacgaagtttaaatgtttcacgtaaaacgatgtagtaataacatgtaattaattaaattttaactattacaaatttaaaaaatggattaatctgatattttagaacaaatttcatataaaaagttttcgcacgaaacactccgtttagcggtttgaaaaacgtggtacgaatatccaaaaattaatacatcctttccagaggaaacgaacagggccgaagactgcacgttccatgggcttcacggcattaggctagtaacaaaataccggcccatctacgtgaatgggccctggagttcagtataccggcccattcgtgtacatgggcttcgatctaggcccatccaaactaggccatacggattttgatcggacggttcagatcacaccagatttcttccccgtctccgtcacccgaaccctctcaacccatggcactctccgccgctcgccggctctcctccgccgccggcggcgacgccgcgcggcctgggacgctctcttccctcttcgcgcctcgaagctctccgaagcctcgcgccccgcggccggagcccggggatgggccaccgcaggagcggaggaagccgagggcgaggccgaggccgaggtcgaggcagccgtggggggaggaggcggcggcgctgctccggaggttctacgacggcgggtacctcccggggcctgacttgtcggtggcgccgcacgtcttgtcccccgacgtcgtcaagggcgcggccgagcggttcggtcatgatcaccaggtcgtcgccaagtgagtgccgcctctccgattgctttgttccctttgcgctctatataagttgtatgatttagctacatcagatggatgccactaaattaccatgaaacactagattttgtgagtttaattcggaatgcctgtattttttttctgttgcatctctgaacaatatgtcgacagtggaagtatgacggtcgttaagtatcgatttcgaccgtcaattatctcaataaataaaaataggactaacatttcttacacgtacattagtttcaaataatgtacttcctccatatttcacaatgtaagactttctagcattacctaaattcatatagatgctaataaatctggacacatatacaaaacatatatagtgatcaacggatacatctagataagtccaaaaagtcttacaatataaaacggagggagtatgttggtagcaagtttggtctaaactctggatatggtgggtgaattcattgcgtttctgatttcgttaacctgggagaagatgtggtaatgtggccttatagaagagaacaagtgaacagctaccctggggaattaccaatgtctaggtcttcttcaatttggaaatgaagagcttagtttgtggcaatgagttttaccatgtaattggttctgcttccttgtttcaaatcttgactttctggattgtggtatgccgtatgcattgtgctgatgctgctgtatgttttgcagtggattctaacaatgaactgcattcctttttttttcctcttacactttggaaactggttaattgccacctacagtgggggagctatcagtcctgagcagattttataggttgaacacaaaactatactaaaaaaaatcatgaattaaccgtttacttatctgaaactcttccatttaactttccgtgctctgaaatgctgtgtttcaagattaatagtgattccaggcataatacatccttgtgaacaacactgatcatgctccctgtccctgcatatgctacatgagctggccatgcttgatattttgttgaacagttcctttggtcttttatgtttgattttaatattctttggtagtagtatgtaaggcaaaaaaataagttgaaaataacattgaagaactatctttatcacccaatttctccgctgttgaagctgaaccttgtgtgtgcactgtagatggttatctggaagtgacttgaagaaggttgcgttgtttggttgtccatctgttgagcgaagaacagtttttgcatcaaaaagactacgagctttctttaaaatccaggaagctaaagtaggtatcatgtaattgtcaatttaatcctatgcgagaattacttctgtcaaaacatgcttgaggttaacgttttgctcgttgtcctccttcagatatgcggctcttgtaagatgagaaattcatgccagtttgttaaccaggaagtatctaggcatgataaagtgatcctgtcagatactatgagaattcttactttattcgtcctggatacatgtcctcagcaactcaaggttactcctgaattgaaagctagcatttgcaagcttgtcaaggacaccataaacctaagccaataattactaagcagatcatttgtaactgtagaaggtacttgaagtataccaggtagacaagcattcatgtttcgtacattttatttacttgatactatgtgacaaggtctaaaacataattataacatgtttttttttctggtgcttttgccagagaggtgaccaaatttatttggatcaaatggatgaagctcatattttgtttgcaaatactacctgaaggttagagcgctgacctcgcatatttatattgtgtgtaacttctgttgaggcaggggtatgtgaacctgactgagtagcaattgacgatagctgtaaactgccaagctcatactgtttgaatacattatttgattcctttaagtcagttctgcatatttatgaggttccttgtctcttaagtatcttgtgtcagcttgacgagagatactccatagatttttctaagctcctttgctttcagaagccattgtctgtttcaatgaccttataaatatttatgaagccattgtttcaatgaccttatatcaaggaaaacataaggatatcttgtttcctgtttcctgtgatttgttattttgctgtgaactcgtaaaagtttacataacgccgtaccatgatatccttttttctttaaacatcaccaacgcttccacattccaacacatgtatcacataccatctgattacttgttttttgcacttaagcaactcaacctgattgcaccgcagaagcagatgcgctgaagctaagatgcagtggttcacccaggaatcttgcatcagtcagactccccatgtgatgttgtttagctagctgtaaaccatttagtttggacaaggtaccgtacccctatcactcaatctaactcttactctttctttaataacctgttcctttcgtgattagaaaaagatcagccaatgtatgcccttagccggcaatgcatctgccttcaggttttgttggccatattatattcgaagcactatggttcatgtgcccctgaagctccaattggcatggatccccttatcctatcagcgcatgctaacttggtaaaatatgatgcagtagaaaaagggaggcccttttcagaccaatgccccgtcactttctacctttaccttgtagccacgagcttttcttctccttcatatgatggagattcttgtgctgtattcttgtccaaccatggaacactgggtctttagcaaccattgtcacgtagtgatgtagtcgacaggatcaagagttcgttttcagactgactggaaacactgatctttggtgtgttgtgcagggagaggaacagtttggcttcagactaactggactgcttctctgcatggcacctctcttgtagaataatccaggatagctggtctcctgaggcgaggtcggtaggtcacttcatctatgtgataatgtgaacccttccatattgccgcctgatgagaactgaatcttctacggaagtgatgctctactctctactctgtttttttttccttttggtttcttttccctaatctcttggacagttcagttttgatggattcttctggcctcgtgttgatgatcaaagtattcaagtcgtcgtctcgtgctgatggctgcttgcttgattttaaacttcggctgaaactcggagcctctttcacatttgtccggtcagcgattgcttttcttctctcccccggtttgccgcttgcatggtagtgcctgccactagtaatctaatagcataggtcttcttgttaacttctctcacataataagtcaagtagtagtacttcagttaagcaagattgatcatgtcagaaagcatgctatttgaacgttttgaaaggttgaatcacaggagcgtgatgcatgcatctcactgatgcagcagagaatcaggttatgtaattttttattctcctggaagaagtgtagaaaagtccacaatccttcagttttgatcgtaatcaatctaccatcaagcttctaaaaaaattgtatcatcaagtggagccctctattaagctggctggttggattaattagaagtgcatgttgacaaggcggcagagtattcagctggagaaatcctttgtgtacgcaagtaggacgttttttttcccctctttttgagggaaagacgcaagtatgttttctcgttgcctcttctatcgaatcacgggaaaattaattcgggtctaaaagctcattctgcctgtttgaaacttgaaaaaaagagaaaatgtactggtttctaaaagaattgaattaattttgttccgtgaaacttttccagagtcatgtgaaatgaactgtttttcctggtggagttgaattcagtaatactagaaaattagcgcgccaagtggcgcgctcattatagcccttgtgtacttgctaagtagtttccaaaattcatgtctataaaaggttggtaaatgaaatattcaatggtgttattaaccgatgcaacaagttaagctaaattagcttccatggcacttatgctaaaaaaaagtaactattacactttaagaacaatcatcaaaaactggacagaaccatagataaatatatatttacatgaattcactaagataaaaaagtctgatactaccacagttgtatacaatcttttttttttaaagaatacagtcgtttccggtctagcttctaggtacggcacaaagaagaaacacaacaatgtagttacacaaaaaatttttagaaccatagtctttcacatattttaaatccggaggtcatgatttcgagcaccttgtaggtggcaacaatttatatctttggtatcttgcatatccctagaaatataaggaggtgaacacaaattagttggacctatactgactatagaaggagatcaatagcaagagacaaggttaagccagattgttctggtgggttagtggcacagcagcaaaagctatcagagacatggcagtaaaactatgactattttttttagattgaaacagcagttccagatctaaaggaaaactattgttagttcttattatgggtgcattcaacatccacccaacaaaacaaaaaggatgggggagagggatacagagaaaaaaaatctctttaggaaatattttatctttatatatttgtcagataatcgcaaaaatacatgttcagataacactatattttttccatatatagagaatgtggatagaaatataacaagctcatgatgtattaacttaagaatgtggtcatcatgaacagttgcaatcgatcgcaacttcaaaatttctgaagtaatactcaggacaatcccttgaatagaacacttgcaagttgcaatgagcacactaaccaattatgatgcaaatgttagtaaattgcgccacttttatagatcattttcttttgtcaggaggagaagtactctcgaaataaactactgagcaggattgagaccaaagaaaaaactatgtatcaatgcagaattattttcatgattataaatgttattagaaagggtattcagaaaaaaaaaatcaaacttgagttttgtcaagaaccattcctgattatgttcttctagcgcattaatatttctgttccaaattatgctaactgtatatatactaatagctctaactcatgtataattcgattgctgctacgatggaatcagtaatacataacttaactgattagtaatccatataagagtttcataacttagcatcaaattctgcaatttctagttgtgtttctcctggatttctgcagaagtagtatagtagcaacagagcaattaatacactatccaacaaaatagtcctaactgtgctatcaaatgcaactctaagaaagaacaagatatattctttcttggtcatttcatcgaacaccatgaatgcacagttcgcactacaaatcagcaaccacacgttcaggaaaataaattgaagaaacattacactgtagcttgctcaccactaccggccatggcgacgaccgataagcgcgctctgctgaccgccgagaacggccatggcggcggcggtccagtcgccgtgtcgttcaacaccaatgccatcgtcctgctcgccctcctcgtctgcggcctcggcgcggtcgcgctccacgtcgtcctccagtgcacgcttcacgtcacgtcgtaggctgggatccctgtcgttggctcgccggcgccgttaccgggagcgggaggcgtcgagatgagatcgattagaaggggaagaggcatgaggtcgatcgacccttcaggagaggacgagaggctaacttttttgcattttactccttcgctagatcatattttacattttagcccttcgcgggaagagcgtatacacgaaccacgcagcgccacgtggcctcgctaatcgcacgctaatttgcatagatttcgataaatagagatggcttttgcccttgaacttatctggagtgctgctaggataaataaaaacttatattttctgccacgctatattatgttggtgttcttctataaggtcttgttcggttaatcccggtgagacctcttcaatcccctttaaaccgaataaggcctaatgaagatgaagatatgatcacaaagttaaggcgcgcaaaacaatgattcaatgaagatattagcacatgattaattaattttatattactataaacttgaaaaataaattcatttatattctaaagcaacttttatatttatatctagaatttttttgcaacatactccctctatcccataaaaatcaacttaataccggatgtgacacatccgattttagattcgtattttatgggacaaaaagagtagcgtttagcagtttaaatagcgtgttaatgaaaatcgagagaaaatctatatcttaatcgaaaataattccacgtaaaccgtcgacgcttacacacttaattatctcatgccaggaaaagtcgctctccagtaggtgacaccccaactagggccaccactaagctgtcacccatgcatatgtaaacgcatgctttaattaaccccgtatattatgttcgagcactaagctatttttacctacgttattctcttaatcaatcacaacaattttccttttaattgtgcatctactttctctggttaacatatcacaatatttttataatcatttttaactactttcttaatagctataactatcttaaaaaaaaatatttgtatttggatacggagagagcactatgctatccaaaccacccgttgcatcgtacatgcccagaccagaagccaccagtatgagggtatcagggtcgttgaggtctctcctcctacactacacggctcgtgggggccatgggccgccggggatcacgtggtggcaactggcaaaaaagcccacatcgcgcgtggcgcggaccaatcgccggccctccgtgcggcggggggtcgggtgggggtgggccccgggcccccacgctcacgtgcacgccgcacgccgccccgtaaccgcgttccgctgtccctcacccccgtttccccgtcacctccacgtgggccccacgatccaccacgtgtcgacgccaccccaacccgccgagcacgagcacggaggtcactgacatcctggccccaccccaccctcgcacgccgaggtggggaaggaggaaaaaaaataaaaataatcgcacgcgccaaaattaaaatactggacggagcagtagcacagtactcgacgtccgagcgaaaaaaaaacagagaggcgtgggttgatcgcaaaagcaataggctcctcacgtgtcccgctcgtggggcccaccgcgcatgggtgcccacgtgcagcgtcgttgacgtggaccgagccgaggggggtggggcccaccccggcggagggagagagacacgcttcgtggggggtgccccccacgcacaccctagtggctagtggtgtggggtggtggtgcgaaatgacgagactacccctggcggggttagagcagacgcggcgccgcggtggtggcatgcgcgtaaataagcggagatcgaggggtaatacggtggcgaggcaacccccggtgctttgtcaaagctcacgccactgcggcctccactacccacccacaacctcctccccctcctccgcctccgcctccgcgtgatctcttctcgcttcacgcttctctcctcctctccgcggcggcgagagcaagggcgaggcgggcggcgaggtgagaaggtgggggtttgggttggtatggcgacgggaggaggaggaggagggggagggatggggggaggaggt

SEQ ID NO: 38982 - DNA, 6893 bp, Oryza sativa
agggaggatgccgacgtggagggagcgggagaacaacaagcggagggagcggcggcgtcgcgcgatcgccgccaagatttttgccggcctccgcgcccacggcggctacaagctccccaagcactgcgacaacaacgaggtcctcaaggccctctgcaacgaggccggctgggtcgtcgagcccgacggcaccacctaccgcaaggtacccccagatctcccccctcccctcccctctccgccccaccggatccgccgcgcaggccgccgccgccgcggcgacgatgtgaactgtgattccgtttttttttttttttttttttgcgccgtggagatgcacgtggtggcgactggcaaaggtggggtgaagatgccgccagtctggacccgcgcacgggtgtggtgggtgggtggggcgcgggtggtggaatttccggggggaattttcgcgcggagagcattgcagttcgcggattcgtggaatcctttgctagggcgattgttaccaccactccacccggtgattcccgctttgcttttgtttgcataagcaaaagcggcggatcctggctcctgattggccgatgggatttgtggtggagcgggggatgcatgaactcggggcgtgtgtgtatgtgtggatcggatcggccttatgcttgcgtgatgttgaccttgtctttgcccttggatttggggatagatatgcgcttgtgttaacatagtggttttgtaacgacgattgaccgtgagtatctgctcttcaagactgggcattagcatttgtgttgttgcattagcaagcgttgctaggttgtctcttcagaatttcatggctactgctgatttgctcttctagaactgaaacaatacaattagtactactttcgaatctgctgatgattgtaaattaatgaatcataaggtcatttttagagttgagttgaacaatggggcattggagttgcatgatctataaaagcttggaggttgtttgtgttgttagttcactcaccttgttctgtatcaaatgtgcttgtctgcgtcccaaacatcctgagaaacaatgcatttgacttaatttcagctaattgaataatttgatgaatgattttatttatgtgtaaccgattgtgcctttttccacagggatacaagcctcctgaacgcatggaagtgattgggtgctccgtatcaccaagcccgtgttcctcgtatcaaccaagcccgcgggcatcatacaatgcgagtcctacttcctcctcattccctagcggcgcatcctcccccttccttcctcaccctaacaacatggccaatggtgttgatggtaatcctatcctcccatggcttaaaacactgtccaattctccatcatcaaagaaacatccacagcttcccccactattgattcacggtggttccattagtgcccctgtaactcctccattgagttcaccaactgctcgcactcctcgcatgaagacagattgggatgaatcaaatgtccagcctacgtggactggttcgaacagtccctgcgtggtgaactccacgccgcccagccccggacgcacaatgcttccggacccagcatggttagctggtatccaaatatcatcaacaagtccatcatcaccgacatttagtcttgtgtcatcaaatccatttagtgtctttaaagacgcgattctggtgggcaacaattcatcgaggatgtgcacgccagggcaaagcggcacatgctcccctgcgattcctggcatggcaccacacccagatattcatatgatggatgcggtttctgatgagtttgcatttggaagcagcacaaacggtggccatcaggcggctggtctggtgagggcgtgggaaggcgagaggatccacgaggactcgggatcggacgacctagagctgactcttggaagctctaggacaagagctgctgcttaacaaaaaaaaaaaaaactaacctggaggcattcttgtctgtagcttatttgttcgtgttcattagtttctgaaagagagaccaatcgtgtggttccttcagatagcttcagttgtgatgataattgtgttatttatgtgaggcacgagctagagagaaagggggctttaattcggccaaacccagctgtgatatggtaatctcagctggctgtaattttaaagccccccctttgttgtgacaaatgtaaattgatgtgagaaatcatgcaaaattcatggagcgttcagctcaacgaagcattcatttgcgttccgtgcacggacagcaaggcatccacatacttttgccgaagcctgctgctttcctcgagctccacggcggcgatggcggtggtggtcgacggcgtctcgccgccgtggtccaaggaggccgtcgtacacctcctgtccggtgagctggtggtggtggtgattgactattgtatcatccttgccaactcgtgcactacagggtcattttcaggcttaattgaacgtgccattcgaagtcagcaaatgcagctgtgagagcacacctgtgccgtccttttccactgccttcaaaaccaaatcttgcccttgaaaagccagaccacacttgtactgtctgttctccgtgtgagcataacagcaggagtggtcgagtacctgatagtagtagtaacaaaaatttttttagaccctgggatttgacttaatcaaatgaagaattcagtagccctgatcacgtaagtattagtgtcacagctcaccaaccctgcctgctgaagaacggcttggaggagacagagacaactagggcaagtggtttgccaaacttgcgcaatgattcgatcaaccgtgttctgattgagtctttggttgaaaggtaatttgcattttcagagggttaatcttgacttgtggtgttcgagaaaccgcccctgatttctgaacatttagtacaagccaagtaattagaaacatattatagaactttagttgtgctgtttgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgtgcttgctcgcctcgcctggcctggcctggcagggcaggcggcgcgcgtgcacgacgtacgcgtcgaatggtccgaaaaattggctcctcacccttgcgcagatgcagcctccttttgcagttttgttttgctgcaaattcggattcgttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcaatatatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcaaccaagcagccggtcttttcgtcacctcggtacgtgttcaatatgttgcgcatatttgatctgttcatgttattctgcgtagtttacatgtgtagatctaatgatgcgttcatactagttttcatctgtaatgtcatgatttattcatggaataaattaaatcattatatgcccataatctcaacactgttgtcttcagtccataagccaagcactagtctccgagctgtctccgagtaggctggactgctgtatatgcatatgaaaagttcgtttgtttttacatggatggtttgtcatgtcctgaaagtctgaatttcatctgttttagtacaaaaaaagagaatgacttgagagttgagatgaattcaattaggtaggaaaaacgtaccagcaagagtatatttgccagattctgattttaaaattcgtgttaatccaacttcagatggctttcgtctttgcacacgcctgcctgcatcaacacactcatggtgctataaaagtctagaacatgatgcagctggcctggactagtctttcactgtctttgtgctctcaattctcaacagattgatagctttgccattgagtcagggagagagatggctgggagagaggatggagcagcagcaggagccatggaagaagggcaagacagcaaggaggtgaagtgtgagagttcagaggatggaagcagcagcagcagcagcagcagatgccatggcaacgacgtgatctccgtccaattcatgcagaaggtacgtatggtgatggtcgttgcgaacttgcgatacacggtctcctggtactaccccgttgccgtacctgaactcgcaaactgaaactctgaacttgacacccgtgtcaaaagcatatggtttctgactttcttctccattccttttcagcagcagtaacacgtttatagtaattccgttggcgattactaccatctgtgactttttgactgtggagtagatttcttcatgtagactaattcagaaacatcattagagattcctagtgactgactgactgactgactaatagggatgaaagcggtcagcctgctatcccgtataagagcccgaatgctagttcattttcaatccactgctacaaaaattagatgcaaaaaatacagttacagttgtggtttaggggacaacaagcctgcaagcccgccctgctttcatcgatccctactgagtagtactggctaaccgttgctctgaatattttcgcaaactgaaactctgaacttgacatccatatgcgactaattccactggggattactgtcatatgtgactttgtgagtgttcatttcttcatgaagactactaactcagaaatggcattagactattagagagggaaatatacggtggaaatcatatatctagtagaaacctgaaaattaccgttggattgaaaaataaacgtttgagattcgtccacatcatcaagagtaaaaattttactcctaggtttactcatgagtaaaaattttactggacgtgaatgaatttcagacatccattttctaatccaacggtagtttttatgtttctacaacatacgtggtttgcgctacatattttccatattagagattactcgcctgaccaactgtaactatgattgatccttctagatcaaattttcaacgaacattgattgctgacacagatccatggtgcatgtgcatgaacaaaaacctgctgattcttgcggaaattctggggacatatttcatgatattcgccgggtgcggcgccgtggtggtgaaccagagcaccggcggcgcggtgacgttcccggggatctgcgccgtgtgggggctcgtcgtcatggtgctagtctacactgtcagccacatctccggtgcccacttcaaccccgccgtcaccgtcgccttcgccacgtgcggacgcttccggtggaagcaggtaacaaagcattttcttggatctgaaaatgacatcccaaccaacgacaatttttttccagctttctgtagcacaaacggagttatcagtggcactgtagactgtccgacaaaaacagatttttggtttcatggttcgcttattggctgaccagccgcatccaaaatttaaattcaaaaaagttgatttaaaggtttttgttatatacgtgtgtataaaaaatatacagtatacaaagtttgtatacgtgtatataaagtttgtatacatatatagtattaagaaataaaaaaccaagaaaagaaaaaaaagggaaagaaaaaaaggaaaagaaacgaaaaaaaagaaggaaaacaggaaaaccatatgtgggaatcagatctactgtttttttccattgcataggaatcggacagcatgtttttttgtcgttgtttttccccatttttaagggaaccggatctacgattttttttgtttttttcgctattttttttctcaaactctttttttttgcttttccctgtttttaaggggaatcggacttcttttttttcggtttttttcgctattttttttatttagacggacggaggaaacactttgtattttttaagtagtagagatagagaagagatatatttttttaaaaaaagtaaagtagtataagtagaagagaagattacggacaagaaatttttttagggagtcgtagcttttctctaggagtcggacctttttttttctttttttcatggtagaagttttttctcctttttttctcgctttttttctccaccggggagttggacgttttttttttgccgattgattttttttcctccttttttgtttttctcgcttttttttttccaaacggacgacggaaatttcttttattttttaaatagtagtagatagaagatagataatatttcttttctcctttaacattggcttttagattgtaaagaacatggatgtaaaagtttttaactgtcaattaaaaacgagaattggaaggagagacattttgctccaaacattttctaagaaggaattgtgatctcgttgattgaaaaccacacacaccacttaacgctgtactattaagtacatctctttctacccgtcaattatttgtggttgcttccttcaatttttccaggg

SEQ ID NO: 38983 - DNA, 14534 bp, Oryza sativa
ttcctcatgttcgtcgtctccggcgtcgccacggacaacagagcagtataagatcgaacaccaaaactaacaaattaactatatatatatgcatgatgatcgatgataattttgtggtgtacaacacagatcggtgaattggctgggctcgctgtcggtgcgacggtcgcggtgaacgtgctcttcgcagggtatgtgttgaagtaaatcataaaatttcacagttaactacgtgctgttgatgccgcattagtagtagttgttcggtattctttttcgtttatgcttatacttatcagccagtttgaatttttaaaattaaatttgaaactaattttgtgaatttttttcatcaaagtttatttttcagcctttacttttaaagcgctaaaaacctgtatataaaagttttattcacaaattatcttttttttataaacacgtcgtttgatttattccacgaataagctaaacgatgaggcccctcattgttgttgttgctgctgctgctacagtgtgtattgcattgggggtttaatttgcaggccggtgacgggggcgtcgatgaacccggctcggagccttggtccggcgatggtggcggggaggtacggcggcgtgtgggtgtacgtggcggcgccggtgagcgggacggtgtgcggcgcgtgggcgtacaacctgctccgcttcaccgacaagccgctgcgtgacatcgccaacaccgcctccttcctcaggaggagctcgcgtaggagttagtgatagatatatagacagaattgaagccgttctgtctctcgaatttgcagcaaaaatccaatcaccgtgatgctaatgtttttcatgcccgttgcaagtgtaaatgtgtaattaacggcccaggcaggcaggcaggcggaccggcccatccttcggttgatttggtgaaatttgggccgaggcggaatgaagtatcgggccgtgatgtcagagatgcggtgggcccatagtgggctgcgcgagcggctagtggggtcgtcgtgcacgtacgtcggttacacgattctcttttctttttatttttaccgaactaggtaaaaacccagaagttgcaacgaatattataaaagaaaaaaaaatacagtatagtcggtcgattagatatataatgtcatcttcaaaggcagccatactaaaatatgctgctatgctggtggatcatctattcttatcctcttcatatatttccacaagttatatggtcggacaatacaacgttgaacacttctaattcacctgacacccacatatatatttgtgtgtgaaaccccttgcaatttctagagttaacaattctcttattcattcatgtgttgtggggcttatggcccccacatgttagtttgtggtattaaaggcagactcgaataccacactagcatcacttaaagcagtatatatacaccaaaacatacatatactacactcggacatataagaatatataataatacatcatttgacacgatctcgaagatacaaaaatcaacggtagattcatatcatcattgaattctattaaaaacgcacccacgtgcaaaacataataactttggttggaggttcccagtagaattcaataattaatgcgtctttgttttgtgtggatatttattagcttgtgttttctttagctttgctggtgtattttttaaaacttgttttttatgctagtttgtgtgaatttgtataataattggctgtagctccttgagcaaaggctgagattttattccattatctaaaaaatgcaaaacataattgtgagcataagaatcttaaacctggttggtggtggagtcactccatcaacgtaccaatggtgcttcctctacacattttttttctttttctaacttgatgatcggatagattatagatactagatagataccccgcgctttgctgagtgatatttttattctaccaaacagtatttggtatacattgaagtgttattcttgctttgaatgaggaaataatatggaaaagagacatgaatgattaatctaaatggactacatgaaaacttgatagccaaaaaaggcacattcagaattatacatacagttgatctcaaagaaaacaaaaacaaaatcaccttcaattgagatcgatgtacatacagtgagatgtcagtgctgtagccacttgtaattatgaattagaacttgcgcagtgtgcaaaaaaagttatctgaggctaaattagaaaaataaagatcagacataatttgaaacaaagtaggatatattatgaaaatagatgcacaatggagacacgatttttacgtggaaaacccttataggaaaaaaccacgggcgctgaccaacaataatcactatagaggagttggatacaaatgcggggaatacattgggctgttgcacccttcttgtgcggcttacgagggatatatataggagaaatatatgaatcctagtggggaaagatttaagagtcatactagtaaactaatcataatagtcaagttctattagtaaacttatccgaatatattgcaggcctaaatttcggatcacatatttaacaaaatctccaccttgatacgaatttcccaacataaaaatcttcaatctccaaacaacctcacatatgagataaaatcactgcgcggcaaatagcctccatgactatactgtatcaccctcgatccagaagaggtagactatacttcaaactcgccattgggaataaatcctgaatctgctagtataaaccggtgtgaacctagcagagatgcaaaattgatgcacaaactttaaactcaccatgggaataaaatcttgaatttgctggcatgaatttctgtaatcctagcagaaacgcgaaactcttgtgctcaaaacggagtacttagatcttcttattaaccttctgatacactgggcaaacggacgtagcaattccgccgaaaatttgaccaccctcatgtgatttggacaggaaccttccaactccctctcgatgatttcgcttgtgtgtcctgaaacatgtatgcgcaactgatagattggtgcacgacagtattagcatctcctcatcccgcttcaaatcatcacttgccataatgagaatttgtatctcaatcttgaaacggtagatcaaatttcaaactcgtcttgggaataaaatcataaatctgccagtataattcgttgaatcttagcagaaacgcgaaacaccctagatgcataaaacgaagtattttgatctctgtgcagaacctggtagacttggctttgtgaacatggcaattgaattgattccctagtatacacaagcttgggtgcgtataacaatttcccctccgaaaaaatcagactagacaggagctctcggttaattttgccccgggaatcgtgcgtgattagatggcctcctgcttttcttgcgctgctctttctgcgatggctgtgcagcggctactgctcctttttcctgtgcaggaggacggcgacgactcggacttgccgaacctgccgattagtagggctgtgtttacatccgagggtaaaattttctggcatatcacatcggatacacggatatactcctccattttttaatatataatgccgttgactttttctcgcatgtttaaccattcgtcttatttaaaaaaattacgtaattataatttattttgttatgagttgttttatcacttatagtgctttaagtgtgatttatatcttatacatttgcataatttttttgaataaaacgaatggtcaaacatgtgagaaaaagtcaacagcgtcatctattaaaaaacggaggtagtatatttgaaatattaagtgaagtttaataataaaataaattacagattccgtctgtaaactgcgagacgaatttattaaacctaattaatctgtcattagtaaatgttactgtagcaccacattgtcaaatcatggagcaattaggcttaaaaaattcgtctcgcaatttacacgcaatctgtgtaattagttatttttttcgtcgatgtgacagggtgaaaatttttggggtgagatctaaacagggcctagattgattcttcaatcgggagaaacacgccggccgccaggactagtagatctaatcttcaatgctttaataccacttgttataaaaattgatgtacaatggagacacgaattttacgtgaaaaacccttacgggaaaaaatcacgggtgtcgaccgacaatgatcactatagaggagttggatataaacgcagaggatacattgggctatcgcaccctccctgtacggcttacaaggaatatatatatgggagaaatctattgagttttagtggggaaagacttaaaacatatttaacaagatagatttatgccgaaatataaagttgaatgcaaagtctcgtacccacaaatctatcctaacaaaatattgttctatacaatctggcatcgctgcaacctaagcaagttaaaaatagggtgaatagccagttcagtccttcaacttttgctcagaggtcgaattagtacttcatgttttataatgtccaaataggaccctaaagattatcatgcggcttaatatagtccttagacccacttaaaacgccacatggacatgccacgtcatttgtgcatgtaagataacatttaaatgtccattttaaccttcaattttctatcataaaacaaaaaatgttaattttttttatctatcaatgctacatatttttgccaatggtcaaaagctttttttttgtgttttctcaatagtttttctttatttcctatgaaaacataagggtataaaggacatttaaatattgaatttacatgcatagatgatgtggcatgtacacatggcatgtttagagggtctaaggaccatattgaatcacacaatgaatttaaggtacttgtttggacaatacgaaatgtcagggactaaattgatccttaagtaaaagttcaaggatcatgttgggtattcacccttaaaaatacataatctaaataattttccagcatgaagcttggatgaacagaaaactgcgggatgtatactttgtacttcagattcatatatgcaccaaaaatattgatatcttgagctcataattatagttaggaatccatgcgttaaccaaaacaaaacattagcagtaaacagaaggaccatagaaattcgagagaaaagggaaggggagataagtaaataattacctgtgcttgccgtcaatgatcgattaaacagggttgaacaacgaaactaagccaataagattgaattgtaggctacgtttctcagagtaggaccctaaagtaatctaatatctcactttgtggagcaactgtgcgcaggatgtactagtagcaagcctacagaaggagaaagagcaccatggcaagatggtccaaaaaagtatgcaggcaacatgcaacaaatagtctcatcaaataagtaattctatgaaaaatatttgaaggggtctgctttacctcatagtgcagcgacaaacacttttattggctaatcagacagttggattttttttccgtaagaaacattatacatttttatcgaactaagaaatttttgatatttgacggacaatttcagaaagaaatccgaaaccaatctgtagcattaataatggttaataacggtttagtttccaattttttttctcaaaaacgtcacatcgaatatttggacatatgcatggagcattaaatatagataaaaattaaacaaaaatttattgcacagtttgcatggaaatcgcgagacgaatcttttgagcctaattagtccatgattagccataagtgctacagtaactcacatgtgctaatgatcggcttaattaggctcaaaagatttgtctcgtggtttccatgcgaactatgaaattagttttttcattcgtgtccgaaaacctcttccgacatccagtcaaacattcgatgtgataacaaaaaattttctttttgcgaactaaacacaccctaacatacctgatgggaggtttgcaaaatccgagatcaagtaggcgagtaaaaattttgaacaggggctaatcaaattcctgtgcatcactgcaatgatgatcggtggcacttttccctgcttgatcaaatcagttgatgctagagctattacatcctaggcttcaattcaaataacttgatgatatcatggtggaaaccaccttggaaagagagattgaattctctctgttttttttcaacaatgaactgtattctctcataggggaaaacaaattaaatctgcaacttgacgatagaaaatcaataaaataaccttgtcattacggaagagaagcggccagggtaggtagaacatcactcgagccagttgcctattgtcaaatagtatgaacaatgaaaaatgagaaaaatgaaatagaacttggctgcttgtgaggataatgatgacatgcgagagattcatcaagcgatcgatcttctgattgatttcagaaagacgaaacaactgttcgaagctctcaaacatatgcaaaattagttgatctaggcgaggtgccgatcacaacagatcgtggtcggagaatacaatcacgaaggccttcaagatcagatgataaagccaggatgacatgccctttaataactggcatccgttggctctttagtactcccaccgtccctaaatatttgacgtcgttaacctttttttaatatgtttgaccgttcgtcttattcaaaaaaatataagtaattattatttttttctatcatttgagtcgttgttaaatatacttttatgtatacatatagttttacatatttaaaaaaaatgaataagacaaacggtcaaacatgttttaaaaaaatcaacggcgttaaatatttagggatggaggaagtaactggcatccgtttccacttttgcgtgcatcacttgaaggaggcgaccagccacgacgtgggaattcaatggtcagggatgtgggacgccacagtttaatcttccatccagtcaaccatggagatcgccatgtacgtccttataaatgcacacgtccatcttactccaatgagcacctccacgagactggaaacaattaattagctgtaaatacaagcatctcgtgccaagtatatgactttaatttaggtgaataggttccactacaagaaacctaaccatttaagatacgcacacttcgagacgaaaaaactcatatcgatgaattatatattataaagataataacaaataatttagaaaagcactatctgttcaatgcttatgtagaacgtttattaagcatcaatatcttctacaataaaacctttaattatgtgttagctgcccccccccccctcaaagctatcctccatccccgtgcccgatctagcgacgttgctgcgctctcccatcttcatggcccacgaccgacatgctgttgccctagcagcctagctccctctaaattcggcgaacttcccttccacggttccaccctcacccttaccctaactttcaacattgacttgtcagagtttgttgaagcatgtttggacttcgctagagctagaaatcaaaggaggttttagatcacaaacagtgaagcagatatgaaggtcatgaatacaatattttggttggattgttttttctcatatgatgtttagcgaattcaaaaattcttagcaattgttattttcctcatacataagtcttggattgagggtttttttttaaaaaaaaatccacggtccacataggccaccctctagatttgtacacgggtgcgcccctcaccctgaagaattttcttcctgaacttgaagaagagaacctaaaccctcagcaagagttggataaaaattaagatttttgtggcacgcttttcaaactgctaaacggtgtgtttcgtgcgaaaactttctatatgaaagttactctaaaatatcatattaatctatttttcaagtttgtaataattaaaactcaatcaatcatacgttaataccatctcgttttgcataaaaaaaactttatcttcatcttcatcttcaggagaaaagaacaccatcatagctgagccggtggagatcaggaagttggacagagtgacagagagacgattccatgtgcgtcgagttagcgggcgattttattcctgtgtgatgtcgatgtgatgatatgatgcaaaatgcgtttagggatccatggccatggatacatagcgcctcactgttcaagtttgaacggtcttttgtgatgtgcgtacgtgttcatagtgtgtactaatcctagccaatacgtacctagaggagaaatatgtagatggaatattggaattgaagtatcaatagatcacattccttttattttgtactactccataaagccactgctcactccgtagattatacacattctagtatttcgaattagagtttgtctataggtccatggtactgttacgatgtgtttaatttagttataggttactaacttactatattttatgatttatgatttcatgatagagagagtacattattagaccggcctgttcgaacccactggttattcctttagttaattattaggaagggtcaccggcgagcggcggcggccggccgtctgcaagagctagctagctagatagatacgccggctatatacatagctagctatgccgtgacggtggccggaagcggcggccgccggtgccgccctcgggcttgcaggtgaagaaggcggcggcgacgggggcgccgagggcgtggtcgtcggcgaagccgcgggtggagaagttgtggcggagcagcggcggctggtccacgccgccgcgcgccatctgccggaacagcaccaccgccacccggtggatccccgccgctggccgggggctctcgtagcacaccacctcgcgccctgcaatgtgcaatgacatattattaccaatttacctccgtgcaccatatgcacacatatcgccaaatttacttgctgtgcaattgatagtgcatgcatgcagacattcaggcaattaattaacagtactgttagttcgaagatatttgtaagctaattcctatatatatctataaagttcaactccactaagtgtaggtaatactaattctctcttctctcgcgaagccatatcaactcaattgtttttaatctttgaatgattcatcaagggtgtaaattacatctcttcatatcacctcagttgtttttaacttttggatgattcatcataggtgtaaattgcatatctcttccccctaaaaggcacaccatacaatcaatcatttataacttttggataattgataaatataaaaatatatataaacatataaacacttgaaaaaaaattgtatagtaggtaagaaagaaaattttagatatatcacacaattctcccacagcaacgcacgggtacccatctagtttattagggatgatgtacaaggctagcttaactagatatactcccttcgtcctagaataaatttatttttttcctctcatttgttccaaactaagtttattttttaaagtaatcattacatagaagtttgtaaaaatatgaaataaatatattagaagtagataaagagagaaataattgcattattgttatttgataaagtgggggtattcattattttttattttatattgagtgaataatgaatatatattttggggcagaaaagtacaacagaacaatttaaaaagagtattttattttattttatattggtatgtgtgggattaatggtagaggtgaaattgaacgaaagatgattttgattggttaagatgacaaagtaggtgcataaattaaacaagataatatgagtactgatcgtgatgcgggagcagatgccaaaaataacttatattttaaaacaaaatttaaactatataatttgggagggagacactaggaagcacaaactcgagcaaattattgtaataaaaaaagataaattattgcaaacgaaaaagataaattactgtaaaaaggacaattattgcaaacaaaaaggaagataagtactagatgtacgatcgacaaagaaaacgctataaaaagttgaaagttattgtcagggacacgcgagtcctttacatatgcacaactcacaactttcgtattttcagattagctttgctgctgcagcgcggcacctgagtttagcgaaacacggtcatcggctatgtaaagatcaaatatccaattacatggttctatttatgatagttagattcagacttttgctgtatatattcatacagcaaatgatgcattcctgcttatatctataaaggacatttaatttagtatttctaagatcaagataaattaatatactatacactgatgaaacttaatttgcatgataaaaatagttgcaattacaaacagtttagtagtggataaaacatgcatgacagaaatttgctatgacagtattgaataaataactagattgatgagtgtagtatgtgctaccgctaggtgttaagtagggtaatcagggcacttctataaatcagatggttgattttggcatctctacaagaaatacagtatatgcatgatccatttcccattttagcatgcactaacagcatctaacgtactaattgtttgaagatctcatgaccgttttgttttaattgcatattgcattgcatttgatggtaacatatgatatgtagatatattcgatcacgcatctcgcaaacacaaaactgcactaagagatctcatggaaacaaaaaaaaaatgaatgtgcagttatcaactgattcagctgacagtgttaacgaatgtttccccataccatagttcgcatcagttgttccaggaatatctgtcaccaacctgtgcaagcaaacaaactaatggtcaaattccaaataaccatgcttacgtccacgtactgaagttactgatcttcagagtttttcagacatctacatatatgcacgctgcatgcagtacaacaaattaaaaaggacaaataacgatagatatgatagatcgatcgatcaccagtgtaagtactctctcaacgtcggattgcttgggtttggagcatctggatccaccatcaccttaatttgcatgaatcagacatatacacagcaaattaattaatatgtagtcaagaacacagctagcatcatatatacttcaagaaattaaagtaacatatatatactgacgatcgtgtagaactggtggagatcccctccgacctcgacgctgggcctcgccgacaccgccgacggccggaggtcctcgccgttgacgacccgcacgccgttgtacatcacccggagcgtcacctccggcgagaacaggtccaccacgtcgccgatcacccgccccagcaccaggctgttcgccgacgacatctcttcaagctaaataaatcagttgaaactacagagatttcagtatagttaaacaattacccttgaggacgtacaattggattggactctgctcacattatatagaatagatagccaaggctgcgagcgtcatagtcaagaatcgaatgacatcgtcgctgcatccaccttcgaaaaaagatatcttcgatgcatccaaaaaagaatcttattctgatgtatgaagtgctacgtcattccagtgcatgcaagtacgcaatatatatgggccggccggctaactctttacgcatgggccagaattttaactagctctatattcttattaaaacgattttatggagcttgtaaaaaacagcttctacatcatacataggaactcacgatcacaaagttcattttagtgggtaagtgtattggtaagatgaaagtggaacggtatttgtcatatactcccactagtggagaaacccttatttatcccggtttgcaaccccctataatcctgggttgcaaactaggatcaagaattcggtcccgagtgaaataatcgggattaaagatacatagtagttaatatactcccaaatatagaaattaatatgactcaaaatttataccggacatcaacatttccaggccattgattccaatgcacgggaattcaaacatttttgagcaatcatgtgcttacaagaggaatctaagcaatttaaaatttgaacaataagataactaaaaggtttttttttctcgtttaccttaatctttgctaaataacacagaaatacttatatttagaaacagcgggagtaactttcacatgtgaaaatcagattgctaatttattatttttattccaaagaaaagaagccactctcgctctcaagactaaaaattctcacattagataaaaagaaaaagatattaaccgtccaattgtgatatatccaaattataacggtgtaaatatagttgtatataaaatatgatggcatctataaaaacagaagttaagagttctatacaattgtatctatgaaaatatgtgttaagagttgtataccaaatctggtttttctattgtatataaattacaattatatatcaaatgttaagtgttgtatacaaatccacttctacattaatttatctaacctcacacaaagttgtgtgggtcaattcactagttgtatctgatatggattctttattgaataattttacaacttttaaccaaaatatcagttatttctaaattatattttaatgaatactgtagaagggtagtttattacaataagaaagatattacatctcatagatatgatcgattgagataaggttgataagacatccaaaaaaatgaaacaatatatatcccttgtaagccgcatagggagggtgcgacagcccaatgtatcccctgtgtttgtatctaactcttctatagtgatcattgccgaccagtgcccgtggtggatttttcccgtaagggttttccacgtaaaattcgtgtctccgttgtgcatctattttcataacatatcctactttgtttcaaattatgattgatctttatttttctaaattagcctcgataacttagaaaacctaaattcaactacaaaattaagttttaaattcaaattttggatataactatttttttgaacgaattagctatataagaaaccaactagagttcgatgaaaacctgatttgattaattgtcgcaacatatgtaagcaaatgagcagagccataaaatgattatccaattttgataagcaagaactaagaacactactgatttgattaatttatagactgcattttgagaattacaagaaacttcaggaattcgagcagaagaattttgttgaaactcactgaaattggactggttcttgtgaaagttttgtaaaattgctatgttttaaaagaatcttaatttggactaacttacaaattattcaaaaagaaactctgctatgactgcatgtgttgttctatagctatatatctctatgccacaatctctagaagctaagccatctctactctttttttaacagatacatgcagtcacaaagagttcctttttaataatttataagttagcctgagccaatattcctttaaacaatagcaattttatagaactttcacgagaaccagtccaattttagtgaattttcacaaaattcctctgctcgatcgaatgccttagggcctcatggttttccctggttttaaagttgattttgatgttttcaatgtagttttttttcaatattataagtcgctaagaacacatacaaaaagaatttatttttttcaattatttttttatcactaacaaaagttttacttttaaattattttttatcacaaataagctgttaggatccataagcaaaccttaactttctagtaattaacaaaatgtgaaggacggatcgaagacaggaagtctgtcggcactcggctgtcgttaaagaaagtgctggtctttttcaaatgtcacctcggctacctccaaatctactttcactgagctcgcggtgtgatgcacatgctacagtagatgaatcttaaaatatgtacctcagatcgcaggacacagaaacctacgttatcaacaaggttggaggagtcttccgatcgagcgcccaatacccccaaaaaaaaatcgatcgatcaaatgtttcagttaaccaatgagtgaaacatcaagttatatggtgaaacgaaaaactaccaactgaaacatttaaaaattttatgaaacatggtgaagatacacgttgaaacatgttcctatcacatatgaaacaacaaatgttaacggattgaaacatatgtttttctttcatcaaaatataatcatacgatatcttgttgtaaagatttaattacaacaaatacaacggtgtgatcggatcgtagattggataattagtttaggagaaaaatcattttgaagctcgctaaaatacatgcatgcatgcatcgatgaggtggagagagaggagagagtagt

SEQ ID NO: 38984 - DNA, 8449 bp, Oryza sativa
tatgtatgtattgttggagcaaaagaggaagcggtagtacactagttgttagtagtacactggtaccaatcagatatttgttagtagtatactagtacaatcagagcccgatggattggttcaccaattcggggcattctccaacaaggttagctccctcattggttgtcccaaaaaaaaaagcaaaagccaaaaaaaatatattcaacgtagtttcttttttagcattggtttttaagtcgttaagagcacaaatataaaagctttacgcatacattactctctccggactgataatacttgtcgttttagacaagggtgaggtcaaactttaaaatctttgattatgaatcattttaaaaatatttgtctttcaaatatggtgactacaggtatatattagtcttaaaaagtactttaataaaatcgtatatttgttaacacttttatacatattataatagaaaataatggtcaaagttgttttttttagaccgtgatcttgtccaaaacgacaaatattatcaacccgaagggagtattttatagttgttaataagccgttactttataatcagtttaggggcaaccgatgaggtcctaggatgccaactagtgtagaaaaagtgtggctactgtatttcttcctttgtttcatatatttatttttttgaaacagtttaagtatcaatgtatcatgttgcatatagctagaggcattatgcaacttatcaggagtacgctaacatgtacttaaaaagggatagcaaaagcaatactgaagaaaagttttcaaaaaagagagaaagcaataatgaagaaggcaaaaagccaagatgtagtgggcaagtggcaacctacttagcagaaaagtcagggcatgcatcctaggatatctgattgatcaaattatcaaattattcacatggggatagaatatgcaggggcattgttcattggttcatataaaagggacatagcttcacagggttggccagctatataaaccaaaacaacttattagcgaaaaaaatttataggtaaaaaaattatgtgtccttagcaacttaaaaaaacaaatgttgaaaaaaaattacgttgagaacaccctaaattctccaaaattaagtgagacgcacaaaccactactttttataaacaatctttcataagtggtatgccaatgttggcataagtccagtaaagaatggtttgttatcttttgaaacatgtgtggtgtgtgttgtagtcatagcaaccaaacaaacacttgtctaataaaatatgggacacctatcatttaatacggtaaacagtaacagcaaaccaaacagacgaacattttgcgaaagatgagaaatctacacactgatcactgattgggccgggctcgctaggtcttatacagctaatcaaattaaggccactagatgctgcaggtaataattaaaaagaaaattattacgaaacaaaaaggcaggattcctcgggtgctcacatggtaaaggaggaacaaagcgacaaaatctttctggttaaatgtattggagacacaacgtgaatcacagacgaatcaacaagctgaaagacaaaatgtgaatcggcttgacttcagggtggctatagcagttaacaagagcatggtcaacattctactaagtaatggagtctctgctaagtaaataattatctcagtaaaccctcatacaaagcaatgtactctctaatcgtcaaaagaaagctctagctagggagcacaagcacaccaaaaaaatgactttggggaagtttttgtcttgtttagccccttatacactcattaactaaattaggatacatacttatctttatgataattgatagctgcccttctcagaatttggaggttggaaaaacactcttcacgtctttttaacattcttcccttgattattttactactggtattggtaaatagggtttggcctacgattttttaaggagcatttgcattcacaattccaaggaagaaagaggggtagtgttggagcaaataacattattaatcacatattggtatcagcaaagatgccctacctttgtctggagggaccaattactagaaacttctatgtaaaaagtcaaaaaaagggcataccatatagaattttgcagtatcctgctttagatctggagaagtgaacggaataaatgcacctgtgttgcccatcagcatcagaataacgttacgtacttgaacagtgtgattgatcagagtaccaatgaggaagaaaacatgtgcaggggaaatgaaatctgttgtcttttactatgtgaaactaaaaatggaatcagttgccttttactatgtgaaactaactggaataacatagtttgaatccaatggatatgtaagatacaatttagggatgcaaaaatttgagactttagttactaaccataatttcagtaagtactttagacatgaaaaataatatagaaagacattttattcaagagacaggtaaagcaaacaaattgaagtcaccaactgatgcaaacgtcagcttgtgcaaggaaagaaaatggttacaattactaaagcatacctggtagaaacaactaggagcagaaaaactgaataaactttccatcatgtttgatttcatatccttcactttgtggcatcggataacaaggtctgacatgccatcaggcacgttaacactccatcatgtttgatagtagaagacaacatgaaagaaaagaatattatatgcttacatcgtgtaaaaaattaaaaaaagacagaaaaataagatatcagttaagcagttttcaagataagaatgaatgacagtttgtgatggcacctacccagattgtttccatccaaaaacctctttatcgcatcaacaccaaaggaaagaactgcacctcttttgcgtgaacctctctgaagctgaggcttggcacattaaaccagtcacaagagagcccagaaggaatatagcaattatatatattgaagcaagctttgtttccatgtaaatatttttgctcgacattgcagtgattcaaaacagtcagaactcagaactacaagggtggcatatagcatcagatatataatgtttgcagacttggggctatcgtttacatattacataaattcaggttgcagttgatggtgtagcgaattttaacgtgatatccttataatttaagagaatcaaagaaaacacaatcaatccagagcacaactgtttgtgttcataaaagaaaacataagttccactcaagattggacaatgataactagagaactacgtatatgccttatacaggaggctcacataaataaccgatggccttaatgacataaaagatataacttcactccatgaacactaaataaactcccaaaagctacaaactccttacttattacatgagcgcgaggcaggtgacaaatacctcagaaaacagctcaacaaatgtatcgctcagtttggactcagttattcctcaaaaccatatatagttttgttcatgctcttgctttcatggtatcctcatgctaggtagatacctgaagcataaaaaatagccacacaattttataagtaaagcctgtgtatccatttaatttaaatttagctagtaccagtatgtaatggaaaaacacatactagagcaaattaagctagcttcacaccatcaaaataagaaccacacataatacatgttggattgagccaccagaatgcaaaatgtgtaaaaatgacttcaggagaaaatgatcctctgtccagagtctccattgaaaaagtaagggttttctgaagcccattgagctcaaacatatttaaaagatcaaaacaatgaatgaaaaacaagagattagtccaacgaacaaccacaatttaaagtttgagtaatggcgttcctttcatgaggtcaaatctcctactgttttctgtcaaaaaattttcactcggtatgatatataataatataacactctatttgttaccaatcacaccggattatgacattgtcaaatgcatccgagaaattgtaatgtatagagctatattatgaaacccctcaaatgataaaacaaatatccgaccataaatctccacaaactgtaaaaggacaggctctcagggcattcacatcaacaagctggcattgattgaaataagtattgatcttgtaacacaatctggaaggaattgtgtgttcacaaaatgcttcagttaaatatcagcactatattagtgaaagaatggcgagcattcaattcatcttagcacaaaggaaatctagaacctcacttgcctctatttccgtagatatcaggatttcaagatctagggtgtgtttagttccacgtcaaaattgaaaatttgactaaaattggaagtttgaagaaaaaagttggaagtttatatgtgtaggaaagttttgatgtgatggaaaagttggaagtttgaagaaaaagttaggaactaaacaagggcctagttgacaagcgacaagtcgaagagacttaaattttttcaagcactctatgtttgtaattcagagacaggatccctttcacaatcaataaacaaaaaggaggtaactcaatcaactgaaataactcatcagtcggtcagtcccccaccttcacccaaccacaaacatgccagttttttcttcagctggccaaaatggcccctccaattgcttgtcgattcgctaaggcaactagcttaagccatttcatctgcatatctgcgctgaaaaaaaatataggataacagggacgcgatctcagtaatttgggaatacatatctcggatcaaaccatgtcgcggattatgcattcagaaagcgcccgtgtgcgcaactgcgcaccagaactagcggtcagatagggtttaacatccgaggtttagggattaccgacgagctagcggggccaccactatgggcgatcagcgagggtgctcccccggggaaggccggagaagagaggccgcggcggaggcggcgggttttggggattccgtggcgggagtgcggccgcagatcctgatcaccggcacccctctcgcctacgcccaccaccgagcacccccgagcaccgagcgccggggagggaggcggtccgcggcggcggcatggtctccggcgaggcggcgactcaccgacctcgccgacgcggatggccaacatgccggtttttttttctctctttttccctcattttattttgggcctgtacgggctagtgggccgaggatccttgcagtgtacgcttctgctcggttcgacttggtttgcgtgggctgtgtgggctagtgggctgcttagcgtaggcaaggtttgcgtgggcttagtaggcctcggctccttccagagaaggaaaagtgcaccggaggtccctgaacttgtcaccgagatacgaaaacgtcctcgaaccgcaataccaaatatgcggggttctctaactatacaaaaccggtcaccagagatccctcggtggttttgacccgggttttgatttacgtggcggctgagtcagcgtgggacccacgtgggccctacatgtcaggtgtcacgtcacactctctttcccctcttttctcatctctcttttccatctcttcactcgcgccgagcaacgcgaggcgcgatgagctggcgaggtgacggtggtcgcgactccagcggtgaagggtggtggctggcttggagctcagcggggcgaggcaggaggggcagcgcgagctccagaccactccacgcgggggcggctgggatttggcccacttatatgttcaaattttgggtattttaaaaagatatctgtatcttgcatattggcgcttttttataaaaaaaaataggcacgactctctcttctttttttttctttttttttgcagaaggttggagagatggattgttaggtgtcctcctggaaagcacaccagaaatgctgtagtgaaagtgataataaacacgagtcgtgggataaatgacaatgacaaacaggcagaatgtagtttcatttcgcatctttactaatttaaaaataaagtcgtcatcctcctcctacactatcgtagttctcacataaaaaaatgcttttaaacataccacaccaaaaaaaatattaatgtttctacgtaaaatcaacccggaaattaagttggatgaaaaaaaactggaccacataatttagtcgaagccctaatatttgcagtcccaatattacaattttctctataattccagtcacgttgtaatacgtggccatgtcattaatgcacatcaacaacgggtatttaaatttctgtctccatctaattttcgtgtacatatttctttatcttttcgcttatatttatgtttatcggttaaaatttgatttttcaatttaaaatttagagttgattttgagttaacatatatataattttatttataaattattttttgtttgtaaatatattatttggcttagtttgtaggagtatttgcctgcttgttttcagtaactccttttattttattttagccttcaagatttgtcctaaaatataatattttttcatcagtattctcttctcaaccaatcacaattctctatcattcaatttttttacctatctctacttctcaaccaatcacaaccttcttacatttaattttatttattttcttaatacccatgttcagtcttaaaattctttatattctgatacggaggaagttgtatcaaactggagcagtagacggaaaaccacgtatgctcaaattggcttcagcttgccgtacgagtttcagtttggaagtttgagtgatcatctcctacttgtactaataataaataagagtactatgaacgcgattactcggtcaaaacgcaattagctgtcgccaatctcattacgtgccttttcgcaaagtcagaacgaattagtgcgaaacagtcctccataaatagcaaaacagtagtagcgacacaaaaaggcacagatttttttttcaggtgatacgtcaatgatttgtgacagcccaatagcttgcagccaaggccatctccagaattgaagaatactcgaaaaacttctcgtacctaaaattaaactaaaacacttttaatgtcctaaaataactaaaatttagtaattagacataacataatattataaatataattagtggatgtatctaatctaattatctaattatagtttgctattctcctgttttatattataaattgtttggattttttttccgttacacaaactttttacaatctgataaaaattttgtagaaaaattaacaatatttataatatcaaattagttagaacattaaatgtaacattgaataaattttgataagatgtttgttttatgttataaatattgttatattttatataaatttggttgaaactaataaattttggttagagaaaaattcaaagcaacctataatataataaattatataaaaattggagggagtatattttaatatggacgtagtatgtaaaattcctgaattcaaaaaagggccaaaggacatatccggaggcaaactgtatgaaacaaattgatttgcaattttctccactttatttcgttttcttttcactgtccttaatttctattccctccgtctctaaatataagggattttaattagacagccaaaatcacttatatttagggacggaggagagtagtaactaacacaaaacgttacacaaatgcagcattgcagcccctaattaatcagatccaaagctattatatccactaatacagagtaagcgatcacctagtagcaggctagctagccaagtacatcaatttacttcaacggattaccactaattaatctcacactcaaatactcctactacatgtaccaactcgaacattttctctctctttcattttttttctctcattttgttgccgcgcttcttaattagcatctcctccggcgtttcatggtatggtcaccggcggcggcggcggcgaagcaacggaaggggttctccggcgaggagatgtccggcacgaacaccgcgctggcgtcggtggcgccgccaccgtagcgcgggtcccgttgccagtggagccctgacgccgtgggcggcgaggggagctccggcacggcccagtgaacttccggcacctggccgaagaagtcctggccgccgccgccgccgccggcggcggcggcggaggaggaggaggacgacgacgacgacctgccgccgttcggcgagccgtccatgctcccgatcttgccgctgtccgcctgcatgccattggaacgcgccacgttagctcaagctgtgtctcgcaaaatatctcatgccatcgatcgctcagatcagcatgagcgaataatgaggtcataaatagatcgattttttagtag

SEQ ID NO: 38985 - DNA, 16643 bp, Oryza sativa
tttgttcgggaagggaagggaagggaaggaggttagttggtggtggtggtgaggggatgtggcattgcccaagatattattgtcggtctgtctctccgcgggtgtccacggagggaggagctagtatacattctgactgcttcccggggagttttaaaatagagtaaactttacgaatagtgctccctccgtcctataatataatataagggtttttaagtttttactcataatatttaatcactcatcttatttaaaaaaaatttagaattattatttattttttatgatttaatttattatctaaagtactttaaacacaacttttcattttttatatttgcataattttttttaataagacgagtggtcaaacagtacatgaaaaactcaaaatcccttatattatgggacggagggagtactttacatatactcacccttccttaaatatttgacaccgttaactttttttagctcatgtttgactgttcgtcttattcaaaaatttttataaaatatgtaaaattatatgcatacataaatgtttttttttaaaaatgaatcaaatgataggaaaaagattaatattttttcttatttttttaataagacgaacggttaaacatatttaaaaaagtcaacggcatcaaatatttagggacaaaggaagtattactatacatatatatgatttgatcaaattatcgtaaaagttatatatttaaaaagaatatgaatcacaaaatctacatatatagtgtcttatggctgtgtgtcttatgacagaagccgaagatgtaatccatttccattatctaaaaaaaatctacagatatagtgtcgaatttattccagaacagatacagtatcaaatttatcataaaaagaaagaaaggtgctaattaattgctggattatgagatagaaaaatgtggagtctaaaattttaacaagaattttgatagtcttccggtccaaatagaatgtgttatatccatccaaaatctattatattttaggaggggaaagtggatatctgtatttttaatggttaaattggaaccataccattataattttgcaaagtttgagatatgtcatcggtatctcaatgacatttagaacccacatgagtcaatgacatgtgggtcaggatggcatatcttcaattttgcaaaattataatggcatggttccaattttcccatttttgaaatatatattttataatattttcaaataaaataaatacttaatcgttctaaaataaatcaattatgtataggatgtaacatattctgatatagtaataaatctgaatactgtgtgatagtattttaggttgatttattttgggagctgcgtactgtatggcggcacatgggggatgtggggcgcgtgggacttgaattgaccagacaaggatcggggaagcggtggatggatggagttttgaggagagttgagtttgggccgacgtctcgcactgcacgccgaggccaccgctttgacccctattctcgcccgcttcgcccgccgcctgccgctgctaaaaaaagcctgcgactgcgacactgactggacaaatcaccgtctcgcatacatgcacagtccttagcttcttagagcaagtttagaccatgtttagataggactaaaactttcaagttccctatcacatcggatgtttggacactaattataaatattaaacgtggactattaataaaatccatctataatcttggactaattcacgagactaatctattgagcttaattaatccatgattagcctatgtgatgctacagtaaacattctctaattatggattaattaggcttaaaaaatttgtcttgcaaattagctttcatttatataattagttttgtaagtagtctatatttaatactctaaattagtgtctaaatatagagactaaagttaagtccctggatccaaacaccaccttaatagtgtagccaactactagcttcaaatcatctatagccaatataataactaatttatacaatagttgcttactatactattaatacctggtcccacctgtcatacacacattacgtcttggagtccgtgttgcagctggctacatatctgtagcccgttgctcttctctctcttcctttatctctttaaaatatctttatagttggtttatagcctgctattgtacctgctcttaggcctttcttctaaactcgctttcaccacaccctccttctaccctacttcttccgtctcaaaatatatagttatttttagcacagtaccttattccaaaatgaagctatttttttacctaccacctcctttcaaccaatcacaaccattcttcttcacctgctttctcttttcaaccaatcacacactttctccaatcattctcatctactttcttaatactcgtgccaaccttaaaaatataggttttttactgtccttgaggttgtgcagtaccaaatcctgaccgttgatctggcatcatccaatggttagaaatcatccgtacctcatggtactgcacctcctcattgaagtggtactatgggtggaagggtatttctgtcctttactgtttcacgagagaaagaaaaaacgtcgggaaagcacagcagcagcgtggcggctggctcgagggggacagcggcgggcgcctggacgcgtgacagcggcggcgggctggacgacggcggcggtgggctggacagtggctgcggcggcggctggagggggctggacgcggcgggctcgagggggacggcggcggcggctggacgcgcggcggcgggggcagctggatgcatggcggcggcgggcggctggatgcgggacagcggcggctggatgcgcgacgccggcggccggctggatgcacgacggcggcggcagcctcgattggcgacgacgacgaccggctggatgggggacggcgacgacggcggcgacgacgacggcgggctggatgggcgacggcggcggccggcggccggctggatgcacgacggcggtggcggcctctattggcgacgacgatggcgggctggatgggcacgaacgacgaagagatgtttttttagtccgatcatacccctgctaaatcaacggttagattagattggtacctcatgatacctcgtagctcatggtacctcttaaaggatgggaaaaatgctcttaaaaatatcttcatttttgggcggaggaagtaatattaagtgacccttgacggaggtttgatatgtcaagtgacaagaaatatgctgccaccgagggcttactaagaaagtcaccacatcctcatgagtatctatcatcttcgttctaatctctccaaagcggaatggtttggagtgaattgtactagaaaattataatattaacaaatatgattgcatccttaagaatacgtacgaaggtagagtctgatataacacgtactcttagtttaaactatcacttagagactacttcattctcttatcttataacacagttgagacaataacgtctcttaatattatcaatgcaccataatattttttattactcttctttccttttcttcatctccatataattaattttttttaataaatatactaagagtcgactgtaagctgatgttataggtagccatgatgttcttcttttctcctctctttgatattattaaattaatttgtttatgtggcaacggagagagtccgctaataagctattgtgcatatccttaatgcaactaccaatagaatgttgtagttatacaaatagatacaatacattcactaggctagagagaaaaacgagaagtctaattatttctcttactataagagccccacaattaactgcatgtgcttcactatacttctcggaccattttttttatgtgaatgactatcaggctttacccaacagtataacttttatataaagaaaaaaaggaaagaacaaagacaattacaaatattgtaatcaatccaacactaattgaagtatagtggaaatacagccccctatcagcgaaaccatgggcgatcgacaaactgaacagcgggcgattactatatggtatacaatgatgtttagccaaacatgaaagaaagcagtgtctaccaccatcataaatgatgaactagctagctccggccatctctgccctgcaccaaccgcggccgtatcgatcacaggccatgcggctactgggtgcactgaaagcgatttctatccatatatctatcttacggatcttgcaactcgatagctaggagtagcagctgggggtgtgaccaccccactggttatccaaagttgcagataatggccggccatttaatttcagatgagttgcatccacaaacctattcagaaaatgcagtcacttttgtcctcttttcagttgtcatcgtcactcccgttagctggctatttagctcgggcaaaatgctgcttgttcatgcatgcaattgttcattcatcctagatatttttgtgtaagctagagcagatgatatggaactgatggattgatctagtcgctttttctttacacaagagataatgggatccaacgcttttcatggggatcgatgcggtgaacgtacttttaatcgccacacagaaataggaggacgcagatgataaaaggggttgtttacataaaaaaaaatttaaatttttgacgtgtcacatcacatcagatattctatagagtgtcgtatgaggtgttcgagtactaataaaaaaataattatataatccgtcagtaaaccgcgagacgaatttattaagcctaattaatccgtcattagcaaatgtttactgtagcaccacatcgttaaatcatggaacaattaggctcaaaagattcgtctcacaaattagtcacaaactatgcaattagttatattttagtttatatttgatacttctatatgttaaactttcgatgtgatatgatataaaattttaggtgggatctaaatatggcaaaaaaaaaaaaaagagaaagaactttctcgagcattcaactgggtacaaactggctttggtccgcagtccgcttgatttaattacttggttatacatggtataagttgatgatccatatttacccatgtattaattattttaattaattactccgtacaacttgtttagtggagtcactcttgtgacttaatcgtcgagggcgacaaacgcgtatgtttaagtcttcaagataggatattttgtccccaaaacaaagttgggtttgtaagctgctttggttacctaaaattttgcaacatttttgtcgcaatttttgttgttatatatgatttttctttattttatataagtttgaatatttatgcatgtaactttataaattttatatggactgtaagtttatttcatgtttaagttaaaataatttattgttcaatccgaaagaagtaacttttacagtggagcgatgagaagtattgtatattgtcattccatgaatgcaaaaagtgactgaaatatttaaaattttatggacccgaaatctttacatccctataaattaaaatgtctcccgtgacgtgagcaaaaaattcaatataaaacaactattacaacaaaagcatgcaactttatatatacatgtatttcctatacaatactccctttatttttaatatacgacattgttttatctcattaaaaaaatagtgcaaaaattggaagaaaaatataagtaatgcttaaagtaactttaatatgataaaacaagacacatcaaaataattgttttcaatgcaaagtgagtgtagcaacatatcatatgggtttaagtcttagacttgtatgagtactcataattaacgggtaattattccttcggtagcatacaacgtataagtgataataagacgatcacgatagtttcgttaatctcaagatatgccggccatgtttcttagatatgctcgtaaatatatcctaatataggatatgtatgtgtgcattaatatctaggaataagtagtataaatgtctacgttaacttatactccctctgtcccactaaggatgtcgttttagatattgtcagccaaattagagttaggtgaaaataaccatattgcccatgtttataggattgcagcaaatcatgtggagtcttgagagtagcacactgcaacaatcagttgtactgccacatctacttaaaaaagaatatttaaagcatgataaaattaattaatagctggtgcttgcagcagcggtacacattggtgccaactttatggattatagtaatccaatgggtcccatcaattacaaaacttcggctaatgttacttttctgtgttaatacagttgatgtgttaatactagttgatgggaaagttcagcgtcgagtattttgggacatttgctactgagcaaagcgacttcctttatgggacggagggagtaccatgtttctaaaaaaatagatattttaaacaaaactaatggttaaacattatatgttcaaaagtcaacaataacgtatgttttttctttaaaaaaagaaaatggtaagtaataaaaggaaaacgatacacatataaataaacaagtaataaataaatacatgcatgtagctgtgccttgtgtggtcctgacatgaaaaatatatactcctatatacacatgcaatgtaccggctggcaataagcccatacctgtagatatgtacagataaccggccggctatcgatcattatcgcatatatagccttcatcccgaagaatgtagagaaatcgatcgaccaaagtaaagatgcgggtgcgtttgttgacggtgtgtcttttataaaaattttctataataaagttgctttaaaaaaatcatattgatcatttttaaaatttaaaatagttaatacttaacttaatcatacgttaatggctaatctcattttacgtatattctcttctcctctcctctaaaggtttttttaaataaaactaaatatgttctaaaacgtcaaagccgttaaatatttagggacggaaaaaagtactatctagcaccataaataatatcctatccagatagatcgatcgagaacaccacgacgctgacgcaccgatcgggacttggggatatgcaccgtatgtcgtatacgtacgcaggcacccacgtatgccgacacgcgtggtgtacgtacaagctagcagagccgtctcgggtcgtcgtatgtgtacgtacggaggaatccttgtacgttcccacgagctatataggggtatctatttatgggctgttgggtctctgaagaagagtgggcctatcaatgtatttttgggccttgatggccatggattgaagcatccaattgggcctaggtccaacagtagaaaatgcccatgcaagcgtgcgtccggttagcccctggacagccgccctggctcacgggtgaaaactccatcaaatttcgatattgatgagcaacttgatggcgaaatttccataacaaatactgtactagttatattgaagtttgctagagctctaaaatttttttggctccgttcactggccatgatgtgtgtgcgcgcgttccagtgatagtcggggcggatctacagtacaatgaccggtatcgggtgacaccgacgactttcggcaaaacctatagcaaaactgtttatccatatgttatcataccatgatttaaacataattagcatattatgacaccgatagacacattatgacactaacgaatcagttttttttggatccgagagagtccatacctcgaaaagttgttttgacgtttttttccattaaaattttaggtttgatcaattttataaaaatgtttcaacggcatctcattaaatatattttaataatatatttattttgtgtttgaaatgatgctacaattttctattgattttttactagaggaaaagtcaacgtgacttataatatatatgaaataaagggaatagtatttgtgttattactactccatctatcccaagaaaaagtacatagtacttcttcctctctaagaaataaaataacttttgattacgaatctggatgaataaaattatttttaaaaaattatccttgaaacagaaagggtgaatcaatattgtgttgtgtgtgcaggcgcacgccatataagtatatacaccggtatgcatagaacattatttttaaaagaaatacaatataaacatagatgatcataacatatgcactcactcattcttgtgaacatataccacgcacatccctttgtacagatggatcgacgacgatctgaaaaaaataacgtatctagtaacgaatctagacatacatatatgtctagatttattattaattgtactagtatgtagtaaccctattcacttttaggtttttttttttttggatcagtagtgagtacgtctgactcgatccacgtacgtgtgtgtgaccacttgccaaccagatgagcagagcagaattggtcaggtcagattgatcgatcggtgtgaggtgagctgctgccacaagaatttaatggcggcgtcgcactcgcgcatttattttacacgcaaaagaatgattcgattcaattcgagcgagtaccccgtaccactctccctccatccccctcatttatgatagagtttaaaaatgtatctcaaaaatataggtttaactttaatcaattatatatatcctctatctgtcttaataaaataaattaatatttaaaatctccaacacaaactttcacggcgagtgtaaaaatgaaagaccaaactatcattcatatttaatcatataaaagtagcatcagctggtgatagataagtgatattgaaggaataaaatttaatttataggccagtggtaaacaggagacttaggccttgtttagttctcaacattttctttaaactttcaacttttccattacatcaagactttcctacacacataaacttccaacttcttttcttccaacatccaattttagtcaaacttctaattttgacgtgaaactaaagacaaccttaataaacaacttagctagctagctaccttgggacaattattaaactctacaaatcaaattatttcgggacgagtcaaaaataaaatttcttttcaatgtctctcacctacctagtcaccaatgctgatttctaccgttaacagcatctttttttccctcgctgcccagtacacggacttatatagagagtggtaattgttagcttttcacttacacgtaaaacgtgaagaatcattaatgtatgattaattgtgttaattattataaacttaaaaatacgtttatttaatttttttaaaaaacttttacataaatgttcttttaaaaatataccgtttaccaatttagaaaacgtgctaaaggaaaaattgaaagttgcagatgctaaaataagaagcgaaacagaggcctagattctttggatgccataaatccatttgttttaggatagagggagtcagttgttgcgttgtacttttgttttcttttgtgctgctggtggtaccagctgacaaaaagttcttttctttagaaaaaaagaataactaaaggtttcacttaaagtttaatagtatatgtactactatacagtgacacaagcgatatgacagtacttaaccctactaattaatagctcatattttgtgttgagatatcgtctcttatcttctcttccatataaagaagaaaaataagtgctacaaaataatacttcctccggtttcattttaattgacgctttggataatgacacgctctacaagatatatatttgaccttatttttctattataatatatacaataaataaatacatgtttacttattatagtgttttgaaagacaaatctatatatgtttttctagtttctttaaactaaatatttttaaagttattggtagtcaaagttataaaagtttaacctcaatcttgtccaaaatgtcaattaatatagaaccggagggagtagtgcgctaggatgtatacatgtatatatcttcaaaatatatgtcatcacgtgcaagctaaaattaattacaacttcgtatttttgctaagacacggttcccaaaaactgcgacaataaagattagttacaacttcgttagctagtgtttaactatttgcacgcatgacacatgatgcattgcaggttaattggaccaacccgtgtcacatagatagaattacagtcgatcttgtgctaaacacgtaacgttacatacgctgcgtacgttgcatttgatgaaatattagttaatatgcaaattcccacaaaatattcgcaagaaatttactccttgttttatttctatgtatgattatgatttaaattgaaagcatatgtaccaaattaaatgtaccactaaacttgtagtactaataacacgctccaaaaagaattgaaaggatcattttaaaatacactagcttaacagtacgttaacgttgttttctgaggtggtaaaaaaatagcatgttaacttcatatatatgataactttttttttctaaaaaaacaagtcgaatttgggatacctcttcagataaaattagattgtccaaaatcttctagtcactaacccaaaaaaaccacatctactttcctaatccaaacagcttaatcgttcccatcctcccgattcttctatataccaaccccacatgtgcaggttaagattgagccaagtattatatatcatacaataaaatttagcataatatggtaggctagctagcttttatttcaggacgctaagaccaagctgtggcccatgtggtttagggtccacccttacacctttatgaaatgctataagggtgtgtccccttctttagtgttatttaattcttttttacatgtgataaaaaaacttaactaattacacaataagatactttaataggctacacattatattgtcaaatagttttgctgggaagaaaaggtaaataaactacctgttattttttcacaagaaatcaaaccactacttattgatcatatatcggaaaaaaaacctcaagcccctgatgatgggtgttgggtcaggcagccagcgactcaaaccacacaacagtgtggtaacctttatatgattcctgctgtttgaatgtgctgggtgtccaagactgaaaataactcattgataagataatcattcagcccaaactaatttcaccctaaattttcaatgacgctagctgaagctgtccccaaaagcagatgccaccgtacatagcacacagtactgcgatacattggtgaagctactagtagctactaggattgtagtaattattgtacatgtgggctttcaacttttttacagtgagaggaggcctatgtccatggttatgggttcatggtcaggactagctgattgatgtgatgggaaagctgatgaaagaggagcacttgactagctggattttctattttctcgcaccttaattacttttggtgtgtttgtgactgtggtggagtgcagcacttactagatccgtgctaaaaaaaggaatcaaattggatatgtgtgcaacaaatctaaacaaacaatagaaaatcaatgcgccggttggcgcttccgctgattaagctatgtgtatgacctttaaaaactacatatagttaatatactaatatttcagtttctcttttatgaattttagcatcagacaatgcttagataagactttatatatggatccaacaccagtattgtttatttgttttatcagaattgtaacgttttcaaaagttgaaatatttaaaatattatatattttatagtataaacaaaaaatacatatatttagaatctaaatattatttattttatagtataaacaaaaaatacatatatttagaaaattgttatcattgttacagagttcgattcaatcttaaaaaaagagcaaattgttcatatcatttatttttctatttattgtttttagtccttgaaatatacgatatgtggtcatgatactttctccgaataatttgcaaagaattttacaaaaaagtattttcccctttttttaattcttcttcccttttttacacgtttgcactagttcgatcacgcattgttggattatggtgccgcacggcccatctacacacatgcaccatcgcaacttgcacgcttgccaattttatagagagggtttcttacatagcgctcttttagccgcttgtatgatatctcgccatgtgtcgctcacctaaaggattgtgagagcaactaatcagctagcataaaaccaaccagcatgagatagatagattgcaaaggggaaaaaatattttcggaagcctctagaatctggatcatgtgccttttgtttgcttctcggtatttcttttcttatggatattctctagatttatctcaaagtggatagataattgggaagtctctagaaattggatttgtcttcttcttttattttggctatttcttatgcttaattttcttagatttatctcaaatttttacatcgccatgtggctcaataagatggctcgaaacacaaaccagttttagaaatatagaaattccatgcgtcttttgacgcgctcatgttatagcctgtccacattgattctgtaattataaagtggaaattttgaaaatttttaaagaataatttgcttttgttaaaatttgaaaatcttttaagttttctctcttttttctatttagggttcctttgtagagtaaaattataattgtattgtctattaattgaaaaaataggtgataatattttaaaaggcattttttgcaaatgcatattttttttatgagctaaatgatttaatataagtatctatgttggaaaaaaatatacttgttgataaaaatttaagtctaaccggactccactgatctatacctgatattttgctccttactaaaattcttttaagccccatgaatccttctagattcttccccacttcacctttgcattttctcttctctctctgtgtgtaagctatagcatctaggtctatttttttttcttagtcatgtttgattctctttttgcctatggatgtttatttcctttttctatcgagccatgtaggactctggagatggttcagcacttcagcactgttaccacgttttttcgcttatttttttctctcatataattcctagatttatttgcaatgtgaaaggtgccacatggcccaatcatcgtttgcatgcacggccagcattagaagataatactagaaaatagacatgccaggtggcgcgccctctgattatataacttgtgtgtgctatttagtgcttcttccaagcgaggacacattagctggcgtttccgcggattatacatgcccatattcttcctagcaaggactatttaagggtttctatatttgaaaactaaatcaagtaaaagagtaatacatttggtcatatcatttaactttaatgaataaataaatgtattcgaagagaaaatattttgaatattaaataatatttaattttgtattgaacatgcataaatactgattatgtatttttattttattttacttattcatgtcttgttgactttgatctaacttggtcagttggtctcatggtccatcggcccaagtagcatatatttggcccaattagtcagtccaggagaagaaatttgggattttactatcgtaaaaggatggtttcgctagaatgctatcgcttcaaagtgattcattaatatgctatcctaaactgaggggtgttcaccaaaatactatttttggtctttttgtctaatactaatgtttttgctctattttgttttgtcttgcgaccaaattacccctgcctctatcaactcctttctcccaacctctctatagggactgtagggtggcgcatgaggagggaatggaggcggagcaagcgcctcagctggcggtgctaaggactggggcagcggcgcgagtaaactggggaggaaggaggcgaggagcaggtgggggaacggcgggggccagcgccggcgctggagccagggccgctgcggaggggcgccgctgccaaagagagaggcagagaaaggcagcgatcgattcgatctggtctctggtcaaagagataagagagaagggtattttggtcagaagaaaaaacaaaatagagaaaaatcatttctattaattgaaaagaccaaaaatagtattttggtaaacaccctcagtttataatggtattttaatgaatcactttgaaacgataccattctagcgaaaccatcctttgcgatagtaaaattctaaatttctcgtccaggagttaggagaccaccaggacgtcttctcgtgtttctcgatggatcgatggacctctatctctctagctttattcttttttttctctgaaaaaaattgtttgggatttatctgttaattcaggggtgacacgtggtccaatcaatactgcccatcgtggccagcattagatatattgattgatatgtttaaatttgtatatagagaaaatatgtatactaggaataccacgggtatatatattggactagcttattgttgcatgttttattttctttccaagcaaaatatcaacatgatgcacttactgcattcgaaaataagaacttctcatttttttccccaagattaatgatagaggtgaaaatttaaatgaaggatggttttaattagttatgacgaaaaagcaggtgaaagaaattgaattaagaatggttgtcaatagttaagatgacagagcagatatagtagaagtaactgtattttggaatgaaagcagtgctacatactactccctccgtccaactatgtaagaattttgtagtatttaaattttaccaaaaagaaaaggtattcctaaactactactgaactagttactttaatcatcttctatccgaatttcatctaatccctaacactaaccaattattaaatgtggaacactaaagtgtttccttcccaatctaaagatgattatattgttggagggaggaagggagtattcgttgtagttggtgccttttattctttaaactttttcgatgtgcgtccctctattttatataagacacattttattttattaaggcaaggtttcgattctctattgtgataataattagtagaatttggtcgaccaacagacggaatgattagtaacaaacgcatatgcatcgatcacgccgtactgtatagtattaagtatatttctgacgtcttctatacccaacattatttgagcatgtcgtcaggtagtatatatgtgaagttgttgtccatgacactactgttcccctacatcatcgaatactatacagtctattattacatcgtccgtaaaaaaatatattacaaatttgaacttaaacacaggttttaagaaagtatattaaactaaatggtggagaattgtgattgattgagaagaaaaatcaggtgaagaaattaaatgagagtggattataattggttgaaaaaaatataggtggagaaattatatatatatataaagataaattttaaattataaaagttacttcctccgtcctaaaatataagaagtttttgttagatgagacacatcctaagactacgaatctagacatgtcatcttcaaatttgtagtactattatatatatgtattccatctaaccaaaactttttatattttaatggaggagcgctatattttggaaaacaggaagtaattagtaatagcatttgtctatttataggtgaaacattagtagtaaggtcatgtcttcctgcagctgcacgcccggctacggtgatgaagcagacggtggtgaagcagctagctgaacgcgtgaaccgacacactagctatagcctatagctccaacaattaactactcctccactactgcagtactcctacacttatgtactctcctgtctcctccaatccactgatgaataaactggtccacacgtacaccatcggtcccaaaaattaaaatttcgcctactccttttgttgaaaaaaaaattaatattatcattcgttgttctataatagatcaatatttttttatggagaaagtatgttttgtatcgtgtataaaaattacaatagtttattttgaaatgaatggactagtatgaattttgtctaacaagctgtgtatgcatatagtacatagtatatatatatattttaaatatagtttattttggaatgaattggactattggagtattatgttgacaaggaatcagtagggacgatggtattcttttctgctttggccatgtttggagatggagtttttgggcgctgcaatttcttaattctaggatctccaactgaccctcataatttagtttctcactccgattgaatttaaatgtggttgtaaaatctagaaaataaatataagagataaaaaaatctggttttagtgtggttctcactgattgattatactctctccgtctcataataagtttatttttatttttagttccttttatttgcctcagaaataaatttagag

SEQ ID NO: 38986 - DNA, 2739 bp, Oryza sativa
ccttgttgttgactgatgatcaaccgaaagtttaatgaattttgcgaagattaattaaactggcatgcagtagttgtagcgaggtgtggtgtgcatgtgctgtgtgttgcatcaacctgcagcagtgtagcgtgccattccatgtgttcagtattcgctgggttttcctggcgtcgtacacgtgcaggttggcatctgacactgccatgcatgcagcgatgcccgttccaatgcctcaggtacggcgtgtcggctgtcaggctgaccactgggccccctcctgtatccttgggctatcgcccatctatacatacactagcaaaatagtagtacgcagacaatcagctggctaaatgcatgctgagatgggggagagtagagaagagagtagaagtggacttaaaacttgcagctaatttagacacaagaattaaaaaaaactttgtaagagagacaagtggacctgtattaattgtaaagagctaactattatatgggtaggttgaaaaaatgctacaaagaacctataactaacagatcggctgtattataagccttgctctcaatagtaccggttgagccatctttagtctcggttgatgttaccaaccgggactaaagattgatctttagtcccggttatttcacccgggactaaagatagcgatttttagttccggattggtagtccaaaccgggactacaaacgctttctccaccagtgacatctcgtagaaaacctacccgtcctataaaaaatgaatctacgaccgaatatgacagatgttggttttcatgggaaggaggtactcttttaaaaggaattatgtttgtttttgcaggatggagggtatacacttcggctatcataacctaaaataacttttaaataggagataaatgcattcagagttaacgaagggagaggaatacttacgtcaggatttgataaagttaatgtatttaatctttttatttttattagtacgtgtatgatagataaaaataaatttattttggaacataggagtactctcagtccctaatccatactagtaacttttttttagagcaatccatactagtaacttagtacccctgcgctctgagctgcaaaatgtttggaaaaaaaatgcgctgatattgtgtgtgtcattggatctgaaatggacggataaactgactgcagtatgacccaacatcatcaacaattaatagtaaatatttttttcgtataactagctcctaccttcatccgaaaatatagttatttactccctccggtttcattttaattaacgttttgggcaatgacacggtctccaaaatatatttttaacattattttttctattataacatatagaataaataaatgcatgtttacttttattatagtgcattgaaagacaaatctatatatgttgttctagtttctttaaaccaaatatttttaaagttattgatggttaaagttataaaagtttgatcttataatcttgtccaaaacgtcaattattatagaagtggagggagtactaataatacattttaaatatagtaatagagaataagacaccacatagtaacaaaccactaggtacctacattaattttaacaaacgctaaaggtagctatattcatagaatgtttctgcgtttgctatgaataaaatggtagttttcctaaaaaaaataaagtgcatataaacgtccttaaatatttagccaaaacaaatagacttggttctcgtagaatatgtaattcaattatatattgtgcatgggattgtttagacattttgacatgctacacgtgaatatgtgactaaatgaaactagcgtccgtaccgtgcatagcgcaggtggtaaggtacagccggtgtgcttctcgggacccgtgtccgactccctgctcaccccgtgtctagttcatactgaaagtttagaagtttggttgaaattggaacgatgtgactgaaaagttgtatgtgtatgaaaggtttgatgtgatggaaagttaaaagtttggaaaaaaaactttgaaactaaacagtacttaaagattgatattgggtcccttctcattatccgacgcctttttacatgtgtatatgtagtaatttcaccgttttatactatattaatttgaatcactggtggagaaaggggctttactcccggttggggacccccctatagtcccggttatacaatcgggactacgaatccgggactaaaaatgggtatctttagtcccgggtgaaataaccgggactaaacatccaaccgggactaaagatggtaggagcagtcccggttaatttttttttcttaaatcgatttgctccctaaatatccccgatcgtattcccaaatcatccccaaatcaaagtagcatcacagatctggaaagaaatacatcacatattgaaaaaaatacatcacagatcataatacatcacatcacagaatcttaaacaaaaaatacatcacaaatcctaaaagaaatacatcacaactcccagatcagatccaatatcacatacatcacagatcaaatccaatgaatcacaaattcaaaaaaaaaatggcaacaaagaggatggcgccgccggcctcccggccaccgtcctcgcgagctcggccggccggccgccacgcccgcccgcctggccggccgccacgcccacccgcccggccaaccgccgcgccaggtcgcacggcggcggcctgccc

SEQ ID NO: 38987 - DNA, 2821 bp, Oryza sativa
ggccaacaacttttcaaacggccatccgggcctagctgatcccatcgactgcagatttttcaaacaccgaacccccttttcacacagcaatttcacaagcagtagtcaaaccaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggttccagaccaacaacaggttatgtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgacttatgtttggatgaaattccaaggaatcggtccttaagtgcgagagcgggaaaccgtacacccggtacgtttcccggtccgcggttttggaaattcatttagttcgcaagcaccgacccaggtgtcgggttttccaagtcttttgtaaaactccagttttacccaagttgttactcagattttaagtttgaaggcgaccgtcgatactggcacagggtgcacgaatatcgaggcgcaactggatggttacaaggggacatggtatagcaattaacaatggaaggatcaaatgcaacaagttaggtaggtctgccaatctgccttgcagacagaacaacagattaagtgcaatcctatcaatgcataatattttgcaagcaatataattagatttcaaatataggctcaagatgttcaaaggtggcttgccttgctcgagatctggagcttgatcctcgaaatcctcgcactgcgggtcttcgggctccgaaactatacgcaaaacgggacaactcaacaaacggcgaaaataaagccctattaatgacctctaagcgtgccattagatagatctcgagatttgagaaattttggaatttgaacggagtcaaacggatttacggtggggaagatattgaatttctaagattattggatttttggtctaaaggaaaaggatttaattaaatcctttttggaaaagaaaagaaaagaaaaagggagagggagggaatatagacttccctcgggcggctagggcgcggccagagagaaagggcggctcggccgagcttaacgggccggccggcccaagaaggtggcccaagacgcgcgcgcgcgggagggaggagagagagagccggtggaccgggctcaccatgcgcggtcccgggtgggacccgcttgtcagcggctcggctcaccgtgcggagggagtacgcggctcatgcgcgcgggcgggggagggacgtggtgcgcgtgcggttcgcggtggacgcggatgcggcgggcccacgcgcagcctcacggctcgcggtggaacgtgcgcacggggagggactgaccggggtcggctcgacccggtctaggctgagctggcgccgacgtggcgcctacgtggctgccacgcgggccggcgggaggtagacgacgacccggccgcgaatggacggcgggcggcggcggcgagcggcggagcgaaccacggcgatacgggcaaaagctagcacaccgggcggttgttcgtgatgaggggagacgagccaacggctcggattcgccagagggagttcgacggcggcgaatcgcggcggcaacaaccggcggggagggaagagggaaacgccgacgaggtcacgagggaccgattcccggcggtgagagcatccacgcgaccacgggaatccgatgctagcgtcggattggacggagctacgccgagcgaggctggcgacgtgcgggtgctacggagctcgagcggcgacggcggcgagcacgcggcgagcgacggcgacggttggggcggcgccggctagctacggggagtctactcgagctactaccgaaagctagggggaggagatggggcgaggaggaagaacggagggaggcatcaccgagatgaggaggggcgctgtgacgagaggccgacggcgcgggagtaatctctccggcctcgggccggggaagaggaaggagagggcgcggccgaagtccccttccgcgtccttactcgtgccgactcctttgacacgcgcaacaacgaacgacgatggcgaacagagcacgggggcggcagctatggcgaggaggcgaaaacgagggagattggagggtaaggagctggggtttaaagggggcggcaatgtcggtttgggaaccgacttagggtggtcagggcgcgagctggcgctcggcggtcgcggccaaagcggcgacagggaggatgacgccggcgagggaaaaaggggaaaaaggagggggagaaaggggcttgcccttttgccgattcgggaaaaaggaggaggggagcgggggcgacgcggcagagggaggaggggcgctgcctccgtcccttggcggcttgcgcgcggagtggcgggggccgggcggtgacgacggcgatgacggcgggcggtttggagtggcgcgacgacacgggcgacagacacgtgcagaggctgacggcggcggcgaccgggcggtcggccactcggcacgcactcgcggcttgcaacgggcggcgtccgcgcgggcgcgcgcacgcgaacacggcgtgcgggaagcggcagcgagggagcggagtgggaggacttggctcgg

SEQ ID NO: 38988 - DNA, 21267 bp, Oryza sativa
  unsure (1)..(21267): unsure at all n locations
tttttagtcccggttgtttataccaactgggagatctttagtcccggttgtttataccaaccgggagtaaaaataattggagtctgtcttgaaccccacgacttattgaaccgggattaaaaatgatctttagtcgcagttggtaacaccaaccaggactaaagaacaaaaagtacccctcaacttttaaaccgggactaaagatgtttttagtcccggtttttattagaaccgggactattgtagaatttggccgaccgaccaaaaatggtttctccaccagtgaataaccccttgagactattcataaaaagaatagtatatatgagccagctggaatgacagcttcatgacaaccagcaccgtaaaattaaggacttcctttcgaagaaataatgctatattaattcttactcatgtacatgcatacgataaaactgcaaagtattttctcctccctctacacagcagcaagtgtggtttgagcaatttttttgtatttaaatatttttcatccttttagaatgcacaatatgatgtgcatctctgtttacatgagcttgtttcttagtagtcgactactctggctatatatgcttctgccttgcgcccatcgttttttcatttttaaaacagcctaaccccgattaacaagaaataccacactaattaattggtagcttaattttcttttctttttttgaactaatatacttgtcttgatttctatatatatcagcctatagatagctcgagtttgatcgaatgtttgatcaatttgtcctagctagtctatgattgaacttggactcggtccatctgggtccaaacgaaatgtttaatatgtgaaataattgacggatcaaacaactaaaaagtccttgcttgagcgtgagcacgatatgttgggtcaaacaagtaattaagaaactagttatgagatgggattaattaggatataaataggttggcctagctagtcaagtgtacataatttcaactgaataatactacctccgttttttaatagatgacaccattgactttttctcacatgtttgacccttcgtcttattcaaaaaatttatgtaattataatttattttgttatgagttgttttatcattcatagtactttaaatgtgatttatatcttacacatttgcataaaatttttgaataagacgaatggtcaaacatgtaagaaaaagtcaacggcgtcatttattaaaaaacggagggagtattacaagtggagcctatgatggaattagtcgtgccacatgcccggatatccatgcatctcttcaacatgtatagacgactggctatataaaaccatctctatacctttaactaattatcactaaagggttcaaaattaactacctaccattaatttatgtccacaattaattaatatcctctttaaaaatggacgtagtagtaaactagtaattaataatatttgctagtaattcatatacagtatgtacaaagagggtaacatgtgatcatcaactgctataattttattcatatcatatctatcaccaatgaagatcatatgcatagatacgtacacctcctcgatcacgcaactagatcgagaacaacacagacaacagtacggatctgtgagatcctaccgataatatatacagtatatatgtctccttgttgcaagctcatatcgaggcatgggcgtgtactttctagctaacaattcatcagtctaattaattaagttttgcatagaatcaaaactactagttgcacttcttcctagaaaaaaacatgtgcataatctaattataataagctgttagtatagtatatacgtacaccgactcactaagtcagtatgattattttatcggagaatgcattcattccccgatgtggtcgataacgctgttataccgtatgagctactccgattaatatcgtttgtacgtaaatatatgtataaccctttttaaagatattctgtgaaatataaaaacatcgcatgattaaactgccataagctttgtatcggcttgcgttccacttcgacggacgacagtacaaatttcctcgaacatttttttctttatagataatagacaagtttctcattaatatctcataatctttttaagaactctcttgatggttgtagtggtgtgcacatatactatatggttgtgaagtcacctgcccaagtttgagtatcatcttctttaattaaggtattaggggccggggataatccttttcatcatttttttaactactccatccgtcccaaaatataagcatttttgtctatgaatctggacacacagtgtgtccagattcataaccaaaaatgcttatattttgagacagaggtactaattaagctagctattggtgccaagcgcttatataccggcctgcgttcgagtccgcttggatgacacaatttttcaaatttttttatattgatagataagtttctctttaatatcttataagttttctaagagctctcgatgcggttatagtggtgggcatatatggtttgtgaagtcacccgcccaagttcgagtctcaccttctttaattaacacatatgcgggaaaagggaatccctcccaccattttttaaggattaattaattataaattgttgcttactcctccatcccttagtagcgtcatatatagccgatgctctataatattatttgtcggattactcccgtataatgcttcgcctcgtctagtatgtagtaaataatagctactaatctcttttctttatctgaaaaaatggaaaacattcaaacaactgcatatgcgcacgtggcatataaaacaccaccaatacccccaactattccttcaatcctttaacaaataattaacatgagtactaaataatactagcacacacggttttgtctaaggtcatacagtaatacatcttattcgtaagaaaaataagcgaagagtacgaaagaagtattactacattaattatatattatgaagaaagtaagtgattcatgacgtattacttgtacataattaaaaatatatatagctggctggccggtatgtttcttttgtagtcgtcgaaatatgttccacaagttctgattaccatttaattagcaaagtacgtacgtacatgcagtttcaatcgacgctatacgtatacgaaagctgctaagctagctgggtcaaaccatatacacgtacgcccgtacgtaggcagagctagctcaattgttcaatggtcgccggctaattattgaactagctagcattcgcttgtagcaactgaaaagcatgaaataatagcagattaatatcgagtggggcatataaataaatataagtatatccatacgtgtactcttcccgggctgcaagctgcaacctccagaaatgatagataggcacagctcatgttgatcttttacccccttcaattcgtctgactataggcaactatctggcttttatatatataatataaaatgacgtcgtccacgaatgatcgatatatcttgatgtaatacgaatatagtatatgagatcgacgtgtacatacattgatttaattaatcgtagatattacatcaacatgcaaatcttttacgtgttcctaaaaactaatcaattgcatatatgactatatatacagtataatgatatcgatatgtacatatatacatcgatttaattgcagatattatatctagtataatataatggacatatttataagcacataaatttccttattaatatccatcgcgatcgcttttcttgaactagtacttatgtacccgcctacattttcgagaattcgaagttagctgaaagagaaacgtaaccatataatactacacatgcgtacggtgataggttataatttctgaatgtacgtatgtaatttattacttagctacagttcgacacacaagtaagtctcgaagaagaaatataattaaacatacgcacgtacttactcccaattaatctccaatgatatactactccatatgcatatatatcacgcagatgcaaaaataactataattaattaattagctagcctccctgccctcccatatattttgtgtggcttaaaaaaaaaagccaaacttttttgtagacaaaacgtacaggatcttgcatggtgcatctgtccccggccggccgggcaggcgggccaaagctacagatatatcacaagagaatctccaaccaagaaatccacatagcaaaaaggagggaagcacgcactcacgctcacatgcaacaaagaaagaaagagaaagagagacaaacaaagacgagatcacagggggaaaaggcatcaagagctggtgaaacatatatacgtactcctttttatcgattcagtacaaaaatatactaatgttttaatagaaaatacacatattattaaaatatatttaaagttaaatttaataaaattaatttggtattataaactttgctattttttataattttaatcagaataaaaataaaaaaaaatcaaacaacttataaaatgagtaccaagctagctatccaagtcggatccttgtcgccatccacaagtagtagtagatcgcctgaccgacagcttggtaacggggcccgcatgtgtatgtagactaccatcaactctctggcaccacaacgtacagatcaggacgtacgtacgactcatgttattggtacatgcacacagtaaatagtttatatttaggctgtgtttaattcaacgcaaagtttggattntgattgaaaataaagatgatgtgactgaaaaggtgtgtgtatgacaggttgatgtgatggaaaatgactaaagtttgcatataaactttagatctaatcacagccttagtgacattaaaatctttgccacgtgtataaatctcaaagcgaatctgatatagtagggtgtagaaaacaagcggataaggaaggaagatttacttgccgtcaaatataattaagaaaaaaacgtgagcacttcggagagtcgaacgcgggtcggtagggtgaaaccacgtgcctttgcataccttagtttgagtaacaaacgtggttaatcgagtcaatcatcttgtttgaaggtgcaaatcacataaaacttgtgtgttgtgttggagcgtttttgctatatgttacgtacacgcttcttattttttttcacaaatatgaaaacacgatccataaatatgtcaatggtgcaatacaaatactatatgcaggaaatcaaaaatacaaactgcaaagttttgaacagggaaacaaattaaagtgagtggcagtggtcaatcatggaatagaggcccatttggggatggtgttaaagtgaaccacaaaattttgatggtctacaattgaacatgccgatagtaggtggtagacaattaatatagatttatccaaattgatacgcacccattatttaatccttttcttccatgccggccgtaagaaccttccatttagatatatgttcattttcattcttataaaccagaaagttctaaatagcaattatattgagattttttacaacctgtgattcccagatgtgatgaataattaatattggtttggctatacgtacatatgtgtatttcccctttttgtggaccacattgcttattgttgtcattgaagttttgacatatctcctttgaagttagaatatgcgagaaaaatacaaattttatctttaaccattgcagccaaattcatacaatatgcaatttcatgtatggtgttgatctttaatttgtccatgtcatatcaaggttattgtccatatgaaatatatatgtgcattgtagcactttaagagcaacgtgcgcacacatattttgtgctcttccttaattaatgcttctcagcatgaaattatatatgttactacatcattatctaggaaattgttccatttgcttcctaattagagtaagttagttttattataccctcatccttagtttcgattatgtgaaaacacaacattgagctaattaatctctctatactagaaacgtattactagtacaaagttaattcgttattatatcggtttgaatttctagtaaagttgactatagggtaaaaccccaggatgacaccgtgtgcttatatttcccgcattctatatttgcaggtcttgccactcaccgaagctcaattactttacgttattcatatacgcgagataaagtagatgttgatttgttgccaagatgagcagtgacggatctagaaaataattttcttgagccaagtaaattggctaaattattagattaataagtattattttatcaaaaatagaaaatggatgttggagaatagtgtgtgtagctttggccttaggctgatggcatcaagcgttggtgtgagtacgtgaatctttgacttgaattgcttacatggccaatgtagcctctactaaaataggcaaattaagggcctatttggtacaacttcaactcctagatttagcttcagaagttaggtatggagtggagttgtggagctacctaaacccagttctataggcatttaatggtaatccattggctaatacgttcggtggagctcatgcatttgcccatggtggttggccctttgctccgccattggcactagcacagatcctcagacctcatagcgtgttgtaacaggctatccgtgacgggtgaaagcgaaccgttacaaatgataatcttgagtcgtcataaatagacatgtccatgatagtaggggaaagtgatgaggtcgacgcactactacaaaacatcaaatagatgtcgccactataggtgccggtggtgctaaaaccggcacctataggacttttcccaccttcacgggttgaaatcataaaaaaccggtacctttaagtaatcataggtgtcggttctaaatattttttaaaaatggcatctttaatatattataggtgtcggtttttatagaaaaccggcacctatgtaaatcgagccgagccggcgtcgaatgagccgaccggtgcgccccaccacgacgagacgagcatcggataaggtttgatcacctcgctccctcttctctctctctcccttctctcttgtctcactctcttctctctcccctgcgctgccggcggctggctggtggaggtggcagtggcgaccgcgccctcccctccgccagatccggtaggaggggaggcggcggcggcaagtggcttggctcacgggcggcagcagcggcgacctcccctccgccagatccgacgggaggggaggtagtggcggagccctcccctccgccagatctagcggggagtaggcagcggcaacgacggcggcgggctccccacgggcgtcgatgagtacccccaaccgtgtccttcgcttgcagctgcctgattcaaatgtttgattcagtgattcaatgatgtttgatgtgagatgaatgttgccaatttttttttgtgaaatgaatgctgcctgattcaaatgtttgattcagtgatttattttgtgagatgaatgttgccaaaaaaaaattttcttacggatgtgggaggagggactgctcggctcgatgcgtcggcttgatcgagccgatgcatggagccggttttttttattcgtcgaacctaaaaggtgccggttaattctaaggaaccagcacctttttgattttcaatcagtgccacctcccttgtgccggttggaaaaaccggcaccaaagggggtttcccaaccagcacagaaacccttttctcccttttctgtagaagtgtacggtgaaattggtggtgcttctttaattaatggacaagctagacattgaaatgctgcctagaaaggttgaatcatgaggtcatcagcgaaacaacggagtgtttctgtacaagcatataatagtaagcgttttgtattggtcggcatatatcatgatcattaaaatttgtcaacagaattcaatattgtggtccatcgctaaccgacaaatgcatgcagtgcaatgactttaatgtgtgacatagtactagtagtgtttatttccatctcctgtaggagtaaaataaacaaacttttaaaagatactactcacaatattagagtaagttcaatagtataatagtatagctcactactagctccaatttatctatagccgatctaatagccaattcatacaatagttgtttactatactattaacatatggtcccacctatcatacacacattacgtcttggagtccgtactgcagctggctataaatctatagtctgctgctcttctctctcatcttttacctcattaaaatatgtttatagctggctaatagcccgctattgtacctgctcttaacgcactagacactaactattattagaaataaccccaaaatatcaacatatatatgtgcgtgtgtgacgtggaatcataaatgtactccattactttaaaataatatatagatatggaactgtattagtcggttcaagtcagtgctagcaatttacatggaactttactttctttttctcattgaaacaagaaaccaaacaacacgagatttcagtatagtcgacatgcatatgactctagacacgctcacactttttttaaagaaaaaaataacaccaagttcgtctctagcggtccactttttttccctcatccaacgtaaaaaagaactaagtaacacaccaaaattttccctcatccaacgtaaaaaagaaccaagtaacacaccaaaatacaacaattagatgtgatttccatgcaatcgtataaacacatatattaattgttcctctatcatccaaagaaaaagttatacactggtattacgccccccctcttcattatcattttgttatattaggagatgtctcactgttgttgcatggacatagtgaaaccgacttaggggtagggggacgatgacttaggcgtatgttcatgcgtgtaaaggagaggaagagacactcaccatacctgccatgtgcactcaccaattcgaacccatccccaccaccgtcacgtgatgccaccatgcatcctcctgaccaactgcacccatcacgccatgtcaccccgtcccacctatattaaaaaaaggtttcccacaaaaggcggtagcgtgccttctcctttcccactagtctgtctagcaaacggtgactcacaagactgggtgggatgactagtacctaagtcaactgcccaacaaaaggtcagacgggcttagctggtcaaccaactttgttggctcgtatgcattatgtgggggtactcatgcctcagtaatgttgtgtcacatggattactcttttagtttgcaagaaaactcgtcggctttagaatattggatctgtaacaagtaactattattgtgatccattaataaagatatgatgaagtcagttagtccaatatgcatagcatgtttttgcccattatggtgtattttagtgttgaaagtacctcatgataccatcattggtagtatgtgacacatttgatatttccggtagcttttaatttccatcccccactatggaagtaaaaataagccatattccaaaaaatactaacatatttaattaaattttgatattacccacatgaattctaagcatgcacgtccttgcaaattcgatctatatattatatagaaaaagtgtgtgttacattttttaaaatattgtgaaatatcaatagtatagtgaatccatccttctaaatagattcataggaactaacacaaaagttgttgtatcactattgttctatgcatgccaacaaacattcatcaaggaataacgtattcatatgctgcagaatttaccacaaagttacctaattttagcggtagaaatagtactaactattattagaaaatactcaaaaatatcaacagatcggtgacatggagtcataaatatactccattactctacaataggtgaaactgtcaatactcaagtaagtgctatcaatttacatgtaactttacggttgtcttctcgctaaaacaagaaatgaatagcatgagatgtgcttgctggcgtggtggcaggagcgtgtggtttcagcctagtcaacacacgtacaactccagacatgtccacagtttagtataatctatttaacgtcaagtttctctcctgtggtccaactttttttggggttcgacgaaagagacgaaccaaacaacacacaccaaaatacaaacaaaaagatgtgattacttcacgtaattgtacaagtatattgtctctctatcacccgaagaaattaaaaagtgtatgtttcataaaaaaaaaaagaaaagggatataccgatatcactcactcatctttttgttgtattactataggtgacgtatcgctgttgttgagtggacgtagtgaaaccgactgagtagggggatgcggatgcaagcgtaagttcgtgcgtgagaagggataagagattcatctgttatgtgtgctgaccagttcaaaccacaccacatatgcagccatgggatgccaccatgaatcctcccaactgatggcgccgatcacgccacgtcactctgtcttgtctttataaaaaaaattccccaaaaaggtctaggctagtgcgtaaccttctcccaccggctgtccagcaaatagtgactcacgagcctgggtggggtgactagtacctgtaagttcaagtgccttaatttggttttggtgattaatgacaaatctaattatatgagactaacgtttttatgagcctttctttgactagtctcatttggatatgaaaataaaaatgatgagaggtatgtattaaatttcacatattctaacttggtctctcttgtggatccaaaatatagtgtgagctccctcattgatcttgattgattatgtgcatatgtgttcctttatatccatatgtatgtacacttgagggggagcttattctatattttgtttattataagatttctatcttgatttgaaatcatctttcatctcatctctctatattgtttatatcgggttattatccatcaccaaagagagaaaagattgaaagatcttggattaaacaatttgtgtaattgttactttggtgatagatggtaaaccgatgtttatgggattaacctctcttttgcataagttgtctactaggttttttcccgataatgagatgtggaagacttgcattcttttgtgatggaccttaatcatgacaaggatgaaatgcatggagataaaatgatatgtaccacttcttatctcctactttttgataggtttatatatatgatttccatgttattgatatataagtgtgagactaatgtttacttgagtcttatcttatttagtctcatttacattgagaacatggagatcatgaaggtatatgttttatattggtctacatcattactacatatgccttctctatgtgtataggataaacccccattggtcattctctaattatgcatacacttacatctcttgtatatttatttgtatgcatatatttagggggagcaaatcctatacatttattgtgcatgttccagatccatgttgttcacctattatttatatcggatctttgcacttgagtttgcatacgagtatatgacacttgtgatgttaatgaaaactcaacaaacatatccatatctttcatatgcaaccggttggtcatcaagtgaaggatgacaaccgatttgttgagactattgttctcctttgagatgtgaaaaggaataggtcccactatgatgaggctaatggatgacaccatgggttaatggtcaccaagccaaggacatcgccatgttggcaagaatgaaatcaagcttgtgatgagaagaaagtcttgacaaatgatggtaaataccttggtataaacatggttgaatcaaattgtcacaagtgttgatctcgactcaagcttgaccccaagttggatgcgcaaggcaaaggtataatggagctaagaatgttttcttagtcttttcccggtcttgatgtttggtgtagaccggattagctagataggcgtcgtactatcaagaggggtctatgaagcgagcttgtggatgatcttgcgccatattagttcatatgcatgtaggtgtattttgtgggcttgtctagccaagtgtggtgagttttctcaagtcctaaacaaagagagatgtgggcaaatcctataggtttgggtagcctcatgtggttatgtccggtggagtattctttggagtgtgagccctttctcccagagaaaagttgtgtttcttggatagattgttcatgggttggatagccctttgaataagctttccatagagtctaagaacgccaaattccgagacccgagtcaagagatatcgccgttttactaacggtcggttgagctgaaaagtgacttgcggtctgatcgtgggccttaggccagtctgaccgggcctgttagccagtctgaccagcgtggtaaggccggtctgaccggccccactggtctgttgcactggtctggtttttggtggcgatacagagccgccagagccgcaaccggtcagaccgagccgtggacggtctgaccggccactacactgcggtcagaccgaccaggttgagtgggctcaatgattgccctgtaacggctagttttctagccgttacaaagtagtccggtctgaccggcctcacaacggcggtctgaccggcaaagcacagagttagggatttcggttcgaacggctagttttggtggttgggggtatatatacccactccccagcagcaagggtaaggttttggcactccattgcattatcttgaacccttgcaagagctctcatacccttgtgcacttagtttatctagtgaggtgttagagagtgagttaagccaatccaagtgcattgcttcattgttatagctagtgtggcacttgatcatcctcggcaagcatcctagacttgttactcttggaggttgccgcctcctagacggcttgtgtaggtgttgcctggtgacctctccgaggagattgtggaggaggcccggcgccgtttgtgagtggtttagagttcaccaccttcagagtgaaggaagaactaccccaagtgatcgaggcttgggtagtcctctccgtgggccggctcccgccttgcccaccccttgacgaagggggcgtgcggtggcttcgtggttgagcggtggagttgggctcgcctcaacggggattaggaaatcggcgagtttccgaacctcggtgaaaaattccttgtctcttgtctcttgtctcatttatttgttgcatttacatttgtgctatttacattcatagagacatatttgagcccatatcacctaggtttgcaaaacttaacttagttgcttagttaaccttgcaccttaccttgcctagcaacttaggttagttttgtttaagtgccattaagttttaaaaccgcctatttaccctcctctagtcggcccccttgatcttacagtacctgagttagtggcccaacaacaacaaaaggacaaaggggcctgcctagttagctagctctgcagactcctacgcattatgtaggggttattcatgtctcactaatttcgtgccacgcgtcaagtactcttttgatttgcaagaatactcactggctttagaatactagatttataacaagtaactattattgtactcctgtttttaaagatttggtgaaacttaattagtccaatatgcatggcatgtttttgtctattatggtgtatttttgtgtttaaagtgattcatgataccatcattgttaatgtgtggcacattttcggtagcttttttccatcccccgttatggaagtaaaaataataaaaaaaaaaccaacatactttattaactcctgatatcactcacagaaaaagcatgcttgtatctcctcgaaaattcaatatatatataaaagtgtgttacattttttaatatattgtaaaatatcgaattgctctcttaaataacaatagtagtgactagtgaatccatccaacttatattcataggaaataacatgaagttgttgtatcactatttcttttatacacgccaatacaaacatttatcaaggaacaatatattcatgtgctgcagaactttatcacataagttacctaattttagctaaagaaatagcgctaaccattattataaaattaccaaaaaaaacatatctataacgcggagtcataaatgtactctattattctagaacatgtgaaacagtcggtatccaagacagtgctaccgatttacatggaactttacattcttcttcttgttaaaacatgtggcaaatagcacgagatgtgtgcataagcctgccaatggatcaaaacccgcaccattcccagtccaaaccatgacaaccagttaaagtagcctaaaccaatccagtccacaaatcaacttttagaacccaaaccaatccaacccattttctacctcagtccaaaccaaaccaatccattcccctcatatggattcaatccacctttccaaaccactcaaacccatttcaatccattgaccaccaacaaggatgctgacctcgacgaaccaatcgtcttcctcgcgcggcgtaggctaatccatggcgccacaattacctccaagcagaactccatggcgccatcgtcaccgacggcaacagcaacctgccgacgcagaagaggcggagcagaaggcagctgcggtggctgggccgtcggtgcggcagtgaccgctggtcgcgccgctcgtacaggagctccgcctccttccacgcccccccgtgcacacgccatcgccctcacctcgccatcacatgtgcttgccctagattgcgcgtcttgccggtgagccacggcagcgaggaaagcatcggcaagcacggcacgggcgatggacgggaacgtctcgccggcgagccacggcagcgaggaaagcatcggcaagcacagcggcggtgcatcgagcgatttgtggatgtggtgttgacttggctgtcgagaagaagaggaattggggattgacgatgcacggcaaccattttgggttgtgcccattctgccatccaatagaaatccatggattgaacccatttccagtctagaaaaacggtgaccaaatccaaaccacaccaacccacattttcttccacccaaaccgccccagcccatttatatcttcagcccattacaaaccatccaaacacaatccaagaggaaatccaatccaataaacccattcccacccaatccactggcaggcttaggtgtgcatgtaggagcagtcacaacgcatggtttcagccaagcatacacgcttattactccagacgcgtttacactttagtttaagctatttaatgccaagtttctctgcagtggtccatcttttcttttctccggtccgccgagaaaaagaaccaaacaccacaacaacaacaacaaaaaacaacaaaaagacgtgattacttcacgcaatcgtgcaggcatttcgtctcctcgtcgtccaaaggaaaaaggtacacgctgatatcatccctaatatctctttttgttgtgttatcataggaggaaggagacgtctcgcttgtcgttgtgtggacgtagcgaaaccgacttgggacttagggaggagggtagtacactgtatgttcatgcgtgtgaagatcgacacacgcacacactcgtacacacctgccgtgtgtgcccacctcctcccttgaccgacagcgtggatctcgccatgtcaccctccgtccctgcctcgactaaaaaatactcctcccgttccaaaatataagccacaaccaccattaacacatagaccaagaaacaattattatcatcttcttgtttggatcaccctaataaatataatgcatgcatccaataaaattagaaatcttgagtgtgtaggatttaaaaaataaaaatataatggagaagaggttctaattaattgtatacatgcattcatatattatattatagaacatttagaaaaagtagctacgtggacggacgtaggaaaaaagtcgcccctcagtttagccgctgtccgtcactaacacgtcgctgtcagcaggactaaatgggggtgtggaggtgggcccatgccccccggcacgacaccgaggcgagcggggcggttaaaaaaataaaaggcgattagaagagcgggaagtgggtaagataattctatcctggcgataagaatatcttaattaccttctaaatcggtgtgccctttaaatactacccaccactaggcttctctccccttctacttctctctgccccccctctctctcctccccctcaatcgcggcgcgggtagattcgcggcggccggagcggagcggagcgcatccatggcggtcgtcgccggtttctccatcaggttggtggaggcgactgcttgcctagctccctcggctggtttggttttgttgtgtttttctgatttggtggggggattttttgtgtgaagggagtacacggcgagcatgaggggagcggcgggggcggaggggaggaggctgtacggcctcggcgctggggatctgccgccgatggaggcgaggaggttccggtggtgggcggacgagctggccgcggcgccgccccttcctccccggtcgccgtccccgtccccgtccccgccgccgccgccgccgacgaagccgtcgaggaggacgctggggaaggcgagggcgccgaagaagcggtccatatcggatctgttcgcggcggcgcctcccctcgcgcttccctcctccgattcgggcggcggcgggaacgacgatgacgacgacgacgaggcgctctgcgcgatcatgcggcgagctagggagaagaagcggaagcggaggctgcaggaggaggcggcgggggctgcttctgctccggtggcggcggcggcggcggcggcggagacgcgtgattccgagggaaacttcaccagaaaggtgcgtggtccagcccaagcccagcccagcccaacccctccctttcctggcaatgccatgatgattatcgcctgtcacttgtggtctcgttccagtagcatgttcccccgctgattattccagtaggttcctgacgcgcgcgtacgcgccgcgagcggaagtcgcgcgcacctgccgacgcgtacgctgcgcccccgtcgctttaaccatatgaatagcactagtgatgacgcgattagtgattagtgctaattataattagtacctacaagaacttttatttatgacatctgtctcgtgccaagtccattcatcactacatatattatcaaccatttctaactggtcttcaatcttcaataacatatatataggtgattatatttggcttgcgctcgggtacacgatgattgctttgcttggttgcgggtacaacaccatgatttgttggtcgaggctagctagctgtacgggttatatctgtgcgccaagagtgataaactaaagctggcttgatcattgtgcttttctttcttggtacgcataattacattgctggctggttggctagctagtcaatagtcatgcatatatatgcgtgagtgactgtttgggattcgtcggtattgttatttcatgctgtattttttgacggtaaatggatggaccggttgttccggagtcgtgcctagtgctgcgcgcgtgcgggacatcgacctagtattgttcccgtaggattcgtgcatgcatggcgctgatgatgagagatagtttaattaattaattgctgggataagcatttatgcagtgagtgaaaaatagaatattgagcagttaataatgcatggccagccggctaattatatactaattaattaccactagtaggcagtaaataactgtactggaagcagactagctgctggtactatatgttgcattttgatctgtcgcgttgccttttcgcgcatcgatcaaaccggtagtggtagtaacactggttgcctgcggcaggtagctaagtttgctactgtgtgaattgtgagttgcatactttgtgtgtgtccagccgggcacatatttccgggtccggccggacggacccattacaagagagaggacgtggagcaggcaattatactagatcgagattttctgcgttattctctttggttcttcatcatggcctgcatgtgtggtgtttcatttgatagttttttccttttggtctaggaaaaataaattttgcccaattgtgtgtgtatgtaggctgtgtttagatccaaagtttgcatccaaacatccaacttttcccatcacatcaacctgtcatacacacacaaactttcaatcacatcgttccaattttcaaccaaacttccaacttcaccttgaactaaacacagccgtagtgtgtgtggtatgtgtgcagattgctggtcagtaaaatgtgtctagtccacgtagtacacaccgtcaaaggatatgctttggttgtggtggtagttatcgctgtcagcctgtcaccgtatgctcgatatgatggtctacactgttcgtacgtgctctgtgttggggagggccagggagcattaattccgattattagctagttgaccagacaaaagggatagtagtagtgtaaggattttaagtttattccctgtgtgggtattattttaagtagagtatataatgatcaaaatatagttgggcacctgttccatttgttatgtttttttacttgcaagtacacatgtaagacatgcaagagagtctcattgtgtgctaaatcccttgaagattaattccacaactaattcatggaatcttactatgaaattcatatatccccacaagtgtttttttttggcattcatcagataattatcttactttgacaaaagtgtgatcttaattaagagtttgacttatattgtttgttttaaattagctattgccttttcgaagttctatggatatgcatccgacacatttctgttctataatttacacaatctaatttccgttctgtagtttacacaatctaatttttcctttgtgtcattttcacaacctggctatttatatgcatgtggtaatctgactgttttatattattgtgtttaccttttatttgtattccacattatccactgatgttgctcaattatgcaggaagcacatgacaagacaaatttgcctggtggattggatactcctcaagcgtcaaggagacctgatggtgtacaccatgcaagaacagacgaggaaaggtctccagactcaaagagaaggaagaaggtaaagatcactaacttagataagaacaacaacaagaagattgataagaaaaggtacagcgagagtaaaagggctaccaataaggtggggaaacagcatgacctgaagaaaatgctccctttgcatagtattctgaagaaatacacaaagcacacatccgtcaaaatggtcaaggagaaacatggcgacccaaaaggcacagaagtcattgaagtctgccgcaaatcagtgaagcgtgtaaaattctcagaagttaatgatgtgcttggtattaacaagcaaaatatctgcaagctgttctcggatgctttggcgtcatcgtcgtcatcatccacggacatgtccagtgaaggggacaagcacatagctgcagaaagctgtagttctcatatgccggagacagcaactaaagaagcaagcaagagtacagatcatgaggattctcttgagctcaccagcacacagttgtcctccaatttgtttgatctgaatgaggcactgccagaatctactgatttgaactacccatatgtgtcaaatccagaggagccaaatcatgagcctagacagcatgagcctttagactctgatgtgcaagttattgacgaaggaggacaaaaccagcaggatctgtctttggattcacatggacttcaatgtcagtccgttcctgagtctgggttagaaagagctagaagttcaatatcgccaggcacatttttgcacggtgagttcatggaagtgtctgacacattttttgttggttcttcacggaagttgacagaacttgctgagtctcatggtgattgtagtagtggttcggttaaagatgctatgacaaaggggaagtcaccttgtgcattgcccaatcatacagttcaggactcatttcagcagcaccagaggtattatgccttcaatctgaatcttggaggcagtcagccctccaatgaaggggaagttcctccccaagactgtaatgcatctgccggagcggcttcaagttctcatgctgaaatgggtgtgcagcaggggtgtaggcctgctccaggacaaactgtgcgtctaatgggcaaagatcttgcagtatctacaaccagaggagagtatgtgtctgggacacattcctatactgaagaccatcccacaaagttgttcttggaattgccgcgacaaggacggccttatctctctttacaagctcaaagtgtgcccaatgtttcagcaaattctgcaagcccaagtcaatcacatatcaggtacactgccccacagaatttgagccactcattccccatggccaatgcattatctggagatcgattgcaatacgacgatcggttcagctacttgtcaggctcacagcaccatggaaatgttctgctggggagtccatcacttacaagtcatggcagtgcagcgctccgtcagaatttgccgtatgtttggagccgttactctgatccttcttcatccagtactgcatcaccctcagcaccaattttgcctacgacggcacagcatgtgacaccatcttcagtttatcatgctaatttgcctcggtcatatggtgtggtctcagctggatcgtcggttcacccccacaactctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 38989 - DNA, 51003 bp, Oryza sativa
  unsure (1)..(51003): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatgtagagaagcttgttttagtgtgcatttgtgcccgcgccagttatatgcaacatggtttacatatctatgagtaacttctttctctctctgtgacagtactgtgcatgcacacatttgtaccaacacaacatataaatctttttaatggcatgttgcctagagctagagagctttgtagccagcaaacctatggctaggttcacaattttcatgattgccggtaatatgtactacaagttactactgttccaaattaaaagcattgcaaaggtagggattaattaattgggacaccaaattaaagtgctttggcctacagtgtacagtccagtcctaggctggaaatctagggttaagcatatgggtaaataaggtcccgtttggcacagctccagctcctaactccaacttacctggagcaggagctatgccaaacaatccagatcctccatttttgggagcggagttggcagagctactccacaaatttgtactacgggggtggagctgggtttttgctgctccacaactccactccaaaccaaaagacccactaccctttaaattttttacatatttacacaaaattgccactcaactacccctaactcatctctcacccctctctctccctcccatcaggccgtcaccctcactctccactccgacgagctcgacggcggccggcgcgcggttggcggcaaggtcgacggcggccggcgcacggcgggcggcggggtcgacggcggccggcgcacggcgagcagcacatggtgggcggcgtgcggcgggttggtgcgcggtcggcgcgcggttggcggcgaggttgacggcgggcggcatcggggacggcgcgcggttggcggacggacggcggcaggcggcgggcaacatcggggacggcgcgagtggcgcgcggccggtgggcggactgcggcgggcggcgcgcagcaggaggcggccgcccgcacacggggacggcgacggcagcagttgcgattggggagtttttttctttttttttttgtaatttcagatctagagctcaaaacctaccaaacacttttcagcaggtctccaactcctacaagagctagctcccactagagtgggagtttagagctgagagttggagtttggagccctaccaaacggggtctaaaaccatgagatcactactacaaaaaaaaaattgtagccacaaaaaaatcactagtaataataacagggagctcctatgatctaaacccgcttccgaaaaacaattgtcaaggcggctgtcaattttcacatcaatgtccgtaatatgtatagcgaggttgcatttatttggaagcaattaatttaatttatctcaaatttagactttatttccaaataatttgcttttaggtatctattcctacctatatatgtgtgtgcaaatatgcatgtacttaattactaaaaaagttgaaagaacacttggtacataaaaaaggttaattagtactatggtgtatattgctaataaacttcactctgcactagtaacaattttgccaaacttctgttcagagatctatggctttcatcgagcgtgtgcaatatggatcctcaacatttggttacagttgaggtatggatactcatcagattgacctccctgtattctttccttaatatactacactgactgaccgtgtacatatatccgtgttggatgtataggccgggtttcaatccatcatccaaaaaaacatatactacactgacattcagtttaatttctttcctttataacttacatggtatatattactgttttataaactacactgacacacataaatttgtacaattggatcaggacatggagccttgtagatcaagcagcttgcaagtatccagccatgaactgagcagccctagcctcgagttcacgctaggaagaccgagctggcacagcatagatcatgactagctagctagcaagctcttgcttgcttgcttgctatatatatggacccatgcattgcacattcagatatactgtttatgaccatactcagatcgatacctgcgtcgccgcgatatcagcaatgcgcgatgaaacaagacatggatgaaaaaaaattaattaggagtggtttgtttgttttgtcgaaacaacacgatagtcccctctttcactttgctctcttttttcttagtttttcattacatttttgtatttattctcaatgtgtaagtgcagtagattatattctcatgcactacatgacactaggggtgcttgaaagttgtaatgcctctttgcaacttggtgaccggtgtaatgtatcatttgcacatgaaaaaaaaacagagaaaatatctaacctgacaatgattatattcttcttgtgatgcatatatataagtatgtgtcttctccagtctctacctagcttcaactctctacttgttccacctagccgattatacgtgttctggttttttttttcaaatacatgtggtggtaaagttgtaagaattacttcatatatcagggttcaaatattgatgcctattatttaaaaaaaaaggtggtgtatgcccatagttgccaaacatatgtaacagatttagaatgtaagtgactgcatcataaaaaccgatatatgttgatcataatttagcagagcaacaaggactatgtacggcccgttctaacttcataaagatatagatttttcctcgttttccgttagtacgcttttcaaactactaaacggtgtattttatgcgaaaactttacatatataagttactctaaaatatcaaataaatccattttccaagtttgtaataattaaaacttaattaatcatgcgttaatgactttctcgttttgcgtgcccgcttttaatcttcatctatagaagattcaaatggggccatactgcgctataactagtctatatatattgtcatgtgacaactcggattattgccaccaaatccagatctatatttctagtctttaattatgtccttaatttaagattagttggaatggtgtggcacacataacaaaacgtaagccacatccaactgttattattgacagggtacatatatataactagatgacaccttgcgctttgtcgtgggatatatgaatgaaagtgtgttgaatgttgtataaatgattggtgaatttggattgaaataatttgaaaaatgatttgaggatgatgatttagcgtgtgtgtatacatttgagtttagaatgtaataaaattgtaaatataattactatgcttgcatgttgagctttaggtgtttagtagattgatgtggcatgcttacatggtaagttttaaaagtactaataaataatgcttgcatgttgagattgagatgtctggtgggttctaactttatatgaggtcaagattagcaaaggcaagatttttgccacctcacaataaatatgtgtgtagttgggcagccatttaattaactagtttttcacatatatattattgctattttattccttttcaactagggcttgtgcaagtaagtgttactatcgttaagaggttgtcatacaattatgcacacggtggtcaataagttagatacgtacgggtctctaatgaagtagtataaaagctagatccaattggatatataatataataatacaaaatgggacctggtctgaggtttgaagggatgtcggtgttgttcatctaaagcctagtgggaagatcgatcatgatatgagaacacctaaattggttttctaaataatatagtcaagctagcttctaatttaattagacccatcatgcatgataacgtgtattaatgtcagtggtgtttcaagtgataaaacttttaaaaattgcaacaatatatttttaaatatgtagattagatgtgtgaaaatcatgtttatgtgtgttgattacctcgtaaaggtttttcaaatgatcaaacttttaaaaatcatatcaatatatttgttaacacatttagattcaatgtgcgaaaatcatatatacatgttgatttacctcgaaaacactttcacaatattatactttatcaggtttttaaatgttttacgattgaaattaaggattaaggtctgtatttcggggacatctatgtctatgtcctaaacttatgaccgaagcctgaaggagtattttcttgagaaatatgtgtgtagtatacttagttctcaatctaaatttaggaaaagagtacttactacctctaatatatttggaatttactaaggtattccttgtagctaatagtaccatctttccaaaaaggaatattggctacaaccatacatgattttaagtttacttgtggattgaaatgcatgatgatttattttagatctttacagtaagataaaaattcactgatgttgaaagcaggcaggaccatatatactactgtacatatatcgacagctatgtgttgtcaacaacaaagtagttacagtaacacattacttgcaagaaagaatataatgtagtactacacatactatacattgtttccaggcaacaatggtatagaactgttccaagctagggggaaaaaataacactgaaacatgagtaccagctagcagaggagaaaataaaaaataaacaaaaaacaaataaaaaagaaagaaacagctccaatcataaagcaatggattgcaaaatcattcagtggtccaatgcatgtccccacaaacgatgtcattcacaatgcttactttgtcggcccttttgctcagtatctgacaaaggagagggccaaaaaaaaaagagaaaaatgtttgcaaaaagaaggaaaagcatgggttgtagtactactaccaccagtacatgtacaccatcaaggaaaaataaataaaataaaaaaatgtgacaaatgcatgtcctgtgtaacatccctgtgtgcatttaaatgatttgtccggtgtgtcaaggctgttttctctctccgtggcactgtgcgtgtgcagtacagcgtctgggggcgctacgatgagatatgctactagtacatgtttcgaattggccatttatttgcatgggggccttttggcaccgtgcagatgggtagttgcactgatttggaccactgtctagtctactgctgcccattcatgtctgtgtaacctacagctaatcatatctaaataatggttcctaagttgattgcaacgggattgaagaagtccactggttttgtaacgttgaactttactttacgggaacatatcctatcctatttacacgagcttcctgtgcacaatccgtgcacaccacctagcaaatgtcatagaaaattgtaaaaaaaattggacgcatacttctaatagtattaaaccaacctatgaaatcttaacttcaaattcattatattttagctgtaacaaaaaggataaaattctgacagatttttacgataaaaactgtcagatttttcacttttttgttacggataaaatataatgaatttgaatatgagactttgcatatatgtgtaatactattaggagtatgtgtctattttttttctagaattttctgtgatatttgctagttggtgtgtatggagtgtgcactggaagcttatgtgcataggatatattcccgaactttaccaacggtgtttaaggggaaggtggcaaccagggctaaccatcaacggcaatgacgacgatgagctcctcacctatcctttgccgtcgctgacaattccctgtctttagtagagaatctatggatgaaggttatggttttgggtaggagtacgacagagggcaacnagncnnnnnnnnggggggggggtgttgctgaagccccgtgatggaggtcagcagtgggtagggctgacaacaatagcgcgagggaagccgtggagttaagaggcgacagtcagcaatggtgaatattctggcggctgagctgctagagacaaggaagagggcgatgcgggggaatggcaccattgccagcttatgaaggaagagagagggggaggcagagaagggggacggggaataaggttggtctggcaggctttgacggcaccgttgatggcttccgacgaggtcgggcaatggcgcgcttgagcagtggcggagatgggaattgattgggaggtgtcaggagttgggaagaggataaggatagggctgcacgattgaagatatcttagccgtctaaatttgaaccttttttttattctttcattcaactgaaatgaagagtcccttttccaaaatctaaaagtcaattatggacttctcaaacaattagtttaggtgaaggggaaagtgaacagcttaaaaaaactgaatgttgagtaatgtttgtttagtagttccattttcaggttttgagaaaagttaatgttataaagtaaccttttgtcttgtatgggatactgtaattaatattttatttttttgccaaggaaatgtacgtaataatcttgtttttgttgccccatgaaactatggcgaatatttttacggtaggcttgaccattttatttttcaaataatccactatgtaaatattgtacactcgtggatgatctcttattatatatatagcttgcatatgtgcggtggtgtgtctctttcttgttgtctaaaattaaaaagatagaggaactatttgattcacatggatgctactctatgaacaactgtttgtcctaaaatatacaaatttaatatgttatttgtataattattttattactattactgtgttcaaccaattcatagaattaattaaggcgtgcatttcttatttatatatatatatatatataggacactcatatggggcaccatggtgcccgggcaccatggtttcaaatgcacaaaattactcaaatttttcaaaaattttaaattgtgagtatatacctagttataagaattcgattcatacatatatctatcaacaaaacaactcaaatttaactttatttcacaattcatgattacatacctaactaattatatgtatggatgctatatacctagaatcaaaatctaacaaaaacaagttcaaattcagttcaaacttgctttgaactagttagtaaagtagttaatgttaatacctaaataattgaaaaagtttcatactcatttgaattggttatatactcaatttcaacaatggtgcccgggcaccatggagcaccaaacaaatttactatatatatatatatatatatatatatatatatatatatatatatatatgtcggtggtcggtggttgctacttccagccgcgggggccggtgttaaaccgctacatcccctgcgtcctccgcaagaagtgggacgactggaagagcgactggttctacacccccctcgccaacgaagcacgcctccaacttccaagccagcccccggcgcagttctccagctggcgggcgccggtagatctgggggaggactacgacgccgtcctcgaccgcctggcgggcctgcgatcccaggggctcaccggggccatggtgtacggcgattacctccgtcgccggattgcgccgctccaacggcgcgcccggagcgcctgggagtacaccgggcccgaagattacatgcggacccaccagggagccagatgggattgggctcctgaggacttcaagatcgtggtccaaagggtgctgaatctcagctccgtggaggcgtctcgcattcctcaggagatcctccccctctgcagcgatcccgaccgtgcctccattctaaccattatgatgggggtcggggcctcagaggagagaactcctaaggaccacgatggcgcgggcgagagccgccgggggaaacaatctgccccaggagggggtcgtgcttctgggccccgcgtcgggggcccggggagcaaccgccctgccgacgcccaggggaagaggaagctgggaggaacacctcccccatctcctccccgagggggcggggcggtgcgtgccagtagtcggcgcccggagggggtcgcgccgaccttgcagcccgagggggagcgcaagaagaagcggctccgcaagatgggggagacggaaccatcccggggaaacctgatttcccctccaaggtggtcatttaaccgaccccctcgcaggttcgtcccattctcattgcgaccgtctttcttctatcccattaagcaagttttctcttacccatcttgtttgtcttctggttttttattctgcttcagcgatgccccgtcacattccccccgccaccccaagtccggccagtccgaggccgaagatccagcggccgcagaggagcggaggcgagaatctgaccggcgtgaagccgcagatcgccttcgggaagctgaagaggccgcccgggaggccgcccgggttcgccaggcggaggaagctgctcgggaggaggccgcccgggctcgccaggctgaggaagctgctaaggaggaggccgaccgggctcgccaggctgaggcgacagctgctgctggcgcgtcacttgggcccactccctcgggcggccctcaggcgacatcctccgaggcggctcgcgacgaggccgcgggcgcatcgcctgggcctacctcaccgggcgacgcccaggaccaaacgggcccgggggacatccccgagcccagcgcatcctccggggggccaagccgcgtcgcattttctccaaggcggctcttctcctcatcttctgtcgccccgctgagcgccgagccccttctgtaggccctggccgccgcaaacaccgcagtgctggatgggttcaacgcccaagtggaggccctgcgtgcggaacgagcggagctcgaggccgcatgggcgcgtgttgaggaggggcggcgctcggtggacgccatggtggaggtgggccgtaaggctcaccgccgtcatgtctcggagcttaaagcccggaaagcggcactggcggagatcgcccgtgaggtggaggaggagcgggcggccgccctcatctctaccaccgcgatggtcgaggcgcaagacaccctccgccttcagcacgcaagctgggaggcggagctgaagaaaaagctcgacgccgcccaaggggtccttgactccgccgctgcccgagagcggcgggtaacggagactgaagcggcgtctcggcggcgcgaggaggcccttgaggcccgtgccatggcgctggaagaacacgccggcgccgtggagaggggcttgacggaccgcgaggccgccgctggtctccgagaggcgacgctggcggcgcatgaggccgcctgcgccgaggaggagtccgcgctccgcctccgcgaggatgcactcgctgagcgggagcgagctctcgaggaggccgaggccacgacgcaacggctggcggacagcctgtccctccgcgaggcagcgcaggaggagcaggcgcgccgcaatctggaatgcgtccgcgccgagagagccgcactggagcagcgggctgccgacctcgaggcgcgggagaaagagctggacgcaagggcgcgcgtcggtggggcggctgcgggcgaaagcgacttagccgctcgcctcgcggctgccgaacacaccgtcgctgacatgcagcgcgcactagattcctccatcggggaggccgaggccctccgcttggcgggcgagatggggcccgacatgctttgggactcggtctcccgcatggatcgcgccggtcggcaagcgggcctctggaaaggccagacgaggatgcgccccatcaatctggaaggcctcgctccgcacctcaacaggatggcctgggtcctcgaacgactccccgaggagctcgagaagaccatcaagtcatcctcgagggacctcgcccggggggcggtcgaactcgtgctagcgagttaccaggcccgggaccccaatttctctccctggatggcgctggaggagttccctcccgggaccgaggacgacgcgcgcgcgcgcgtccgggatgccgccgaccacatcgtcaacggcttcgagggctcggcccctcggcccgcgttcgcccccaactccgacgaggagggcaacaccagcagtgcagacgatggtggtgacgaggccgtcgactcgggcgcgtcggaatgagcccccaagcccccgccaatctttacttttttctttttctttcttctaaggccttcatgcctcttttgtgtacaaattaacttaatctgcaatcagaaatgacgaaaaaatttttgtgttagttttattttgctatacatacgcgatgaggatgatctgtgccatggtccttttgcgccttagcttgaaataagggctcgtgcccaagtcccagtcctcgaatggctcgggtcggggctagtgcctggggagatccacatgtcgagactggccaggccgggaacgtggtgaccgaggggtatgggtgacccgattgtgggtttttgccgattcccccccggagttcaccacgccccggggcacggctcggttctgggccccgtttggcgattttagctgaccgaaccgaacccccgagggcaaggttgagtacgagtgaccttattttaagtcaagattcttcaaaaggaaagaacagcacagacacaacctttaggaaattgaaactgcttctattgaaatgttgaaaaaagagaaataagaatgtaatgcatgtgtggtagcccccggccaaccctgcacacccgaggggggtgcggggttggcctgagccaaaacctgacacccgaccccccccccctcctcaggggtagaagcgacgaaggtgttcgatgttccatgggttaggcagctccgtgccgtcgcccgtggccagccgtaccgagcccggccgggggacaccgatcactcgatacggaccctcccacattggtgagagtttgctcaatccagcacgcgtttggacgcggcgtaggacgaggtcgtcgacgcagagtgatcgggcccggacgtggcgctgatggtagcgccgcaagctctgctggtagcgcgcggctcggagggccgcgcgccgccttcgctcttctaagtggtcgaggtcatctctgcgaagctgatcttgatcagcctcgcagtacatggtggcccgaggagacctcagggtgagctcggatgggagaaccgcttctgcgccgtagacgaggaagaaaggcgtttccccggtcgctcggcttggtgtggttcggtttgcccagagcaccgctggcaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggtactccaaaacgggccgtgatgcccttaatgaatttaagagcagagtgcttatcgatcttgacaaccggataagcctcgggccacttagtgaacttgtcgatcgcaacatacagatactcaaacccgcccggggcccgtttgaacggtcccaggatatcaagcccccagatagcaaatggccatgacagtggtatgatctgcagggcctgggccggctgatggatttgcttggcgtggaactgacacgctctgcatcgccggaccagatcgactgcatcattgagagctgtcggccaataaaatccttgacgaaaggccttgcccaccagggtgcgcgaggcggaatgggctccgcactcgccctcatggatgtcaacaagaagctcaacgccttgttcctgaggaatgcacttcagaaggattccgttagccgcgcgccgatagagggtcccttctaccagcacatagcgtttggaaatgcgttggacgcgttcactcccttcgcggtcctcaggtagagtcttatctgtgaggtatgcttggatctcagagatccacgcaatcaatctaagggagcttgaagcgctcccttcgggtcccgaggcctggactccgacgggcctcgggggccggtcaggcgtatccgtttcccctaaggggtcgggtcgcgccgacggctgggtaagcctttcttcaaaggcgcccggtggggtttgggctcgcgaggacgcgagccttgagagttcgtcggcaaccacgttgtcccgtctgggtacatgccgaagctctatcccatcaaaatggcgctccatacgccgcacttggcgtacgtaggcgtccatctgtgggtcggagcaccggtactccttacagacctggttaacgaccagctgggagtcgcctaacaccaagaggcggcggatccccagtccagctgctactctgagtccggcaaggagtccctcgtactctgtcatattattagtcgctcgaaagtcgagacggaccaagtatctgaggacgtctccgtttggagaggtcaacgtgacccctgcaccggcgccctgaagagacagagaaccgtcgaattgcatcacccagtgggcggcgtgaggcagctgtgaggggtccgcgctggcctcggggattgagacggtctctggagccggagtccactctgccacaaaatcggcgagggcttggctcttgatagcgtggcgtggttcaaagtgcagatcgaactcagaaagctcgattgcccattttaccacccgtccggtaccttctcgattatgcaagatttggccgagggggtaggacgtaaccacagtgacccgatgcgcttggaaataatggcgcagtttcctcgaggccatcagaatagcgtaaagcatcttctgggcctgagggtatcgggttttggcgtcccggagggcctcactaacaaagtaaacaggccgctgcacctttcggcggggccgatcctcttcgctaggggccgtatccccggggtgctcttcgtccaagtggcctctcggggcacactcgtctcctgcgctgatgacctcggggtccgaagatgacaggtgcggccttcccacagtggcctcggggccgtcctgggggtcgggggctcctggcgtcgtcagacaagcgggcaaagggccagctccggtcgtcaggggcctcaggcctccgttcggctcgggggcctcttctccctgctctctcccgggtcgaatcagcacagggttagcctcggggtcaaagggtggtaggtgcggccttcccgcagtggcctcggggccttcctgagggtcgggggcacccagcaccgtctgacaagcgggcagagggccgactccggtcgtcgggggccttaggccaccgttcgactcgggggcctctcctccctgcctgctcccgggccaagtcggcacagagtgggggtgcgtagaatgaggattgtcctcatcgcgctccactaccaacgctgcactaactacttggggggtcgctgctaagtaaagtagcagggactcatttggctccggggcgactagaaccggaggagagctgagatacgccttcaactgggcgagggcattttcagcttcctccgtccaagtaaacggccccgagcgcttgaggagcttaaataagggtagcgccttctctcccagcctcgatataaaacgacttagggcggccatgcaaccagtgacgcactgcacatccctaagtttgctgggggggcgcatccgctctatagctcgtatcttctcggggttggcctcaatgcctcgggcagagaccaagaacccgagaagcttgcccgcaggcacaccaaacacgcacttatcggggttcagttttatgcgggcggagcggagattttcaaaagtttccgctagatctgagagtaaggtctcttggttgcgcgtctttacaaccaagtcatcgacatacgcctcaacattacgtcctatttggctacccaaagaaattcgagtagtacgttgaaaagtaggacctgcattctttaacccgaagggcattgaggtataacaaaaggttcctacgggggtaatgaacgcagttttctcctcatcctccctagccatgcgaatctgatggtaaccagagtatgcatctagaaaacacaaaaggtcgcaccccgcagtggaatcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgcactttctgccggaccggccttgcgcccggccgcacggcgagacggtgctcaatcaactccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggcaatccgctgcctcggggcggtgggggcggaggtgccaagcctctcgtcaccaccctcgggcttggtcgcagcagcgaggtggtccgcgcgctgctccatgcaagcgagcgcgactttaaggtcgccacggacagagatggggccacaagggcccggcatcttcatctggaggtaggcgtagtggaccgccgccataaacttcaccaacgcgggcctccccaggaccgcgttgtagggcagactgaggtccgccacatcgaagttcacccgctccgtgcgaaagtttgctgatccaccaaaggtgaccggtaggtcgatgtggcctaacggccatgtgtgccccggcgtcacaccaatgatcggttgagacggctggagaaccatccccggggccttgatagcatcaaaggccgcgggggaaaggatgttgagagccgctcctccatctatgaggacacgccccaacttcacattgcagatggtgggggaaaccaccatcgcaatctgccctccccgggcaaacacaccgagaaggcctctttggaacactaggaaagacaaaacacagcatttaatttctgtatgatcatactcacacatgtacagaacctatgactgtaaacacataaatgagaaaaatgtaggtataactgtctggatggtccacatgaaaaatacaacaattagattaggtgatatattgtaaattaaaggagatttctttgaaaacattggaccccatgctaacttatttccttgaaaaaaaatatatatgcagtaggcaatttcaaaggaatcctttgaaaggattttctataggatttgatcctacaaaattccctccaaatactttgttccaaaaggggcatttagttacgtatttgatccactggaccatgtttgaaaaaaataaatcctagatgtgtttgtactgtgttcaaaagaatctaaaatcgttcttgggtagttaagggtttagctgggttttaaggtttaacttgaagtacgggtactatatagtaacaattcaccaacagattacgttagatcatagtattagtgtattagtagtatgtacttcctccgttttctaataaatgacgccgttgactttttctcacatgtttgaccattcgtcttattcaaaagttttattcaaatgtataagatataaatcacacttaaaatactatgagtgataaaacaactcataacaaaataaattgtaattacgtaaattttttgaataagacgaatggttaaacatagaaaaagttaacggcgttatctattaaaaaacggatgtagtaataggagagtattaatttgctgatcatgcatgtattgcgtacgtacggtaataattaatggtcgagaatattaacaagtactcctacaaattactgaatttaaaagtacaaacaactacaagttaccagaggagagaggacatatatgtatatatatatatacacgtacccagaagcatgtacagtcgcgtacgtacggttgcgttcgtacacgtatgatcgctaattgatgtgagcactgtagctcagcaagtacatgcgcgaaataattaaacatgcttaaaatgtactccctccgttaataatacacggattttgagtttttacttgcaacgtttgaccactcatcttatttaaaaaattttaaaattattatttattttatttgtgacttaatttattatctacagtattttaagcacaactttttgttttttatatttgcaaaaaaaaattaaataagacgagtgattaaacgttgtaagaaaaactcaaaatcctttatattatgggacggagggagtagtaacattgagctagcgagctagaggtactagcagcttcaaggaaatccaggagtaactctatggagatgttgccaatatgactctcatgtttaaaatgactccctatattattttcataatggttttcactgaagtgaagcccacatgatatcctaatcaccaaaaaaccggagaaaggagagaaggaggatatgacatatgagtcccactctactttttaatttccgagatgattggaatgagtgaaaactgactaaaaacaaccgagagagtcgttttgaatggctttaatagttgaaggggtagatatacctggtttttcagttgaaggatatgaattaaatccaacctacaccctctatctttactattataaaaatgaaagatgtttttaccggtattttggtacgtcatccgtgtttaagtcggtttttaagtttgttcgcttttggaaacacatatccgtgtttgagtcaaattttaaattcgtttgattttaaaaatacaaaatgaatcgtataagaaatctctttaaaaaaactcgcatgctaacttaagatgaatatcggactcctaattgcagcttatggttttccaaaaagtatatccaaacgaatttcaccctagctaaaccgtataataataataatattaaaatagccttgatccgtcagaactcacgaacatttactttctagtcttataaaaaaaatcaatttctagatgaacctaaacaagcatgtatccaagttcatcccccaaaagttatctatttttaggatagagggagtgcaataagtaggaacttaggcccttcacagtgctccaccctggagcgttccttcgtcccaccacgtagacttcgtgatgtcatggaggagagaatgtgtgggcccgagttcctccgcatgattgctcggttccttggtgagcaacgagttcctcataaaaaagcctgcaaaaaggtctgaagcatgcacaaaaccatcggaaagaggcgaggaagagcatgaggaggagaacgggaagagtctgggtcacgcgtctggctcgccacttccccaccgccgaggccgccgcgctcgcctacgacgacgccacaagccaccaccgccgccgcgctcgcctacgacagtgtcgcgagcgcagcggcgcacgacgacgctgcaagccgccgtcgtcgcgtcccacccggtgatcgtcgggctcgccagggaggtcgccggcgagtgccgtgggctgccactcacgctcatcaccatcagcatggaggaggagaacgccggcatgctgtaggaccgagatgtcgactagaggagggtgaataggcgatttaaaaactaaatgacacctaatcaaaactaacctaagttgctaggctcggtgagggttaagtctaactaagcaactaagttatgttttgcaaacctagggtgatagtggctcaattaattctctaggaaagtaaattacactcctatgtcaatgttttgcaatcctagggtgatatgatctcaagaaagtctctaggaatgtaaattgcacaaatgtaaatgcgacaatcaaatgagacaaggagacaagagatttttcaccgaggttcggaaactcgccggtttcctattccccgttgaggcgagcccaactccaccgctcaaccacgaagccaccgcacgcctccttcgtcaaggggtgggcaaggcgggagccgacccacggagaggactacccaagcctcgatcactcggggtagttcttccttcactccgaagttggtgaactccaaaccacccacaaaccggcaccgggcctcctccacaatcttctcggagaagtcaccgggcaactcctccagaagccatctaggaggcggcaacctccaagagtaacaagcaatgacccggcgtagagatgatcaatcaagtgccacactagctctacaaatggaagcaatgcacttgactcttggctagaacaacctcaaccactacaatggatgaacactaagctaaaaggtgtgtgagagagatgcaaggggtgtatgcaattgaattgggtgccgaaagagagcccccttgctgctggagggggagtatttatactcccaccaaccaaaactagccgttgggggcgaaatcccccaactctgtgtgctgctggtttgaccggaggtatgaggccggtcagcccgtgctactctgcaacggctagaaaactagccgttgtagccctgtcagagggcccaatcggcctggccggtcagaccgacatggggtggccagtcagaccgccctcaacttggtctgaccgaatacggctccgtcggctctatatcggccaccccgagcaacaccatcccggccttcagggggccggtctgaccgcacaagtgccgtcggtcagaccgaccttgtgcgccggtcagactgcccgcttggggccggtcagaccggccagggaccgccggtcagaccgccacaaggtggccggtctgaccgcccttggtcaggccgaaaaccagtgaatacaaggtgttagtgtgtgttgtgtgaaatgtgagcacaagtctaaatgcataatgacctaatgtggcaattaaaatcatctctttgctagatcattacccctcttaatagtacgtcgaaactaaaaataaactagcaaatttgatcgccctacacctcgattaattcaaaacaaaagcactagttttaccgtcttttttccctttactttgcgccgtcaattttaatccatcgataatcatccatgcgcacatatgacgtgaacctaacttaaaatatatagctcaaagacaacggttagtccacaattagtgcttgtcattaattaccaaaattaacaacgggggactagatgcttcacatgcaggacccgctacctcgccacgcgcgcagctgtcccgccatcgaggtcgccgccgtctgccctcgacaaggagaggaatgggcgggcggagaagctcgccggctcgatggggaaagcgtagagaaggagaggagctcgaggtcgaggccgcgtccgagctcgctgttgtcgccttgatccagtgagcctaggccagatctggctgcttagcctggcgtcgtcgccgtcgccgctcgggccaccgctccgcccggcttcaagaggaagacgaggtcgcgtggctcggtcgacagcgacctccgcgaggacgaccgtgccgccgcttgtcgtccgcgaggaagacgaggtcgcgcagcgacctccgcgaggaagaccccgccgagagtccgtcgttgcagagggggtagggggagggaggcgccggtgcggcgtctgtggcatccagcctcgatgatgagaggcaccggcgtcttcgcatccttgcccgccatccttgccccttgccgcttgccgtcctggtttgggaatgcgaggagagaggatagagagagaggggaggagagatgatggatgtgaaaagagagatgggtgggacccactaacatgtattgcttaagacacatgcactgtaaagtgtggttctttacccggttcgttgtctagctggaggctttgagctcctcatgtgcgttacccgcactgtgaccggccttatattagacattttgctcacacatatacagcagacaaagcccaagagcatcatcgattcatcgtcatcccgggatacccatacgagatgggtctcaaacgacccatgggacataaatctcatccagcccaatcccagcccaactcgcgagcccgtcacgtcacgcttcgcacccaccagtccacctcctcctcctcctcctcttccgcaccgcgccgccccgtcgccggccgcaaccaccaccaccactcgccgtcgcctccgccccccgcacgcgctcctcccctcccctcccctcccctcccctctccccggccgcgccgctcgccggatctctcccctcctcccttccaggaaccccagccaagcaggtagcgtgtgacgggggaagggggggatggggctctcgtcggcggcggcgggggaggggccgcagctgtgcgtgttcgacctgaggcgggggcagcaggaggggcaggagctcgacaagatcctcttcttccaccccaccgactgccccatcctcctccagctctccgtcatcggcctctgcgaggggatcatcaccttcgctaggtttgcagttttgctccacccccttctcactcgcatccccctcctgttcgtgctgctgcttggctcctcgcgcaggttggagctcttagcttattcggtcggagctttgttgctcgtggaggttagttgtttaggaacgatttgtagcacttagttgcgtggacgagcggaattccaacgaccttgaagctcatgggatttcaggcgaaggggtttatatgggaaaattctggcgtgttgattgtaatcggagttggaggtgaatgaatttggttcatcagggtgagatccttatgggggataattctggcgtgttgattgtaattggagtccgaggtgaatgtatttggttcgttaggatgagatccttcttagatccccatagaacttaacttttatctgcttcgagatagtatagtcagacatactacccgttctgttcttgaatccaaattaggtgcagtttcactgcttgttgctccttatttcagaatccgatttttaaattatttcacaaaattgtagtatatgtaactaggggcaaaatttgcctgttattttaatttttgcttttagttccaaccataagcactttctcgcgactggtgcttctgcacttataccttttgcttttatctgttggcttatctatctaaatattattcctgtgcagaatattttctcctgatgatgattgtgaggtgatagaatcagagaaacactcccatgttttttaccaagctgaagcagatatatggatggttctggtaatggctgttcttacattaacagttcatcactatttgttataaaccaaattgttgtactctagagcctcttcaattgggtgtagttaaaaacagcatgtaacctttgtctgtcacctattgtcattgaacaatatttactggaaatcctgaaaacattcaagaaccaagagtatttctagtctgccaccaaagtaaattctgtaacgagaacatgggcgttcatactcaagcatactatgccttcagtctcgcagatagtataatgaccattttggatttctttatttttaactgaagaagctatgagtttgcttcataacacttgttcctttcccagcaaattgtctgtaaatctttttttgcacttataacttgaatgattatcatactcatttccagtgaaaacttgttcatgcataggtagtggagaaaaacaaggacattgagtcaacttggcggtgtggtgcattgcaaggaattcttaaagaggttcactcgcttttcacaatgttccacggaccaattcgaactttacttgacaggcaacccagtgcagaacttgcccgtggtcaccttcgcacatttttcacagattatttaagtggtgagtctcgtttccattcatattgtgtataacatgagcgcaacattgccctttaaagaaatatacatttggtcttcatgaacatgttcttgagcagattttaatgctggtaaaaagatacaattgccaaccttccgtgattgcctaaaggagcgaggaactgtccaaatgctaacaatctcacgagaagtggcacttgaagttcaggtaggaaatgtactcttcaaacatgaaagacctcctagttacagaaatataactgtagtaccttttgatcttttcagggtacatgatagttgtctcttgcttttataattattgcttgtgtgaaatatgttatttttcttgctagcggcctgttatttatgtcctgtccagagttgtagtctggttttcagattatgagatcggcgttttcttgagggtctagtagtcattttcgaaggtagctaatgatgttataggcttaaaaacggttgctctgttgtacttgtaggagtatgtacttatgcagaagcctgctttccgagggggagaacttttggaatcaactctcacaacttaactacccctagatagctattgtctcactgttatagtgttatgaagctgtgcttaaagtactgtctaaagtcatcttgactctgataattacatagatttgttttctctgtttcaactattgatgcatgaatatttgcagtcactcaccacagttcttgggtcatgtcttggaaatgtcatgtgccaatcacttgtattatttgaagatctcttggtgtccacaacacttccaccggtacggggtctccctttaatcatcacttcttttataactttgttttctttgatggctttgagcagttcccatgtgattaatgtagttttaccactttgtaggatgatacactaaacctatatacttatgctatcttgaggttaactcctcgtgctttattgtccaatgcaacttcctggtcctatctgcggaaaggaacttcggttcatgctggccccacttctagttcatcaaatggaacagcttcagtagaaaggtatcgtagtcgatctcgtgatacttctcctggtggacaaaatcagatgcatcattatttcaggcctctccagcgtgagaaactatacaaaggaaaggatggttttgttgccgctggttccactacttcagaagttcgtggtgctgtggcttgggttcccatactgtggttccagcaggcagaagaccgcatgcatctctgtgtttatcagcacaagaacataaccattctgctactgattccagcttcatctctaataaatggagatgatggcattgctcatgtgaagagacatcttcttgaaaatgtgagtggcccttgcataatttccacccttttcatgatttcttgatgcggtactgagctcaagcaggccatgttgaatgaaaataagaaatattctcatgtctggtgtggcttgcaaaatattgatactgtggttgtgaacacatgctcatttttttatatttatattgcaggcatcacagaacattgtgactctggagctgaaattatcacgaggatggggaggagaaaatgcttatcatgttggtggatatcgctacttacttgttgatccagatagaaaagtatcaagagcctccccacctgggaaagtcaccaccctctcaaaggtttgttctgttgcatacttgcatatagagtaaacatacgatgtttcctacaatatgtgttaatggttctgttcttctcttcacctcaatatttccataaattttagatcctaaagattgttaatgttggtctgtttttgtagactaatatgttttagatgatcaattcgtatctcctgttcatttcttcctcactattgttcttcggttgcaattttacgtttttgtgttgaattggattgccatgcatttcttttaaccgtgctctgcaatgaaatcatgcaggattctctactttccttgaatagactaagagaagaaatagatttggagaagtcaagggccaagaggtctgactcttgtcatgacaaggattttgaagtatgcatcagagccaaaaataatgcatgggtcattgctaaagttacccgaggaagagaactttatatggcgttagagaaggctggtgaaacacttctttatgcatctactgccatcgagaagtttagcaacaggtatatttactcaataccttgtaaggtcatgttcggtaaatccctaggtggggggaatggaggggatttattccacacctattgtgatgtggaattattccctctcaatcccctccgatcctcttcaatccccatcaaactgaataaggcctaaaggggcagaagcatatcttaccacattatatgaccagctttggtttactgtgaccacttgagttataattccactgtcatgcattaaccgcctaaacgtggtatatctcaatatcttgtaaaggggcagaagcatatcttaccacattatatgaccagctttggttactttgatcacctgagttataatagttccattatcacgcattggcctaaccgcgtaaacatgctttcgatttttctaacgattgccttcctctctcaggtactgtgaaggagcattctctacagactagaacaccgaaatgacaacgattgttttatccaaaccactcacctatccagcttcgtcatttaggctgtgcggctcgctccctcatggtgtcgtgaatatggatcttgttattttgaagagattcgtacatgttgtacagctgccatgttgttgcctttctatgcatacaaaacaaatagcttcgtcagagaacaatacagcgcaggaaacagtcagtttcccctgccctgcgctccgacgtccttccagttccagattcgaccatcttaatttgtttgttgtatattctgacgatggacctgctgacttatgtagtagttcattcgattgcttcgatatctatgtttcaattcagtttgttgttgtgatttgcgtaacttatacccagagtgattgatttcctgggggatttgaagatgtgccagaaagaacgtgggatgctcaccgggaagagatcatgagaatggttagaaaactataggtaagatgagattctttggacacagtaaagccgagtgttcagagacaaagataggaaataaacatgttgatgaaaaaagaatcaatacaaaccaaaaaatagctgattgcttgaaagcgttcatagagaaacgtaatgatgaaaatcaatacaaaaaaaatggcaaaaatattctacaaaaccgattgctcatccggggaatcgaaccccggtcagtaccgtgggagggtactatgataccactacaccagatgcgctttctgtcatcgttctgaaaatttaggtatatgatgatataatttcccggtgagcgaacgaagataactgagggctttgatcactttcttatcaaaatcaacgttactaaaattttgtaatatcaaatttcgatatattttaatgttatcgaatttttgtagtgttgattgtatttgtcttaaagtcttaccaatttttcatagagtatctaggagagaatctttcgaaattaccaacatttaagtagggtacaaatggtaaagttatatttaactttttttaattacccatatatacggcatgtttggttggagggagttttaaaagggattgagagtttagagggatgatactattaagtgttttgtttggaacttcctccttttcaatatctggtaggggtaggtaattgggaaggaattcctcatttactttatctaagcaaatatcaattatccgtttttattaatgatctaatctctaactaaactccctatcaatttccatcacctctaccaaataagatattgagattaaaaattaaattcacatcttaatcttatcatcaattcactcatataaatttccaatcctcttcgctcaaattccaaacaacaagctatgagcgctgggggcgtctatgggagcagtcacctaacatgtggaccctatatcgccacgtcctaattaacccaggcggccaggtgggccccacgcctaggccaaaacccacttacatctgggccccaccctcgcctctcccggcgcgcgaaaccagaccatcgcaccgtccaccaccagtctcgtagcatcgtggcgccgcaccgcgccgtctccctctctctctctctctctctcttccccttcctcccctgaaacctaacgcgccaccgccaccgccgccgccgcctccctctcccaaatcttcgccgggaatcgcgacgatcaagccacgaggatcgctgctgctgctgcagcagctttgcctgtgcttaacgcccaggtataatgcggaccaggagccagcgcgacggccaccacgccgccgccgctgccgaaaccccgccttccggttcgtctccgcccgcccgccgcgccgcggcgatccaccccccctcccccccccccaatcctgttcccacgaaccccgcctccgtcatcttcccaactgaaaccggtgtttgttcgtcccgcaggggcaagcggaggatcaggaggggacgttgcgaggggcggtggcacgcctcgccgtcgccggagggcttcgccggccgcggagaaagggaagtcgcccgccaaggtaaattaaattaaatcggtgtttgtgaaggactaaaggctctgtgcttgatttcctcattgcgacaagtcgagaactattttaccatctgtggcttgttcaggaacttcgggctctaaatgttccttgtggttaagcgcgattgttcgacatatgttcacattgtatgacttcaaactctctaaactagtaaattgatcaaaaatgctctgggtccttattatttattcaagtctaagttttgcactcttaaggagtgtaattgagtcggaagcatatgtcaaaaggatgccaaataattactatagaatgcattgattttgagacaaaaaaataaaccaactcgatgtgttgaatcatggataggttctggcttaggactctgaaggtttaatgatgttggtggattttaagtattactcctagctgatagggctcaactgctattgtctcttcaggtggaaatggaatcggcattggaggataaaagtaaaaacgttaaggtccatgcagagggttatgacgatgccgggatgacgaggttcggtagggatggctctgaaaagaacagtttggaggaagaagatccagatgcagctgatatggactgggaagaagggattgttttcgcggcggaacacgatgagtgttattcccatgagcttggagagacagtcaccgttgagttcactgatctaccctcttccactgaaaagaagactgctcggaggcttactgctgaagaaaaggtaaaatatttcttgagagaaattttcagttaaggcgtctgacacagatgagctcatggacatttgcattaagtttataacctgttactataagtctaattttatcgttgaaaatttttttataaaaaaattctatttgccttctaagagtttcctggcgccagctcatttgccaagttgtatgtaatgctcaggagtttcgtcacaagctttggaccatatctaaaagagtcactgccttttcctttcttgtgtgctttaaatatctttgttatctttgaattttgacctgttagttttatttctgattatccaggagttggctgaactcgtgcacagggtccatttgctttgcctactagcaaggggtagggtaattgacaaggcttgcaatgatcctctgattcaggtgcgagcattacagtggtattcattatttcatttacaccagattctgtatttctcatgttccaaaatgatgaagtggcattatgatttatgaatcatagtggttaaaacagaggtgtgtttcaaacagaattgtgtcaatattctttgaaatgttctttccaggcttcaattctctctgttttaccacaacatgtactacggaattctgtagacactccaattctgaaagctaatgaactgcgtagtcttgtgagctgggtaagtccccttcatatattattttattgactaaaaatgtgaagttttatgaaatagtagtttttagatgaaatcttttaatttgcatttatttgtctgcagttccacaacactttcagtgtaattgcacaatccgacgacaaggggtcttttaaatcaaatttggcatttgctcttcaaagttatgtaggcactgctgaagaggtatcatcttctccctgaagattatgctgtgaaacaaatctgctgtctttatttcagcaaacttatttttcttattcatgtttctcagatttggaaaacctaaaaagtgaataagagttgtcatatttcaatgccccaaaatatgttttccattgagatttgatatggattgtcaatgtctacttcatttcttttggaaaaaaaaacaatctttagttgccactgaaagttgacaccattggttatgtgccgtcaggaaacttggtctcccttcattgtcacccctaaatattgttctgttatttctattgtcgtctgcccttttaggtaaggttgccaccaacatataaaatactgtcagtttttttttctttttggggccaaaatagaaggacgagagactccagcagctcggtatgcgcatgccaagttggtggcatagagtgttccatcagtaactgtgcacaaaacaccaaaggcctaccgacatgactcttgcctatagtggtcatgagttacgcaccatgcagtaacactaccaaaggaaagcaagagatacattcacaggtcgacggtcgaccagtcttctcaccttggaacgagggagaatagggatgcattaacaagctgatcagtcctagggccatcaaacgcatggtgcaggtgtgctttctcatggcgtgaacaggtttcagtgcacaaacattgaaaccaataagcatacgaggtagaatgcgtcatgaggagtactgtgtagttgtcagtgggaatcaactatccttttgcaattccagtgaggaaatgctctgaaacaaatatggtaaaatgattgctttaggtaaagaaatatgggtatgggaacacatctttacgctgctgaaattgttcttggacccctggtgctccggttctcaatggggaagataatgatggagaggttccttgatgtcacaatggaaggaggatggagccagtgcacctggagtgaccatgactaccttgactcctttttggctggagaagatgcagaactgtcttttttttttgtggaccacttaacagcaaacttatacaggactgtcgagtggcaaataaggtaacaaaactctgaaggagtagcaatgaagggagaacttttcctatggcatataaggtataatgtcaactttcagtctttcaatggcaaataaaaaatctcctcttttgtaaaacaagacgctatttctgtttaaagctgccaaataattcgtttgcaatgcaggtttgtgcactttcagtggcattgtttagggctctcaacttaacagctaggtatggatttcactctgtaattagttttatgattgattccatccattccagaacgttagcataaaaaatccataaatcattttgcaatccattctcgtcgaatgctgtttgcttttgttccacgcaggtttataattatagtaaacagtttccatgatatgtattatatgtttaattccgtggtgaaaactggattttctgatctcttccagagaatagatttcttctttttctttgttctgataaaaaaaaagaatttgtcatattctaaagaagtggttcagtagaatggactcttaactaactttcaataaactacagtttgataaaatcctcgggtgcttgggttagaatagttgatattactcctccccagactgatttatttttttttcttcctatcgaacttcccataaagatcaaggaaatttcaattgtaagaccatctattatagttagtaaaagcgcatataaaggttcattatgttgtcctgtggttttgttcgataaccttctgaaccaattctaagtatagcttcccttctaggtttgttgcgaatctggatgttgctggtctcaagcctgacactaaatcaatggggacatcaaatcaggatgaacctaggctttgtacaaaggcgctgccatctagttcttttgttgcaggccataatgagtataataacctttcacctgtcctgtcacaaaacaatactgaaggtagcatcaatacaactccaaaacaagtcaaagttcaaggctgcaggaaaagtttgtctaaaaaattgtcgaagtgcaaggcaaatcagagagatagctctgcatcactatcaaaagatagctcatccagcagccaatatccttccacctccagtaatgctgaagtaccaagacgaaaaggggatttggaatttgagttgcagctggaaatggctcttttagcatctgcagctaaaagtcaagacaacaagctagcaactcaattaaatcagtcaactgatagcttactaagttcaactccaccattgaagaagttacgaaaaagtgaagaagcctcaagcaactcgagcgtggtttggtcgaggaatagagcaccgttattttgggctgaggtattttgtggtggcgaggcatcgtctggaagatgggtccatgttgatgttgcaaatgatattattgatggtgaacaaaaagtagaagctgcttccgctgtttgcaggaagcctttgagatatgttgttgcctttgctggaaatggtgctaaagatgtgaccagaaggtttacctctttcataattcctaacttagtagctatatagaatcatgaggatatattctttgcttttggaaatttgtaaaagaactggtttgagaactgtgttctatattttcctaggtattgcctgcaatggcacagaattgttcaggggagagtgaatcctgagtggtggaaaagtgttttggcacccctagagcgtcttgaattggcagcaacgaacaacactgaagaaatggaacttcagaccagggccttaacagagcctcttcctaccaatcaacaggcaatgcacttactgagtttacgatattggttaacttctagttatgccttttgcttctttcaaaggttgcctgttggcttttctaattatttatgtaaccataaccacttaggcctacaaagaccatcatctatatgcccttgagaagtggcttcacaagaaccaagttcttcaccccaaaggcccagtgcttggcttctgtaaagggaatcctgtttatcctagatcttgtgttcagacactgcaatcaagacatggatggttgcgggagggtctgcaagtcagagaaaatgagttgcctgcaaaggttcataatagaatcacagcgctagcagtttttttctgtcttcatgtgaagtaaccatttttctgtacacaggtcgtgacgcggccaaagaggactttcaattctcagtcaattcaatctaatagtaatagtaatgaagatgggcttaagccaaccatggaactatatggtaaatggcagctggaaccgctgcaacttccccatgcagtaaatggtattgtaccaaaggtagacctccttgattatgactattgattttcattaggtagctatcagtgcttattttgtggtgttccatgctgattaaatgctaaaatatgtccaagaatgagcgtggtcaagtcgatgtgtggtcagagaaatgtcttccgcctggtactgtacacctgaggttaccaagaatattccaggtcgcaaagagacttggaattgattttgccccagccatggttggatttgattatcgaaacacccggtgccttccagtttttgatggaattgttgtctgttccgaattcaaaaatactatcttagaggtatgctgagtacttgatttatttttcaaaattctggtcccattcatcctgctgtctacaattttagtcggatcctttatgcaatctgatgtggatgtttaattaggtaaaattattaacaatctttaacaatcacaaattagcccaaacctgttagcaccttagtcaaaagtgtgtgcttgaaaggtatttgcacactttgtaaatatttttattttgttttcttccccttgatgaaatgaaatgcagttctctcgttttcgagaaaaaaaaaggtatttgcataagcatgtttcataatagcgcttaactcattgttgagcatgtctcattataatgcactcaatgttatggaaagtagtgtaatgatcaagagtagaattgttatattcatgtatatgctagaggtagtgatggtattatagtctctaggttcctgtactctcttgcgtaacaagaactaacagggaaaattgctcagtaacactaatcactcgagttagaaaataacatcgatgtgtcactgtcatgtaggcctagggccaaagctaattctcctagtttcatcaggtacatacaaagctagctctatagttggtctaacttactcctacgctttctgccaggcatatgcagaacaagaggaacggagacaagccgaggagaggaagcaggaggaagctcaggctcttattaggtggtatcagctgctgtgttccgtcgtaaccacacagcggttgaaggactcttacaaagcaccctcatcagagcacggaccagaaggaccatcccaagatgttagtcagcagaagggcacacgcaaaagtcgaagctcggaaacgaagactcgctcaagcagactacaggcggaccgaccatttgattctccttttcctgtccatgaccatgagcatgagtatccagaggaagatcagagcttcgacgaagagacgtttgtgaggacgaaacgctgtccatgtggtttttcaatccaagttgaggaattgtagcaaaatgatatcagaaatgcactaacttaaggtgtagcctgtttttggtcccaggtgaactctcaaaactatggtagctgtgatgcttctgacgaatgcaggttttgatgcatttgtcttgagttgggagttaagagtgagtttgctaaacccatagttcagctgttgcactgaaatgaggtgttgaaagttgaagctgatggtatgaaatgtagtgggtgttaaaactgttaacagtatatgcttgtttaagtttcagcatagtgccatcacgctaagattttatcaaactaatgttgagtttgccagttatttcttttacctcttcactgctaaacttgattaaatttctatcaccaactttattgcattcacatgttgagaaagaatctcagggaatttgagaataatgaaataaacaatccaatccaacgtcaacagtgtgtgaccttatgacactgcagaatcggcagccaggaacagtagaggaaatggaacaacaacaaatttggcaatgtctccttactgaaagggaactcgagggaaaccgtggacgccgcacgccggcccggctcgccgccggtcacgccgacatgctccggctgccgtccgtgctgccggagtcggcgttccggcacgcgtcctcgacgatgcgctcgatccgcgcctccacctcggccatggccggccgccggtcggggtggtgctcggtgcactccatgcccagctgcagcagccgcatcatctccccctcggtgcgcgcctcgttgccgatggcggcgtcgaacacctccgacgtccactcctcctgcaccaccgaccgcatccaccgcggcaggtcgacggcggcgccgccgtccggcgtcgcgtcgagcggcggccggccgctgagcagctcgagcagcagcacgccgaagctgtacacgtcggcgctctgcgacacgcgccgcgcgtcgaccacctccggcgcgcggtaccccgcgccccgcttcgtagtcggcggcgccgccgcgccgccgacgagctgggccaggccgtagtcggtgacgtaggcggcgtcccgtgtcgcggtgacgacgacgttggacgacttgatgtcgccgtgcgatgagattggccctccgcggtggatgaacgccacgccgcgcgccaccgccagcgcgatgcgcgcccgcgccgcgaagtccagcttctcgccgttgcctacataaacatcaatcaaatcttatatgaagttactattcaggaaacgtattgactccaactttaaacacaactacaaaagtgtgacatgaaaaaaaatactccctccatcataaaatataataatttttagccttcagaatttattctaaaatttataacaacttttctaccaacattttcttcacaaccaatcacaaccctccaccattcatttttctcacctacctcaactactcatccaatcacaaccctccaccacttacttatacctactttcttaataaccgtgtccaaccttaaaacttcttatattctggaacggatggagtactaaatactatgtgacggagcataaagacagcggccatatggatatttatcaacttcatgtgcagatttacaaatagatttgaataaatgtttgtctttattttgtgttagggttattagttattgtttactacttatttttctggtttatatatgctctctattgagtgaaataataagagccctttgaatcgcaggaatgaaaaaaaaataggaaatgtgcatgattttaataggaaggtaaatacaaaacaaatgattgcaaaatataagaaaaatataggaataaccgtttgattggactcataaaaaatacaggaatgggatgagagatatagactcaaaagaaaaatttttaagaggttagagctcttactaaatttcctccaaaatccatataagattgtccattccatagaagtttcaaagaataagatagggttcaatcatttatttcaaataccttcatggaaattttttttatagaattaaaatcctccaaaattcttatgtttttccgccaaacccataatctctttataagcaaaagaccgtgtttctttcgctgcacgaagagaagtgagaaggcgaggtgatgtgatgaacgaaccgtggaggagggcggcgaggctgcctgcgccgacgacgaactcgtagacgaggagcttctcctccctgctgtagaagtaggcgaggaggcgcggcaggctgtcgtggctgacggcgccgatggccgcgacgcggtcccggaactcgcgctccgagaggctcacctcgcgcagccgcttcacggcgagcaccggctcgccgccgtcgagcgtcgcgcggtacgtcgtcccagccgcgcccttgccgaccacctcggccgacgcgcgcagcagcgtgtccaggtcgtacggccgctccggcgcgccgccgacgaacaccagcttggtgctgccttcgcccggcggcggcggcgagtgcgactgcttgacggcggcgtccatgtccgtcctcgccacggtcaccgtgatgggctccgccacgtcgtgggcggccgccgcggcggcggtgctccgactccgtggcgccgtcgcccggcgccggaagcacgccaagaaccccacggtgagcgcgacgacgagcgcggccacggcgccgaggacgatgccgatgatcgcgccacgggagagctttccgccgcccttgctgtccccgggcggcgacggcggcgtcggcgaggggttggcgcacggggcgagcggggcgccgcagagcgacgtgccgaggaaggcgctcgccggcatcccggcgagcgacgccggcacggcgccaccgagctggccattgtacgacacgttgaaccgcgcgaggttcggcagcgtcaggttaccggggagcgtgccatcgaagccgttgcggtcgaggttcagcgtggtcaggctcgcgagccggctgaactccggcgagacgccgccggtgaggcggttcccggagaggtccaccttctcgagcagcgccagcgagaagagcccctccggcaacccgccggcgagccggttcccggagaggttcagcgaccggagctggacgcagccgccgatgtccgcggggatcccgccggatatcgcgttcatccggagcgacagcgtccgcagcgcggtgaggttgccgaccgtgcccacgggcaccgctcctctcaggctcttcccggggagccggagctcggtgacgcggtcgccggaggcggagcacccgacgccgcgccacgcgccgccgcacggcgtgggcgccgaggggtcccacggcaggtgccgcccccccaccgcgtcccgcagcgccagcagcgccgcgcggtcgcccgccatgtcggccgccgccgcgcgcgcgacgagcaccagcagcagcagcagcagcaggacgtcgcggcgtcgcccggacgacgccatggcgaagcgagagcgcgcgaggaaggcggaggatgctgtgctgggtaagggatttatgggcgggcgaagaaggcggcgcgcgcgcgcgcgcggcggcgagagagcttaggtttctccatttggaagagctcggtttttgtccagctcgattgatcgccatgcgcgcagctggcatgcacacgcatagcatcgtggacgacgacgtcgtcgggtggtgaggtgaaagaactgaggcggcgggtttggaaggcagcgagcgagcggcggcgaggaagagcgacgccgtcaatggcgccggcgacggccggccggccggcgagcagattgggcccgacatagcatgctgaaataagcccattgatttgatgtgactgcccaaacgtagcattaggcccatgataattaatacagtactccgtattaaatttccaaatttgaggttgcccatttttttctttagtgaaatggaacagtaagacaattaactttgttgccgcaacgcgatcaatgtttgttgatatgcatttcacaaatggttaccaagccaaacatgtgggttttttttgtttgttttttttaacatgtttgattcagattattgagtaatagaattatacaaaacacaatactgagtagaagaaagttttctgataaaatgtatttttccgaatcgaggagcaaacaatccatttcaattatctaaataatccgaaaggaacgaggactttaccgttgagctgtcgtgtattcatgtggttcctaaagcaaacattaaaattcctcgtaagtagtagtagtattagtatgtctgcatgcataaacaataggaatggaaagataccgctaaaagtttttccgaatgtgaaaacaataagtatcttttttaaaaaatagaatgataagtaaattaaaatggagggagtactttctgaaagttccttatgcccccaagtcttcacttcatcctctttcatgcatatgagtttttgccttattcatgtatgtctttgtttttctttataataattacatcttgggccaaagatttttttttacccaagtttcaccttcaaactactctcgatataattgtcaacgggggatacatgtagatcgtattctgaggtattagggtacgttggtacgaggatttatacgaaacgatatcaagcacacagaaaacaatgattatattagttcagacccctcgtaaggtaatagtcccaatcttgtttatatgggattatgaagaaaaccacagagattataatagagaaccacagaaccatcgagttactgagttcacccctgtcgagaatgacccgacgagatcaatcaacgagttggctttaagtccttcggattgcttctgctatggctagtggcaaaggtatgattcgatgatcccgtaccccctgggagccttgtatttatacccttaaatgtcttggtttccaaatagaactcaaagagtaccttacacgtacgagatcacactcctccaaataagactctaacacattatattcggggagtcagtttccttatacatcagcctattttaaggtaacattcccgtatacttgaggatataccatattcgtataccgcgtaacccccaggataggaggtatgtcttatccgtaaccctaacactaatgttttcacttcaagacaggtattttacctattttacactttagaccaccgtcacaccatctctctctcccttctccacctcatgttctccaccgccccacctgttattgctggtttgccacctcccccgagctcaagctcaacatttgactctggtgtccccaatattaagctcagtctcttccttgtaggaagacaacggtggggagctcaagctcgacaacgaggacctctacaagctcattgttgccttgttacctcagcttcattctaaatatcaatgtccggagtaaggaaaaactacctccttccttcttcttgtcctccatgaaaccattgatgccatccttttccctagatctaactgaccagagttggggacgactgccactaccccgcttttacttcttcatggggattgccgatgcagttgcactactttgccctccagctctgctccatgaggagagggagatcaacggcatcgacaagacccaaaacttgatattcacttgcaacaccagaaacttgagcatcatcaagaccatgagctcgatctctatcatcgcctatgctctcatggctcccaagcttgacctcctcctcctccaatttcacttgatccagtggcgtttgtggtcgaggtgctaagaggcatgatggagaaatgggattgggaggaagaatgtcgcggttcaagagaaaaggagcacacagacgccttgtcaatcaaggtccgaatggtggtggtagggaaccagaggtggagaagagatagatggagagagggtggtccaaagtgcaaaaggggataaatataccatggtaaagaaaatggggacaaatatacatggctttcaatgaaaatattagatatgggtagtcttagtgaaagtttggtaaaaatcttactcccaaaccacaatttactccatttcttttgatcgctctattcccattccatttgttgactatgagctgattgttagattttttttttacgttgactacattgtacttgttggtcataagtaagtgcttgcttaaaaagcataattgtcatgtgaacaaatttcaacaagaaaattgaaagtgaaatagtaattagttgaccccggatttaaaaattcttatatgaaatttgataaatagttttagactaaattttacgaaatattaaaggatagtttcactctactctttccaaagaaatttaaagtaggttcaattttacttattttttaaaaaatacaaattttatttatgagtggaagataggaaaaatggtgatccgtgtaatttcccttttaaaatttcaccaaatttggttgcaattcactagaaaaatttaaattttggttttcaaaatttggaattttggccccttaaattgttgtataattgaagcttttcaccttgataaattttataaaattacatatattttgatcaaactattacaaaataatatactttaaagtggtgtatcataaaactatagatttatgactgaatttatataaaaaaaactacatatttaagatgaaattatcccagaactatatggtttgcacaaagtacagtacaaaactacaacatttgtaactacttaacataatagtatgtagtcgtagggatttaaattgtaaaacctatagttttgtgatgactgtagtattaaaattgtagttttgtgatacttggcattaaatatgtagctttgtgataaatcttgcgttaaatctatagttttacgatacaatatcttaaatatgcagttttacaataatttaattaaagtacagttttgtaaaattactcctacatatttataacaaggtacacacaacttttactactatataatagcaggagacaatataatcattttatttttaaaatgacattcacgtatagtgattggtttggtcggaaatacatgacgtcataactgctaaccacaattccctcgtaccatcacatggcaaacacgcgcgaaatctgacacgcgaaatagtacgaccgtgacgcgccacagctctccccctatccgatccgacgaccagcattgagcgcgctccccctgccacgtcaccgatccgcgtactctctcctcattggctgcctcctcctatataggattactccccctcccgcttccacccccaacccaatccactccactccaccgccgctcgctcgccgccgccgccgcgtcgtcgtcgtctccggcctccgcttcctcgccgacggaatcctagcttagccatggctggtaggggcaaggcgatcggctcgagcgccgccaagaaggccacgtcgcggagctccaaggccgggctccagttccccgtcggcaggatcgcccgcttcctcaaggccggcaagtacgccgagcgcgtcggcgccggcgcccccgtctacctcgccgccgtcctcgagtacctcgccgccgaggtacgccacgcatggacgcactcgaattcgtggtcggattggattggatggatgaattcgggctgaatttcgtttggggatttttgaattctcgcaggttcttgagctcgccgggaacgcggcgcgggacaacaagaagacgcggatcgtgccgaggcacatccagctcgccgtgcgcaacgacgaggagctgtcgcgcctgctcggcgccgtcaccatcgccaacggcggcgtcatgcccaacatccacaacctgctcctccccaagaaggccggctccagcgccaaggccgccgccgccgacgacgagtagagacgaacacagattcctcactatgacgaacactacatgcttccttccgccgatggattagacaataggcatcctgcttaatttagtttttaattgtgcttgtttcgtagacaagggattagttgctctgtaattggtgttaatttatatgaaatagtgtcatctttctcgatgacttttgtcaaaagaaattctctccgggtgttcagattttccaggttgatttgaatgcgttgtctataaatcgtggtaaatgtttcttgatttttttaactcttgggactttttttttttgaaacaacaactcttgggaaattgggttgttgtcaaacgtcgcgtctggtttttctagagttcgtgcgttctcagcgtggtattcaaattgagacttgatttggttctcaaaattgttggatctagcgcaggatttggtttgaaattgagcattggcgcgggcgggcagctttgaaattcatgtgatttcaaacagtgccaaggcgggaagacgaaaatttccgccaagaaagaaacggcttaacggcaggaaagagagagagagagagagggggatggggaaaatgaaagttgaaaataattttaaaccagctccttgcaagtggaagcagcctctatacattaacatgtgggtcccacttgctttgggcccacatgtccgtgacaccgcctgcacgttcagtatcccattcccatgaaaggtacacatacggctcattagagtagggaaaacaggagggtcataagtcaattactatgagcttctattgaggtgatagatacaaaaaaatatatggtgttgaatttttatgtaatactatctccgtcccaaaataagcgcagtcatacgtttccgcgtccaactttgatcgtccgtcttatttgaaatttttttataattagtatttttgttgttatgagataataaaatatgaatagtactttactcgtgacttatgtttttaattttttttaaaaaaaattcaaataagacgaacggttaaagttggacgcggaaaactatagctccacttattttgagacggatggagtagctagctctacacatggtttaatatggatatattaatttcatagtgagataaagagagaaaacaataaaactaatctattatatatatattagctatagtataaatttatacggggtagttgttctgctattaaacttgctactacgagaggattaggctgctgcagtttaccacctgacttcacacagagtacatactttcttcgtctaaaacaaaccaacctcgtattaggatgtgacagcgaatctgaatatactctatatccaaatttattgtattaggatgtgtcatatcttactactagatttttttgggcggatggagtacatacgtacatggtatcgacaagggtttaccatccaccctaaggccccgtttgttttctccattgggaaagatttttcagcgcatacgtagtgagaaaacttattagtacatgattaattaaatattaactattactaacttatttgaatcttataaacaacttttatataaaaattattgaattctagttaatttatgacatattgattagtatattagtgagtaattagataattagtgtgtattagacgcagatgttttttttgttgtggattcgccgctacgttcatccttgtttcttttatgatatctaatgttttctattaacaagatgttatcatgacagtactaacgcagtatgaatctgtgatatatacacttaaattaacatgaaactaattaatcgctgatactcgagatggaaatgaagttcaagcagaaactaattagatcaaagttctgacgtggactctcctctcgcactagtgttgtcacattccaattcggtggttggagattaaaagagatggttagagtggatggccgcatgcaccggttgctgaatatctatatgcttaattagtgagaaaaaacgtggttttccttttgatttgtgcagtcgtttgttgttgctttgccgcttccatctagtgatggtcagcacatatatgctctgcacgtatgtagctgttcttttctcccgaagacttaaggaagattatgttttttacgtaaaacgagatggtattaacgtatgattaattgagttttaattattacaaacttgaaaaataaattaataggatattttagagcaacttttatatagaaagttttcgcacgaaacacaccgtttagtagtttgaaaagcgtctcacgaaaatcttaaacttaatccaactcttgttagagtagtcataatcttgcattaggtgaaaagttggaggctaatccatataaaaaaagtttgtagttctttgattttgccaaagtgtcaatgcgtcataagtttgatatatttcagtgaacggcatcatatataagttgatatttattgaggtcagtggcgattaacaaagcaacagtgtacgtatgaggtctgtaatttcacttggtggttatatttgttgttgaactttggagtaattctgaggtagaagtagagcggtagatcgatgaacccaaaccagaaatagtcaaaaaggaaaaaaaaagagaagctttgcaaaaggcaaaatttactttgagatattcttggttaagttcgtggcatttgctattggatactctcgttttgtggatttgtcataggacattctagttttacagttgtttgataaaaatacactttgaccattattttagtggatttaatatattctcttccaatggagctataaaactgcaaaataaaagtttagctgaatttaaatatattatgcaaattcaaaacttgtccaaagttgtggaaacgagaattgccaaagattttttaaaaatcgaacaaagaaacaaatttgaacaaatattggttgcatttaaataaatatttgtaaaatgtttttatttctgtaatttgagacaatttttgaattttgcaaaatatgtttagatccagtcaatatttgttcaaaattacatcttgcaaggtgacctaacgataaaatcatcttttcttcatttaaagatgatatattgaaataatggtccaaatgtctcttactacctcccaagaaaggtattaggactgagagagtagtaaacaatcgtaaaagtgtgtgctatataataaagtacacaactaaagtattcttaagcaaatgtcgtggatttagagtctcctagagcaaattttacctcagatattggtgtgtgcctttaatacacagttgaatagtacaccatacacccaaagtgcgatttaatgcatatatatacccacaagatatgcacacatatttatactcataaaattggatagcattagtacacaatttaagatttgaacacaagtgagcggaatgcacaacttcaagcaccaggactagcttacatggccacttatatatcaagatcttatttatggaagggagtagtccttaattaagaatttcctcatcagattatatataaaaaaagattttacgctcctttcaagatgcttaagttgaacagattgctgagaggggaggtcatatttcaatttcgaaatgtccatctgaatacctgtgttaatttgtacgaacacgtacatggccgtttcttccacgcacccgacgaaagaaaatgactcggcaaccatcaagttttctgctcattgccttttttgaagagcaatccacgcaacaatctgtcctctttttagtccttgtatagattgtatgaactaccttcatttttttaaaatgcttgttttccaaagcatggcgtctcaaatgaagcaaaacaaggtctgatcaattcagcagttttgttaaattttcctcacaagaggctttgttaacaatgtgctagcaatttgtctggttgaagaggaggaattaattcaaaccatgcatggaactaatcctaatccactcctaacaatactttttcaagagggtgaaaaaaaaaaggaaatggcatatgtcactgttggaacaatggagatggttggccccaaaggtttctttccaaacagttgaaaggagcctctctccaactgttcacaaagtttgtcacatttctcacccaccaaatcttccctacaaaaatataatccccacaagcaacaccacacccccaagtccttctccacctctcactttctccctcatcttctctctctagctagctcttctcttgcatatatatatatatatatgctgtgacaccagtatttcatgttctgggagtagcaaagcacatgtcaagattgttgatgctggctactactgctacaatggaggaggagatgctggaggagcaaggtgaaagcaggagagtggtcaggttggagcaagaggtgctgatccacatccaggtcaggaggatcaagcaggaggatgagaaggccagggggcttctccagaggctgcagctgctggagatgaggcccaccgccaccgccgtcatcggtttccgcgagctggcgcgccctccctcgccgtcgccgctacgccgcgccggtcaggccatctccgttggagattgagggggggggggggggggcatttttctttcccttgatcaatgtggtgtaaatatgtaggagagttcagagtgtttcaggttttcagttcatgtgatccatccatggattggcataacttgatgtgttctcttcctttgtgctgtaaatacaattgagccgcttaaattgccaggttgcattgtgttggtttttctctttgatcctttcttggccggaatagcttcagataagaatgcagaggtcacatcagcaagcaaagcggatgaagcaaagagggaggattagccactcaaactttgtataatccatagacagcagattggaccagaaaacatggattatgtcatgctaaccattggatggatgacaaaccgatgaatcgtgtcattccagtaaacaacaaagtgaatattttttccttggtgttgccgacaaggtagactagtgaaagatcccatctaccagattagaagtcagcatcaacattggagaagaaaaatcatactagcaattactactacctgataaagaaaactattgccgttaaaggacatccaagacttgggataatatagactaaactacgtaacttctacggatgatgatgagtcataaaatcccaggatttacttttgtttgggaagcttaacacgacaatctcaagagcaagcagcaccaaaaaaaagaaaaaaaaaacctagggttgcaaatcccagataatcactacacaccacagttgcgtcttcttcaaacttctagaggcagagtttgtttttgcaaacctaagcagaaagttctctgcttccaggagtactacagctcaatcgggctaacctatcataacgataatcttgcaacagatgcttatagagcagttgtgacaaaatggctgccaccaccgttaggtctgcagcgatcagtcggtcttcattgcctcagcatgataagtttccaggtctttgtccagctcatctgcagtcttcccagcttgcctccttccgcgaccacggccctggaattgaccacggcccctgacactgccagtgccacggccctggaactgggactggaatggggcacgacccctgccacggcctcggccccggccagcttggaaggcaccacggttatatctattactggaatggcaagttcaggtgacagatcagcaaaaagatcaataaagtttcaacacatttgtggtgtttttcagtttggttgtgtcaactagggaaaaacacaagcaagatgaaattgtcaccaaccaccgccaaaagtgagaataactagtagaaaacaaccttattttcttctttgtatgtcacaaatgcatacagtatccatgactaaactaggaaaaattgtagtatagcaggaacaggtggaaacatgattaatttatgctagacatgtagtataaaatgtaaacctgaaactctgcacattacatgcttcttattaaaaacaagaagaaattggttacaataataaccaaatggcagttgctttactgtagatcatgatgcttttaaaataaccaagcaaaatgatgtggtcactattcgctactagtaccagataagtaacagaataaattacacagctaagaaaatgatactgtgagaagccttacactgtaggacctgttggtctactgctggaaccactgccacgctggccaatttcaggcctgaaatatatttatttttgttgagatttatagaaaaataaggtagattgactgaatggttgataggtatatagctttaaaggctcagagaaaaatgaaaacaacaaaagcccaacatagcacattttcaaactggagttaaatttcacaagttatcaattgacttgcaacacacaactgctaacgaacgtgacgaaacatatttatcagttgaacttttatccgttttcagactatagtccttcctaaatatggctagctcattagaatatttcacacaatactagaatctgctaagtaaacagctcatattggcagtgacaagttaaattagcacatatactggcccaacaagaagtttacttaaaaatattacaactcatcaaacaaattatcagcctctaaagtaacacatgaacagaagcttgtagacatgccatattgttagcagaaaaaagaaagaagagtttatctgcaagcaattaggagttctgatagcccagtattcaatatttaacttgggacatacagactgcattgtgatgtgtgatccagcttaggttccaggtatgtcattttctttttgtccttggaagctaaataagaaattgagatacatagaaatggaaggattactcacgtcataacaactgttcttgtaggtctgccattagaagccccaaccacatttatgcgaggtgtcataggcaaacctaagtcacttccaataacttctatcttcatagctttaccatcaagcagaacattattgtaacgtttcaatgcagcaattgcatcacttctcctagtaaacaccacttctgctgtgccctgcagaaatttaacaaaaaaagatattagcacaataatcgaggcaagaggcagttagcaaaagtttcagtgatcacaaaagttcatttatcattttctttttgcagaataagcaccgcaaatggacactgtttacatgctgttaatttgctaggccagctaattagtacataagattgtgtatatataaatttttttgaccagaaaacagagagggaggtccccacgctatatatagtacataattattacaacaaatacatgtattttgcaaatgtactctaagcagatcaccattttatggagtttcaaccagaaaagctcagcaaagttcaatgtgtgaaagaataagaaagacataatccctacatatatattactaaaaacaaacatttcctatgtttgtcttcttgctgttatctcaaacgcaagataatcactaagatacatattatcctattgttgttttattgttcttggtaaatctaatgcaaggcataaatctgtgcactggaagttttcatccataagacaaggtataattatacttcatatgtgatcatctagagcaaactgaaagtactgagtgggaagatgacaaggtgtgtatggtttcccttgaaacaatgcaaattggttcaccgaagaaaaacatcactttgagtttacatataatacctaattgaaatcaaaatatgctctatttgtaaatatgataagaagtacaaacatttgggcgcccataaccatcaaagtgaacagcaaagcgcttcaagtgaccaacttctgaaaacagctcctacaaggcgaattgaaaatgttagcctgtcaactctatatccaacaagaatagtgaaaagaaatatcccaaaaaattaattagtctaacaaacctttatatcctcattggaaaccccatagtccaagtttgaaatgtacaattttgtaccagtttcaattccactagctgccatactatcactaaacagatcaggtctccaggtcatgtctttggttctgctaaaagactgaaaatggccaaacatccagcatgtgagaaaatgtgtcatcacagaagcatatcacctcaaactgttctgtatgatcatggcaactatcattagtaatatcaatctttatggtagagcagaaataagcagcttgactatgaaaatgctgcattaacttaaaatggagaggaagagagttccacaaatatcacaagtggagtagataaatggctagagcattttctctggagacatcctagaagcacttcaccatagcagatcccaaagctgtcagatgagagctgcattgaagttccaggtattgcacaaggatcaatgaagatccttccttcggcaccacatgcagattatatattgaattgcaagaataccacaaacttctttttttttcttttcatttggttcgatccatatgtgtgacaaacctccttttccatttatttcgatccatttgatcgaagagcagttgctgtccttcaaagttcccactagatgtatccaccagttatttctgccactccataaatgaaaccttagaaatgatctacccaatcaaagtttttcacaagagattaacagcaaaggaggagagcattcactagcgtggcattggttccccttgagttctctaggaacatcaaattgtaaaaactttgggctgtcaccctagttgggccagctccctgtaatctcatttcctcgttaaccgatcggcaaaaccactgccttctcctctaaaaaaggaaagactaatagcaaagctacttcttcctctcctccacctccacatgatagagagatgctctagccaaatccaactcgacaaaggctcgctccattagtgataacttctgcccctccacattgtacaaaatcttagagatgctctctcttcattcattcagtaatttatttttttttagcgtattcaggagaaatctgaccatgaacaaaaacacagcgtcagtttcggtggccttgccttagcaatagtgcgcgctgatggccgcgagttaaccccgaggccaaggggccctcgaggaggcatccctgatcttccacgcagcacatatccacctctcccaccaccacctccaccacctccaccaccttgaacacggccaccaccactaaccctatccccacccctcctggcgtaatacgccataatcccaaactcgcttcggtcagatcagattaacacggttcttctccttcttctccaacaatcaaacgatgaaaaacctgcaacattacaaggctcgatcagggggggaggcgcgaggcgcgaggcgaagagaggaacctcttccagatctagaagaagagaggggggtaggattagggcaaagagagaaggtgcggtgcggtgcggtgcggtgcgatgcgatgcgatactcaccggcgttgcgaggatgcggagtaggaagcagcaggacgccggcggctgctcgccgctgctcggccgtgcggaggcggaggcggcggcggcggcggaaacgtgaggagaggaggagatgtagtagagaaggaagcaaaggtggagtcaatgaagaggataattgcgctgggctatttgtttagcggtatgggctttcatgtgggccggtctgagtcgagtacggcccagcccggctgaaacggaatcgagaaggtgaacctcataggaataagcttatatcggaaag

SEQ ID NO: 38990 - DNA, 1285 bp, Oryza sativa
tctcgccgatcctcggcctcccctcctcctgtgccggacgccgccaaatcgtcgtcgtcgtcctcgcccgagggacgccgccgcctcctcgcctccctccgtcggccacctctccccgccgtcagccgcttggtgagcatccctcctttcctccccgctcccttccatcgcttgtcggccgccgcttccggtgaggacctctcctccctccccttttttcccgtcctcctttcttgccggccaccacctcttggggtgcgccgccgtcccccgtgcgcgccgctgtcctccgcccgcccgccgccgttccgcatcgccggctgccgccgccgccgcaccttggctcggccgggccggctttgtgccgcgccagtggccctggccgctgctctcccctcgggtcgacctgggtcgtccacgtggtggacatgtgcccgaggccgtggtggaccgtgtccaccgtgcgcccttccccttgtgccgctgacatgtgggacccgcctgtcggcgccggttccccttgctgacgtccgcgaatgccttttcctttgagaaaataattattaattgcgtcataaatcggtaataattctagaaattcattaaaacggctcaaaacttctaaaatttatgtctaattcatacgaactccgaattgagccattcaagttgcaaaattcatctaaaattgggatctacatgtttttttactttttatgtactatttccttggtttttattagtgtttttcctcgttttgcacgccaacgagtagattccgccatttcggaagtctgcggtcgcaaagataagagttcagaagatccaagtaaagaagcaagggaagtcacacatttccccttgagcatgttgatcccaatttacaaatgttttaccgtttgcaaataaatatgcatgttttgctaattacatgggatcagggtttacctatctgctcgcttgtgccatgtttacttgatatctgtcatttgtcaatcgtgggtaataaatcgactagctcatgttacttatgtgacacatctagaactatatgcttagccatgcttaattgccactagctcagttgatgggataattacagttttagacctgttagtatcatgacgagccgcgtgctcgagacacccgaccatgttgcattggtcgtaattatctatctaaaatgcaactgaatggtgggctgtgggtgcatggttttgcgagtcgcacccatggcaattaagaccagtttacgggaaaccctggaagacttacagtgcttgcc

SEQ ID NO: 38991 - DNA, 13824 bp, Oryza sativa
gtcttgtgcgtacagttatgcacctctggctagagtaaaactattcgaatagccgtgcccgcggttatgggcgatcgagcagattcaccgtgattagtctcacccctgataaatcgacccaatgcactgtagttcaggtgggttggttgggcctgttcaacgtggtgtagcattgatcaatggagatttaatattaccttaattactcaactgtcttactgttttgcgcaataaatgttttacaaccgcctttatgcaaatagccacaagccattcttgaattcccttgcatgtctgcattgttggtgtggcttgctgagtacagtggttgtactcagccttgctattatttcccccttttcagaagtgtagtgattctgagctgaagacgaagttagaggactaaggctcagaccccagttgagttttgcgtgtggagtggagctgaagcctcgttaggatcgcctttttccgctgcttctactttcgtttcagtgtgaggactaagtgcctcttctgtaagtattttacgctttatttatgtttgaaactgtatattacttgtcgctttatttacgtttggaactgtatattacttgtcgttttgtgtaccctggctggtactggacagggatttaatacacaaaatagtctggaaatttgggttaaatttctgggcgtgacactggtgttggcccatgtcagtccgacccgaccgtcgggccgtgtctgggcctcggcctcggcacagtgggccgacccagcatggcatagtccaagaaaaaaaagtctattttgcctccctcggcttttcctcttagttgagtctcatccccttgttgacaacataaatgttattcaatacacaataaatcaattacggtctttctatttgagtaaaaatataataaaacttataaaatccataactaactcatatgtactctgtttaactccattcaaaatgcagaaaattcataaaaataccccaaatccattcaaaatcctagtaggcttttcgctgacacactatatacttcatcttgagcaaattttgtaaatttttattatatatatagtttcatcctattgtgcatatgaaagaggattagctcttagattttttatgaactggacccatgttaagaaccttattcatattagctaatcttcagtgtgaaatcgttatcatctagtgagtaatgtctattcgctattgctagctcatgcacgcgatgaagtttccaaatacagacaatattaaaggctgacagatatgctagctatttgcacattagccaccgtttttatcaggcaaacattaacttgcatttattcgtttgatattctcgaatgtgtaaaataatttctttccataatctagtgattgttgcgatatgatcttccattataaaaccaccatattcccctttctttgaactcatatcaatctaaccatttcccatcaatccataggtgcagtcttgctagaaagtggtgaatcgtgaaggccatggctcgcaacaaggtgaagttgcagcggatcatcaatgatgcgaagtggcgggcggcattcaagaagcggctcaagggctagaagaagaaggcaagcgagttgtcgacactatgtagtgtggatacatgcctcatggtgtatggtgagggcgaggtgcaagcaacagaggtttggctgtcggtgcaggaggcgacgagggttcttgagcgcttcaaggccatgccacagctagacagatacaagaagacgatggatctggatggcttcatcaaggagcgcaccgacaagctccaagaaaagttgcacaaggtaagacgtgatgccgatgaaagcgagaccaagatactcatcgttgaagccttctatagccgctgcgcaggcctcgaggatcttaccattgagcagcttaccagccttggctggatggcagatgcacaactcaagatcgtcaacaactcagtctatccgtaaccgtgccactgaaattttacaaaattagaaccatgccactgtcgtcacgttttccgtcaatttccttccttttccaccttcttccttctttctcctgtcttcttccttctttctgccatagcgaggttgagcgcgtttgcgattagcacggtgtccacacggcttcccgcgtcagtgcagccagcgtcggccgtagcgacatcactattcccgccatcgtggcggtggcgtgcccgcccgcgcagagccccatcttcggggccgagagccccatctcgtggcatctttcccttctctctctcttccccgtcgcatggttagcgggaggcgcggcgaagcgcgtggtgccggtgtccaagtgaggcggcatctcggacctcatttcccccctctctctgtccccaccccttgggtctgatcactctgcgtcgaggagctgtcgggtccaaagctagtgccagggtcggccgctgaagccttggggggggggggggttcctcatcgtcgcaggctagctccggccgctgtctcacctccttctcctccatctagcgggctccagcaccagcgccttgcctcctccactgccgccggtgctagcaagccggctctcccgctcccgccgccgatccgtgcgtccccaccttgccgtcgcgatctttttaactaggaaacctccacatcatttagcgatatttagatcatacatgttgcctgcggaaaacgtgagacattaattaggagatcatatgctctatcgtgtgttacctttatccgttataacgcacggacatttttgctatattcattatattaaaagttaaagcaatttatcaagtactacctctgttctataaaagttgaatttatagggaatcaaggatagaaaaacaatcataataaccttattatttaatgaatacagtgcacgcacacattctatatataaacttaattaacatgaaggttgagacttagagaagggatggaaggaagggagattaaaaggaaatatttttttatgtaatcaatttgctgggtcccacattagtagaaatacaattttagatagaaattcaaattttatgaaacggaggtagtaaattaatgtgggaaataaactttccttttaaaatcatggctgagaatattttcctaatattcttcattccctaatatactctataattttccttaaactttcatagtaaaaaacaaaggaataagttcaccggaggtccctcaacttaacagcgagaatttttgaggtcccttaaccacaaaaccagaaatgtttacctctaaactcacacaaaccgtgcactcaagatcctatagcagtatatatggctggtttcgctgacgtggcatcctagtcagaaaaaaaattaaaaaatgtacgtgaggcccacatgtcagttgcacatctcttctcttctagttttattctcctcctcttctctattctcttcttcaggccggcagcaggcggagagccggcgggcaagcgcagatgaaggcgacgggcggagagccgtcgggctgctgtcgccggagctgcatagccggctcctctccgaccaccgcgcgcccttgctctccctcctccgccgccaggatgacgagctccggaccaagatcaagaaccacctcctcgcgctcggatggaccatcgcctccaaagcccagcctccctggcctcgcgcccaggctccgctacgtctccctcgccggaagcatgcatgctatttgtatgtatgtatgtatgtatgtaagctcgctaatggccaggtgattagcgagcttaggaaatgggctcagcaaacaccacctcatcctggaaggcaaccatccatcatcataagaagtcaatactgccctggtccatctcctcgtggaaggcaacctcgcccgcccgcagcacccctgtgtccccatcacctggccgatctgcttaggagcatcgtcaaccaacgcctacgtcggacttccatggcagctagcacagccatcctcggcgccagtacgatgtacgccatcaactcatcatcagacgccagtcgccgacgatgctacctccacggtgccaccacgttgtcaagacgccggatgtcctcgcatgtgcggcagctgcaacaacaagagcacggcgacggcgatggtgcctccgcccctggccacctctgccgcccacggcctgccgactccccccccccccgcgcgccccgcccagcgctcccgccgccgacgacgccctccccttctcttgcgtcaccggccggcgccgccggcatccgaacctctcgtgacccgtggcccgtggctccatgcacgcccgccactccgctgccgtgctcgcccaccgatgctctgcccggcggtgctccaccggtgaagaggagaagaagagaagtgaagaggaggagaaaagagaagaaaacatatgtgaagctgacatgtgggccctacgtacttttaaattttttttctgactaggatggcacgtcagcgaaaccactcacatatactgccatagtaacttgagtgcacggtttatgtaagtttaggggtaaacatttctggttttgtaattaagggacctcaaaaaatctcgctgttaagttgagggacctccggtgaacttatttcaaaaacaaaaggagagagaagcaaggtccatcgcttgggccgacgtcctcccccctttccttcttacttgggccgacgctcccgcacggcccaaggccgcgctagcccatccccatgccgaaccagctagcccaaggccacgccagcccagcttgcccgcgcccctccttcagtccagcccactcgtcaattttgtccccctcctctagcctagtccactccctcggcccgtagagtaaaacagaatgccaaattagtgcacgattaaggccctatttctttcatgttaggattattataatctagattattgagagtaaactgaaagaaacagataatttattaaagtagcttattataatctggatcccagcttattataatccgataagctcatttatgtgagctttttccatattattgggtgaaaaattacccaccatgccaccccactccttctttaaacttgtaaacccaataatctagactctaataatctaggaaagaaacaactaaccgcctattctactacatattatagcttatagtaatctgactcaataatctagattataataatcccaagctaaaagaaacagggtctaaaccagaatgtcagattagcgcacgattaactaaatattagcttaaaaactcataatataaattaatatgatttttaatgaaacttttatatagaaaatttttttgggaaaaacgattgaattccattagccgataggcgaaaccgaatttttttttttactaggagagcattgcaggcgaaaccaaacttggctttggtttttcctccctctcgaaggaagcattcctcgccactctctctccatatgctgcccgccaccgccaccgcctccgccgcgccgccgccgccgccgccgttgccggcgtcccccggcggcgagccgcacgccgccctgctcctgtccctggcctacctgccgctgcgcgagctgctgtcctgcgcgggcgcgtgccgccgcctccgcgacgccgtcgcgggggacccgctcctgtggcggcgcgtcgcggtggcggcgccgccgctcgcccgccggctcaccgacgaggcgctcctcgcgctgacggggagggcgggggggacgctccggtccctccgcctcctcgggtgcacccgcgtctccgacgccggcctgctccgcgtcgtcgagcgaaaccctggcatcaccgaggtatatagtgggagggttttcccccacaccgcatgttcgcttcattttggtttgtgagaaaagtttggattagggaaagatctatagatgctttgggtagttgggtgttgctcgcctaatgtttgctgtaatgcctacgcaccgtggctgctttagctttcagcagtttggctcatgttaccgaaatcgaaagaggggggaaaatgcaataatgtaatgataattgatcaagttaatttgaattcattacaatttaaacattacatgtttacaaatacaaatcgatgttagttgatacttgatacactgtactttatcgtgtttggagcttgatagacttatgttggtgttcatgccctcagtaaatagcaccccccagaaagccagcgcactagcattttggacttttagttatttctgtatgaaatactatttttacacgaggacaactcgacatggagcttgaagctttgtgcttcgagagagaatgcatgttattgttattccaattcctgtgatatggacctttttgaaacaacactagtaatcttatatggtatctatggtggcaacaaaaggtagtggttggtttcttgcttggaagagataaattaattcgttgagcacattactcaatcaagtgtgaattctaggatcctgcttgcttgggtgcccattttgtatcctgtgatctgtgttaagtgatcccattagatactaacattaacatccacactagtcgacgctggatgacctctccttcgcatttattcgttgtaaattataaatataggtcaatgtgacattaataatattttttgttcgtactaaatgtaatagtaaaaaatagtcttagtgtcttatagccaaccctttagtgaaagatgtgctagagcaacaattttccattttgctgttcttggacagtgtgatctcattacccattaaaatattattattttttgggtgtcctagtattggtatacaagttagcaagcgagtcttcataaagttactccatactatggttttggccactgcttccaactttaggcttatatataccactcagtgtgctacatggtacatactgtgtaagtgaaataaagggttccgagatcctattttatgagccttttttatcacagattcctgcactttggaattgggataaagcaggtgccagatgaatagaaatcgatgcctaatacacataagaaaccatagataaataataccagacacagaacattcccattgaattgacaccacgaaataataagaatttcagtttgatcccatgggtataacagtacaaacatctgattgaattattgcctaaggctttaagatggtaacactgatcctacacaatcttgggtaaccacctcacgtattttatacatggttgtttgatgttcttgctgattaaacttgattttaacaaattttttgtgatctcagacattctgaatgtttcatgtatgcacaagatgcatctcattgtgcagtatgtttttggaattcacacgaaacagttaaactagtgcgggaaactggaaaagttattgggttccaaggctccgagcagggaaaagttcttgatttaggactctttgttaaaagatggaataaatggcacaccatgctgggtttctcttactcactttcgctggggttgagatttctctatacgtcttgggttgtttcactaaccttgctaactgcaatagctactgggattagggagtcaacagtatctattgtaattttgaatttaatacatcaaatctgcagtggattgattgtatccttgagagatttttccttggatatacaaccatgtacaccacataatactggaaaagaatgtttatcttgtcaagaaaaatatggaacaattagggcactgcagtatttgtgaataataatgtataggtcttcaactttgaggttgccgtattatttcccttagccacctgtttggggataatatgagatacatttgccttggactttggatgtaccaaaccttatatggtaaaatgtggtgcagttggtcaatactcaatacttactgctccctccgtcctagaatataaggatttttagggttggacacgggtattaagaaagtaggtagaattaaatagaagaaggttgtgattggttgagaagtggaggtaggtgagaaaattgaatggtggaggattgtgattggttgagaagagaatgttggtgaagaagttgttatattttgggacggagggagtactctctaatctacatcaccctttgttctttaatcaatgaaagattctcagtatggagtctagtacgctactgaaggacaccatgatctcaactagggctaaaatttacaaggttagttagaagattgccatgactaacttcccatagcctttctaacttttgaagtgagcaacattagacatctcacacacatgaagttcatttttctcttgtttttttttaaaattcaatctaggaactgataactgtcatatgacaatttctgataagtactgtaaaagcaccaaaagttccattttaaaaaataattattgctagcaactagctgggagcaagttatctagttccattccaaaatcatgattgttgaccacaatttttttatggagcaatagtgagtttgttaaattgccactttcagttaccagaatgactttggaggttctagttctaagaaaacatgggaaataattgcatgagctgatttgttgtatgaagtttgaacttgctttacctatatatagcactgttgacttaacgatgctattgcacttagtttttatccataatagatgctggccagaagttacagtcttctattgcgtaaatctgtttactactgcagaatgctaatatatatgttcaattttgatgctttgttatttctggaagatgaaatcaatatcatatgctcatgaaaagtacatattcacttcacgtcgtaccacttacttctatgcaatagctttagtgacctttgggtgcatcttatctaacttattctttaacttgcagctctatatgcccagatgtacaggcttgactgctgaaggtgtggtgaagattgtccaggttctttatgaatgcaaggggaatctaaaccgcattcgactccatggtatttgcaggatgactaagcatcatcttgatgctatcagttctgccatgtgcaagggtaaccaacaagaagatgatcaatcacttttctatagccacagagtccatgaagtgctcaacaccaacgatgaacgccgtattgatgttgatgtgtgccctatgtgcacaaatgtgaggctggtgtttgattgtacaagggatggctgtaggtttgtaccttctgatcttttgaactcttatttgctctttgcttcgaaaatttcccttcaaatttgttgaaagtttgccactgtttttcttatttgcttattgacaactcatctttgctatatggtcacaatattcagtgcctttagatatttgatagtgttgtctcctgtggttgtggaatagctgacatagggatctcatctttcctggaaagcttttaagtgatggtccagaaactcatttattctctcccctatgggctacaggaaagcaactgcacaattaatttttatttggttgctctcgtctttggaacaactggttcaatatgttaaatattcttcagtattttttcaggtctattgactttgacctgaactttgttcgcatttctacaaaataaggtttgatctattttgatgatttatttatatttcaggagaaaggatagttgggctcaatgtcgaggctgcttcttctgtgttgcccgatgcgaaacatgcggtgggtgcatcgacttggaggagctcagcgagactgaacttgcatgctcggacttcctgtgcatggagtgctggcttccgctcccgaaatgtagcacttgcaatcggccctactgcaagaggcatgaaaatctgaaggtagatttatcaccatctggccagtttacttgtcatcgttgcgtggaattttctagtaactcacgcgagaacctggaagaaagttcttagaggtgagttcctgcccctctacaggaaatacaagttgtcgagtatacttgggtatgaaactactgtctgtgtaccagtacttgctgatgacttttacttaaagcgtcaaatgtactagactaactaactgagtgtactggaaatctaggattctgaattatttattgatcacgtcaaatttagcgggtgcagacttcatggacttgtgcaacttgtctgaaactctgaataacactgaaacagtccattgccctcaagtcccatatgcctatggaatgtgtttaaccttccaggcttccagctcagaatgtgctcagcatgacagactgaaggacaccgttattaaccgccatttgtcattttggagcgtgctgtactctgtctggctgccatttgcgcctataatttcagaattcaaatgatactcctgcaagaaatgctactcgactggaataccttccatcatctgttcatcttttacaggaagaagatacctgtccctgtactatttcgaatccgagtctaaatttgagtagtcaattgagggtttagatcatgttttgcgataaacttgtacaatattgaaatactcgacagttgatagcactttgctttccaaaatttgttccgtagtctatatcagtattttggtccctcattatcttggtcgagagagggtcactaacaaaataaccaaaatgtaccttttctaatgcgattgtttttaactgcacatccatcttcttttccgcttctttaccgaattattgtcatgaattgtttactccgtgcttcaaaaaacaaattttcttttttttttaaaaaaagaaactttcttctactgcgttgcttggactacttgttttaaagttattagataagtttatttctcaaaatatgtaatttattcttacaactaaacagattactgtcacgataattcgatgaataatctgtttcaaatgctaaagcagatcagcggcacctactgaataatcccgtgtccatccctacttttttttagacacaatttctccatctccctcgaggggagcaagccagcaagatctgaaaaagggttttaataaaagcataaacaattacttcaagttcatgcgtctccatttgctatttgagcaaccattttcaggagggaatccaatagttggcacggtgaagtcagagtctagctttaccaaattgagatatcgcactctcgagcgagtccctccattttagaccacacctaataacatcaagatcatgaatcctcccagatgtgaacctggaatactggaaacacgtgtatttcgtgcacaatgagcaaagttagttttacatccagaaacctgtttcgcggcgatcatttcacaatgatgtttcgctgagattttttttatataatggataaaaatccggtctctatatccacaagtgtatatacaaccaaacatttcagaaaaatattattttactataatattctatagcaatagtcaagattcctttggaatataggaattttacaggacttgaggtatgttccttttctcttacagataataaattatcacattcatgttttcaaagcacctaaatggtacgtttttttttggtaaaaagcttcctatttctatatataagtttcttgtaatacatctttagatcaacttttaaattttgtataactaatttattcacatgaaacacaagaattttacaagggccttcttcttttcctcttatagattacaggttatcacagtcatgctttctaagctgtgatttttgcaaacggtttctacatatataagttccttagaatactttttaaaatatttttttaactttataatagttacttcattcgcttgaaccctagaatattattttagaaagaaaatcaaataatccatcatctatttatccatttagaacaacagaactaggcctaattagttcagttcctataaaaatactctgaaatttctacattcctctgagtgatgaaacaggtggcagcagcagattggtcctccaaaatttcgacatgtgaaaaaggaaccttgctactacacccttcaccagtgagttccaaggcaaggcatcactgatcagtagttgtgctgttcccatctagtcccctgcttcttgccatgaactcaagtgaagggcacctcctttttcccctacacacaaaataaataaataaatcagtgctactaaatcacaagctggaactttttttccttttttttttcgcgtcggtgaccgtcttcaggtacactataactaaccaccaaaatccatgacatttacatgagcactaacaccccccggagcacacgcgtcatgggagacaggatttgcagagagcaacagcccaagaaaaggggcatgagctttgtgaaaattgtgactctgggtggcacatatgtcactgcaaaacttgttgcatgaacagggtcagaatgtgagttggagcaggaggaggaaaatgttggttgggagaacacaatctttggaccactaacagtctctccatcatgtatggtgatctgatcatctcttcctttgtgtggaattgaagtggattcagaaaggggaaaaaaaaagaaagaaaaggagctgccttgcatggcatggcaatggcacctggccctcctcatctttcagggtttcacatatcccaatcaaaggcttaatagcacatctaattgtctaatgataaaggatgatgggaggcaaaagtacatccatgatgatgataataataataatctctggtttttgtatagtaccatgtttttcagctttgagtggcgaaatttgacctcagcgcgacaccgagacgcggtgtactgattgatggcttgttctagctagctgaagtcagagggtgcccttttcttttttttgaactgcagtcagatgatgcttttgattgtctgaaaggatacttagtgttggtgccaaactgcccaatcaagatatgccagggaaaagaaatgatgaagtgcactactttaccctaaattgacttgggaattcaaattaagcatgcagttcttcagtcaacctatgaagtgatcattcatgttcgagaaaaaaatttgtaaaaaataagagtgtttttacgatggtctctaccagcagtattctacgactagtacagatcacaataaaaattgtcaaaatataaacgggtctttttgtttactgaagaagatgtagttgatcattccgaccttgtgtcctgaccggcctgaagtgaagtcttgatggatactgttaagttggtcgatcagttaaaatgaaggtcatctagtacaacaaaataatggctttcattgccaatcaatctattgctggcactactacaattcagaacacaattttaccactcaaattactttttactcactattcatttcatttaaacctataaaaatttagtcgaatatcctccaccgtcatcgtgtcgcgatccgcaatctctctgtatggatagaaggaagaatgttttggatcttagctcacagacttttgtgggcaatttcatccctgtgatatcatgggaagtttcatatgttgacaagggagagtgagcagtgttgacctcaatgatcattcaacatttcctgcctgctggaagccaaaatcttgtccaacaagccgtactccatactgcggctacatatacctctgaaattgctgatcaaatcttcaaaaaaaattgcaagttctacacgcgcttgctcgatccgtcgcggccccataatttttcaccggaaaaaaaatggatgaaaatttttaaccatggtaggacaataaggaccctttgcaagtcatatctgaagct

SEQ ID NO: 38992 - DNA, 12261 bp, Oryza sativa
actgaacattttacatgttgtcaattaattaagctggtcggcagcttaatcgattgatctgaggataattaatcttgtcaataactgttttcacctaaaaacaggtagtagaattctctgatctcacctaaaatccatccagggcaaaaggtagaccagaggataattttgtcagaacatgagatgaaagtaaagggagaagaaaagaaagcatggaaactttgtagtgcagcacttgcaattgcaaagcaagcaaaagggacccaagagcagaagctcatgcttcatggtggcacgtaggccaccctcacagccttcactgccgacgcccggcccgggcccaccgcgcagcctcaccggcctcggacacgtgtacatagagctagtaagcaaaataaaaaataaaaaataaaaaaataaagagagatagaagcttgaactacacatcagtacatcacacacagagagacccttggtgcttactacacatcagtagttagctactggctggtttgttttgtctcctcttcttgcctcccccttataaaggaaggtgagcattgcatcttgctccttagtactcctcctcctgcatcatcatcccaatcctcaattcagaattcagaactgccatttgctaccttacataccatacctagctgaattgctgtcagttaatctcttgatcagatcgatcaccctgcagcttcttgttgtttctagcatttctggtgaagaaaccaaatcttcagcagcttaaggtaggagatcatcaatggggaggcagccgtgctgcgacaaggtggggctgaagaaggggccatggacggcggaggaggaccagaagctcatcaccttcctcctcaccaacggccagtgctgctggcgcgccgtccccaagctcgccggtgcgtcgatcgagatcctcgtgtcgcagtactactttatgtgtgttttggctatgtgcatcctacgatcgaggccgaaagtttatatactttcattgtctgaaaaagggtatgtttgtaataaaattatagggcttctccggtgcgggaagagctgcaggctacggtggacgaactacctccggccggatctcaagagggggctgctctccgacgccgaggagaagatcgtcgtcgacctacatgcccaattgggcaataggtacgataacattgtcctcgacacgttgggacaacatgcctgaacgtatgataaattagttttttaatgtatatataaccatttttatatacaaaacatgttaggtggtctaagattgcgtctcatttgcctgggaggacggacaacgagatcaagaaccactggaacactcacatcaagaagaagctcaagaaaatggggatcgatcccctcacccacaggcccctccagccgccgccgtcgccgtcgccagagaagaagcacgcagagagaaagaacacggcggcggcggcggcggtggccgagcagcatcagcacgacgaactctgggaggaggagtccccgggattctgcaccgacgaggtgccgatgatccacccggacgagatcatggtgccattgcgcgaccacccgccgccggtttgcacggccgccggtgcctcgacgccgacgacatcgtcgtcgtcgtcgtcctcgtcggtggcctcctcgacgacgagctgcgacgaggtcgacgccgcggcgctgctcccggtcctggagtggcccgacgacgccatgtgcctgatggagctcgacgagctgatcgccgcggcggcgccgccgtccctgctgtgggacgacgactaccgcctcccgctgccgccgccgccgctatcgccgccggcgatgtacgaggagctagacgcctttcagtgctacgaccagcagaggagcgcgtttgagcaggaggcagcagcttcagcgtggaacaagcttgagctcttctaatcaatcaaaattaaactctgtaaattatgtttacagtgtttattataatcaataattaccgaactaaaacagaacagtgttgtttcattgttctagtattgcctctctggttaattgttccattggaattgcattagtgtagtgatgtgaaatgatcaatgttctcagttatatattgcagaattcgatcagtttatgtcaaaaaaaatcgatcacttactaggcaacttcagtttttcttttttttttaaaaaaatcagatcgatgaaaattgtccctgcatgtgtggggtagtaataatccatgatattataatttcatatctaaatatgaccctgtttagggaagcttctgcaccttctcccagaatcagaaactcctctaaacagtctagtttttagtccaaattctgagaagctgtagttgtagaatccaggaaatgaactacaagctagaagctggaaaacccagcttttccatattcttggaagttgctaccaaccagctgcttctcagaattttaagttccccaaacaggctttatgtccctgtggctgatctttgtactttctataaaaaaaacagaaaattcagcaaagagccaatttttttcttagaaaataggatataaacccgacctctacatctaaccagatggacacaaccgagcataaagagcccaatgagagttatggatttacaggaaaaaaaatgttgtttgctttgctcttttttttaagagtaattctacggtctttgaggaggtaccatgactccatgaggtacctcataatatctaggtatcaaatttacaatagaaaaaataatacctcatggtatcatttcaaggactgtaaaattgctttttttttatgtcatgtgcacttgcacgcgtgcatgcagatgccgtaatgctaaaggaaaataaattcaggagagaaattaaagaatgagacctacgtatgaacaattgagaggagagagatagatgctgatggttgtagctagattctaagaagatcctactagctaccaaactctccttgagtgcagtgtgctttgtacttcacttcattcatatcccaggtgcaaaaggacaataatcaagtcgctggatctaaagtactcccatgggataaagttgtgtgttatgtgagttaaacataattttgtactttactatattctaaatcttatttatttagacgtgtgctataaatgtactccctccatataaaaaaacaacctaaaataatatgagatataatctagtataacaaacagatccatgtccatatttgttgtactagattatgtcatatcttatattagattgagttattagcggtttaaaagttaatactaagaacaaactaagggataaaaataactcgatcgaatgttaactctaaatttagattttaattttgaattccatggcggctaataagataataagtaaacaattggaagcgcaagtagattcaaactttctctcccatgattttacaaatttcactaaggttattgtgatttcaatagattttgaacacgacttatcactagtgatcttcctataagataaattttagtgttcctgacggttagagcatatatgatagttgtagaaatattaggataagattaatttgtttagaaccatttcttattgctaatcctttcatatctctactcatataatctttatacatatatcatcccgagaggccgagacccaatacaatcattcagttacatactatatttctcttcctatatatttatcattgcttcttcgatcgactacggatatatatacccatagtggaagaagcagtgatgaatatagggagaatagctactttagtccctaaagtttctctgtaaaatcagtttagaccctaaccttttaaatggtccaaagaaatccttaacctttttcataaggcctagaatattcgttgggtccaccaaaatcatcatatggatatgccatgtcatcattcatgcaaaatcaataatgaattgtccaatttacccttacgtatatcatagaaaaataaatataagggtgaattagatataaccataggaaaaaaatacttctttttttcaccttttgaggtatatttttgctcttacaaataccatatattttttaactttttccttttgttttttactttcctgtgcgtaagggtaaattggacaaatcatatagattttgcataagaaggtgacatggcaggtccatgtggcgattttggtgggaccaaggactatattagcccacatgacaaatttaaaggacttgtttggacaatataaaagattaaggactaaactaatctaggagcgaaactttagggatcatattaactattctccaatgaaatatatatatatatatatatatatatatatatatatatgtatgtatccagcgtgcgtgtaacagcacagtggaatacatatccaacgcgaaagaaggaaagcagaaatagtttctctagaaaaaacataaataatataatactaagatcatccatgacgcatgatgatcatccttagccggacacacgctcacggctcacatcagcttctttctacgtacaatgggagagaacgaaagtcgcatccatatgcaaaccagctagtatctctttgctcaaatccaaaatttgcatgattggcgcatacaaattcaactgctcttcttattttttattaattaattagcttgaatgcggcttgtcaatcctcgtcatttcacttaataacattattaaccgagaggttctgtatactcgctcgatataaaaatataataacttctaactcttaaaaattaatatgtcttaaagtcgatttcttcactaccttccacatcttaatctatcacaataattattttttaatcatagatatgtccacttcccaaaaaaaagattatagatatgaccactacctagtgactagttggttaattaggttatgaaaaattacatatatatgtttgtttgagctacatataaccaattttaaatttagaatttaatttttaagactagcatagggattcttaaggcgttttaatcattcagctttgacttccataccacttatataagtaaaagtacaaaaatcaacattaaaattattttccgttacatcagtcgtcgcgggtcttttaacttataaaccatgaataaaaaaatatcttccttgagtccgaataaaaagaatatatcttccatataggccatctgtaaggaatttttctctgttatatttgtagctagtcaaagtagcatattgtgcatgcatatcgtggcagctctctaccactacgacagaaacagtttttccatgcgagagacccagtaggtagcaggcgggtcgactgtctcttctttttatatatagagataattaattaactaactatgctctatttttgaaaatatttattaattaagttattttattatatttactaacatgtggcgtgtcaaatgatgtgtggacgtgcggcctcaatggtacgaggtgtatgtgcaacacacgtgctagctagaccatatgctttgcatgcggcggcgagttaattcacataatttaatatgtgttggaggattatttcactagctttgctttttcctaagacaaacaaacatatgtatgtatcttttaccatcagtttttaaaaaattatatagtttaatatcatattcaccatcttaaataagttttataatatataatttatacgttgttaaactacatgattttttttaaaataagtttgacttgagaaaaaagagggagtccagtaaacgctaattaccgcttaatgttctcatgttccaaagctagccctaattaagaattaaatttaagggtattgtgctgcttaattactataattagctagcttgggatatgtctagctatatgctattaataagacagctagttattcataggtagtgaagacataaaattggacttcttgttttatgcatagataatatttttatcatacaaacccttgatcagtgtacgtgttttccacgcgtattcttcgcactctaatgtgcatgtgttggtcgatattttttttttccaaaatggatatttggtgtggaataaatgagcatcaggtgtagaatatctacacatgcgtctaatagtctgttgaagtgcgcggtcactcttcaaacgtaaaaatgatataccatttttttagagaaatatatgccgctttgacaacgactataaattagtataatatattttgaaaagttagagaggtttgttatggaattaatatttgagaacatttttctttcaccaatccttgcatccataattcgcttgtggtatgaaaattttacacttctctcttttggcactattccgttagtacttcctctgttttgtcattatctagtccaatctagtagttgttgatcattatgtacttgggggacattcaaattaatctatttatccaaaataaatatttaatctgtccatgtatattaattatcaggaattcttgtttagcattattaatttgcttgcggaaaatgaagaatatagggtaggtttaatttggtgccaaaatgaaccttaccaaaatttggcaatggcaaaaattttagtaaattgataacattgccaaaattttggtaggattggcttaataatgttgccaaaattccatacacattgccaatatttggtaacaaactaaatgtagccacataattattaattttaccaaataatagtatggttaaaaatgtcatcaatttgaacagactcgtactatagcaaaatttgctgctttcgctctacttcagtactccatccgtttctaaatgtttgacaccgttgactttttagcacatgtttgaccattcgtcttatttaaaaattttgtgaaatatgtaaaactatatgtatacatgaaagtatatttaacaatgaatcaaacgatagataaagaattaataattacttatttttttaaataagacgaatagtcaaacatatttaaaaaagacaacggcgtaaaatatttagaaacggatggagaatttgattaagtggactacaagcgtaattaatggatattgaattctggtactaatggtcatttcattggagaaaaagaaaagaaactgagggaggattatttccatggatggaacactcttttcttcatggaatataatttaatttattacgaacaagtatctatcaaacggggtgtttggtaataagaagaggaaaaaaaaaactaacgctggtttatctttgcttttgggcatcgtgtgacgtactgaaacgtcctactgtctactgatgatctcaagttgtcaattactgccaattagcaataatttaatcaaagttgttcacatcttcgtaggttgttcgagctgtttcatgcatgtacccgtacatatatgcacacaagttgatgatgagatgatgagttaggagcgtgttcggtgaggacacatgcatgcagtccaacaaaaggttctagatattgacattgacttgacgactagcttgatcgcagttccatgcattttttattacaagacattttattttttaaaataaaaattttgagtttaatatttatagaaaaccatagtaatattttttaaataccaaacaaatatattatcaaaacatttttaatgctagatttaatgaactaatttgatgttataaacgttgatatttttttataaatttaatcaaacttataaaaagtttttaaagaagttaaagtatcttttaatatgaaacggagaaaatacatgagtagaacccacggcgattcgtcgaacagctagctagaccagccttttccagcaacttccgagttcaaattaagaaatttgctctaatccggtccagtaaaaagtatctcgaggtaccggcacctcatagtactaaattgtttccgatcgttggatctagctggacagaggtattgttagattcaacgatcggaaacgatttggtaccatgagatattgataccttgacatactttttattggaccggaacaaatctctcaaattaaactctatcgatgagaatcgtttttctttccacttatacttcctatattattcttttcggtttaaagattatggattactgcaagtttgcttcctaaacttccaaaagcgacacttattcttacgaaactttcttcattagtattttttagaaaaaaagatttaaatcaactttttaaatgttcaatattttatttattcgtctgtgcccttaaataattttcataaacttagttgtatccatcacccataaagaatcttagggtgctttcttttctcatatttctcaacttctaatttttctgtttatcaactagctttattttaaaagttctatgtaaaagttgcttaaaaattacattaatctatttttaaatttttttaattaatatttaattatttatgtgctaatgagctagtccgatttctatatgagaaaagttttcaactcttcgacccgaacgcagacaaaccgggcagaccggacagacaaaccgggtagacagacaagagagtttggaagagcttgctgcagcagtagctacactgccttcgtaaaaaaaaaatcctgattttaaagccggacaagtgatttattaaagtatgattaattgtgtattaattattttaaaatttaaatagacttgcataaatttttaaagaaaattttcgagtaaagtgtacgggcggtccttaaacttgtaggggtgtctcatctaggtccctaaactctcaaaatgcatatccaagttctagaacttgtcatagtgtgtcatctaggtcccaaatcgcaacaacccattatagattctacgtggcgttgatatggcatgccatatggaatgacatggcatcccacattgaatgacttggcatcattttggctgacaaatgggtccaatttaaaatttttccatttctttttttcttctctttttttccctttcttctcctttctttgtgacccgagcagcagaagaaagggaaaaaataagaatgagaagaaaacgaagaaaaagaaataacgaagaaaaaaaaaggaaagggacacgtcacgtccatgtggcatgccacatgagccgtaggattctaaaggagatgtgtcgatttgggccctagataatacactttgacaagttctggaacctgaatatgcattttaagagtttagggacctatatgacacaaccctacaagtttaaggaccgccgatgcactttactcaaaattttctatagaatttttgttaaatacataatgtttagcagtttgagaaatgtgcatttgaaacacgatcatacgaaaagccagactgctataagtctggatacgtttattaaaatgtgtcacatctaataaaatttctttatattttgaaacggacaaagtaggctaaccgctcagttacatcagctgccgaaccagaagccacagcctcacaggctctgtacaggacagcccatgatgctagagcaagtttcaccgaatagcctcaaaatctaatcagtcatataaattaactcttacaaaatttaaaattcaagtatcaaaatatttaaagtagacaaaaacaaagtaaaaccgggcataaagaaagtacacgctgcgatcctaggcttaattaggcatatgaaaagaagttatgcgatcaaaatattaaaaatagaaatccgccattcaaaataagtaattggatcaatcattgatcgatgtggtggtagagtcacgatgtatagtataattctatttgttaggtttaaatccgagcgtccataaactatatatagatagtagaggtacttccttagtaaaaagaaaaagacggcgaaagtggaacgacgatggattcctctccttttatcatacgtaggtacatgttcgtcgcttttcatcaatttttttctcctttctgaatttcggcaaattaataaatttcctaaattaatatatgaagataacatttttaaaaaacacaatacaaacgaagacgctcataacatacacgcacttaccccaaacactcatggatatacttatcatatgagcatcttcgaaagactgggttgacatctacttacatgttcatctcttttcgtcgtttttctcctttctaactttcggcaaattaataactttcctaaatttatatatgaagttttttttagaaacacagtacaaacgcagacgctcataacacgagcacactcaccctaataaatacacacgcacactttatatctatgagcacctccaaaagactgagttgacatattttgagattaacgaagtcataacaggcgactcactatcgacaggtacgtcgcgtaccattaaaataataaatagttgtaaatacgagcacacacgttaaatctaatatttaaattcgagtgaactgattctataaaaaaaaaacctaattagttgaggtaggctcacttcactacatgaaaacaatacgatctttcattatcagggaaattattaaacaaattattaaagctgctttggagagacgacgcggttttaataccgctttgcaatagtacagcatatccacttgacctggtatcgtgagcgtctggactgttccggccggcagatggcgaacacgtatactcgacagtataaatgctactacgtactccctccgtcaaaaaaaaataatttctagggataaatctagacaaatatggatccagattcatccccaaaagttggttttttattgaacggagggtgtaatgcagtagcaacgactgacacattgactaaacccatacgtcaacgtctcctattacatcaactgtacaaatttcccaccaatgtgtggtgcccacgcccaagcatagctcctatatgcaaggttgccttagcctcttagttcccaaaacaaaaattttcacgctgtcacattaaatatttagatatatgtatagaatattaaatataagaaaaaactaattacacatattacgtgtaaattgtgagacgaatcttttaagcctaaatacgccatgatttgacaatgtggcattacagtaaacatttttaataaaggattaattaggcttaataaattcgtctcgaatttgtaatttgttttgttattagattacgtttaatattttaaatgtgtgttcgtatatatgatgtgacaaccaaataaaaaaaatttcacaactaaacaggccttgccagagcactggtatactgtagaagatatttgtgcagccaatcgatagcatcgatgttttctgaattgcccgttgctctgtgtatagaattagacaactttttttcaggagtattattatatgacctcctgtaacatttgatttttaaggatagatttattaagagaatcacttacgaaaattatgttttacaagcctttgctgatgaagaccaccctaaaagtatttttaagggtggtttattaacaagtctacatgtgaaaaaaatgttttccttctttaaaagtaatagaaaatttattttaaatccgattgaagtgaatcaaagttgtgattcttacattatttgctttaatataaatggccgggttcatatttccttagaacatttattttaatacgattgttactcatctcatctcaagtactttgaaattaagtagtaaatggccctaataaaaaatattaaccatgttatattaaagaaaatattgtaagcatctcacataattttggttcaccttcagacttatatgaatttttatagtttaaacttcataaagaaccgcaagtaaaattagatactagagcatatatataattagatacttagccctgttcttttctctaataagagttgaatgaagattaagatttttatcgcacgtttttcaaactgttaaatagtacgtttcgtgcgaaaactttctatatgaaagttgctctaaaatatcatattaatctatttttcaagtttgtaataattaaaactcaatcaatcataagttaataccacatcgttttgcgtaaaaaacttaatcttcatcttcaggagaaaagaacaccaccttagatgggctcaaatgtaaaaatgtaaaagagatatatagatcccgtcaatctttacaattctgataaaaccatgatgtaaaaccatgtctccatcagagattgtttgaaaacttatatctaagagaacttgtaacgaatatttggtcttctaaactctctc

SEQ ID NO: 38993 - DNA, 9736 bp, Oryza sativa
aatgataggctaagtctctttaagagcagagatctaggtctttttaaaacagagtttttttagtaaggccttgtttagttttcaaaaatgtcacatcaaatctttagatacatgtatggatcattaaatatagataaaataaaaaactaattgcacagtttgtatgaaaatcgcaagatgaatcttttgagcttaattagtcaatgattagcgataagtgctacagtcacccatatatgctaatgatggattaattaggcttaataaattcgtttcgtggtttccaggcgagttatgaaattagttttgtcattcgtgtccgaaaacccttccaacatctggacaaacgtccgatgtgacacctaaaaaaatttcttttcatcaactaaacaaggccttgtattattcgtgatctcacgatgaagtcaggcacacgcgtgatcactacagtagtacacacaaatcgatcgatatcaatcacacactcatgaatcattttgtgtttgactcggaacgagcgatctatcactctctcaaactgtgctcttcctcactcttgacgatacaagtctaccggtttgctaattagcaacaaagtcaagaaaagacaccagaactcgtcaattacattgaacgttcctacctacgcgtaccaacacacatatatgcctattgcctaaggtctaaatcttgaagataaatacatatgtgtacaacgtatgtatacttcatgaaaggtaacttcccgatgaagtatggtcacaagtttaaattcattaaccggccggccaagattttcctgcaagtcttaatccgcacaatcaattcacaataatcgctgtttctcatgtgttgacaagtgctcattcccaaacgataaatttacaatggaggacagaaaatttacaagtgctcattcccctttggtagaacatatattcactcaggtacattttttactatagacgacgtacctgttaacaaacaaaacattgtcataactttatcagaaatatcgatcccttcctcaaaggtgcttataggattccactttgtaagaaacttcctgttgttagggcaagccggccggcgggaaatagcccttgtgtaaaattattatggttattctatcaacaacgacgactcaaatctgatgtggtgatggaattgtcgtggatacatgacttcactaaatgatgtttaaatcttaataattataattatataaaggtggttgcaatttcaataaaaaaatatgagtaaatttcacaaaactacaggtatttttgaacaatttatcacaaaactacagatttaagagcttgtttcataaaactacagatttagtgtcttcgtttatcacaaaactacaggtactttatataatctatcacaaaactacagatttaagaacttgttttacaaaaatatagatttagtgtattcgtttatcatagtgctacacatttagtgtcttcatttatcacaaaactacagatttagtgtctccattctcacgaaactacgcgttttagcattgttaaaacatgtaattttgtgagaatggagacactaaatctgtagttttgtgataagtgaagatattaaacatgtagctctgtgaaacaatttcttaaatctatagttttgtgatatattgttcaaagtacttgtagttttgtgataaacaaagatattaaatctgtagttttgtgaaactagttctaaaatctgtaattttgtgactgattgtgtaaagtatatgtagttttatgaaatttactcaaaaaatattgatgttccagatttattgttgctgtttctttgggcgtgtatggatgtggtgtatgtacatatatatgccgtatgcatgcattttccatacaatcgcaaaaaaagtcagtcatgtaaactagtgatactttttgatgaagtacttggtacagctacatatgtaggcaaatctatactttctataaagttaaaccccactaaatctaaagcttaatatgtaaccatgccacatcatcatctgctagtaataattacatatttaatttcatgcaagaatacaacatcatcttaaaaaaattgatacaatagtagtgcttgattgccaaattttttttttttgagaattgcttagtaatttcctacagtaaagcgcggggaatcacatagtggatacaatagttactgctgtaactaatttaggactcctctgatatacatgttttcttaaaaaaaaattccataggaactagttcatttcctttaaaattctcgtaagtttcctcagttccaaaatgaggccttatcatttactaccttcatgctaaaaaaatatctttctagacagtttatcaggttcatagttaaaaagataactgtagtatttatttacggggtagtaattaataatttggctcctctctccattctcaaatatctgacttcgttcactctccccatcttactttgactataaattaccttttattgattatattatgatttatatagtcaaatttatgactccagacacaccttaataatatagtagcatattttcaagcagaagtatatatagggaatttgaacttcaattatttgagaatgggggagtatatatagggaaaatatgtagtgaaaatcatacatacagtgaaaacttaaaaaactaccgttggataaaaaataaacttttaagatttgttcatgtcatcaatagtaaaaaaatttacttacatattcaacaaagagtaaaaaattagtaaaatttttacttttggtgacatggataaatcttaggcatttatttttaaatccaatgattccttccatttatcccaaaataagtttatttttcagcaatcaaagtagaggttaaatgcattaggagtagataaaatgaagaataattgtataaggatttaataaaatagagatattctagtcttttattttttatcgatatgtgagatgagtgaaaaatgaacctattttgagatggagggagtaatatatataattgctggtattaattaatataaacttgtatgtctaattaagtcattttccgtgagaatttcatatacatgttactaacataaaaacacaaaattgctcccaattctacatttctttgatgtattagacagtcaatgcaacacaagtcggagagttctcgaagctgaactttctggtaaatcaattatcgccccatatatggccattcggtgatggaggctgcagcggctcgaaatttcctgtaacgttcacatatatacatatatcgtggttaagcttatttaaatttattagttaattaatcactctctcggtcatttctggataaaccacttgacagtttatgtacatgaacatcttgacttggtgtgtcctggtgatggtttgagtcttctgaaactgactgacgatgcataagcatgtggtttagaaactctggaaaatcacccattgcacgaatgggcaaggggggggtctccatcataaccacatcaaagagaccatcaaattaatcacgagtaagcgtatcactctagaactcatatctgagagctatatactttggtattgcaaaagactagacactatcaaaattcagtgggacagagctactccctttatttttttatataccatacttttatattcatcttattaaaaagtatatataattatcatttattttatagtaatttgttttatcattaaagtactttaattatgacttatacttttaagtatttacataaaaattttgaataagaaaaatgatcaaatgtagcgttaacggtgtcatatattaaaaaaattgtaacattaaaggtctcatatattaaaaaatagaggaggtattactataagatggatagatagaaatcactgaaattttagtactatatcataatttaaagtggcgtttggtttactaacaaaacaaaatttcgatgttactaaattttggtaggatagcgaactgaactaattaactctactcctactgacacagtagtcatgatccaataggccaatcttgataattacttttttctcggatgctcgaggacacaatgacgcattgtcaccacacaaactgacacacaggagaacggcaccttcaccgaccacagaaaattacttcataaaaattgagaagtgaaacgaaacaataacctaaagtctagacaagatctcttgctttcatcaaaggaattaacagcaaaactccagatagatagaaagacgacggctcacctaaccagaacataacaccccacacgatctgaataaactatcaattgattaattgattattgatacagtatgtaatatatatatatatataatgtcaggaccagaaaagcaacagcataacacctagatatagctagatagttcttctttaatttgttatgcaactcatgacccaccttagcttatccctgcacacaccaactattttatacttgcatgcacagcaaaacagaattgcagattaatctgaaagtgtcaaccctaccaaacgtccaaaccacacaatcactttctgtgatggctgagtttgagaggagaggaaaagagaagatcgagaagatacgcaaaatgaggtgagacattagcgcatgattagttaagtattaactattttaaattttaaaaaggattaatatgatttttttaaagcaacttttctatagattttttttgcaaaaacacatcgtttaatagtttatgaagcgtgcgcgcggaaaacgaggtgttttctctctcaatcactcagaaacgaacgcagcctaagtactattgttagttgtgacataaatctaacgaagcagtgagatggaagaatggtgtagtttccttggtgaaatggctcttgatgatgtgattggtcactggacatccatgatccatgcatgtgttcaaatgcaacaagttgatttttttttatcttgatttgttagtacaagcaagtgggggcgaacctaggaccaaaactagttaggtgattctcgttgctactaagcatagccacagaaatgttttaatttattttaatatgaggtaattaaactagcaattgtctaaacacttaagtatgctgggcccctccagaaatcaacatggcaatgctagctctgcgtcactgaataattacatggcctttttttttctctctaacacatttattcctactacaatctccgatgagtttcatatgaaatatgttatacagaaaaaatattgtaaggttaaagattaatttttcatgagctatgttcttaatatctgaaaccattttgtgaaagtacttgaagtatgagtataatttttatacactaggtgtatatataagttgactaattgtagataaaatatctatgaagctgggctaattttcattttgagagagaaagcagttaacaggatcaactattaagagctactgtatgaaaatgagctgagaagcattaatagactgacctggatgtgcaacaggagtgaaggcccaagtacaggagccaggaggtaaaactatagttgcaaatgatgtgattggtaaactgggaggtcaaatccagtgtcgagcttttgtttctgtcacagcatcatggtgcaagagtaaatattaacattactaacttggtgtttcatcaggaaaaataaatttctgcataacatgtgcctaacaaaatatataatgatgaaaagaactacagtgaccaccagagcgatacagagacgctagttgtgctggtctaccatgactcatgaccgttcagatatcatcctctttgcacttctccagtggactcagcttatctcaactagccaggggaaacaatagacaagtagtgattagaacaggataactggtctgatacagcaacgaattctgaaaaaggcgtcaaattcaggaaaggcgggcgatgacatgtattccagtacttacagatgaagtggtctctaacgcgctttagtcctacttgttccccagatggtcccataataacgcattccctgcaaagagtgtgtgcctcttggcttagcaacaattgatatcttttcccctgcatatagagagagaagggatgataaagaacaggtagaaaccattgcttcaattatacttcctccgtttcacaatgtaagactttctagcattgcccacattcatttagatgttaatgaatctagacataaatatgtgtttaggttcattaacatctatatgtgtgtagacaatgctagaaagtcttacattgcgaaacggagggagcatgagtcagaaggctaaagccacagcaacacacaccagtgttagcaccttgatattttagcagagctttgtaaaagaagatctgaagttctgaacacctatcattctgcaaattttcatggttattgatttttttcttttattgtttgaactctaaatcaacttaaaactcaacaaactatcactcattttcacatctactcaagtgttggagtttatttggtaaggacttagaaagactaaaaaaccatcatcctgcttaagaaattttttcgggaggaacattctccaatcaaaatgctaaatgagagcttctcatcagctctcaccatgcataatttgaaacatgtttaggtaaatcaaatgtgttaataatgttgcagtgattaatgataactgatattataaagagaatctcgtgtttcggtgtccaccaaacacattaaagcaactacaaatatagaaaattctgtaaaataaatgccaatatgagtgatcagcgttagatagtaaggactaaggactagccagtcttcaataaacaaggtgactggttactcaagcaagagatactatacaactctgcaccctccccttatcctcgtgtacacacctccattcagtagctttgggaaaagaataccatccaagcaagagacatagacattacagacaataatacaacctcttactcaagagctgtagatgacctcgcattgtttggtactactaggattggcaagtgacaaccattccctaactatatatcccaagataacactagtaaaataacaacgcccatagctagtgggaacagaaattgcagtttccctgatctccaatgtcaaaaatattgagtgggcacttcttcactagcctatctgcatcatcaatttttacttctttgagaaaaacaactacacaataatataacactaagccatgaaaacaatagtatatagcaactcatggttttcttataagagattccagcaaaagaattttacctcagggaaattctgtaccaggctgtagtagcaactggagaccacttagaatgaactttcctcattcccttaacagcatatgcctcaagttcaatagcctaaaatagaaccgactaggcaaattagaaggcacggtggtttgcggagaattaccccatgaaaaattagtaaagcaatttcagagtagcaggtctctacaagaaaatatctttgcagaaatttctatcagcatgcacatgaactcaggtttccagcagaaatttaagccgcaaaaaaaattgattggtcacaaaaataatggtaaagctacatacatcaggattccaggaaatgactgcgttgaaatctttattataccatgtggactcagcaaagcgccataatccaaatagtaagcctaaatgacagcagatataggtaccaagtatatcatatagtgtcaaggggaaagccatgataacaaccaccataacaaacttacttggccaggtccaaacctcataatagttatatcgttaaatttcacaccatcctttttgagatatccttcttgctttggccgaaggaagtgtaggtcttttgcttgttcccagattgagcaggagatgacatatttaattggctattttctgctaaccacacctcagtagaaaatatcagtcaaccttacaggaaatatgacaggattataataacgataagggcacaaagaatagaatacttaatttatcattgatataagtcttaggttttagcaatttaatttcttacatgattgattagcataagagaacaacttcgcaaaaaaaaaagaagagataacaagaagtctagccatcaaagctttccaagtagaacaatgataacagaattggcatgaataagctgaagtaccaataactaaggatccactgtttgattcagcgtgcatgaatgatgatggtatcagaaaatcagttaagaaatttgtttagatagtttgagtttttggtacacaaaatattatattggtacatagtagcattaggcacatgctttgctgccaaggatttaccctcacttttttctttgtaaattattctgaacagagtaaatctgattgatgtggcatcaaaatatttttaaatgattccaaatagttttggcttttattaagaattttttaagatggaagaaaaggttggtgccttagctgatttatgctgtatattcagataataatatgaaatgtcgtcaatgtggggatttacccattaaccgcatatctaaagactaaggatccacaatttgtgaaacataacacagttttcttcttatgtaagtctcgtagcacagaatgtgatgtttcaaacagataattggatcatcctcgcttaaaggagatggtggtttgaaggtcactaacagcatcaaatcaggttgtttaatctatccagttgcagctggcaggtgcaaattgtctcccataaaaataaggtccacaatttcaagataaatttgtaaacttgatgcttatttagtaaaaatgagaaaaacatggcatttagtcttaaaagttaaaaagcagtgaataaaaatgactccaaagaataacctggagaagaatatttagaaataaatcacttttgcagttttgcacaattcaaattggaagggaggaaattcgtacttagaaataagatgattggaaactgtgaaagggttaggttgcaggacagcgaagataactgtaagctgggggcctttctaacatgaaacacgcagtttgtacacaataatgaggcatcgttctctacagaacccaacgaaagaataatacagctattattcatacacaagtattcatacatagcaatcaaatatatgaatgtggaattagaaaattttaagttattgacctgagatataataaaaaggatccatttgcatccagtggaatcaaaccaagcctgtgtagaataacttcatctggtgtaactgatgtgttgtcaaccatgaggactttctcaattttccgttgtaggaacattgtaatttaaaataatgaagtacatgtattggaatggaaccaccaaatacatgactcattagaacgcaacaaacagttttcaagatggtagtatggtacagatggcaacatgcgcatacctctggtacgaggattcttcataaggcattagttatcgatgcatcaacaccaatcatatcaaactccatattatcttcagtctttatacatataaaacagttaggccttgtgcacacaaatatagagtaataaatataaatgttgtttctaaagaataatctaaaaaattaacatcatcaatgtcttctaagtagcaaattttacctgtataaatagacaattatgagactaacagactcaaaaactgaatatactattctgtaaccaccaact

SEQ ID NO: 38994 - DNA, 10229 bp, Oryza sativa
ccatgagatgcaataaggtagaaagtgtcatgctgtattagagatcaggctccaccttcgcaacagcaacctatcagaagttcagaacacatgatttcttcaggaacaaaaatagaatttaacaaacaaaaattacctgcagaaacatgaatacaggcatagcatataggtgcatcattcgttatagattctacgtgttttctttcggtatttcagcttgatatatcatcggttgggagatgaggatttgtcccatagcctcgagtatttttatttatcttttcttgactaattggccatatacttattcgcagaggccgaagatgtaaatcatttttattatctaaaaaaaatataggtgtatcataatcacacacaaaaaaaaaaaaaggtgcgggagcagaagaaagagtagcacaacaaatggatacaggagttggggcatcagcctcgcagacggcacgcgcgatcgccggagctcaaggcagtcggggagcccgttgatctggtcatcttcttcgtcatcttccccttgccatcttgctcgcttcgtgctggtgctggtgctggtgctggtgctgctatgttgctgagtttgctcgcgccgcgtggggcgtggccgcatccaatccctctcaccaccccagaggacggattggttgcggcgctcgccggagggcatgggagggaggcggcgccggcggcggtgggcgagggagcgagtgactcactccggcgagtggacggagaaaggaggaagcagtcggcccattttagacaattgggcccaacccaacattggaacgctaccaatgggcccaatccaatacacccgcgttgggtatggcaacgctttggcccatctttatctgggctgctaccagtgtagcggcctaattgggtccgtttgtagttatgtatgggcctagattgctggcaaattgatccatttgttattttactccgattcaggattttgaacacaaacgatatagttatttgcaccttacaaatgtgtgcttgaacttctaatttgcagcctaagagttgatttaagaactattttcatttttgttaacaatgccttctaagtgtctgacatttagatgtgtttggcacaagccaactaaatggacagtttctagcatagcgtaaatagaaaatgtatccgtgttttcgtaaaacaataagtcaataagccaaccagtaccgtgtccccttgtgatttcaaaaatgggattctttttatcttatgttaccattgttcttactttttttttttgcgatttttgacgatcatacacatcgacttgtgtcagccagttgtcatgttaattctcttagacagtgcacgtctatcatgtatctcggcttttcccattgtgtaatctcagtacttgcctcatacacattggctcaccacatcacatcaatacttcatgcggtgtccatctatcatgtatctcacctttatcataggatggttcatattattgacgaaggctgacctcaaatctcataaatatcaatagactaaataattgtatcgggaatattttcttcatgacctgagccattttagtcaacataagtgcgcacacactactgtacaagaaaactgcagtttgcaacttcaaaactaacgaattccatcacaatttatcaaccatagtgggtgatggattagtagctagacaatgacaactatatatgcatcgcaaaccttttcctccatctggtcataaatatttgacattcacaataagatttagttaaaatttttaaattctaaccatcacttttttttagagtacttagattattttgtttcaaaaactcattttgagaaactattaatgatttgaattttaaaagtttgaccaaatcttaatctaaacgtcatttttttatgaccaaaggggctagttttgttcagttatttaaaattggtttttacatgttgcaacgcatagacattattgctagtaaagtattcaaatggtagatgtatatgatgttgatttataacaaaacattgggtgcaacttgtttacacttacgatacgttgtttctaatgctctattctactacttttgtcccgtaaaaaataaatttctaaggaactaaggatacattaggagaatagacaaattatcataataacctcatttaatgaacacagtgtatgcacacatttcatatataaacttgattaaaataaggttaaaacaatgagttagagatgggatggaaggaagagagattacaaggaaatatattttgatgtaatcaatttgttgggtcctatattaaatactccctccatttcagtttataaattgttttgactttggtcaaagttaaactgttctaggtttgattaagtttgtagaaaaaaatattaacatttttaacacaagacaaatatattatgacaatatatttaaatttacatataatgaaactaatttggtgctataaacattaatatatttgtctacaagcttggttaaatttggagtaatttaactttgacaaaagtcaaaatgatttataatatgaaacgggagtagaaatacaatttctacgagacaaatattcaaaggtagaagtttaatttttatgagggaggtagcaataattatgtttctgatatatttttctttaaaaaaaatgtttcaacagtatatcctttcttgttctaccgttcggttctgtttccgaaaaggaaaaaaaaagcaaaggaaatggtctgagcatttttctatccgttttcattcctagccctttagccataaatattaaatattaatatttagcacaagttttggtcattttttacaatatttatgactacgtagagtatactagcttgggagagactacaatcaagtaaacactgtaacatatcactgcatgcgatctccaagggaagcataataatcttagttagctgcgtgatgtgcatgctacaaaaactcgctagtcattacaatgacaagcattctcgcctgtatgcacaaaacagtatgcaacaacaaatgtaccgaacatataaaaatggccatggcaatggcatattggcatcagggatactctgtttgaattctgaagctagctttgtatgtttaaggctagaaccaaaaaacagcaaaattacatacgccgaatctgtaatcctatacaactcagcagcatttcttttcctctcaagtccaatgccgctatggctcagggcaaaaataatcaagaacagcctgaaattacctgcaatgtcacagctctcgtactactaagtggcggcggctgtggctagatcagcacttataaacagctctagccaaagaaagattttgcagccaggatagaaacagcatctagtgatctcttcctatgtctcatcataccctaacacggatgcgaaagaaggcgtccgatctggcatcaaggtcagccgactctcgctgagctgaatcttcggtatacaatgatcaccaggtctcatatctgtaactttgtgctggggggctcctggctgctgaagctgatgttccttggctgacctaagcacagtgagtcctcgcagttgttggtcgaaggggtgatgtccgtgcacgatgatttgctcggtgtgctgggactgccaatggtgtcactgctctctagtggactctttgaggatgggtatggcgcaacacttgacactctacatgataaacaaggcacatgtcaaaaatatgcacaagaccatagtaacagatttcagctgcaaagtaaaaccacaagacacacgatgacacgatttatacctttcctttcgcttctccaagaatcgggcgagagatgcttttcgagcttgaggcacagctggaacaagcaagaacatgaatcaatctcgaataccttatgaaacactacagtagttacgccgggaattcagaattccaaaaacattacagaactagcaacatgaaggtagagccatatacctcttggcatgatagccgaagcatttgtggttgctactggaatcggctgggacggggatgcctggctcaaaggagtaacagccaacggtaggcctccagatttcggccccgcagagtcgttggagctagaaaagctcttggggagagtcacagcttgcgacacgatggtgatcggattcgaaacccctgatacaagaggcacagaagcctctggtttctgaactacaatctgccttgcaggcaaagcctcgggcactgtaagtttcgcagcagcggaaataggcgaatctgatttacgagctgcactcggtggactcggaatggatgccctgcttgccaaaagcataagttcttgagcctgccacagttatgacacaatcaggaatcatacccccaagaactgaagtaacatcaaacagatttcgcgcgtcgcaaagatacgataccttctccaccggaatgttgtcgaacacattcaccaatccatcgtagaatatggtcatctgtgtcaccttcggattttgaaggtcccttttgcaagtcaacgatccaattgtcagctcaatgctttctcatttttttttcttagctttgcactcaaaattcagaaatgatttctattagagcagagtagagattatccaccttgggccgccgtagacgccgacggtggagccggccaccgagttgccgacggagaaggattggttcctgtaggggctcccgccggcgacgttggggaggctatgaacccggagcatggggttcgcgtggccgaacggcacggggtggcgcggcgacggcgacggcgacgggaaatggtgcggcgccgcgacgccgtaggagtccacgccctgctcccggtggccgtgctgcgccgcggcggcgtactgctgccggccgttgaatccaaactgccgctgcacacagctcagaccgttagaatctaccatgggagggacacgacgtgggcgacggggaggtcggaggcgaggcgaacctgcttcatggcggcagcgccgtcgaaggcgtcaccgggggacgggcgcggcggcgggcggaacccggagagggagaagcggtcgaacaccgccgcctccttggggtcctcctccctcgccgccgccgccgacgacctgaaggacatgaacgccgacgacgcggcgccgaccttggtcgccggaaactgccactgcatcgccgccgacgcgcctcctcctcctcctcgataatctgcatcacgagaaactacaaattcactcacaaatcacgacgcacagccaaaaaaaacacaacaatcgcagcacagatttacctacgcagaatcgaagaaaaaaaaggcgctaaatcacgcacaagaaaatcgtgccgatttgaacaagcaatttaaagccgtcaaaaaaattgaaaaaaaatgaaagcctcttttataactaaacaaaaacaaaaaggaaagctgcgaattgggcggccaatcgatgccatcccaaatccgcagctgcacgcattcatctctgctctggtggatcacatcacatgcccgaaatccgagctcgcatcgcacccacccaattaaaaacccgcatcgccatggccgcgagctaagccgctactactactactactagcaccaaccaaccaaccaaacgagttcatcatcaaagaagaacagtggagcaccgacctgaatgctcctccggcttgccggccgcctcctccttcctccaaatcgcgccaagaaaatccctctccatcccacgcgaaaaaacgcctcaagaacaagaaccaatccaagcaaaacttttatcccctcttcctcttcctctccttcttctccacgatgccttgacctttcttcgcgctgctgtgcttcgcttcgctttcctctctctctttctcttcgtttcgattcgattgctcgcttatttattcgcgagatttaggagggagccatgattagttagagataatttaatcattattgctcaccgcatttaattaattaattaattaaaaaaagaggatgggggtgtgggccccaccccgcccaccggctcctcctctcccgtcgtccccgtcccacgtggttcgcctccgcacacgcgaaccccccaccccccgcgccacgtaccccgcggtcaccgacaggtggggtcgggggatggtgggggccgcggtgtcagtgaggtggcaggggtctcggcgggggggcgttgtgccgcggattattatttaaagcctcgtgcgacgacgcctcggggggagtaagagcaaggataatagtatataataagattagctcttcttaaagccaacatagtatataataagattagctataaaattgactataattttcttctcctctctctatctctcacttatacatttaatgtatttgtcttggagattgtgttaagctagctcttacatgagagccaatccacttgatttttttgttacatctctccttcacgtaagtttacagtcaggttatagctcactattatacttgctctaaggtgggcccgaccacgtgcgcgacgcgggggcgacacgtgtccccaccagcgggggcgcgcacacacgagccgaattgcgatccaaacccgcgaggccccacggagtatgacgccggggcccacctggccaagcgggagggtggtgggtcccacgtggttcgtgtgcgggttcacgcaaacccatggtacggagtagtggtaaaaaaagattaaattgaatttttttaaaaaaaatgatagaaattgcgtcacgggggagtttggaattagcgatgtggttagtgtgctagtgggggtggcgttgagggttttttaaatttaaatgtttagtttcctttaattttttctattgtttttgaccctaccaccatgtgcgcatggctgattttaaattttggttgtgagttgctttcgtttttttccttctaagtgcagtattttatttttcttcttggtcggtccaggttgatttgggcagatttgtttattgccgtctgtaaaatgactgtaatgcccttgataagaaagagcatgcagcaagatactcctagtcctaggaccacttgacagaaatacaaaaccactgaccagtgactgagtttgagtttgtgactattcaattgtgaattgaagaatccatgtacgaatgcagtattgtatgcatataaatattatacttcctcctatcataaatacttagaatttaaaataagatttgattaaaagatttataaattttcaataggaaattttatatgaaaataagttcacgattttgtatagtgggcaattttatcatgatataagtacatttcgaagcaatgttttgctcttgcatgcaagaaattattgatgaacaaaactgtaacacttcagtttgatcaatatttgtctagaacaacaaatatttttgaccggatgaagcattgttttgatgttctgtacctaaagcaaaatcaaagataatttccaattgcagttataattaaaccacaaaattttccactcggtgacaagggtgaatatgaggctagtgaaagttgtgagagcgaacaatattgatgcggtggctcactagtcactactaggcttcattctaatttgcttgggatgatttaatgatttacaagaggatgaaaatccatacagagaataaggatagatgattgaccatattattgttgtggattatcgaccttattacaataataaattaaatattttttaaaaataaatttacaaataacgtagaacatgtattgtaatcaatgcagttgaagaaagtttttttgagaaaacgtattttcaaagaaagtttttggtgaaaacgtatttttaaagaggcaagaagcaaacaatctgagataataatttggtgaattatattaatccgagctagagtggtatggttccaatctattatattattaaaggaatagaaaaagaagcctccacgttcgctttcatggcctagaatttatcacattaatcggagaaaaagaaaaaatagagttcatataggaatacaatttaataatagctgaaattcggaattaaaagtatggaatataggaaggtaagactagagtctttatcgttatacaatagaactaatggaaaattcggaattaaaaaataaaaaaaattaaatgtagaggttagagttcatataaaaatacaattagaattaaaaaaaattcaaattaaaaatatattggatggagaatatagagtcaatatagaaatagaatttaaaaataattaaaattcagaattaaaaaaaatattgaaagataagtttagatcaacataaagaaatacagaaataatagaaattaggaattaaaataaggaatattagaagaagagtatagaatacatataagaatttaaaattcaaaataaaactaataaaattaaagtagaatttagagtacatatagaaatacaagttacaaataactaaaatttaaaggcatatttgaagttcgctctcataagacatgtaaaattatattgtcattttaatatatttgaataatacattgagaaaatatatatgctattataagagagaaaatataataatgctagccgcacaatctgcatgggccactatgctagttttcctaaattacagtggtacgtagccaatatcatgaatagtagtcgtatttatctaaaatagaatatttgtagtgacattgatgcaattaacctcatttttaaagtgagtttggcagtttgcatgactaacagtgtactggactcatttgcagcctatagctacacaagaaagctcgacacggctgcaacgagattaattaaaagttactagtcaccgggttgtttaatctctctattacgtttgataccgaaataatatcgtcagagatcttcaccgactacatgaaaaataattcagcagatctagtgcatgcctgccaaccactaccagtgtactgctcatctgcaatttttggcctattatatatgcatatatatttactcatacatatattgcgcgctatcaaggatgcgtataggcggatgtatatcagaatgaaatcatcttttggcttatacgacttatcagccaaaatttgaattctcaaacttaaatttaacgttgattttagggtttttccatcagagtttatttttacttttagatcgccaataacatgaatataaaagttttattcataaattattttttatttgtaaatataccgttttcgcttattccaatgggtccgatagtactccctctattccaaaattgatctacgtatttcataggtacatcaagaccaagaaaaactaataactctctcatactatatttactctagcaacaaactctatgcatgcaccatccctactattttctagccaatagcaaatcaagatattgcatgtgggttataaatacttgtgtgcatggatgcatgcatcaatgttcatttactccaatgcacaaataacgaatagacataatgaatgaatttataaatacttgtgtacatggatgcatgcatcaatgttcatttactccaatgcacaaataatgaatagacttaatgaatgaacacaaatatgtagatcatttaggaataacctaaaaaaaactacatgtagatcaatttagaatggagggagtatatgacacgcgtacacaacacaatacattaatactaatagtacaacatgatactccctctgggctgataatacttgtcgttttggacaaggatgaagtcaaactttagaatctttgattatgaatcatttttaaaatatttgtctttcaaatatggtgactatatgtgtatagattagtctttaaaaagtactttaataagatcatatatttgctaacaattttatacatattataatgaaaaataatggtcaaagttgttttttagagaccgtgtctttgtccaaaacgacaagtattatcaactggagggagcagtaacattggagtttcaatacgtacgcatgagagttcacgtgatactacactctcgatcatcatcacttcttaattaataattatattggtcaaaatagtggccgtagaaatgatacaaccaatgcatatgcatgtccggcaagcaacagcaggtagtatataacatttgttttacatatccatgtgcaaaacatcaatatggcagacacaatttttggtggaaaatatttccatat

SEQ ID NO: 38995 - DNA, 24358 bp, Oryza sativa
tgtggaagtgaatatctatgtgtgtgataattaataagactgtcatcacataccaattactcatagggttaaggtttagggtttatgtcgaacgaattccaccaattgagtgtaaaacctggttaattaacttcgatccatgcagaaagcccaattaatatgacaatgattcataatgtatatattactattccagaattttaatatttaaaatcccctcaaaaaataattttaatatttgattgacatgtctgttactgaaccttgtaatttatatgtgttggcattctacaaagctggatggacgtctgtaagtcaagaaaatatttaattcacctcacatatgccaaatgtaattttgttggaaaataatagtaattgcaaatttcatggatgatttatgttgtgtagatcaaatatcgttaaaaacttatgtttaattatgatggtgcagcactttgatttatcatttatatatatatatatagaccttgtgttacatgagggtggtacatatatattgtggctacaagctaatttagccctggcctaacaagatagacttctgttttcggtgagccatttgcctttgattattttgatcattatttttcattggagatgatagctttcggttagtatatacaattgaatcatgcttgcatgatcgatcggtactaattaataaacacgcacctggggaagcattatatatatttggatgtatgctttggctgtcatggagttggaaagactctagatctgataatttatgtagtctatataaacaagtatataggcggttgagtctagaaataattcataaatatatgtatataccctctacgtaaaaaaaaactaatcctaactacgaatctagacatatgtgtatccaaattcgtagctagaatttattattattatttaagacatagtagtgctcgtatatgtgagcatgcgagatgaatgatagactaaattaattaatggataaaatttggctagctagctgggttcgcagagaatggacggatacagttatcacataggcacatatcattctattactctaatctatcgctaataattaattaaacagcttacattgtggtccaaaagggccaatttgtaatttaatcatgttttacataataaaaagcatctcttgaaagctacttttaatatttatatttgcactgcacgagctgcagtacgtaggggacaaattgacttccttttaaaaatctagtcgatcgatgatctagatctatgggaaaacggcttaattagtaattaatatttcttcaaaaatcgtctcacaaggtacagttaaattaaacatgcatgtggcaaatccatacatctcgtgaagcaataaactcgaaattggggatcacgtaccattagtcaacgtgcatatatcttgccctaactaatcttaattaatttaaaaatcacaggaatatattgaaaagctgaaagatatatatatgatttcttaacttgtttttgaaaatgaacgactcaattattcaaaacctaaaaaaacggttcgaaggacggttcttttcacaatataatatatcaaacgtaaaaataatattatcaaggagaccacaaattaataggatgtgatctggacgaattaatggagcagtatattttagttcgtgtgtaggagcacaatatagtacagctgcttagacaaatatctttcctgccttgaaaatacacatcaaccaacaaagttcttagcctgttatacaatattgtaacttgttcaaaaaaaatattgtaattaacatgcaaatgcacctgcagttttagttggtacctactacaattattttttcacttgacttttagggcattaaattaaggattgtatgtttgcaaaaacacttggaacataataatatagcatcatgagcctatatagtcttaaaaattgacttttggatcgaattaattgatgtgagatgcatatatatataaatctttcaatctcattgttcagcaaatatgctgagacaacttgcacagattaaagagacaccaccatttaatcttttgttagattgtactttgaatgccttgtgccaaaattaactgaaaaattagtctctgtcagaccattgatgcatgcaacacaccacacatggatataaccaagtaccatttcgacaagtggcactagctagcccctcgtgagtcggtacgtgtgattttctttgtttattatataagcgcaatgtcaacttaattgccattcgctgcaactcataagcacatgcttaggaggtaagaccaattcattgagatctgcaaaagaaattgctggatgataaaaaaagagaaacgaacgaacaaacaaacaaatttccttctattgaaaatcatgccatttgtatattattttgatgcttggatgagttgtgactcacacaattaatgtaactataataccctattatatttttcttatttaccacacatgtgctacattgtagataactacgtaccctccatctgaaaataagtacatttttatacactgacctaattcatgtataaaagtaaacttatgttgggatgggagaggtgtagataaagtaagggattgttcgtttgagctaacgatgggttatcgcgagcacgcttttcaagtttctacacggtattatctttgtaagaattttctttgtcatcatttctcgaataacttttttaaatcaaccttttaactttctaatatttaattcatccgtttgcacccttgactaattgtcatatactcagatttattcatgatccatcatccatcggcactttagaaataggctggcagagcataaatgaaaggagaagaaaacaaataaataatgtatctacggagcataaataaaaggagaaaagaagaaacaaatactagctggacaggtatggggagagtgatgatgtttcatactgatctatctatatatgcactgattgagtatggatttgatgttctaggcctagccatatgataataacttgacagctctatgtatatcaattgtgtgttcttgtctcatttgattctgtataaattaaggaatataatgaacagtgcagctagctagaaaacaatttgtaaatatcataatcaaatgatgttaattatatacagtgactgacgacccttcatgtgccgtggcacccacatttttgtcatagcaggaattaattaagatgttcaattagtcaaggataagagaaaagtaatatagcttgtgcaaattaaccagcgtgtgagagctagctgcagcaatactgaaatctctagcctttgtttggttcagtctggtttaattagcttgttttattgtgaagtttgtcagtaccggggagcaggaggtggtggtgttaactgttaagccttctgttagtcttagttaattcattttttttgaatgattgaccctgtccaacaaacatgaccatatatgctagctattgttccaaaaaaaaaaaacatgactagatgcatggcacactagctggaaaagatgcttgatctagaattaaaaaccaaatgcatggatctacattaatttagcatcatactgtgttcatgttgatgcccatcttttgcttgttatcctatatatttccgtaatgtctttttttaaaggattccgtaatgtctttatcaaataaacattataaggcatgtatgtatgatgggcgtatatatacttttttgcgagatgtctctttcatagagtggcattggatattttggcctaaaaggatttgtatataacaagaatgcactattacagaattgagtttcatgtacgagatctcctccaacttctaggtggactgtaatagcgtctgcatgtgataatcggttcctgggatgggttaagggctgcttgcaaaaatgtattttcgcaagtaggtccttagcaggcccggctgcgacaatggcaagcggacctcttaaagagacgcaggcatacaacaaagtggcgaatgcatcctcggtcccacccctaccctagcgcaccacccatccttatactctcctcactcactccgcaccattttctcttctctccaaccagcaggcctcatctctctctctctctccaccgtctcatcgcccagagttgagtgcgcggaagcggagcgcctccgcctccgtaccgttccagccatgtacccgcgcccaggcctcccagaggtgcggctccacctagcgtagtgcacggggagcccgtgtgaggcgagcaacatggagaggtggggaggcttgatccggctgtgggaaagccgcaggatcaagcagtggggaggctgaatctagtgacggggaagtcggatcgagtggtgggaaggtcgtaaatcgtggctaggaggctagaccaacccccataaggcagcgtgcggcggaaaggcttcccctgtcccccttcttcacgccggtggacatgggaggatcggctccagcttgggcaacctcgagagagttggatctggcacctcctctcctctgcctcttcattgtcgccgcgcgcttgggtctgcaccgccggcctcctctcctctgcctcttcgtcgtcaccgcgcgcactggatctacgccgtcggcctcctctcctctgcctcttcgtctccttcgtgcggcctcctcttctccatgcgaagagcttggcggagtggcgtatcctgcatggggaacctcggcggcagtggatccggcgctgggaccacaatgacaggatggatctggcggcgtggatgacctcagcgatggcggatctggcatgggagctacgacaatgtcggtggcagctgtgatgataacgttctcttggggagctagggtttccaccatccccgactctggtatataggggcagatccgtcgccccctgctccgggaggggcgttgattgctgcagcgaactcactgcggccataacgactaggttttggttttggggatttttattttttttgtgatttttcttttttgggtgggtagcattactgaccggccgcaaaaaattgagttttgcatgcgggtgtgccacccgcaagcaaaaatatcaatttttgcaagcatctccgagtagacgtgcaacccaaccgtatgggaaaatgagttttgacaacatggaaagaatttctatagtagggatcagataataaattagcaaatagacgaacaatagaatgagtgttttcaataaaaccttgttccgtttggattgataattaggaacatttaaggagatgtggaagaaaacagtaagcaaagattatttcaaggtggttctccagccagccattacctccttttacaaggaaattcaaaccaaattaaagatctctaggtattcaaacaacctaatatatatattacacacatgtttatccaaacaaattcactgcgattcctcgaacatatatgcaatgttgtatttgaaccacattttctccctatatagaagatatatacgaacacacatattacacctttaattaaaatgtatttttttagaaacaactaaaaataaacttattatatacacttaaatatttatttttatttatcacgaatcttgaggcaatatgacaggcatccggaccatacccccaaggtggtgtccggcgcactacaagatagtttcttttttctttttagaacttacaagagagtgttgatctgcagtctgcatgcacaggtagtgggagattgacgaagaaaaagtgtcatcttccttgtacaatggggccttcatttaatcactcgataattagtggagcattaactaattaaagaacagtgtggtggattgagatgaagtagctcttaattaatttgcagacaggtagcaagctaattaatttccacgatcgatcttatcgtggctccattaaattttgatcggaaagaggagctttttccaagctaagtgcctcaaagagaccgatgcatatggcaatcagttgccagtacatcatgatacatataatcatttgtttttgcaagcaataatatatcaatctatccaaattgtgttctgtccatcttgtacgatcaagtcatatatatgtattgtgcttaattactccctaataataatggacttatatgtactataggaaaatggcatttgtttctagatcaacatatatatagatattaaattatgacggacgtttttttattcaaaaatatgacatgcactatttatcatgtgatttcatataggagtgccaatcaattaacagcgttctttggttggacgattgatgtcatggccgtacgtaacggttagaagaattttagtcagaagtttatattgcaaaaaatatacacacactccataaagtgagaaggtcgatatcgggaagataagaccagggaaaccgaattaataagagaaaaaaatgtttctcgccttaaggttgatgccaaaaaaaaaagtcgctagcttatctgaaagcacgactgattcataataaagaagggtctaggtacatcctaatcctagtaaatcactaatcaacaactacaaaactagacataaccaacaataacatcctataatatgttttaccttttgatgaacaatttttttaacaatttttttaattttttttaacaataacatcatacaatcacttttgtcagttttttcaataaaatgacaaaactaccctcgtgtgttcttccattgcttctgttcagctatcatcaacatacacacacttacgcatgatggttccaccttgcagttgatttatcatttttgctaatccatccagaggatgtccccttgttcttaccgtcattaaaatagttatgaatttttaaaaaataaataacaagatagattaatattttatatatcggtacaaaaatttaaattcaaatttgatcttcacaaattgtaataaaaataacaaatttaattgaaattagtatacatctgctcatagacaaatgtgattttttttagaaaagaaaacttgtaaaagtgaaatttaaacttgcatatttgtggaatgatgcatcacacattattctatcttattaaaatttttattttttataattatttgcataacatggaaagaaataagtggacatcctttcaaggtattaatatgcaatgatatatcacacgttattctatcttattaaaatttttattttttataattatttggataacatggaaagaaataagtggacatcctctcaaggtattaaaatagtaatattatacttttgcatccctattacacaagatgatgatgtggatggcatataggggaagaaaaacatcaagcagtggcatataaaggattagcaacttttcgatggaatataaggaaactcgtgaattttgagtggcaaataagaaattctctattaattaggaacatataaaaagaagactcggttctcgctaaggaaaaaaaatgttatttcaggccaaacagtgcatacatcctgtaaacggagttgcagctagcatctgcacctataagcaaagccaaacaaatcgaagttgtctcaccaaagtgcatgcatgcatgtgatagctaatctaaccaagacacttttgcaaaagactaattagtaaagctactccagcatcatatacacacaagaaaaagaagatgcaaattgaaccaaacaaacaaataaataaatgtgaactcgttggttttctccacaaccctcaaagcaaaattaaaagctaggcagatcgtgacacagacccatatatattcttcccatgctaatctgtaccgtcttctctctctgctcttccttgtctgatcttcaaatggccaacaatgggcagacagacaagtgactagattgattgacaaacattagtacaataattaagggtgtggtatagtgctttacctgatcaccctttaatattgcatgtgtttttccatagatgcagcccaaagaggtcattgtcgattttgtcgccgtgatggctttcagaccaagcaagatttcgcaagttgtgatgtgaaagccggtaggccacaagtgatgatggtctagctcatctatgccggggagccacgctagtgatcagattctaatatctccggaaagttttatacgacataaggaggatcggaggtaactagttatagttctgcaggaaatattgccaatgcatttttggcaaaattgaagaaccaagaaccaaattaaatgtgtggtagtggagttacagtataggtaaattccagtgatcataaatattactcgcatttattaggtgtgtttcaatagaaatttggtaagcttaaatatttgttgtcgacttctctttgaccgtgttgtaaggaggtacacatggttgtgtgcatgtccatctactatgtaatcgtaaaaagaatggctcgcagtaaattgctcaggttttgctattatttgttttgcatattcgttcttaggcatgctttcatctttaatttatctacaccgcaaagtatgtaggaccggcttcataagatgtatggttgtggttaagatcaactagctagggcttgactggagagagagctagtgggtggtatagtggatttgtgccactggatggaagcatactcatacttgcctgtgtcctgtctagatgctctgaatgcacatgcaaagcaaagtgtaataccccgtatattaaaatattaaaagatatttaggttgttttagtttggattgatttgttaaaataaagatgttaaccgaaataaataaaaaaaatatctttagaagtgggccaacatgagaaggcccataaacccagcccattagttctcccctaaaacctagagagaggggaaccgaatcccacttcccctcatagtgccgccacccctctccctggccggcacctccttccttcccttctgctgtgttcgcatctctcccttctacagcaaattgctctctctatatctccgccttcatagcttggatcaagaagcaaagtagaaaaacgaaacgaggaggaggagagaagtaaaaggaggggttagatcggagtctcccctattgtctccttacaagttctctaaagaaaccctaggtgaggcttattcttttgttgtatcagttgttctagcatggctttagtgctttaattcgtggtcagggaaggctagagaaggagtttgggtagttgcggttcggtttgttgcagttctgcatgtgggcagatttacagtgcttcagttttttgatattttggggctctaaatgttattttctgcaaacgtgtataactaggaagttgtagataatgtttggatctatcttctaaccaaagggcgcgattttatctcaagtggtttaggagatataattttttttagtatgactgttgtttttatgtcataatctggatagtagtagattgaactgtttttggacgggttaaacagtacaatcagccaggtcacctatagacaaagttgtagaggtttttcttagctttccatattggtaaagtacaccctgattgggcgagtagaactctagttatagttgttttagtgcggaatctgaaattctggacagattctgaagcctgctttcaagcgcaaattagaccatttaaatggcagaataaaaatacgatttccacataagagttgtaggccttgttctgtagatttccaaaatgtatttattttcactcatagccttttcatatttcaagatataaaggtttgaagcagtagtcttgtgtatagtccaagcggtgttccttgttattgagttttgatgggatggggcagtaggttcacctttttcattgttttatatgcatgtttgaatgtgttttctgaggttttgtttataattaggtggtggtccatcagatcgtgcatgataccaatccttcgttggaggcaagtgcatgacgaactaattgtgtgattcatggattgtttactctatctatttatttctgatatatttctacgtgataagtaactgcttatgttcatattattgttcacgccatttagatttcaagttgatcttatgtgtacgatgttattcttgttttaatattctggattctggttctgcttaaataattcaagttccctgcttgtcatggatgtgcaatatggtttcaatttggttctttgattccggtttcaattattcaagtaccatgcgtagtcatgggagtgcaatttggttctttattcaagtttctgtgggtaagcgctgatcacgcttactcggctttgccggcaaatgctaggatatattcactattgtccgggatggaaactactattacaattcatgcctgcacgggatgggaactactatcttctttaacttggtgtttggaaatgtgtttcctatcaaagaaagaaagccttatgttcatgctttattgtcaatgatgtatatatgtattttctagttccatattgtacttgctgagtatttttatactcactcttgtattttatttggttttaggtacgtattgagaccgacatgcatgggcgggaagtagcacctttatatacacatttatctgcacactatcaaactatattgcctaggtccataatgatacttaaactatatcatgattcggtcttgtaataatcttttagatttctaatagtttcttccccatggattataaggatggatcgcactgtaggaatgatattattattagttcaatttataactgtttgtcgtgaatgtccatatttacaggggagactctgccgaaatttctaataattttgggagttagtggttttgagtgtattttagtgtggcactccaggtacgtggctacctggggcgttacacaaagtgatcttaagctcatcgtataagcatatatattcacgctataggaagaacccactcaacaatcttctgaaaaatggcccatatcagatttgttttttcaaccatatggaatcaaacccacataacttcaagagaggtaagtatgtactccacggtgactagacctatgagactgtttgctagaaatacatataactatttgaagtcgtaaggacatatacaatgggtacacggcttcatgctttactaaaggtaaaaggtcaaatgagcttggtgaactgacgcgaataaactagcaagttaagcctacaaacggtctaacgtagcgaaaataagtttttgatatgtttttcaaggataataatggtagcaggtattgaggtgtaagaggttagtggcaccaattttaaccttgatgctagctacagaaaataggaaactagtactgaggacttatccttgctagagtcgacactaagttgagcgctgctgatgaaacgatgggtttatgagagtttttttagctatattgaataagagggatgtttgaattaaaaggtagaattaatatgatatcaaagttatttataggaagaattaaattcttaatttcctttgtgctatcatagatcacgttgttttagtttttcttttattcgtagggaactcttcgttggattttccctttgccctcatcacctcatggggtataagaccgaacatctcatttcaatgtaattcaacaacatttggcatgaatgccataatcaacatatgatggctggaatttaacattagccgatccctatctacaaccttgacaactctcatggacataatcaacatatgatagttatgaactcactcatatctcctcaaggtttaattaagtctcacattctttcaacgcgtatgggagagaataagtctttatctctcaccctccacatttttttactatgtcgttaatgtagtgaaaagaaattcgaaaactgtatacttgactcaccactaaaaaaaccttgtatagaccagccttataggtgccggttcaggccttttcccatatccaggtgatgaaaaagatataaaaccaacacctttaaggacaataggtgtcggttctaaagaaaaaccggtaccaatacgatataggtgccggttttttaatagaaccgacacctatacttatattgtaggtgtcggttctaaaggaaaaactgacacctatagtataggtgctggttttttaatagaacagacacctataaaacgagccgagccgattgaatgtggcgccaccgacgaaaatatctgcgccaccgacgaaaataagtgtgcatcgcttctagtctcttctcccatcttctttcgtctctctcccatccttttctctcccgtgtccttttctctcccccattatcttctcttttcttctggatctggatctagtgacacggcgcatcctcccaacggtggcgcgcggaggatggcgggcggccggtcggcggatggcgcgtggaggacggtgggtggcctctccacggcggcgtgcggaggatgacgagcagccacgtcgaggggctcatgggtggccattcaacgggcgacctccccacggtggtgcacgaaggatggcgagtggccgtgtcgaggggctcaggggcggccggtcgtcgggcagcctcccgacggtggcgcgcggaggacggcgggcggcctccctatggtggcgtgtgaagaacggcgagtggccgcgtcgaggggcttaggggtggccgctcaataggcggccttcccacggtggcgcggaggactgcgagcagctgagtcgaggggctcaggggcagccggtcgatgtgcggtcgtatcgaggggtacggactccccacgacggcgtgcgccggtggactccccgtggcggcgctcggtgggaggcgagcggccgatcaacgggtggcctctcccgcgtctgtttgtgcttctctcccttcctccctctgtccgtgcttctctcccttcctccctctcggatccttcaagatttgttctttgatgttcttgaatctcaggtgtctatatgttgttgtttagatgatgaatgtgttcttgagatgctaccagggatgatggggagcggctgcatcgagctgaattttttttttttgattgtgggatgttataggtgccgatttctaaaccggcacctatcacttatcttcataggtgccgacctataggtgccagttggaaaaactggcatgtatggggggttttccaaccagcacctatagcattttctgtagcagtgacttctatgcggatatccttaaatttcaccataaataattcataactaccaggatctgagcgacattacaataaacattttctcctttgtcattttgacaattaagaatttgtcactgaacccacatataatgaatatatgaggatcagctataagtgataaatagttaaacgccacgccttaaaagtggtaaatagttaaatgtcccatttggaatagcaactgcggacaagagctaggcaatctgaaccacattcacgtgcatatgcatagccaacaggcagctagccgttcgtcaggtttgacaggcatgtgtccgaagaattctggacgagaggccaaggcacagagagagtgctgtgccactgtggcgtgggccccactccttgtatgggcccactgtcatcgtcctcctgatcgacctgataatatcgctgcttccacgtgatgcattgcacggtgggtgccctcatccaatcattctcgcattgtttcctacacgtttctctctgccctaatccaattatatgccagcttcttgttattaccttctcctccatattaaaaaagaaaataaatggataacaaaaggaaggggaaaaaagaaaaaaatatttgatgggcaattgggcattgcgtacagaaactgaagaatgattgattgatgagattgatatttacaaactaccaataattagaatttagtaggagtagttgcgtttatgtatattatgaccagattattgccgtggattatttgcttcatgcttctcaaaatacatttttttatataaaagaaatcttctatactgtattgtttagatcccaagctagtttggcgagcttattaatttttaatctacccctatataaacgagtttgaatcatccatttcattttgtacccgttcatcgctttagaacggatccgtcttgttccgaagaaaaatatgcaaaagtactgaaacaagagtgcaccttgtgaaagtgtcggtccagcactggagctcactataggtaggtagtgaagtggtaacaataaaattgaaaggtactaatctatatataattcgagtcaaagataagcattctcttccatgcatttatttatctatcctacttgaaagccgccaccacagccatggcaaattgcattggcaataaacaaagatctgcagctacactagcttatcaacctgtagcagttgaaaggcagtacgtatgcgtgtgtgactgtgaactgtatgatgggcaagactcgtgcaaatttattactcctccttttttaaaaaaataaatatatgaaaccgttaaattttaaatacttcccccgtgccataatataagggattttgactttttattacactgtttgaccattcatcttattcaaaaaattttggatttattatttactttatttgtgacttactttattatccaaagtactttaaacacaattttttgttttttatatttgcacaatttttttataagacgagtggtcaaacagtgcaagtaaaaaatcgaaatccttatattatgagacggagggagttacatttttaaccattcgtcttatttaaaaaattaatgtaaatatataagatataaatcatgcttaaagtacgttgagtgataaaacaactcatgaaaaataaattatagttacgtaaatttttttaagtaacaaaatagaggtagtactcatactaaacagtcggccttaagcaccatactttagcctaatcttgctatgctctcttttgcaaaagcaagcgtgaacaataacatacacgcacacgcacctgctatcactatcagcaatatatatttcagacaagttcacataccattctgtgataagtgataacctagctgagcatggatgaatcagctgggatggaagaacaatatataatgagcatgcttatcctcccaaggcagcaagaaagtataagaccatgttgagagcaagtttaatttcatagctaactgttgacttcaaatcatttataatcaatttaatagccaatttatacaatacttacctataaacatatattacacaattaatatttggtctcacctatcatacacacatgcatcttggagatcgtactgcagctgggtataaatctgtagcccgctgctcctctctctcatgttttatctcctcgaaatgtgtttatagctggcttatagtttgctactatacctactcttagcgagcttaaacttccaagaaagtaagaaattagtagtaaaaatttaaaaaggctattttttttcagcttctgtccttctgacttgtggtgtatgttttggattttacaaccaccgcttttcaaaatctaagtgaaaattctagattgcttagagaagctaagggttacgagagaaactatggctggcagaagcactttaaagtttaaacaaagcctaagtagcataaaaagagcagaagctaagctagtagctagcttaatctctcctgcaagacaggcacaagacactagttcaatcttcatcagaagaagaaaaaaaagaagcaaaaggcgggaggagcaaaagacatgcaggtacatgggtcaaaagcttcaggctgccagcactactacctcagaatactttgattgcacggattgatttgatctttacaatagacaatcataccatcacctgtacccagatccacaaggaacatgcctgaacaggaatgcagaagaaagaaagaaagcagcttgtgtgcaatgcaaatccaaagctgcttggatcgatcgatcgatcgcaccatgtatgtgaccatttcactctcatgcatatatgctactacagtagtactagcaaacaaagaactcgagagaaaatgaaatgtgatcctcctgctaaacccaattcatcccaatctctaaccaccacagtaatccttgtctgtgcaggtttcagacattcagtcacatgttggatcgatcagcagtgaaacaggtgtattgtagtaccactgatggtgaatgcagaacggcagaggtgcagaggtttttttcttgcctctttcagacgtagttgtcaggcaattgtcgagctgcagggcaaagataataagcaatcaatcggatctaatctcttcggaatggtgcagctgagctattgaattcagacaaactgaatcgcacagggggggtttaagattgttcaaactgaattgtgaagatagcactatcgaagagcccaatttccgaagcaagacagctaaaaagcagacgatgtgtactatataactgcagagcgacacaagtttggtgagcgctccaagcagaaactggcaaatgttgaacgaatatcaaacaataattaactgcaaacttggtattctgggaaattgcaatgatagagtattcacatagaaaaaggttccaagtcccaaaccagaccagaattcctgccatgtcctgatagcagactgtagacactatgttctagtatgatccagagttgaaatgccgagcacacgcatccttagataatagaaatgttttacatttcgggcctctgccttcaggtaccgggtcaggattgattgagcacacctacaaaagaagcatgattaatgagtaataccatatatgttcaacattccagtacttgtaatttggaatgtgtggtatgtagtatctctgaccattctaggtagagctgagtggactagaagttcaggaaaaaaatataaccttaaacaccaataaaaacatggagcaaaggtaaagatggttgtacataaactgctttggtgagctgcaagggtcgttctgatactctgatgtgtttcaaacatgaaacaaaagataatgtaatgaatcgtctgagattacagattccagggatcagaagggaaggcttcaccacactaagtagggcaaaaaccatactaagttgatactgttgtggtgtcacctaaccatatctgctctgattttagagctatgctgtgtggtctggtttaacagacaaaatacacaaggtgtgtttttgtgtaaaacagcaggcagcattcaaacaatgctagcggagcaggtgggcatggatgaggtttgtgctggaaaaagttgtgcagtgctcgttgcatttccaacacaaaacaaatactatatcataaaaatatttccgatgatagattcactttgagttttttgttgcaccacatgttactatgtttgtctataaggttaatcaaacttaaataaatttgagttacgaaaagcccaaaacgtcttataatatgaaaggtggggagtactactgaacgtgtatagaacctgtgtggcttcaattacggacttgcaatcgccagtattaacaacacagaatctcagttcaatgaaattgcatggccagtaaattaagagatgactggctgggatgggccggcgattctcagtagcgggctgacttctagttgggcctatatgggcttgtccgctcgtgagaatattgggccgactgagtgaccggccatacgcttgggctggaggaactgaagatttatagtgcagtaagttttttttttctttgagtaacaagtttatagggcagtattacttgcactgtgccaaaacttgcctttctttcggagattttctagaaaaaaaatattatgggtacagcataaaaactgcagagaaaacaccctttgtttcgaatatagtgattacctacgtttagaactgtacattgtcccgtgtaagatggaaactactccctccttctctaaatgtttgacgatgttgacttttttaaacatgtttgaccatttgccttattcaaaaaattttgtgaaatatgtaaaactatatgtatacataaaagtatatttaacaatgaatcaaatggtaggaaaagaattaatagttgcttaaaatatttgaataaaacgaacagtcaaacatgtttaaaaaaatcaacggcgtcaaacatttagagatggagggagcatatgtcagagactctcctctcttttccatctctctccaagctcgccgagcgtgaggtagagctcaacaaacacatcgtggacagcatggtggcggtcgacggcgagctcggtcaagcgcggtctcaccatgctcggaaacctctcatttataggtacggcccacgcctacgtcctctaacgtcgcaaatcctcacttgtgatatcatccaagggccattaatcaatcatctaagggatagagacaagatatatactggttgataccctgcattttgccgcggtacatgtggatgaatacatacatgtttaaataatgtgaaaataatatggagataatgatttgacattgattgcatattaagttctaaaaatacaacaaaattgtaaacgatatatcatatttgcatgatatttaaaatactctagataataattgctagtgggtaatgatgtggcacacttgcatatgatttaaaatactctagataataattgctagtggatgatgatgtggcacacttgcatgttgagatttagaagttagtagacatcaactttacagtaaaattgaatatgataagccaaaacggcctattaaggaatataaaataatttatagataaaacttgtatatatttgtttttaagtgacttaaaagctaatgcgtaaaaagaaactacgttgaaaatatcttaaaataaacttcaaaattaagtttaaaagttcaagttttgtcttttgctttagcttattaggcgaaccgatgggacctgaatcctctagtgacctaagtgcagggagcaaacactatattacagagtgaaaatatagagcacacacatctttagaagctgttctccatttcatagacatggatcctctgcaatactacgcctgcagtcccagtgactgacagatggatccagtcctacatgttattgttacagataatctctacagatttctattatctaaggatgtggacatatctattggtcttgaaattacctgagtgcagagtgcaaaccctgaaatgttcccaacatctctcttagaattgagtggaccgagaaagtgagaggttgagtaacatgaaaccttaaacagcaagaactacatgagaagtaccaacaaggcaaccacagtaatacaaaaaccgctttggtgagatgcaagcatgcaacctgcaagggtctgatgcatgtgtttcgaacattggaaaaagaaagagaaaaataaaatcattgcaaatgtaataaataagctgagatttttgcaaattcgtgagatgagacttccctaattttgtagttcattcgcgtgggccgttttattggaatgaatccagcccaaaaccaacaacatcctgttgggcaggcccggcccaccgatgtcatccctcagagacggactacattctggctgggcctatatggactttcgagaatgttgggctgtccgagtgagcttgggctgaaacagctcgagacaatgtagcatagctctctctctctctctctctctctctctctctctctctctgttcttctctctttttggcgaaaccatagatttttcattctgcttacagtgccaagacttgccttcatttcgtactcgaaggtaccgcgagatgttaaaagtatttttctttttgagaattacacgatgttaaaagtatttaaccatgtgataatttgaagtaggagtagtagattaactctcggcgtcaaaactgtaaagagaacgatctttgtttcggctgtacttgcggaatactccctcaatcccataaaaaaaacctaaaacagaaaatgatatattctaatattacatacaaataggatatgccagattttgtcatatatttgttttgtatggaacggagggattacctaggttgttttacagctatcaaaaccctaaattgtcaggcaaaagaaaatctggtcaaatgaaaggcatcattgatctgaaataatagaagaggattgcatattgtacagcgaaacggatcctcttacgctaaaacaagcatcattttacagctacaccggccatttgtttactaggagctacagctgtgccatactgtaaagtaaagacccccaagcctcttttgttgactagagtaaacaaacaaatgcactggacggctggaacatgcatgggttgttgttgatcgatcggcaacacacgtggcaaggtttagggaaactccatcctctattaataatcgctcactcggaggagaaagagtaacatcaacgctaagagcacgtacaatagcaggctataaatcagctgtaaacatattttaataaaataaataaggagagagaagagcagcggctacagatctatagccagctataacacggactccaagacatagtgtgtgtataacaggtgagactatatattaatagtatagtaagcaactattgtatgaattgaagctagtggtggactatcctattaaacttgctctaatctatcaaataagcatcaccaatttggcatcattttttgttaagtagcgtccttttgaatccatcgagaccatccaatcacatctacaattcgttatctttggtcacatataccttctttggccttgataatcacctgtactagtagctcgcgaccagtaaaagcgttttaggtcactgatagagtgaagattctacggacggacattatgccagtgtagtaattaagtgagctaaacaagttaaaaactaatttacagagtactgtgttctaaaattgacttctcactacttaagtatagaagtcgcgcttgacttacgatgtcctaagcacaaatcgcgttttgaagtttgaaccatcggactataaaatcatcagcttagaggcgccttaggactggttcactttcttagcattttcatctttttcaaagttgaaaataaaatttggtaaggcaacccattaccaacccaaacgtcccaacttttggtaattctacaactttctactctcaaaactaccacccaaattctaccaatattttggcatggtagcaaaccaaacaaaccctactttcaaatctaactttttttgaaacacaaacaactttattaagcaagaacagatattaggggataaaccccggtacacaacaacggatagaagttaaaagcagagacaatcctgaagaaagagggttaaccgaactatggaaacaaccttccagatgaaaccgaacagcagaaaaaggagcaagccgacagagagctgcggtggagccgtgacgactgcagagccacaacgtcttaaaaccgtgacgactgctaccttgggcctcagttgaagtgcacaccacttgacaaaccgttaatccccttcggttgcctccacgggaacggcacaagatcgaggttggttgttgagccgtagatttttggtgtgagcgtcaccggactcagcaaaacatccccataggattcgtcattgaatctgaggaattctaacaaccctgacaatcgaaattgcacagggggtccgagctcaacccgaatgacaaaccatgtgcggcttctgctactaggaatcaaaagagagggccaaaacgtagaccagccaaccaacaacaatggggcttttgagaggctgccaatagacttctgtcttgctttgaggcctgagatggctaaggagagggcgacctgcaacatggaaccataagattttgagcagaacaaacacccaatcacaaggcttccaaaggcttcggcttgaaggaggatgtagatgacgacgagccaaccgctgccgccaacagaggaagaagctgcaccaacagtggcaccggctagcacacagcaagcgactggagttcagggggcgacaactgccacaccgccgatcatagcacacatgccgacgcctgccggcgccacagctagcataggtgcgacagagggaaacaacgccaccgctagctcgggcacggcgaagggggacgacagacgtcgtaacgccgaggacagcgcagagaccgtcgccacctcaacgacgaccaccgaagtgccaggcgcgacgcagactccgtctccaccaccaacacaaacccgcacacgagcagggtgtcggcaaccactgccagaagctcctcctccaccaccaccaaggccatccagatccggaaactctatcttactttggggctcttgctcggggatgatttgaccgccatgtcttcgattcgccgtccacgaggcgcagaggtaccaactcccaccaccgccgctaacgagaacaccggtcgccaccattagaggccagactaactagagaaacagaaccaacctgactaaagagtactaggggaaggtggccggacccctcctccaaccctcgccgacagcgaaccgctgaaatcgaaggggaagaggggctggaggggagagaaatcagagaggttactgtagaggaaaggggaacgagaggggaatgcttcaaatgtaactctttggtaacactaaattttggtaaggtaagcaatgaagtgaacatgcccttagacttgtgaatcaacttgccaaactctagttataagtatatagcagaagcccattaccattaccatttgtatttactctgaaataacaaaatttatttccctacggcccagcgttgaagagactaacagaaccttaacctcgaacagcttgactaacataaactcctacgaaaacgtggctaatagagagcccttgcaagtactacagtgcattctattagggctcctttcatagaatttcatagaacttccatgaaacaactaggactttcatagatttttcagatattttttttcaattcttgtgaaattcctcctctctgaaagaggccctcggtatgcagcactaccatcgtgtatagagtgctatgtatatgcgcacaaactacaagatgatcctacattggcatcggcataaacaagctgcagaccaaaaaaagaaaaattccaccaaggttcctgcttggttatcacgcggacgcggttgtaacaattatcacgtacggtaaccttctcaacttttaaaaccagaccacgatgtgaggtaatcttctcaacttttaaaaccagaccacgatataactcacagtaaccacacggttttttaaaaccagaccacgatataactcacagtaaccacacggttttcgcagtaaaggcaaagttacaacggtaacagctaaaccgtgaagtaacgataatcctatcccaaacggtttgataaacccagattctaactactaatacctcacagaagtgagaaagcaaaaaaaaacaaaaacaaaaactcctatacgcaaatgcaacagaggcacacagctggcagcacaccagtacagtacagtagaatgaatggatgtgtgcaatgcaatgcaacactacgggcagctacacgacaaaacatccaaagtactatcacagccacaaccaccaccactctctcactgtccactccactccactggataagcatggtcaaaccagctgcagctgaatgattagcacgccatcaacacagcagttagcatgctaagcaccgtcattatcagcatcagaaacggtcaaaacactcgaggcaaatcaaatcagcatcccttggaaacaaatcaccatccattaattgtacacatcatcatccacattagcttagcttaattaatccactcagcagcatcagcaggagcaggaggagaagcctagctcagccttaatcttacaacaacaacacataagcagcagcagcaacatgattaagcctaattacccgattaattgtactaagagcacaacaattagaggaaattaaaggaagcgaagcctaagagagattaagattaagaagaagtaattaacaaaccccatctcgccccccccccccccaattcgatgccactacgccctaaccctaaccctagagattggggttggtcaggccgccgccgcctcgctggggacggcggggcgtaccttgggtggccggccgcggccgcgcttgacgggagcggagccgtcgcctgcggcgggaggaggggcgggagccgggttggccttcttgggcgggcggcagcgggacttggggatggcgtcggagatggggtccttggacttg

SEQ ID NO: 38996 - DNA, 14210 bp, Oryza sativa
  unsure (1)..(14210): unsure at all n locations
tagggcgggagaggcgccggcttggaggcttcgtcggcggcggccatggcggaggagaaggagggggtgggggagatggggatggggaattttcgctcacgaagaggaggatatatgaagaagagagagatggatttggatcaggaatagataagaaaatatggaggaggaaggaaggaagaggagatggatgggctcgccttctttatttcttttttttttctctccatttttttttattgttaagctcggctgtgtcacctgtgtgagaggggaagtgagaagatgaggatggacggctgggatgagtcgatccgccgccatcggacggcgcggggagggatgggtcacgcggatcggtgacgtggcaggggtaggggtaggggaggggagaacgcgcgcgctcgagagctttatgttttgtttgcttttgcctcccgtcccgacccgacccgcgggtgccttttttgggggagctgtggaatgacggtattgccctccgtggtggcctcttttttttggttttttctgtggaggtgggcggtggtcaggcctgtgatttggctgcatggacaaagcggaaatgccctccctcccctgagttgtgtgtgtttatatcgttattattgctaatattgttacatgcacagctgaggatgtacaacggtatagtgtggctggaaatacacctgttttggttgtaatgtggtatgcatgtaattggtttaagatgatttaggttttgtctgatctgtttgttattgaagtttaaattacaggtaaatcgtaatgtagaaatagtagaaaagttgttacttccgaaaagtccggcgctgaatagtgcaactgaatttcaagtctacgcaacggttgcctggatttgcggatttaggtgaaatatagttgacctctttcataacgtgttgtgaatttgtgctttacttaggtgagcggaaataaaatcaagtttttaatttagattcaaaatagagtttcacggaatgttcagtggatagacatgtatgcttgctagtattgctatgcatatggttgatgaatagggtatagtgctactataagttatcgtgttttcattagttgtaatatggtgagtgtataattggtaagataagacattctaagtaaaaggcaacgaagaaatatatttggttttttttaggcagatgtgattattatggttacatataatgaacactttaaaaaggaaagttttaactttcaaaatattaagcgaatattaatgtaactaaatttcaaataaataaatggtcactcgggcttatgaaacatgtgatctaataaaccactttttatatcttagctactttaaaagcgcaattgtcttcatccatccttcccaaaaacaaaatcctgctatgtcgatcccctagcttccaataaaagctccaaagacccagcccatcatgaaaaccggcatagaaagaaactaaatcataactttatctcccaatcctattggaacagatgggaatgtaattagttgaattgtaaaattatacctaaatatttttctgcaactgaattaacctttgaacaaatatgatgccatgatcgtgaactcttttggaacaaagagaactacggaaattgtggaggatttgattcatatggaaaaatttctatgtagtcttttggaataaaggaatagctctctcagattattttgaaattcagtaatggactattttcataggaatttggagggcaatctagcataaggttctaccgcatgtttatctcttccatggcacagccacaaggttcctctgttttttctatgtaccatccaaaacaataatttttgaacttccacgtgttcttaattcctatagaaaatcaatgggcatgacactcttcctacgtttttcctattcttatgttttcacaagtatagtggcatttacaaatttgccactggattttcttattttgtaagaatactatttgaatgatagttctgttggtagttttttttcttttcaattttatagtgggaattttgccataacgatttagaacggggtaaattcgcaattgctcctatttatcatggttctttttagtatgaggtagtatttgtatagctagagaacatgagtacagagtaacaatttagatagattaagacaagtaacaaaatttcttaagtaaaattcgtataattttttttaacaagaatttaggttttctcaacttttgttttgatgcactctacctcccataccttaaaagtgagatcatgtgcgcattgcaattgcatgtacatggccaacaaaaacagctactagagttaagcagattagtagctcgacatgtacagttgtgtggaccgtatgaactagccggcactataaaaaaagctcaccgataacgaaagatacaaaattttcgattgggataatagaggcatcttccttttaatttaaaataccaagcgggaagtttacttgcttgagcgcatgggtaaaatcgtctttttggcgcttcgccatcgagtagtagtatagcttagctgccagctaagcccacagcttcgaaatttttgaaattggagcgtgcgctgcgctgggccgagccaagagtgcgtgaagaagaagacgaggaaaaaaaaaagaaaaaaaatattatatatatatagtactcgttttgttttttcccaattcagtttgagctcggagtactaatgctggccgcatttgcttcgcgcgaacgccacctgtcaccaggacacccgaaaagctactcgtacggcaacgcatctcctccctgcgccagtggggcccgcatgtcggtgagagtaagagtagtcgggtgcgcacgcgccgtgtacgcataataataggtgtagccttgcagccgtttacaccgggagcacggctcgccccggctggcgcatcggtcgctgacaggtggggccgggtgcgcctggggcccacctgtcggtgagggatggatgagagggtgtgtgtgcaccgtggagagtgggatttgcattgctgatgaactgctttttgggaacggggtatttaaagcactctcctccctcttccacctcggtgactgactggtccccccacacttctttttattactgtagtaataaagagtatgctagtactgtcactttgtgcacacaccccctctagagtttgtatatgggttaatttgatccatcctattataaaagtgtgattttagataagtatcactaatgttcgtttccatactattcgtaatcatgccacccgaatacgaaaatatttggttcacaagctcggtttgacttggttttgtttgctctgaattttgtattttttatatggtcaaaattgtccttgcatgccaaagacttgactcattcctcttttggacccgaaaccctagccatcgtcgacggcaagcggtggcggtgcttgaaggcggataatagccaacacgaatattaccttccaatcttgactttaatctataaaaattatgtagcttatccaatctacaccaccagattggatttttttcttcaccttcttaaattttaaccgaaatacatttttttacatagtatggctctgtttgaattttataaagatgaagatgaagatgaagattaagtgttttacgtaaaacgaggtggtaataacttgtgattaattgagttttaattattacaaacttgaaaaataaattaatctgatattttagaacaactttcatatagaaaattttcacacgaaatatacagtttttgtgcagtttgaaaagcgtgccatgaaaatctaaaacttaatctcgcctctgttaggttcttgaacatgacctataacttatttagctactatataattagaatgacaaaatgcttatacaaatcgaaagtatgttgacatgcttaaaacctaaatgtgtatagaaaaaaaatgttcagaataattaaatcgcacccacctactaacttcttgcaatagcatgcttacttttttatgttcttacactaaatttcactcacatatatgccaaattgatgtattgtgctctattaaaattatcaattgtttgtggattttttttctttagatcatataatcacatgatgagacgagcatgccttgccctcctaaagacctcttttgtaggctcatccacaagaaaagccaattatgcaaaggcatccaaccgcacttgttcaacttttcctttatgggctgcacaaaaactggccactagaaagtgcaacgtccaggttaacaaaataatttgaaagcaaaaggtccaatttattctggctatgtgttggaccaatttcaagttgacagtcacagttccaaaacgagctcattaaatgaaattattaaaaattccaagcctacaaccaaaaaggcattatgcatgagagtatggaccagtttagatcctcggtaaaattcttcaccctgacagagcaaggctaataatacagccaatctgttggctataaggttatttatagccttctcttagtctacccatataatagttagctctttacaattaatatagggcccacttgtctctctcacagagtttcttggttcttgtgtgcaagccggctgtaagtttatagcccgcttctcctctctcttctctcttttctcctccacctcaacatttagcctgcttatagcctactattatacttgctctcacatcgaatatttggacacatacgtagagtattaaatataaacgaaaaaaataactaattacacagattgcgtgtaaattgcgagatgaatttttttaaacctaattgctccatgattcgacaatgtggtgctatagtaaacatttgctaatgatagattaattaggcttaataaattcatctcgcagtttacaggcggaatctgtaatttatttttttattattttgcgtttaatacttaaaatatgtgtgtccgtatatccgatgtgacacgccaaaactttacacccataaatctaaacacccctatatccaacaatctttctaaatctgactctctgagtatctatttagtcagcttgccaaacaaattagagagctaaatttgtctttttcactccagtaatctctctaatctgatggtggatcccacatgtcaatctatatactgttagcctaaaaaaaacaaatattaattgttacacaaacatttgctcgatatagatctcattgtgacacaatcaaccaaactaagagactacccaccttgtttatgaaattcatagattcagccaaaatgatgttggggagaggagacaatgacacttacaaagacaacacaaaaataccacatgaaattcatatagtttaattgttgttatatatgtatgctagctctctatatattggttgttgttgtgcactcggtggatagatggatggtggatttttatagaaggaatgggaaggtctaggtttaggggttgtggtttttttttgtaccgacactaccgtgatattttctcttcgtttggagcagccgatcgaaggtgagagaggctttgacttgtggatgcagctagctagctaaaccaacctccggagcacgtgatcacgctgcacccatgcaacaacatgtaccaaacccctcatctagtcactgacagcctgaccccacctctcataggcacgcatagcaatcctttcttgcagtagattgagtaacctctacaagcatgtcatccaacctttctgtttggtataacaaaaacttgcttggcttgatatatttacttggcttcattgtaggttttttttatataggtgttctttagttttgtgttttgcttttctttaataattttataggaggaactgtggtattgactaggattcttgtggtgaaacatgcatagttatttagatttgggtcctaaacctggcatggatgcttgcattatacttgttattgtatcccgatttatagcaaggactaagtgtcatatctcttattcaaccaatacgccacctctagtattttcctaaagcatgttttaaatggaggtaaatacttcttgagttcctaacatgtaactagaagaagatcgaactatccgagcaagaacacattggttggatgagtagtattcgagcgtgctacgggaggtaaatggtacaaggagaatgaaacagaagcttttcaagcactgttaccaagcttttggcaggtaaaaacataagcttttatgctaccaagcaggaatattcgcacaaaaagatgtcgggatatcactccaacttcacttgcaagttggcgctagtggtcctaggaatcgtccgaacgtatggatacacccttagggttctaagcttttgaagggcattattgtaacttcatgtgtacctcctaaggctatataagctgacccaatcctagcgaactaaaatacatttttactggtacaatgacgacaagtgttttattgacacatcttgatttcacttcaccttaaggctagacgggaagagaagtactttcctgcctatccccaatttcttcatgaccaatatgcatgcctagtttacataaggttaggccccaactaatattatttagctatgtaatgggatagacatgctatgtgagatttgatctccaatcctgtataaatttgttagggtacatctatatgagtgtgagggcgtgcatgtggtatatgcatatgaaatttgcttaaaaaccctttatgggatttttatcagtccaaccgaaatgttaagctatagttgaagcttaagctaaatcttaagctaattaagggattataaagcaacttcttaccttcggaaacacattgagttctatacgtagcaatcaattgaatcttagttgatgaagaaagatgtgtatgacatacttcaacacaacatgatcttaatcgcgaagattattaaatatgctagcttcaattaatccagcccacaatttttagcgagctaaacctcaattaattaaggccccatcaggaacaggaaatttataggatcactgtatgaatagccaggaagattccacatgagattctcaccaaaatctttgtcgaattccttaagtacgttgcaaaatggggcttagtggaactgcttatcaaacagaaacaagggttggtgtttgtatggaatcagatttgtctgcatcgttcaataaattccggtgactatgcgcaagtgaattgccacagaacagcaagctgacgtcttcgtagtatatttatttggaatcgcagatgttaactatctttctaaaactttgttaaagttagagaagtttgacctacgacaaaactaaaaccaccttacattctggaacttgtaaaccaccttacatactagaacttctgaaacagagggactgagggagtagctgacacaagaatgggcaaaccaacccctggtctgtaccaagctttccatgcaggaaatgggtaggtttgtgtttgctgccgctttgccatcagtctcaaagttgaagtaggtatgacatgcccccggaccggcaattcaaagcacctgttcatctaaccatatgatgtttcagtaccacagttcatagggtagttaaagtgacctttctcctgatatgacagacactaatagtagtaagcctcttcaggatacttaggccattcacaatacgcctccgtggcgttcagcctcagcttgagaaacagcatattctataccacgtcgatcgcgttcggagccttattaggaacgcgtagcaaattttggtcacccgttcttcccactaaaagcctgaaaatgctggcgcagtgacagggaagaggggggagagtgtgaaaactgcccgctccgctggcgccgtcgccatcctcctcgccgcaccgccgagcttgtcgccgtcctctccgcaccgccgagctcgtcgctgtctgcgccgccgagctcatcgtcctcctctccaccgtcgctcttcctcgtcctcggagagaggagcgccggagaggggagaggagcgtcggacaccaccgctctgccgccgctccggtcgccgcctcgctttgttcggccggtggagaagggatagagcagagagagagaggagagaaaaagtgagggtaggtatatgcactgtggaacatgtagctaacaatgttcctaggtgttcttgagctgagttgtatatttgcaatgcattgctaatgcccttacgatgcagtcaccaaagaaagaattaatgtatataataatatagtaacctcaatttgcagagttgaagtgtcctttacaaggtaggagtagcatcattatacaggccagatagcttcaaaagaatcaatctttctgacagatttttcatgttaactatgtgggtcataatgtacatggatcaggcctctccttgtctgtggctggacactgcaaataaccatgcttggtgtccatgggggagaggttatccttcctatctactattgactgactacaacctgatacaagttgggtacaaaatgaatcgacgactaacctcgtgatagggacagagaaaaaatgggttatgaatctttacttgaaaactattgtggtggcgatgcttctgaattctgatcgctggtggttacattgaaaaaaatcaacaaggttagctgctgcctgtcaagaggaccactgatcggggacggtgaggaagtactttgacatggctttcctgaacctcttcttgtactgcatcggagatatgacggtcggggactcgttcttggggcctcccaggatgcctgaagctttcacccaggtctcgagctgcttgtcccaggtgtactggcgcaagtagtcaataatgccaatgacaagctctttcttctcctcgtcgattccaacaagtagtgagtaatccatgacatccgctgtctgcaaagtatttcaaatgattaacagtcattttcagtaatataaaatgcaccaattcatgaagttgtgcagttttacaagaaataagtattttgtgcaatcccttgtctgaaataagaatatatatatgagatgaattatcaagattaatttccataacaacataccgcaagaaaagaagtgtcattccaaacggctctttccaatcttcgttttgccttgctccctaaaaatattggctttgtatgcaatgcctctaggaggtttgaatccaagaggactttactctcactggatgtatagcgtgagcgcaatgaaccctttagatcatagactctagatatcttcctttcaaagaaaagattctccatcaccatgaggtccatctttacttccctaccaccttttaagcccttgatattaacctgaactcaagaaaaggcagcagaagttagaaccaggggaatactctatacacttcattcatcatcagataaatcatgcaacaagaagaaaacaaacctgatatactcctacgattttggccaggcaagttggactacctgaagtcagggattccatcaaatatctgaagtactgaggagcaaactctacaaacgattcaagctctgtcctggtgacttgtttgattatgaatctctcatcaagagtctttgcaaagtaaacattgctttttccaccttgcgcattccatctcttgcagcggctaagtgaacggatgaaatcaatatcctttgggcagcatttcttcctaagtgcggcaaaatgctttgcgaaataacaagtaatggaaaactttgctttatcttcagaaagtggcgattcatcatcaaaagaaaacttaaagtgagttcccttagaatccaaatggtcttcttgtgagagcaaggtcccgtcaagtccatggctgctgtcaatggcatttggtaggtgtaagaaactcaaacttgaattcagtttgcgtgtgacttgctgcacatattcttgtgaagtcattgcataggacacgatactggtaggctcatcatcatagactgcaatgacagcatcatcttcatacccaatctgaggcaacagcagccgtgccccatcatcgatcatatgtgaagcagatgagatatatgtaagtgtacgggtaagaacaacatttaatttctctactgcaccaggagacctttgagaacaagccctccgtatgtttggcattggatctttcaggatactagtaaaatccccaaagtattcagcagatctgaatgacgacagatgcaatgaagtaggagccaatccattgcgttctcgctggtgtatagcaaatttagaatcaaatgaatgaattctgacaggggttacagaattcccatagcttggattgtctgggaaattaaacgatccatactcatcaattttggtaaaaccttgtagaaggtcatcttgtatctcactagatccagtccatgccaaatcaatcttatctgaaaaaatagatgcaagtgagggtaacctttcaacaggttccttacccattgtagctgtagtaactggctgctctgtctctccattgaatctgcggaaaaccttgtccagatcttctgcatcatccacaggatgagttacaagatcaatctgtgaatttgtctcacccatcctgtattccgtatcattcaagcagccttctctagatagcaaggattttcttggacttcctgaagattgcgacaaatttgtggattttcctatttttgtatcccccacaagcaggtcagctttccactctttcagtctgacatctaagaaaatatcaggatttgaaacatgactgtcttttttaaggagtgaatctatgtaacaaagccttcgatcccaaatgtaagcatcaaggagaagaccgcgtctcaagcggttgagctcaagaacatcaatagagacctgcacagaatgattgctatctgtaataactggcaacagcaggatctgcaaaacaaacaaagaaagagacagggggtcaatattaagataacataaccttttgtttaacctgaacgcatacaaccaggaaaatctcgttgcactacctcatatccatttctttccattttaagcaaatctttcatctctatgatctgcctttgaacacctgctttcaccggctcatcctctgatgtaacactattttcattatgatgaagaaaatcatatacctctgaatgtaaggtctccattttgctatatatctgcaaaagccaaaagtcaagtatatgagtatcatattattagtaagttcacagcaaaactatatgatgcagtctatgaacatggtcatcataacttagaaaaattgcatacctcaactgccatccttctcatccaatcttgtcgactgcggcaattgaaatccagtactgaggggggtaggttaactgagagaatatcaacaggagaatatctgaagaaagcaaccatgtttccgtacctggatatttagcagataaattgaaatcacattgaaggattgagcaatgttaattggtgaaggatacagcagatacatacccatagaaacgaaggcagtctctctggagagaatgtccacaacttgcaactcggttagcagtagtatggtttgaaaagcttagctccaagaacttcccaaacgacagaccccaagctgcatctgacataattaccctccgtgtggcaggtggtacaccatccttaggttcgcacttgaggcatctatgccacatccatatcctaccatcacgttcacctggtaacttttgagacagaagccgccgaacactaattgttaaactcccatgctgatgagtatagcacctgacatgtgattctgatgactctttgcatgacgggcagcaatatgcctttgcatgaaaaaaaacatttccaaaaattatgataatgataagaaggccatatgatagtgcacatacggattgtacaggaaatacctgatcaaataagtcttccctgaggtacctcccaagtggcttatcaaagctaccataaaacttgatgcggaagagctgagaacgctcgcatagcatgcttttggggatacaagtgcttgaaagggaaactaagatgctctgatggttgtcagtagcaggaaaatattcaccagaaagctcattcgggccatctgcatctcccatcaaataatcatcatgtggtttgggaccatagtggtctacctcttgaaatttctttcctgaaaccatgccttgacggtcatcatttatgggaagttgtgtcgagtcattcaaatactgatattgcatcaccatatctgaagttctaatgtcatgatccaatgaacatggaaatattttatgacctttgcatgattcagttgcatggaatgaatcatgatcatgacaattcatatgttcaacaggaattttagattccctatgctcagagatgaccccctctccttcctcattcaacgataatgagccaggtgatatagaattttccttaaacataccattgactctagtagcttctgaatgtttgccttgtacaggtttaagtccatgaggaataccaacaccagcagatccagcaaaatagttacttgggtcacttcgaatatcatttaccactaccattggccttgaaggaaccttgggaagagtcgcaccttcatcagcaaagaatgatgtttcaagagagaggtgataagctgcaaacacagcaagttgcacaacacgcttaattttctttagttcctctcgacatgatcctctcagtagaacctgcagaagttgaggtacattgattagaaatatatagtcctttgaaaagaatgcaatggtgatggtgaatctgacaccctccccctacaatgtgtacaagctgattttacaattgattcttagttcccgttgtaacagaattgtgattatgtttcagtgtattcaatggaaaaatcatttcttttgaacaggaatgattcatttttattcgtggcaaaaaacgggcatttaactagtgtaaaaggtaaaatgagatattcaattgaaaactaattacagaaccagtgctactactgcgtatgattgaatatacaagcaaggagttatcaatttatgttagtgaaatgaatctaaatggaatatttagggaacagaaatagattattaccgtgcaacctaaacgcctcggacagccttcaaagaacatcagggtcttcattgacctcctgtttgtctgttttcctgatgagaattctgaaactttatgcaccttgaacaattcacattgacctagtcttgctgaagcaatattgtcaattgacgaggcaatttgtgctcctgagcatcttgatatcctatccaaaagcggtctcttaacattcagaactaaagaaatatcttttgccaagagttcctgggcataagatgagacacttttctcaactagcagcacatttggtcgccgagactcaatctttgcaacaattgccctcaggtgctccttttcctgcatcaatggtatttcattcagcaaaacaagaaacaacaaatatatgcaacacaaccatgaagaaaacacaaacctgttcaagtatagtatcaatggatgctagtttgttcgtgaccttctgatactcaagtgctccccctaaaatgagcaattttgcattcacatgctcagaggccatgcgtttgtgttttacattcttagagcaaaccactcctctaacaagattgctgcataaaaggaacacccatcagtttcatatgatggaaagtacaaacatgtaaaaaccagtcaaacaacaaagctaagaacatacctatcacttggatcccctgatgctaaacatttaactttcacataatcagtaggatccatgctgccacctttcttggtatctggtctcacatagccagcagctagccaagctagggaggatactatttcaagccagcttttggatccattgtcattttccagatcaatacattctcccttaagcaattgagccacaagagcccggaaatgcccaagtacagcattcctcagaccctctttgtgagctatgtctgtgattgtgtcaacaccaactattttgttagtattaaagttaccaagagcaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 38997 - DNA, 2111 bp, Oryza sativa
taatctagtgataaagctcaaattataagtaccacatctcaagagatttgtgtacatatgttgaagagtggtgatttcaaagttcatagagattccaaatgcacgcacatgtcaagaatcatccccctcatctatgcaaagtataagtgcttaagtcttgaaacaataatgccatggtaagctgatagaacggataaaaacatccaaatacgccaatttccccttaaatacaatttatgttacacggtaacatgtggataacttgttcacattaaaagtaacataaaacatctgcacatgcatctaaataagcatgtttctgtgcaacgagcatccattttccattcatgtgccatcacatgtgcccccttaagtttaactcccaaagaactaaatttcatacgctaagaatataaagatttacctgtgtactccccagatttttcgtagtcttgaatgaagtgattaatcactggggtgggtatgacgtagcctatgttttctacatcttcgtgtttaagagattgaaaagctatgcccacacacttgcccttatcattaaaagcagggcccccagagtttcctgaatttatagctgcatctatctgttccatgaaacagtgaaaacttaagtatgctcccaggttaagagattattagaaataattccaaagagaagtaaaaactatgtctacaatatgcaaaatatagacaatcaaaagcatgcaaagatcttaagagaaaaacctgcaatcctagaagctccgttgaaccatgaacatatgaaagtatctctattctagatacaacaccacttgtgactgagatcgtgtctcctccaattgggtaaccaacaacagtcacagcatcttgaagtgcaggcaaagatccaaactctaggggtgaaacccctttccagaattcatcatcctctacagttaacattgctgaaatggaaaggttatattaattatcaaataacataagaaagctaacttcttgaattattaaacaataaattgacaggcaaatctttgcaatttaataataaattgcttgaataatacaatttgactcctgcccttgaatttttttaggtcagggcaacttccaaacgatcgacccagtacctccaaaataataacccacataggcaggttcctgataacattagaccaagaataatagaatattgttcacttgtaatcaccatcaagcgctcaaattagcactagcttttggatttcttttgcacaagtactataacaatttcacaactgtgcatttatgtgcaacgaagcaaccgtaaagccttaaataaacaagaaagggcacatgagatttagttgctatccctaaagttatgtggcattactttagctactccttatcattccctatcctgttaaaaatatcacaaggcattctacacaagcttgatacgcactctgtccaatctagattgccacctattatcacactactccatgtgatgaccaaatctgttgaaatggtatcatcgaactcaaacctttgtgattagagtgaacataaataaaaagattacaatgctaaacctgactaatctggatttctggtatgccaacgtgaagatttgtaaaacaaccgaacatacaaaatctgcaatagtaaatagcaagtgtttctagctattttatgagcagtgcacatctgcagttttcaatctgtttcacaggacattgccattttaccaaacattgcaaggattccgattgccaaaaactagtccatagtcctagtaaagtcgcacgagtgtgggctatacataccaatgtcacactcggtgccaatagcgagaacggtggcaaggtatttggtatccgatcccctcttcttaagcttgacctgggtgtagtgctcgacggagtgagcgttggtaagcaccctgtgcccaccaatgatgaacccgctgctgctggagctatattgccgcttgcgctgccacggcagcgagaagttgggctccgtgtgcacgcagaacaccttcaccacggcgtccatcgacggcatcaccttcgccacctgctcccaccgcaacggctccaccacggggacctccgccgccgcct

SEQ ID NO: 38998 - DNA, 3229 bp, Oryza sativa
  unsure (1)..(3229): unsure at all n locations
atatgtggctgacatatgggttctagtgacacgtaagcgtcaccatggcatgccacgtcagcacacagagtgggttggaatccgttggacctatatgacacccgagacaagttaagggacccaaaaattcatttcaaaagtttagggacatagttgacatatccacacaagaccggccatacattttactcttttgaacgatggaattgtgaaaaattctcacggtttggtttggtctgtctcgtgtgtgtgatcactgatcacctccacatggcaaattctcctcgcagtaatcagaattcgtcactgggccaagccagagcccagtttgcggcccatcatcccggtaatgggctgaattcgtaattgggccgaacagatcgctggcacctctccacattttctcgtcgtatctttctctgttctctccaactctctttgatcttccggtgatttcgcatttcctcgccgccggcgtttgattccgacgaactgatcatatccgccgccgccgccgccgccgccgccgctgacgccgacacggactcacgccgtcggagcgaaagaaccgccgcgattgccggtggggttccgctgctcccgcgacagaatttgggttcagggatcaaccacagccatgtctagtcttacccaatccaaatcttgcagatgggatactccgacgatgttcaggtgatctcccgcccgacgtggatcattttcctttctcccctctcgcccgtacccttgtcccttgcagttgtaagcaacaaaatgttttggtcaaatcatctgtagattggttgtgttgtgtctgtgtgtatgtgtgtgtgtttcaaccaagtgttgatcaaatcagctgcagggagtatgtttgtgactagaagcacggtccacattccctgtcacccaagttcctttcattcagcattggtgccttgttcatctgaaagatccatttgtgaaattgtgatagtggcgtagactgtagagtgtgacgtagttggaatgggggttttgcaagtgggcagtcttaataactcttagtgcaacctgacgaaaggtgtttttttcggcaatacgcgaaagatttgtgtatcattgcattattaagatggacaaagcagggctgaaaggaaccaaaatctgtattagatgctaagcacctgatggtaggtatttgtatgcaatgcattcccatatgctagttaactctgttaaattttgcacttattgtctttttcggaggatcgagtctgcacgaaccatgtgattcattttctcatcaaagtgtagggttgtatttctccataggattgtaccagaatttcgtggtttactcctgtgtcgtggtctcatggatttaagttttgaactagaatggttcacaattgccttcatgctcttgttagatttgaaacttatagttactataatcatatatatttcaaatctatgtagatatatttccttgccttttgttctactagacagataatataataattattcttgtttagaggactttggaatctgggggtaagatataagagcaattctacggtccttgaggaggtaccatgaggtaccaaaaatttaatgtaaaatttggtacctcatggtacctcacagtacctaagtaccaaatttacaatagaaaaagtggtacctcatgttacctcctcaagaaccgtaaaattgctcaagatataaagcttcatctgtaaacatcatcatcagaggtacattagtacttccgtagaaattctgattgctatccctcatctgataaggcatttaataattactttataatggtagactaaatatattaatgatgttcttatgcctattatctaaatgatcacatcccctttaatttgtccttgacaactcatagctagttgctttgtttgtgtcaatattcattaccctgtatgtgttcatgttggacttcagacttcagagtctagacagtagatagacatgccaacttcctgaaagtgatcccttccaacttttagttgggacaataaacaatatgatactgtcataactgcaatcaagtatatgacatatgtgagagttaaccacttgttttgcttgtggtctgtactctgtacgttaggatgctagctgtaatatctggatttctttcagaatctttctaataacttatctgtccctcatcaggaaaatggcaatgatttagctcctaaatcatgacactctttgtgcatgcgcactagaactgttctcaggtagatataataatttaaatatacaatagtgcatcctagctatcttttatcatttgacaacctcagtttcagtatttctgaataagacacagatacacataggcatgacctttatattgtcagatttggatctgaagcatgacggccatcatacttattcatgatgcaattactcttaatttaaaaatactttataagcacgaagcaactactatatagaagaaaataaagtacttgtcaccaagaacttatatgagaatatttcagttacagctaggaagtgataacgctaaataactgcaaacattgtaagaagtcatatgtgggtttgtatagatttatgttccttagatttatgctgttattgagcactgcaacacatttgggcctcttctggaactcccttgtagttggttaaccacatgcatgttttgcagtcaagcaaacatgcttgatgcttcagtttcttccacaagtaagagtcttatatgacccatagtattgatcactatctcaagtaacttgctgaaactgaggtgcgtgcatagaaagtaatggttagcaacattgtcagcaccttcttggtctcccactctcactattggtttttggttgaatgtgcatctccaaatacaaaatactagtgtaatacacttaccaaaccccaccagaaaagtccctgttagtggctcatcataggaaagatttggataactagatttccagctcattctgcaacagcaaaacacgcattgcacgaaggtgaaaaaagcctatgncgccctaggtttcacaagtgcatgtgggtgtagctctgagactgtgcatgaacaccagcctatcccacttgagtcctccttcctgagctcgctggtcgccactgatcccaaataattgcaccgagagcaagctaacaccatgtttagatcccaattttttcttcaaacttccaactttttccatcacat

SEQ ID NO: 38999 - DNA, 1216 bp, Oryza sativa
ttgggcacgacagccgggtggcgccatggccttgacgcggtggctcgcgcgcggccatagctagcgcgtacgacgaggacgacgacgtcgtacggcgtcgaacaggtgggagtggtgacttcagatagtttgtactacatgtagagaggagatggatggagtgtaacctggaaagcacagcattattgcttaatcgaacataaaggggattaacatctgaagtagagaggaagtgattaaactggctgattgaagtacagtaacgatttcgagtggccaaagtatccctaatatttgtgtcaaatctaatccactggtttgtgtgaagcaataatcatatcattatctatcatccatctttctatttttttcggttgtatactaaaattccactaaacggaacactcttaactcacagtgtgtcacctctaatagattagaaaaaagattagaaattaaatgagaaaaaaacaaaatatatagctcatgatttttcacttaaattgatgatacgttattttagactatcagattttattttaaaaataatctctcccttatcttcagtacgtatgattacaaaagaaaaatacacgcgtactgtttgcctgaaaaagagagaaagaaatgcaaaagaaaagccactttcattctaaaatataatcattttctcttgtttcttaaaatatatgttgacggagggatgtccatatgcattcaaaaaaacatgcagaaatgataatcttataaaagagagattacatatgaacggttgaaaatggttcattaaacattctctgaagcattttaagtcgccacgtgtcacattaaatgaattaaaataaaagattaaaattctattagatgtaaaatttttagctctaggttttcacctaaaatcagtgaaaccattattttggaccattatatcattttaaaaagtctcctgatctcatgtatgtgtacttacgagatatctcatgtacgtgacttactggagaaaagtgcagtgcgtatatgtactattcgcgagaggaaaaaaaagagagagaagccttaaaaaatacgtataaatattttttaaaaaaatagtagaaatgcttatattttaaattggagggagcacatatgaatatatatacacatgtaagctaatatatagtctataaatatatatacatatatacggtatgataaaatgtctatcaaatatcct

SEQ ID NO: 39000 - DNA, 1000 bp, Oryza sativa
tcgcctcgtcaatggccatgtgatcttggcccagcacctcctccttttcctcctattcatctgctaccagcacatcctcctataccgatttgttggcttgtcgcacttcccctactaccacctctttcgccgctacgtcggagcatgtcttgtgcatatggcaaggagcaagaagtcgtggcgcaggccttcttgttgctgctcacagcggtggacttggtgctgctcggtcctccaatcctcgttgaagtcagcacaggcctggatctccatcccggctcagcatggccaaatccggcttctctagcggcgatgctgagagaggactcagaggaagaggaggcgggcgcgagcgcacgtcggcgagagtgagggggacgggaggggattcagcagcggtggccgacggcgacgggaatcgccatcgcggagtagccgggaagggaggtggctcattatatgaggggcgcaagggtttggagagactgcgcgagtgcgaggtagggacgcagggtgtgggccggtgtggcccgatccaagccgtttcgcaagtggaccggttcgcaagtgtaaccggtgcatttaaaaaaaaaggaataagttcaccggagattactcaagttaccagcaagatttttttaagtcctttaaccataaaatcagaaatcttcacccctaaactatacaaaacggtctaatttaggtcccatgatagtatatatgcctggtttcgctgatgtggcatcatagttagcaaaaataataaaataaaaatgcggggcccacatgtcagtgagagaaaataatttgggccccgcttctccattttcctttatttttctcttctcttctcaacttctcacgcgcaggcgggcagatgcgggtgtgcggccgacggcggagcgggcgcggcggcgagcgcagcgggcgctgcggcgcgcggggaagaagcgggagagggggagtggaggcggccggcgccagataaggggagagagtc

SEQ ID NO: 39001 - DNA, 8810 bp, Oryza sativa
gccgtggcatcatattaatttcgtgcaatggctggtaataggatgccatgtcctcgtcctaggtgaaacaaccacatcatctcgcgggtaaatctatacatcgatagtgtagtactacacaaccaaaatatatgtactcaagtgccaagtgtcaaagtgcgtgtgattttctgcaacttggaccacaaaacatgtagttttgtgaaatttactcttcattctttatttctgttgtttcatcttccctcttccctctgggatcatatatataatcgtaaattttagaaaaccacatatactatggtccaaattacataaaatcatagaaattttggcttgtgacacataacctaggtattatgatactaaagtttcacaaaccacaatattaatcattttaaatttgatctaatacatatttgagttgtacaatcacatctcaaatttatgacaaattatccatcgtattaatgttacatctattttataaaattttgatatagaaatatgtcaaaatagttaatgatatggttttatgaaactttaggaccataattccctgagttatgtgtcacatgtcaaaattcctatggttttatgtaactagaaaaaaaatgcccgtgcgttgcaacgggtgaagtctattttaattttattattgttatatggtttagtaaagataaaattcactgtggaagttcgcttggatatatatttttagaaaatcatgagctgtagttaggagttcgatcgtctcaagttagtatgcgagttttttaaaacagatttcttatatgatttcttctgtatttgccaaaagtgaacgatcttaaaaaccgactcaaatacggatatgtatttccaaaagcaaacgaatttaaaaaccgactcatacacggatgacgtaccaaaataccggcaaaaatatctttgatttttataatagtagagatttgaatcatattaggtggggttttatgaaatttagtgctatttttcttataaccctaagttgtctgccttacataaacttgcattcagttacagcactgtttatatcttttgattcgctctagtggaatgaatagaccagtactgcaatatattataaattataaacaaggggttagggtggcatatcacaaattttgcaaaatttgtgtggcttggttcaaattgtccctataaacaaccacagcttcgatctcggtttggttttaactgtgaggattatgcttgaattttgtttacttttttgtctagagtttgattaattactgaagccgctgcccatcacctaaaagaattacagaaacctgaattttcatcacctaaaagaattacagaaacctgaatttattggagtatgtggagtttgattgcaatcataaatctgttcttgttgcatcgcgcaggcacttttgctaggccacttaaaatttattatttcctttttgtcatgcacatgtttttgttttctgaaattgcttagctcctcggtacattattccgttcgatacggccctgtgacatcggatgtttgacgctaatttagagtattaaacatagataattacaaaacacattccataaccttgagctaattcgtagcctaattaatccatgattagcctatgtgatgctacagtaaacatttgctaattatggattaattaggcttaaaaaattcgtctcgcggattagctctcatttatgaaattagttttttactagtttatatttaatactttaaattagtgtctatacatccgatgtgacaggagggccactcacttgttgtcagttgtcacctcagagaatcaccaaacggcaaaacgtagggacgaatctccttcggtgagtctgcacacacatcttcgccacttcgcgatgtcaggcgtggggcgggcccaggattttcaacttgggtattcgaaattggaagagatatttttttccaacacaaagtctaatagttgtataatatataatggtataagcatgatgcgtgtctttcataggaagggagctgactcccgctcccttccgtccatcagggatttattcaaaacctgaaatcgagttgagttgaatggggttcaagtcaactagatgaaatgtttcttcgtagtgagcgaacgagttgtaaagtcatagattcatagaattgaccataaattaaatatgttaagcatattttaaagtacagtactaaagtattaattgacaaaacatgtcaaatttataaagcatagaaaatggaaaaatgataagaaatcttacaatttagagagacttttcgtttcttgatattttgaaaataagtgacgatgtctttatccttcactttcctcttcatgtttcaaacctacaaaacaacactacggtcttctaatttaagtattaaccatgctaactctgctaaatatgtgcactaactctgctacaaagcctcacaaatcagtgaatcacaagtttcaaagttcaattgttcatccataaaccatgaaccatccctgtatggctggattcaaatcctaaataaaatgaaccatcctggattcaactaggaactataaatccgaaactcctaaatcctattcgaacctaattaccaaaatgttcctaaccagttttaccttcatctgggtccagccgtctgggcgtttggcgcggtggagtggtggagaggacagaggaggccggagcacggagcgcggctgcgtgggcacttgggcgccacagcccacaggggcggcggcgcgtgggcgccataggggatgggcggatggcgcccttcgcggcaggcggcagcccgggggcgcgggcgtggccactgggtagccgtggagctgcagcagcttggcagccagctgggcgccgccgccatcggggttgggaggcgatgctgcgaccccgacgcgcctccgctagtccgctgtcgctgtgcccgtgcgccgtcgggagtcgggaatcagggtcgggaggccgccagggagaagatcgaatgggaaggagaggttagggtttcattattcccttttgctgatatgggctattgggccaatgggccgaccagccgaggagaggacggaggtgggatgggatggtgctaagtcgggcttctctgaagaaacaagtctattttacatattttttttcatatacatatgaaatatatattacatatatgaatttttttttgtcaaaaattttgggtattcaactgaatacccatgaatcatggtggacccgccctccgcgtggcatgctggcgggtgatagacaaagccgatgatggcgcgcgacgacacccagtcatgttaaataaagcagccggatggagtagggtattacacctctggctgaacctgtattgtattcagctgatctagagaagacaactacaccaacacgaaacacacaagtagggtattacacctctagctaaacctatataattcccgatctagggaagacaactaaaccattacaaaacacaggagtaggatattgcatctttggatgaacctgtattgtatttagctgatctagggaagaaaactacaccaacgcaaaacacaggactaggcattacacctccggctgaacctatataattccttatctagggaagacaactaaaccaatacaaaacacacaggagtacaatattatacctctggctgaacctgtattgtattcaactgatctagggaagacaactacaccaacataaaacacaggagtagggtattacacctttggctgaacctgcataattcctgtgtctccctagtcggagctcgggtcccgcagatccgatcttgctttgatctctttctacgtcatgcactaatctagggaagacaacaaaacacaggagtagggtcccgccgtgcactgatctagggaatacaacaaaacacaggagtacactgatctagggaagacaacaaaacacatttctacgccgtgcactgatgtagggaagacaacaaaacactaacacatttctaagccgtgcactgatctagggaagacaacaaaacactggatcttgctttgatctctttctacgccgtgcaatgatcttctctttctacgtcgtgtactgatctagggaagacaacaaaacacaggagtagggtcttgcagatccgatcttgctttgatctctttctacgccgtgcactgatctagggaagacaacaaaacacaggatcttgctttgatccctttctacgccgtgcactgatcttctctttctacgtcgtgcactgatctacgccatgcactgatcttgggaagacaacaaaacataggagtagggtcccgcagatccgatcttgctttgatctctttctacgccatgcactgttctagggaagacaacgaaacacagaatcttgctttgatctctttctacgctgtgcactgatctagggaagacaacaaaacctgatttagggaagacaacaaaacacaagggaagacaacaaaacctgatttagggaagacaacaaaacacaggagtagggtcccgcagatccaatcttgctttgatattttgatctctttatttctacgccgtgcactgaccttgggaagacaacaaaaacataggcgtgcaagcagatccgatcttgctttgatgcactgatctactttgttatctttctacgccgtacacgccgtgcaagcagatccgatcttgctttgatgcactgatctagggatctgatattgctttgatgcactgatctagctgatctagggaaaacaacaaaaacatcttgctttgatgcactgatctaggcccgttgtccgagcaatcgctcgctcgacagcatggttccaaactttatcagtgttagtagcctctggcaaacctcctatttaatctagtgctgcccaagctagataagtgaggtggtattattcgtgctacaatgctcggttgctacatgtcgcgcagtactgtgctgggttgctactcctctgctccgtgggctggctgctgggctatgtttgtttttttgttgggccggtctgcttctgctttggccgagctacttgccagcttcctctttttatttgcagagcgttaggatgtgtttggataatggaaaatagggggtgagattgggattgggaaatgaatgaagggttaggattaaatggaaaagggagaatgaatggttaagatttaaagatgggtgggaaatcatttccctttcccatttgccaaacactcccttagagatcgctgtcacgtgtctggactcgcggattagagcaagtacaatagcaggctataagccagctgcaaatatattttaagtagataaatgagaagagagaagggcagcgagctacagatttgtagctagctgtagtacggactccaagacgcagtgtgtgtatgacaagtgggaccagatattaatagtgtagtatataactattgtataaatgagctgttagattggctataaatgaattagagctagtagttagctatactattaaacttgctcttagtggtgaaatatcgcgtgggcccatgttttaatgacggatgaaaaattagcttattttttaattaaaaaagtaggtataggtataggtgtaggtatagattaagataagataagattaaaataagattttacattagctgattagcagggcttttgccttgatatttgtactgcccaatgacgacttgacgagcggggcaacggggaacatgggccagcgagtcggagtacgactcctgttcgcaaccccgaggggggcaccgacttctgggcttctggcgttcacgcggaatgctggaagtggaaaccgactcgggctcgtaccggtcatccttctctataaatctggggttcgtgccgcctcgtcgacaatcgcccatccaaatccagcgcaacgcaacgatcagacgagacgagaagagaagatagaccggcccttcatcagtcaaaagagttagagagatggtggcggcgatgatgatctcgccggaggacgttccatacgaggaggacgtcctgcgcgaaccgttccggctacggtgctggacgcgctacctgtcggccatccgctcggcgccgctggcgaagcgctcggtcatctacgagcgcgctctgcgggctctcccgggctcctacaagctgtggcacgcgtacctcacggagctcgccgacgccgcgcgcgccatgcccgtcgcccaccgcgcccacgccgccctcaactccgccttcgagcgctcgctcgccgcgggcatgtcgcggatgccgcgcgtgtggcacatgtacttctcggctctcctcgaccagcgcctcctcacccgcgctcgccgagccctcgaccgcgcgctccgctcgctgcccgtcacgcagcaccaccgcatgtggccgctcctcctccgcctcgcctccctccccggctgccccgttcccaccgccatccgcgtcctccgccgccacctccaattcgaccccgcccacgccgagcacttcatcgccttccttgtctccgctggccgatggcgagaagccgctgatcacctcgccgcggccgtcaacgatgactgcttcgtctcggccaagggcaggaccaagcgccagctcctgctcgatctgtgccacctgctcgcgcagcacccggaggaggtcgccgggctaccggtcgacgccatactccgcggcagcgtacgcaggttccccgacgaggccggcgcgctgtggacgtgtttggccggccactacgcgcgggtgggtctccacggcaaggcaagggacgtgttcgaggagggcgtcgccacggcgaccaccgtcaaggacttccggttggtgttcgaggcgtacctgcacttcgagaacgccatgattgacgtggagctcggggagcacggcgacgcagaggagaacactctcggtcaaggctgctggctggccgaccgcgacgacggcgacatggcgctcgcgaggctcgagcggcttctggaacgccggccggagctgctcaaccgcgtgcagctcaggcagaacccgcacgacgtgcaggcgtggcacgcgagggccaagctgttcgacgaggaccccgcgaggaaagtagccacctacgtcgaggccgtcaagaccgtcgacccggcgaaggcgacggggaagccgccgccgcacacgctctggctcgcgttcgccaagatgtacgaggaccgcggcctcctcgacagcgcgcgggaggtgttgcggagagccacgcaggcgagcttcaaggcggcggaccacctcgccgccgtttggtgcgagtgggcggagatggagctgagacagcacaatgccaacagggccatcgagctcattcggcaggcgacgtcagagccgtcgctcgaggtcaggaggcaggtcgccgccggcgtcggcgagaccgtcgtccaaacaaagctgcatcggtctctcaagctgtggtgcttctacgccgacctgatggagacgcacgggtcgccggaatccacctgcgccgtgtacgataggatgcacgagctagggatcatcacgccgctgctggtgctccgccatgcttccctcctccaagagcacaagcgattcgaggacgcgttccgtgtctacgagcgcggcgtcaggacgttcaagtacccgcacgacgaggcaatatgggcggcgtacctgacaaagttcgtcgagaggcacggcgcgagcaagccgcagcgggtgagggacctgttcgacgacgccgtccggcatgcgccggcggagaagaaggcggccgtgtacatgcagtacgcgaggttcgaggaggacttcggcctcgccaagcgtgtcctgaaggtgtacgaggaggccgcggccgccgtccccggcggcgacaagctcgccgtctacgaggcgtacgtcgcacgggccaccgcgctgttcggcgtactcaaggcgagggagatataccaccaggccatcctccacggcggcggcctcccggacgcggacgccagggtgctctgcctccagttcgccgacctcgagattggcctcggcgaagcccaccgtgcacgggcgctgtacgtctacgcctccggcttcaccgacccgacggctcaccccgacttctggaggcggtggaacgacttcgaggtgcgtcacggcgacgagtgcacgttccgggagatgctccgcgtcaagagaaccgtggcggccgccaacgccggagccggcgccgtggcgcagctggccgagcaggtcctcgccgacgacgccatggaacagatggacgcggcggtggcggcgccgaagaggcctctgcttgcgtgtgccgctcagcaagccgatcatgccagcggcttcgacgaggaatgcaagagaaggcgtctagtatatgtataggggctacggactttgcaaattgtaatatatgtattgtgcttacttattatattgtattctaaaattttttgagcaatcggtcatcagctagagctcctctgttactaagttttcttatgagatctaccaagttcgaacaaattaaacatttttatttttgaaaattttcttcggtttaatgcccacacacgtttatttgcagaattttttttattttttattttttttattaaaagttttacaaaaataattttccattttgaaaattgacggaagtactcgcctaccgccctctgggaaggcgatttttaaaaatcgccctcccagagggcggcgaaaatgacgtggcagacggccgttcgctctcgggcgacggccgtcaacgaaatttgcaggcgg

SEQ ID NO: 39002 - DNA, 1893 bp, Oryza sativa
cgggtgagggggcgggcggcggcttcggcttccggccagggcggcggccgggcttgcgcttgggggaggaggtggaggcgagctcgtggttgtccatggcgacgagctagggtttcatgaaggtgggagaagccaatgcccgaaagggttggggttggctcggtcggtatttcttaggtgcgggtcgggtcgggttcgagccacaaggtcggttccaaaggagaaattggacatcctctgccatcgtaaaaagagggtttcctcatattcaccatttttcacgttttttaccattttctacgtttgatttgaccaaaatactctgagctcgggttcgatgggtgtggcgtggcattggtggggacggcatcggccgttgcggcgggggaaggggggaggggctcaggttgctcaccgcccaataggctgtcagcgataaccacgtggaggaggatggaggataccggcgttgatccactgtgctccagcttgctgatagatcaatcgatgaagcccgccggtaagaggagcaacgacgggggcagcggtggaatggcattgctcgatggcgatgtcacttgctttgatgtcaagtccttcgccacctccctcgcgctactcaccctcgtcatggagctctgacagctccacccctaccaactccttatcctcctctccgccgccagctcaacctcctcctcctccattcccccctccaccccgcttacccaccatcattgcttccgtttcttccctctccaccgccgccatgcccgctgctaactattttggtcaagccaattgcggaaaaatggtaaaatcatgtgaaaatggcgagtatggcaaagtagcggtttggcatcggttgggagtggctttttaacgaatccaatctacggagtggcatttgagcgaaaccatcttttggtagtggcagaatgtataatttctcgttccaaagtggtggcgtgtctgtgctttgcctgcacaactttgtgttacattcttttctgtgaactttttatgtaacgagagaatccacttcatggattgttctagttcaaagatttttcattgatattgtcaatttctataatataccaacgagtttatcatttattctataatacagtgttaggctgcttttttttccagaaataccaaaaggttaccaatttatttaccccattattttaaaaaaaatatgaaattttttatgtaaccttcttgcacaatatggtttttttatctaagtttcaagtttttatattttaaagcaaaatatttttctatggtatatgagagtgaattgcttacccaaaagataaataacacaaaaatattgtgtgacatataaaagataatttacattaaaaacaagaacaaaaaaatattttatgtagcatataatgaataaattatttttttagttgcaattgaaaattctaaaacttatacacaaactttcacattttgttaagaggctaaataaactcgccggtatattatagaaaagagcaatacaaatatcacatcattaaattgggataaattatatttatcaggtgctcagtttcctttattctgcaccatgctaaagatttgttcaaatttcatccgtgttcagaattcaaaaacttttcatggtagcaaaaacacttgagaacatcagattgtcaccagttttcaagtccttataaagaacagtctcatcgtcttccagccggtgcatgttttctgaggagtgaagtgcacggatggtccctaaacttgtatgggtgtgtcaactaggtccctgaactattaaaatgaatttttgggtccctcaacttgtctcgggtgttatataggttcaacgggctccaatacactccgtgagatgacgtgcatgcc

SEQ ID NO: 39003 - DNA, 752 bp, Oryza sativa
gctgtggttagctttgatgagctaccagaaacttctccagaagagctggatgcaaagctctctgttgttataccagcttgtttgcgagccagttccaattgaattctctgaaatgcctctagagatgaagacaatatctcttgcctgtgtggtgaacttgtcatccttctgacctgcatatatgatttaatcaaaaagggttttgttaactcttttagcactgtgagatactccccaagttgatttctagcattcaaaatttgtctaaaaaagggttgatttctaaccatccttggtccagaaatcgagaagtattaatgagtcttatctcttcaataccccttactacattcctattaatgaggggcacgtctttttccctactaatctgtcttggaattgctagtagaaatcaactcttttggagacgtagtagatttgcattccatgaaaagtgttttgtggcaattaaccaggttattttaacaactattaattcaataaagggtccaagtccagaaactcgtcatgatatatgtaatcgttcaattcttgataagtacataggcttgtggacagagaataatatgtgcacactatgagttgttcaatgatcataaaactacgctaaaacttggagcaattgaaatgaaattctgcatacaagtcatgtaagaaaatatttcataattttgcgtattatgagaatacggacctcccaagacaggcatgtggtcttcgatggtcagctt

SEQ ID NO: 39004 - DNA, 1397 bp, Oryza sativa
tagtgtacgtttgaagtagtgaagaattttagctgggacatgttccacgctcaatgggcagaaataaaggcctcagcccaatgacatgtcggcccacttgcgatgatgatatctggcggactggcgcacatacttcgttcttttcacgtgggctaaatttccttaaagatataggctgaattaacgcccactgggccggaatttccatacttaaaagccgaattttcgcacatttctcggcctcaaatatggtccaacccgccgaacgtttgggcttaatttacgcggatctttgggccgcattcgcgtgcacagttgagagctgagatcgctcacacttttgggctgaatttagaagaacgtagggctgaattcaggctaagctttggaccaaattcacgaccatctgtggcctgtgggctcaactcacgcgcatttcacgaccgcattttggtacggattgacaccctacttttgggccgaaaaagtgtatttctggcagagaatataccttaagtttaagggaaaaagtccactttacattcctaataacataatggttgagtttgcaatcatgttgctcaaccgtaaaacaacggatacaacgtaaccctcatcttttaaaaccagtacaaatgtattctcaactcctaatataatattgagatcggttttgattgccgtggcataagtttgaaacatagtttacatgtacataactttgtaatacaaatggaacttaatatcatcagacttgtatctcaaatctcaagttagttgttcatatttgccttgcatgcacgcacacgctagtactccggtttatcgtcaccgcctcttgctgatcagtagctgcagcaagatctcgttgaacgtgtccaccggcccaggcaggcagaagtggaggcagtccacctgcagccgcttcggcacgccgcgcgcgaacgggtcgcggtgcatgtacacccccgggtgcccgtccggccgcatcgtcgccagcttcgtcacgtcgagcacctccaccctgctctcgccgccgccagcggcggcgccacggcgagcggcggcggcggccacctcctccatggcgatgctccggagctccctctcgtcggcgtccacctccttctccccgtcgtcgtacggccgcgtcctcgcgcacgtcgtggggtcgtcccacgccttctcgaagtgcgacggcgagaacgtggccaccaccacggtgcgggcgcgggtgcggttgccggcgccggagctgacgagccgctccagcgccatccgcagagtcctcctgtacggcgcgaagaggccgatgtcgccggtgttcttgagcccggtgacgttgtgcatgccaaccacctcgcccgtggcggcgtcgtggtagacgggggggatcc

SEQ ID NO: 39005 - DNA, 4553 bp, Oryza sativa
aaatcggtgaacctttttttaaaccattaaattataaatctattataaaagataatccctcctttccagtacgtggacgtacaacagaaaaacacgtacgtacgtactattcacaaaagaaaaaaaaactaagtaggaaaaaacatattcccaccgttagttgtaggctaataattaatttactaaacatgaattttagaggaatccactagacccctttaatactactttatcatttattcttaatcatcaaattaaacgagcagtactcgcttcttctcctcgatattttctctccatattaatggagggcatgataatattttaacatctggctaatctctctttacgtacctagctaaaactcttagagatagatgaactacataagatacaaacgtaacataaaaaaagaaagcccattgaacatcttgtggaacgcttttaaatcaccagcttttaaatcaccatgtgtcacctctaatcaactaaaatacatagaaactctatgagaaaagtaaacattttattctcaaatttctcttaaattagtagactcataaatgttagggctaataatcctcaaatttgatccatcggcctctcctctgggtccttttactacccatcatttctacggtagttgactgtttaaaacaagaaaaactattgcggcagtttgaagtggagatgacttttttattatattaattatgtattagacttattttggtggtataatgtgcaatgtcacttttttataaagtaccaatctttaaagatcatgatacttcttccatccttattttatcatcacctaataactttaatgtcggtcgtccccatattaatgtctaaggttgtgtttggccactcctttttccaacttctactctcttatttttcacacactgttaaacagtgtgtcttttgcaagagttctatatctaggaaaattacttttaagaaaaatgtattaatccatttttcaaacttattttagttaataattaattaattatgtactaacaaatcactccttttacatgtgatgaggtggagttctcaacctctaccttcgagcacaacctaagaacgtttgtcgtttgcatatactccaatgatggagcggagaggcacaacgctggagctggccggtggggctggcgttagtgacacgggcacacaacgttgtacactaatttgtaaattgtaagtagcgaattcggtatgaacatggacaagcagtactcaacggaaacaaatcctcggacttgatgttctctaattttaagtgactgatcagcatgttagaggagcttcttccgtactcaacatggagccttctagttctcattagtcaatgcaaactttataaaagtcaatgcaatgacgaaatttatcttccttaaaatgcttatgaggtgtgatattctttactctgagcgcattggcaagatcttaagtggtcgtgcactctctcaaaggcacaactttaatggatttcatgtgtatttcttgttctttagccaaaatttttaagcaactttatttgtaacaccttctttcctaccataatcgtgtctggctgcacaaatctaatagtggcacatcaagtctcaattggactaactatatcactcgagtaaaaatcacactaagtatggttataatataataatattgtaattatagtgtaatcacattataattatattcatttgatatattttttataacaaaaccaacccatacgatgcgtaaacgatggtctcaggggtgtttgctaggcttctaaacaggcgcgagtttttttttttccaaatctcccaggcaactagaatatcaccaacgacttgagtggtttctttggagtgtttgatgccgaaaggattgttttccacaggtcttggaaaaagaaaaacagtcacatgactgttagtatgtagcaaattcgaatctcaataacttgatttgcccaactcagggtcccacttaaggtccaaccgtataattttgggtcatttggattgtttgatcatcgtataagacttttaagttcctactcaaatggtggcccaatttgtcagcatctgctgaataaacctaatataattgtgccattttgatgaaaagaagtaaaacaagtgggacatcctgaaatttttttttaaagaaaaggcctcacagccctgcttatattgaaagcaaaatgtcgaaacaagtttatggccttacggggatacccattttacatatcaaaggctcaaacacacatctattacagtgagactaacagccaacacacaaaaggccatgagcagaaaaaagtcaccgacaaaagatactatgacaagctaaaacaaggcatatcatcatccaacaccggttctctgagcaccatattatctcttgttgtcacttttaacttctcagtcatcgtctccatcagcaaaagtctcctcagaacgacataggcttttcactgcaacaaaaagaaaatgattggaaaggcaggatcagtggagagtaaaccattttgtctctgaaaaccatgttgttttcggtggtccaaaacaaccatgaaacaagacgtcctgaattaaccttcataggattgaaatcctataagaaatttttctatttggctatttgattcaaagggttggagttttccaaatcctatacaaatcctatggaatagctcattgcacgtagattttggagaaaatttagtaagaggtccaacctcttagaaaaatcctttgagtctatctctcactgcgtgtttcctgcgacccaatcaaacaattattcgtatgtttttcttgtgttttgtaattctctgttttacatttgcatttctataatcatgttttttatttcattcatatgatttaaatgatttaaagagacccttaccataccatgccagcagcccagcacgtcgtggcacacgtacggcagccgacgccatcgttcgtgccgtgaccatgacgcggcgaggcgaggcgagacggcatggctggcctcaccgccgccctagtgtcggaggccggaaatttcccggttcaccgctccggccggcctgcatggtactccctcgccggaagacgagccaattgttctcgacgccatatgcagatatgctgctggctgctggcctgctgctgctatcgagtgggtatcaaagggacagcaaacaacacactcaaaggtcaaagtggccaccactcttgtctaagaagcagagacaatcaaggcacaacttccgccggaggctaagcacagacagatccacggagccgacagcccacttgcgacacaccaaccagattgtatggtagattgactgctaccagggttgacgttaccgtgcggttaccggtcttaccgcggaggtatggtaatataaataccgcggtaatcttcttaaatttaaataaatttaaaaaataatttgaatttttgataaattttacacgattttgtacggttttttacggttaccacgcttaccgtcggggcgcggtaaccccagacccggcggtttgggaaacctgactgctacttgcctgactgctacttgcacaccagatcaggatcaacatgtgaacgcaaagtcctgtacttaatcctgatgctcatatttaggactaattatttattttttaaaatgatagacgatgtacacggctcatgaacgtctgcatttattttcaaatcaagcaagtgatcgagtagcagtgtccacgaaaaatcaaatgcacgatttgttcacacgtgatcgtaagatcaaacgccaccgacgatcccgtaatcccgttgtattgatgacagtagtacagttcagttcagtgggagtagttcagatttaaaatggagcagtttagagcaagtttaatagtatagcacactactaactccaaatcatctataaccaatgtaatagccaattcccatgctgcagctggctacagatctgtagcccgctgctctcctatcttttcatatatctctttaaaatatgtttataacggacttatgtttataacggacttatagcctgctattgtatatgctctaacaattacagctacatcaaaggcgacacccaaaaatcactgagatctaaaccaaaccatttttaccgcggaattcgcactatctactcgtatgatctcgtaaacgagacgaaacgattcatcttatcaacgtcgtcatctggtgatggtctggagcagaatctcgttgaacgtgtcgatggcgccggggaggcaccagtgcacgcagtcgttctgcacccgcgcgccgccgccgccgccggcgaacgggtcgccgcgcatgtacgggcccgggtgcccgtcgggccgcaggttggccagcgtcgtcacgtccagcgccgcgaaccgcaggcccgcgccgccgccgccggccgcggcggcgtcggcggcggcgacctcttccacgacggtcttgcgcatctccgcctccgtgtacccggcctccttctcgccgttcttgtacggccgcgtcttgttgcacgcgccggc

SEQ ID NO: 39006 - DNA, 5187 bp, Oryza sativa
agccagccgaggaacgcctccggcgagaacgccgggaggtcgcaccgccgcggccgccaccgccagtggaggtagccggtgtccggccggccgtgcgccatgcagttctgcccatccttgatcgtggcgcagctcgtcccgttgtagagaggcggccgcgcgtccggcacccactcgccgtcggagtagtcgcacgccgccgccgccgccacttctccggctgctcggatccaacacaagatgcaaagattagcccaaaaggatgcccttccctcccccaattaaatccccaagaactcaaatctgttcatacatgctaaaatctgcacaagaaacatcacaaatctaatgcccagaatccgataatccaaaaacatcaagaaatggagaaaaccaatcggggcagacaaatctcatcatggaaaaaaaaatcctaggtactcgaaatcgacaagagatcccaatatctcacctatcgcattcttcttgaacccttcatctccttggtcagaagggggcacaggcagctgcttggcattcaccttgacatgctcgtgatgagacgaggcgatgaccgaagcatcgtctgtcgcctgaaccaccaccaccaccggcttcttggcagtggccacagggttgaagagaaggtaatggaggagggcgagagggatgagagcgtagagggcgtaggtcacaagctgcctcttggggagcaggaagaactggctgttctgaaggtggtggttctgcacgaaattggtggtcaccatggctggctgcaggtacaagctgtgctctgctcagctcaagatgcggaaaccatggcaaagagggatggggagaagaaagggatcaaggaggaagaagggggattggggagtaaaaaagaaaaagaaaaagaaacaatttttatattactaacaggggtttgtctctggatgagcagtgaccaacgtctgttgattctttggagcggctgttggttgggtacaactggtcgcaaatggccacagacaatcagacatgccatgccatcaagcggtgttggttttgatgctcctgtgttctttatcaatggatatctgtaattttttttcttgctgaccagcgcattgtttagaaatggaagttgctaactgctgggtttgagactttgagtatgaaaacacggaaggaacatgattgcaactttagtcctgcctctaactaaccttctttgtgttgttcgctgaaggttataccatcctcccgtaaaaaaatttatatactcctttctattactactagatttgtaactaaaaatattatctaagtttatagtaaaaaatagtcatattttagaaaacctagataaacctattggttaaggtttatcctgcatattttagttctggttaatacttagatattgaagttatgtattacacggttggctatgacagagaagtggaggggatgggctatatcggtgtcaatacttcgtccttgcggaaggggcaaggaagtgcgtatgataaaatttactacctctgtttcaggttataagacttgttagcattgcccatattcatatagatgacacatagattcattaatatctatatgaatatgggcagtgttagaaagttttataacctgaaatagaggaagtacttaacatgtagttttgtgataggaacgccttgagacataggggttttttataatatttattctttattttaaaaatcatgtattttgatgccaagggagtgtatccgattggattgagagcatgtttgagagtacttcaatttcgagatttaacaccaagagttcagtttaaagtggagttgtggagcagcctaaatccagctccatttctccagttcattttgtgagaacacttaaccgtttcatttttttcttttatggtggagctgaaataaatgggctctaactttaggagagatgaagttggagctaagctctaacaaaccgtaagtgagctggaaccggttagctcgtaatcaaatcccaacccaaatcaactttgaggaagtgacactgctcctaatcctcgccgacacgagtagcacttgacctaacatcatcgagcgctcccactgcccgaataggtatactcagcattaggagcaatggagaccgtccgatcaagatcaaatcgtgcactacggtaactatgctacagtactctgtagtgttctacaacgttttcgttacggttgctacactgaattgacactgttcacacgcattgatttattgtgctccccacatgaagagtgcacctttgcattactacggaggttctggattccctaccgccctcacgtcaccgccgccggtcgccggagcaccgtcgccgcgctggaccgcctcgtcttcgtcatccgccacctggaagccagtcaccctcagcctaaaatgaccgaaatgcccctcaccctgacttccccacgcctctctcactctctcccaacccgcagtctccactagcctccctaaaacgaaaaaaaaaggaaaaaaaaagaaaaaaaaaaactgcggcgagccggagacgtggctccccgactcctcgcgcgcgcggccggcggcgagaagggcggcggcggcggcggggaaggccatcctcccctcatgagcggcgtggcctcctcgcgcgcgcgtcgggggagcaggcaggtctggaggggcgacgccgccgacgacatccttccgtctcggttcggatcggattgaaggtattcgtcctcctccgcccactttgcgcgaggcaggcgggcgcggtgtagattgggaattgggatggatgggcagggagaagggagggagcggggcctctcttcttacccccaaatcgtacaaatttgcgccggaaattggtccaaccaacaaccttgttgttgacatgttagcacgagaggaatggaatgttcttgctttttttagttgttcgatccttggttgattgtagtgaatgccagtgacggtgagtggcaggagtcattttggaattttagattggaaattcggagaccagctgcgaagggatccggaacttaagtagccccacgttttagtttgtctacatttcgtccaattcctttgatggttttggatttatttatttattttgtctggatatgcatcgttggcaaaatcttctgcactattttgctatgttttatgttgcagttaagtgtcagggttttagtgaggatttcagtacctatagattatagttgttttcttgaaaaatctgtgatttttttaatccctcagcacactgtacacttaaaaaaatattttagctggtacatttcctggtataattaactgccgtatctgtatgaaaaagcaggaatgcatgaggaaccactgaagatttattggtggtaatggagaatgatcatggagatctagatgatgtgggatcagggtggcttgaagtgaaaaaagtaaggagttctctctgttcaattataatgcatcgaatgattgtggtgttttccccattatatgtgttataaaaccggccccgaaatcacatcggaaaccaaaccgcggaagaaaacaccataggagatccaaatatgatgatgacaccgagacacgatatttgataacggagttcagccgtagcctacatctccggagcactgattacggacgctcctccccaatccagcatattacagcgtatcagagttacaacgactcacgactggtcgctgccggcagccgctccctctcgctatgctaagtcgtcatgcggttacaataggcacgcccctctatttatgagagagcctaggatagagtctgactcttactctagtcctaacacctattacaattccaagtcctaaactggaactgactttgtacatatattcgacacaaactctaacaatatgttcccacaatcgccttattgttaaatgcaaggttaaggccttaaggggtgtgagtttgatccatgcaacaagacagtcatttctagataaacagatgcaatagcttggccgagagtgataataatcaatttaacacctgtttataaatcaaatgttagaagaatactagattgaaccaaacagatgttgtggtaggagtttctgtgttatttatgcatagcaaaagggcatgtattcagtgatatattttggccatattccattctgtccaggatgatagctattaaccagtactatcttgcacacacatagacttacatagcgaaggtataccctgtaaacagctctaagttgcttgaagattattggctctttcagaagcattttttctggatcatcaagttaataccatatttcatcaaacattttatattttttgtttgcattttgctcagagacttggatcatgctctcatttgatgctctattatgccagaagaactcttagtgcttctgttcctaacttattacaaatctattcaacagaaacaccgatccagctcaaaattcacattgcagaggtcttcaggaggttccaatgataataaaatttcaaactcgtcctcacaatctcagaccaactttggcagtgatagtgcaaagtggtgtgacaggttacaatgctcacctcagatcacaaaggttaatgtttgcgttaatgaaccgggtagcgtagtcacaatggttgttcatggtgaagaatgtgctcatgcagatgctagcaatctgaagagtgaattaagtgtttcagcctcggatcatgcaatagaaaaacctaaaaaactgctagtgactgaagaaataagtgaacctcccaacgttggtaagattgactgtgctgattctccaactccacatcaatcctccaactgttcaagtggtcttgcaaaatcttcaggtttttatgatcatgttaaaggccctccaatgacagatagtataggtgttttatcgaacacttctgtcaggtttggtgattttgatgaagtgccaggtctagcattacctgcagatgcatgtagaaataatagttcatctcaaaaacacatacacattggcgatgctacagaattcataaatgaatgtaaagatgaaagtgaacttaaaactgagccgaattcttgtaaaacaattgttgagacatctcctgttattattcaaggggcagaaacgcccactgaagatgagagcaaggtattggatatat

SEQ ID NO: 39007 - DNA, 8008 bp, Oryza sativa
aaggataaggaattgccagaaaacaaatttgacaagctcaggtcaacagatacggcaaaaaggactacagttcatactgagaaggagaaacaaaatgcagcaccacggaagtcattggatgcctggaaagagaaaagaaactgggaagatatactgaaatctcctgttcggagttctcgtgtctcccattcccctggtgttggcagaaaagtaccagagcgtgctcgtgttctacatgacaagttaatgtctcctgaaaagaagaaaagaagtgctttggacatgaaaaaggaagcagaagaaaaacatgcacgagctttacgaatccggagtcaactagaaagtgagagagttcagaggctgcaacgtacctctgaaaagttaaatcgtgtcaatgaatggcaggctgtgcgcagctcaaaactgcgagaagtaatgaatgcacgccaccaacgtagtgaatctcgtcatgaggcataccttgcccaggttgcaaaaagagctggtgatgagagtactaaggtcaatgaggtccgttttattacatcactaaatgaagaaaacaagaaattcttactgaggcagaaacttcatggttctgaaatgcggagagctgaaaagctactggtgatcaaaacaaagcaaaaggaggacattgcaagggaagaagctgtattggaacggagaaaaattcttgaagctgagaagatgcaacgtcttgctgaaatacagcgtaagaaagaagaagctattattagaagagaagaggagcgcaaagcatctagtgctgcacgagaagcgagggctgcagagcagcaacgtagaaaagagataagagcaaaagctcaacaagaagaggctgaactgttagcccaaaaattagcagagaagcttcgtgaaagtgagcagcgccgtaagtattaccttgagcagatacgtgagagagcttcaatggatttcagggatcagccttcaccttttcagcgccgctttccaagtaaagataaccaaaatcgttctagctcagctaatagtggagaagattcacaaataataagcagtgccaacgctgctgagtctggtgttaaatcattcaattccacgcaaatgaaacgaaggattaaaaagatacgccagaggttaatggctcttaagcatgattttgttgaaccactcataggcgaaaatacaggaattgtgcacaggtctgctctaggtactgcaaaagctaagttaagtagatggcttcaggacttgcaaagacttcgtcaagctagaaaagagggtgctgcgagtattggtttgattgttagtgacatgacaaaggtacttcttgtttgttccatattgtgttgtaataaagatgtttactaataccactttctttttattttggcacagtatttagaaggaaaggatcttgaattacatgcatctagacaagttggcttgcttgattttattgcatctgctttacctgcctctcacacttcaaggcctggagcttgtcaagtcactgtctacctactacgactgttgagagtgttgctctcgcttccagccaatcgaacttattttcttgtacaaaatcttttacctccgattattcccatgttatcggtatctctagagaattacataaaggttgcagcatcaaactctggaagttcgaacattcagtcaagcaaaacatcaactgaatacatggagtcagtaggtgaagtgttagatggatttttttggacagtgaccgtaattgttggccacgtatatctcaatgaccaacagcttcaaatgcaaggggggttgatagaactgattgtggcttatcaaataattcatcgcctgcgagatctttttgccctttatgacaggccccaggtggaaggatccccattaccatcatccatactatttggtctcaaccttctggccgtcttaacatctaaacctggaaatttctctaccattgattgggagtcctgcaaatgcagaactctagcgggtaatctagttcaagaatatgaatatctttgttcacaagacataggtatgggcaaccagttgatgatatctgatcaatctggagatgtcaaattgccatctaccaagtctgatctattgaaatgtgatgaatgcgatcctagcgaattgatcaaagaaaataagtccttggatcatcataaattcaacattccaggggacaacatgtcagtttatgaagctagcaaagactcagggtccatgccagaaatgcagtcatctgatacactagaggtacactctgtaattccctgccagggagatgctgcagatggcacccttgaaagaaaaaaggggagtactacatgtttgcatgatagtcctggaaaagacaatgaaataaacctaaatcaacctgtagtgcttgtactttctgctatggcagagacaggccttgttagtctgccttctcttttgacagctgtgttgctccaggccaacaacagatcatcatcagaacaggtttgtctttcttctctatttacatccaatgctttgtgtggaaaaaatgttgtttttatttaagaaaaaagctgcttatgttgcctccaatacttcatagacattatgaaacaccattttaccatattgcaagtgaattatatagaagccacacatgcatttggatatgcataaggttctcagtttcaaaatgacatgctcacatgcatttataaacaagcatggcagatgacattatgcacataaatctgttacttggtgactttcagactttaagaatcacataaggataaaactggaattcttttcacagaccaaatatatatatacttgtttcatggatcttctctttgaagcaaatggcacttcatttttcaggcttcagcaattcttccatcgaattttgaagaggtagccactggcgttttgaaagttctgaacaacatggcatgtttggatatcacccttcttcaatgcatgctggtaagtggtggcatccaactatcgaaggcttggtattgttgttgctgtctgcttgtctgttcttcatgtataacttgatgttgttagatgaatttagcatagcaacaaatgtctccatgttatcaatggacacaatcagtcttccataaaggtttcatgcatagctgtcaggcaaattgatggttttccagtataggaattctgaagatagtttctttctgttctttcacctatataagttttcactcttctcataatttcaggctagatcggatctaaagatggagttcttccatttgatcagtttccttcttagccattgcatgaataaatggagagtgccaaatgatcaggtaaagtgcagactgttccttacagaaaaaatggttcatacattcttgacatgatatatgtgatacttttaaatatcttttttttttgtcgaggtacattgttgccttaagtatcatagtactttaatttcaagtttcagattttaatgtaaatcaattcttctatcactatagcaatactatagcaatagcaagatgcatctcaaacagtttgctattacttggatggacttggttacaatttctttgttatccgtgacattagactaatagagtgggtaccttagaatctagttgatgtgtagattgtcaagaataaatgcatgggctcctgtccttgaacaagaatcttaatgtgtattcagcatttgcacgttcttattggacaaacactttccattatatatgtgattcttataatgtggtctattgacaacttgcacactgatgctcaaagcaatgctttagtatgtggttgaatgatcagctatcacgttcaatgtgcaaaacatgcagggatagttgtggataattctatttaccataagagtttgtgcttcttttttcaggttggtttactgcttctagaatctctgctacttcttggttacttctctttgttccatgctgggaaccaagcagttcttcggtggggaaagagtcccaccatacttcacaaggtaaacaaagttttatataaccatgtttctctcctaacttcagagacctatgggcaaaactgattaagatgaaaaacaggtgtgcgacttgcctttcgttttcttcagtgacccggagttgatgcctatcttggctactgctcttatcgcggtctgttatggttgtgaccagaatagaagtgtagttcagcaagaaataagcacagagatgcttcgttctttgatcaaatcatgcaaaacaccaggactggctgcttcagattccattcttttggatggttggggaaccaacagttccagtgataatacacagatcttattggatacaagaaacccgcaaggtgatatctcaataaggtcgaaccgcaaaagtgcacggccagttttaggaaaaggagtttcaggggtcatcagattgagcagaaataagggccaaagagacggccgaggagcaagaattggtgatgatggacctctgaagcaaagagctggagaaacttcatctaacttcatgttgcatagaaaaatcccagcttctttcttggacaaggctgaagagttcttctgtagtgaaaatgatacagcagcgaatataacaaactgaccagaccacagaacaagctacttaatttggaccttttttatttccttttgagatgatggttcttgagaatatacaactagacaggctaaacttcagctggacggatggtgatgattagggattgactgtataggttttggaaaagacatttgccatttttacaaggcttgctcgaggtaactcggccaaattggtcaaaccctgggagctaatataatatacgtgtcaaaatttatcatgcaaaggattttttttaatagaatgttatttgtgcctcgagttggactggccagcgaaactgcgaaagatgtacagcagaagggtacaataaaagcattatacgtttcctcatgataaaataaataaataaaacagtaaaccgtatagtctatttgtaacttcgtatgagtaaatttcagaaagctataactgttttatcaaaactattgatttacggcaactttagctagttgtttcagaaaactagcaataaatgattttatcaatgaattgcaaaattgttttgttgatatgtttggacctaccagtcaaccacacatgtttatcaatgatttgtaatgggcagcgcccggtgtctgcattataaggggaatgcacacggtcaaccacacatgtagttgcatgcatatacaaaggattaaagctgtaatttacttataaaatggatgaaagctgtaatttacttataaaattatcaaatgaaccacggcaagagattccgttttggcaatgggataacataacgagcaaacaatttttttccatcgatctattcccagcagatcaaattgcttgctcctccatttgatgtgcacgtcgttagtaatctgagtaaaactatttgcgctttagcaatcgtacaccaatcttagaggcggttatgaatctcgacggatgcatggtcagcccaaccacgagggtatttattcttgcaagcaatcgataactagcaagaataagatgaacaagcaactcaatttgcgaattaaagatgtaggattgaatcaacaaaagtatcacaggtgagcttccgcagcgaacaaaccggcgatctaaccaatcacgggattacacggcaaagtagcaaagctaaactttgatgtaaacaaaacccaattgttctttgtggcggctaaaggtataagaagatgagagaacgaccacaggggtgttggagtcatgttctaaccctagtacacgtccctaatggaccaaactcgatacatggcccattagacccaaataagaacttggtagtaaaatgatgattgcggccgctccaacatagatatggacacgaggctagatccatttgaaagtagacttgataagattttcatgaagtagttgcacgcctaaatcggagttcgcatgaagtcgtagcggtcgtcagaatgaagttggctctgtcctgcagtccgaatccagcccgcgtgaatcctctccttttggatcctctctattgttcctgagtaaaacaagagtgcgcgcatctctgtggtataactaagataaacatgaagtaaagaatgaactcaccgatagttgtacttgtacttgtggagacatggatgtattgatggtgttgaattgttgatgtcctcatcactattctactccctttctctcctcaatgaactcccatcttccctgttgtgacttgtgaggtaccaaaccaactaccaaataccgttatacgtaagtaccaagtatcaaggcactacagctaacgtttataccatttccgacatatataatgctgacctaaatattcatttctgtagtagtgttggttgcccagcaagtcacaatcaacggctcctcctctcctcttctactttctttttcttacgtgctcctccttccctgtttgttgttgtggtcgatgggggcaaggagacgagggacgctactgcttagcttgtgcgtgggagttcagccaaacgaaggaaaggaaagtggtcactaaagtatcccgtcctccttcccctagatttttatttattatttatttattctgaactatttgctgttgttatagctttatgcctatgagtattctggtcgggaaaaatacatgtcatacgtgaagatatgacacgttattgccatgtaaatggtactcttcttattgctaatgtgttgtggcccattattatggctgctacagcgtccatcctcgtcggcctcaatatatttttacatttctttactgattataattccatgtaagagtcatatatgatgaataccggaaacataccatgtagctaccatcactactggcaactgatctttgttgggtcatgcaaaatccatattagtcccgatttaaaatcgcaatgtaagttaaaagaccatttttagtctcggttcaaaatatgtcaggcgtcccactatctttattcccggttggtgttaccaaccggaactaaagatcgatgcattatatataatccctcgcacttatcctcacctcatcctcacaaactcctcctcatctgtaactccctttcctcctcctctctctctctctctcatctctatcttatcctctatcgatcttatccttaggctcctctctatatctcatctctccattttttttcgcaacagagaggagcagcgttgggcggtggcggcggccagcgcagcaccgggcaagggcggcctgcgcgcgtcgggcggcggcggcggctaacacgacgccggacgaggagcagcaccgggcggcggccggcgcgacaatgacttgattaatgtgtatttgtttttttatgtgaatttgttcataccgtgggtctaatgaatttgttatgtcaatttgagtatgttcattcgatctatgaatttgtcgatgattttgtgatgttttgtgaatggggatgattttgtcgttgagtttggtttgaaattaatataagtagcaaaaaaaataattaaaaataaaacaaaaaaaaatactaaagatgagagcgtcagccacgtggcactctgatctttagtgttggttcgtattacgaagattcatctttagtctcgattatttcaaccgggactatatgcccatctttagtacctgattcggggtcccggttgcacaactgggacaacagggggttacgaaccgtgagtgaagacccttttctccagtagtgcatgtaggataaaaccaaccactcaagaggaggcaaaacaaccgatttcaatagctgatggagtttccatgttagtttttacacaatttaaactggagctatatataattgagcattaacctatgtataatggcagtatgtgccggaagggttcgttttttgtggcgcggatcacggctggttgggccaaaacattattatggt

SEQ ID NO: 39008 - DNA, 710 bp, Oryza sativa
acggtgggtacccgacgtcgctgccacggacgccactgtccggccggagcgagagatacctgcaagagcagttcagttccgcgctgcatacgcaaaaacttcagctatatcttcaaataagttcagaaaagtccaactcacacaggggaatcaggtgacacattagcttgcttcttctggccatctagcaatctgcaagaagcagcaatcgatttgaaaggcagatacatgaataatgaattaacgtttgaatttttgattgattatacgaagaagaaagctgccgcgtcgtcggcgtcatcgtcatcggtctcgtcgaaccgcaggtccggcgtgttcccgtccgtcgagaatggcacggcaagcacgcccagctccatgaggtctgtcaagagcggcttgctccggtggaacgactcggtcacgaactccgggagatttgatttcagggtcatcttttgggcacacctctgcctcgccggccctgcaaccgccgccgccgccgatgacatctacgatgaggaggaaagcgagaaagaggaggaactataattttttttatttttagcaaaacactcactgacatgtgcatcttagggttggtttggtttgtggcctaaataggccttaccaaattttgtcaatgccaaattttggcaagttttggcatgactaattttggtaagacaaagttgtgtttggattgaagc

SEQ ID NO: 39009 - DNA, 3450 bp, Oryza sativa
caaaagttggcttcaaactaaatagacactaaacactattgaaattgtcaaatattggtaagcctaatttaggcctcaaaccaaaccaaccttatattttttctgattttaagtgccacgtcaacgccatgtaagcatcatgttagtcgaaaacgccatctaaactgttttaggactggttttgtaagttgaagggcacttcatatatgatattgtagttcagacacgtatttctgactcctaaaaattgagtaacctaaagtgaacttattccgttggctgttgcggtcggcctagaattggctgacgtactgatccagttggaccatatctgcaaataaagaattttttatttataattttttttattaaaagttttacaaaaataattttctattttgaaaattgacggaaggagtcgcctaccgcccttaaaaatcgccctctcagagggcggcgaaaatgacgtggcagacggccgtcgctcggcccccttgccgccctccgctagggcgattttgtactgtgggggggccgcctgcaaatgggcggcgagggggcatggaattttgcaggcgacccccttgccgccctgggggagggcgatttttgcctctccccctataaagcccagtccctcctctgtgaaatttcattatattcactaaaaatccaaaaaaaacaaaagagagagaggggagggcagcagaaggggagcggcgaagccctgctggttcgctcaattcatcacaggtatgctcccatacatcttttgcatttgtactaatatgttatgtttaagtatatatgttgcgttttagttttagttccatatattttagcacatctgtagcacacagcacatatgtgtagatccagagcatagaatataatagtatgaattgagacatagacagtagtgttaattgtaagatgtagtttagtttgatctggagaatgtaacgtaattttagaaatttagagaacaatattgtagagaatgtaacttagggcgtagtacagaaatgcgaggttaacgcagttattgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtgtcagttgtagtgagtcgtgcaacagaaggttatttttgggaactaatgccgatggacagcactgatgcttggagacggtatgtggaaatggcttttgaacggtcatggcccctcgttatatttgtgtcggtacaagagaaagatataaatgtttcaatgcaaaccgaagatgtagagggtcctatcaatgcaggggatgttgttggaccatcgatgcaaaatgaggaaaatcaaccaagggaggagcaggctatgggcatggcggatgagggggagagagtcggtataattgttgatgaaatggagagggaagattcggataatgaggaagtggacgacgacgcatcatccgatgaggaaggtgatgtaatggccactgattgggcaaatgaggacttctctggacttgttatatcagagggtgatcatgtaccctgggagtataaggagaacgaggtaattgagggtgcaagatatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgatcgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccatagctatgcaaggcctggagagccaaacaaaagatcattgagatgaggtatggcacatttgaagcttcttatgataatttgcctcgtttgttagccaccattgcccagaggaataataatacgtactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagaccactagttgaaggtgacgagcctcccatacctcttggtgcattacatgatgacccaccaacaatgagaaggaggtcagggtcgtccatcagaaatttcactcagtggattgagaatgagcctaaggagaagtggtctctattgttcgacaccgatggatctcggtatggcataatgacaaccaatttggcagaggtgtacaactgggtaatgcgaggagttcgggtacttccattggttgctattgttgaattcatccttcacggcacgcaagtgtactttagggatcgatacaagaaaattggtccgtccatggccgatgacaacatagtgtttggcaacgtagtgacaaagtacatggaagataaaatcaaaaaggcacggagacatcgagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcag

SEQ ID NO: 39010 - DNA, 1769 bp, Oryza sativa
agtggatcccccgttgtttttatataggacaactactgaatttgttatttccatcttgcataggctgatgccgcacgggatatcagtgccgatatcaccgcagtccaagtgaggttgaacagaggtttgcacttgactgacgttgagcagagggtgaccttcgaccggatgtaggagaagatgcgtgcggtcatgcgcgtcttctcctgtcgcagcgccgtggacgtcgtacctccagctggtccggtacaactacggcctcgcgcgcctaccgtcggagcaggacctcgacctacggcacctatttcgcacggtactgctcagcccagaggtttcttaagttttgtttctgtttttgtacgaaaacatcaccccgtcgtaacttgatgatccatcctcgcaggacctcgtttgccttcgagcgcccctagcttcggatcagtgcgacctacagcaccggtttcgcacggtacagttcagcccagatattagttcatttttgtttcagcttttgcacgattatgtcaccatgttttaactgcacgtttcctcatcgcaggacctcgtctgccttcgagcgcgttcgcaggcacgaccggcgcttccacgagctccgcaggggcgttcgccacctcttcgagcgcgttcgccagctcttcctctcacggagcgtcgatccctcgcccacacggtactttactttgtattaatactgttaaatacctgtacgaaactgatggtccttgtccagcaggatttgcagccgggatcttcggtactggggcctcttcgtctcacgccggtaggactggtcctactagccagttctacgacgacgacttgcacggtgcagaccaccacgacgtactaggctcctctcagcttggaggagctccagaggcgcacactcaggagcagccagaggtcacacctgtacaggcaggacgggttggccgtgccgtacccccggaccaactcacgtactcccacgggcacattagggcgcagggtaggagggacaggggtaagaggcctcgtcagtagtgttctacctcttcagtccttatgtgactgtttcttttggcttacaaacttgtaaagcagtactacttttgctattactactgcagtactacttgtgtttgtctcgtctacatagttcttttcattcatatggtgctagaacaacttatgctcacgacaacacactttcggcgctgcacggtagtgtcagatccagtagcgcgcacagtctacaacagcacacatgaaaagcggcagctcgagttatcactatcaactttcggcgctgcctgtttacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacacaacacacgaaaatggaagcctattcattgataatacgtaatctagatttgagattatgtagaacattcttcactacaattttacattttggcagcaaaccaaatatgatcaaatgcaattttaccttaccaaatatttggtcgtgaagaaaaatttggcactaacaatccaaatatgccctaaaaattaataaaatatttgtacggtaacaatccaaatatgccctaaaaaataataaaattgtattttaccagtcttggagattttaatcttgtatagttttcaatataaaaagattt

SEQ ID NO: 39011 - DNA, 1426 bp, Oryza sativa
tgcgattctacttagaatttccaattctaattaagcatcgtgatttcgaattctagttcaggattgtgattttaataatcttggtttaatattttttaaatcacactttagtcattttgagtcattttgaaactttctactacgcccgtcccaataaaaatcaatgaccgaatgagacgattattatattttggaatggagggaatatcatttttacatctttttttcctgtgtggcctgtcaaataaatgggaaagtaatttcatcccttgaggggatatcccctcgttttgtgcatgccacctaaatagtcgtaaaaaaatatgaaaaaaaatgacaacatagattaatatgaaatgtatcacttcacaaacatgcaagtttaaattcaacttatacaagttgtaacaaaaataacaaatatagttgtggatgcgcgataactattttcagtttaatttttatttttgttgcaacttgtagaagttgaatttggtcttgcatgtttgtggagtgatatattttggattaatatagtcaattttttaaattttttgataactatttagatgacatgtaaacaacgagaggaaaatccacatcccaaataaataaatactacaactatattactcctctcacaaagtgtaatttgggttgttttctcaaatcctatgcacaaatcccaaacaacagaatatatttgagttgttttcacgtcacgctccgttgacattttttgggtttgagctcttcttcttcgacaatcatttcatttctacatagacctatcagaactcataacacagaacccccctggtaacatcgtcatccactcatcctcaccgattccgacgtacggatcgccgccgccgtcgtagctgcaccggcggcaaatgggagcgtacgacgagccgccactgcgtcaccaccacggcggcgtgcaacccatcagagacatcttcacgtcgctcatctacgtcgcgctctgcttggccctcctctacctcctctgcctcacccctcgcggctcgccggagaacgccgtctcggctctgctccggcacgtcaccattgcttcttccggcgaaggtcgtggtaagctaagcgcccatccatggatgcgcgtgatcgcgtcgtttcagtgtaatcttgagttgatctcgtgtgtttgtgttgttgcaggaggaggaggcggcggcggcgggtgcgactactcggaggggcggtgggtggcggcggcggggcacgcgcggcggtacaacggcacggcgtgcgacgtcaagggcagcgaggactgcgcgcgcaacgggcggccggacacggggtacctggactggcggtggcggccggcgtcgtgcgagctcccggcgttcgacgcggcggcgttcctcgccgcggcgcgcggcaggcacgtcgcgttcgt

SEQ ID NO: 39012 - DNA, 1760 bp, Oryza sativa
gcgaggagcagggtggaggtgctcgacgtgacgaggctgacgacgatgcggccggacgggcacccgggggtgtacatgcaccgcgacccgttcgcgcgcggcgtgccggagcggctgcagagcgactgcctccacttctgcttgcccgggccggtggacacgttcaatgagatcttgctgcagctactgatcaagaagaagcagcagtgaacaacaccggtatcgtacaagtacaagtgacatatgcgttgcgtacttgcgtgcatgcatgcacgcacgcacgacaatataacaacttgacgaatttcctagacattttttatactcttaagggatacaagttggaagctgcatgcgttggtagatactaagagcttctccaatagactatttaaatcagactctccaaacacatatataaccaactttctaattgatttagcaagccaaatttgttgcttacttcaacaaactctgatccatctacgtaccctctttattttgagtctatgacattgagaccccaaatgttagcctctactatactcttcctcatcctctttctccccctcttcctcactacaccacaacaccaaataggaggcacttgatatatcgggataaacaacttttagtagcaagcagtctgtcgggaaagacttttgccaacactttgtctgttaggtgagtccgagtcccccttcctcctcatggtgtcttgctccatttaccctgatgagacttcggtgagttggagccccatatctcccccgtgagttgacaacgtccctttcatcctcgccgacatgccttgcatctcgttccaagcaacgacgaaaagccaacacaccttcctcctcagatccggactacattaggagataatgggacttcttttttggggggagctaatgcaatttagttgacatttgaggagttggtactaaagtttttcaaattttagttgaaagttttatgattttgagttgaaagtttcaaattttgaatcaaaagtttgtgatttcaagttgtaagtttaagatttcgaatcaattgtttttgtgattttgagttaaaaagttgtttgtggttttgagttgaaagttttaagattttggaccataagtttatgattctaatttgaaagttttagactttgaatcttgcgtttttgtgatctgagttgaaagtttaaagtcacaagtggaaggttttggaaattggaagtaaaagttttggtaagattatctttaggaatatagagctaggggtatgcgtcgacacttcaaatgctcttggcatgcacacgctctattcatggaaagggcagcgaaattggtctgacttccctaacgcatgcctgacctatcctgctggtgcataccccctccgtcctaaaaataatacaatcctagctacaaaacatatgcatgtccagatttgtaactagggtttatcattttttggaacggagtagtatgtgcgatctaggcgcctccgaaattgggtaacctgtttttaattgctagtttatttttttagtaaattacagcgatggtatataaacttttgaggtgggtatagtttggtataaaaacatgtaaaacacttgtttcggtggatgcattttgtctggtgcgtgtgaaccttaggccaaatgagcatgccatgccatggttaatcctacttagtttgaatgtttattaagatgtcgtgtaggcatacatattagcatgctgtcatctagacgggctgcagga

SEQ ID NO: 39013 - DNA, 3290 bp, Oryza sativa
tttctaccctgagttgaacatggaggagcacctgtaaaaggcaagaccaacccttatataagggacaaggccggttcaattgaatcacacaatctactttcaaccaattagccaattgaattgctttttcaatattgcatctacttttcgcttagttctagcctagtttcgtccatctttgttggtttgcaccgtgaaccgttcgccgtcactgcgagagtgcaataccgctttgtaggtttgtcccgtaaaccttctgttcgcccacgagacgggtggttatcctttgttccacctagattagatccgctagccggtctagtttgcaaaacacatcttgatttcgaaaggctaatgggcgatcgattgcccctagcgatcacccccctcctccacgtggtttctttttttggcaccgcattactttcctattttagtaaatttatgcatctatagtttgtacacctcaaatttacacatctaaattttatacacctaaagtttagagacccaaagtttataagtcaaaagtttatatgtctgattcaaatttgaatctgaattcaaatattttatatatatagtatttctatacatctaaagtttatacacctaaagtttggagacccaaagtttataagtcaaaagtttatatacccgattcaaatttgaatttgaattcaaatattttttatatatagtatttctatacatctaaaaattatacacctaaaatttatagacccaaaatttataagtcaaaagtttacatacccgattcaaatttgaatttgaattcaaatattagtttatagacccaaagtttataagtcaaaagtttacatactcgtttcaaatttaaatttgaattcaaatattttttatatatagtatttccatacataattttttctaactttgttttctttttttaaaatttatggtgtaaaagtaggaagagaagaagggggggaggaagccaggaagggggagaggagcggataggggggatggcgggtgatcgctgtgggagatcacccgcccattagccacgccatcttgatttagccttttggctagatcggagtggttggcgactccatatcaccgtaagacgtttaggtatcccgatcatggttgtcttcttgccaaaaaaaagttgtcaacaattttgttgaagtactttttgagattaatctataaatatggagaccatgattataagtcaaatactacccccttttcaactgtaaatctttttgacttgttttttcaagtaaaactttttttagatttaactaagtttataaaaaaatatagtaatattttcaacacaaaacaaacaaaaaatattaaaatatgttcaacgttagatgaaataaaataaaattggtgctataagtgttactttctccgtttcatattataagtcattttgatttttttagtcaaatttctttacatttgattaagtttatagaataatataataacacttctaacataaaataaaatagattatcaaaatatatattcaatactagatttaatgaaactaatttggtgtttaaaatattactaattttttctataaacttagtcaaacttaacaaaatttgattaggaacagagtcaaaacgacttataatatgaaacagagggagtactatattttctataaattttgttaaactttcgagaaatttgatgggaaactattctaatccctcgaggggatgttccctcgtttgctcaaaaaccatctaaatggttatgaaaaattctggaaaaatttgacaacattcatacaacacatatatacaactccacaaaatcttaagtccaaactcaactcacacgtcgagatataaaaaagacaaattcagcgtatgaatagtagcgtactgtttatatctaaatttgtcttttttatttctcaatgtgtagatcgaatttgaacatgaattttggtggactagtaggtatcattatactgtacattgtcaattttttttcagaatttttcacaactatttgtatcgaatttagaagaaaaaggtatacgaggggatatcccctcgagggattagaatccactcccaaatttgactttaagaacggaagaagtattttagaagttatttataatattttttgaaaaaaaaataacatcagtttattaaaaacaataattattttaaccggaggctataagtactttgaccaagttggcaagttgaattcgtaccgcttgtggatggtcatgccctctgccatttgctgcatcgatccgcaccttcctcaattagatgccctgaggtgtagtacgagaaatagcaaagaaaatgacctcgaggtcaacccatctccattgtcgacgcacccatgcacattttcccctatcagtgtcagaatccctctatatagtaccagtactcgatactctactcactcactaaccaaaaccctcactgctcgatccccaagctcgagatgggagcttaccagccgctgcagcatcaccatggcggcgccgccgccggctacttcctgccaagaaccgccgtgacatggctcgccgccgcctgcctctcccttgccctcctccacctcctctgctgctcccctcccggcggccaccaagccgtcttctcccctctgctccagtatttcaatggcaatggcacttactcctccaacatctcgtcttctgggtatgtacaagctaagcttggatggatgagcgagcgatcgggcgagctagctagctcatcaatggcggtgttcgttgtcgttattgttgttgcagggtggaggagaggtcgtcggcggcggcgtcgtgcgactactcggtggggaggtgggtgcgggcgccggggcacgcgcggcggtacaacggcacggcgtgcaacgtcaagccggagcaggactgcgtcggcaacgggcgccccgagacggggtacctggactggcggtggcagccggcgtcgtgcgagctcccggcgttcgacgcggcggcgttcctcgccgcggcgcgcgggaggcacgtcgcgttcgtgggcgactcgatggcgcgcaaccaggcggaatccctccactgcctcctcgccgccgcgttcccgcacgagctcgtggcccaggacgccgagcgctacaagcggcagttcacgcggtggtcgttcccgtcgcacggcgtgacgctgtccacctactgggcgccgttcctcgtcaggtccggcggcaagccgttcaactacaccatgccctacaacctcgtctacctcgacgag

SEQ ID NO: 39014 - DNA, 9460 bp, Oryza sativa
ctggttctggaacccggccgtgtaccacaggcgcggcgaggtggtcggcgtgcacgcgcacccggagctcaacgcgaccgagatcggcttcacctcgccgtaccgggaggcgttccggagggccctggagcggctgggctccgacgggcggcggcggaccgtggtgctgggcacgttcgcgccgccgcacttcgacgggaagccgatctttgacccgacggcgtgcacgaggacggagccgtacagggacggggagaaggaggtggggagcatcgagagggagatgaggagcatcgtgttcgaggaggcgaccgccgcggcggcggcggcggcgacgatgagggtggaggtggaggacgtgacgaggctggcgacgatgcggccggacgggcacccgggggtgtacatgcaccgcgacccgttcgctggcggcggcgcgcggccggagcggatgcagacggactgcctccactcctgcctccctggcccggtcgacacgttcaatgagatcttgctgcagattctgagcaggcagcggtgattcgagccagtgcgtgcgtgcgtgcgtcggtgcgtgcatgggcattgtttaattgtgaattgtgactgtggtgtgtacgtgcagttcaatttctcgtttatttcgtcctgctaattgtaacttctgtgtgttctggtcaactctgaattaaccaatttcatggcaacagaacaattcttaggctgtgttcgcttgtgctggctgagaatctttccttccagcatggaaaacacatgattaattaattactacctccatattttaatatatgacaccgttgactttttatccaacgtttgatcattcgacttattaaaaaaattatgtaattatcatttattttattgtgacttgattcatcattaaatattctttaagcataacataaatattttaatatttgcacaaagattttgaataaaacaaatggtcaaacgttgtttaaaaagtcaacggcgtcatacattaaaatacggagggagtattaactaaaactaacttgagaaatggattaatataatttttaaaacaacttttctatatatatattttttaaaaaaacacaccgtttagtaatttgaaaaacgtgcgcgcggaaaaggagaaataagagttgggaacccctacaaacgaagcacccttagaaccgttaaatccattggttttggtgttggtctacatgctaaggacagtctcaatcctccatcttagagcaagtataattgtaggttgtaagccgactaaatgctgagatggaggagagaagagaggagagagaggagaagcgggctgtaaacttacagctggcttgaacataaaaatcaagaaactctatgagagagacaagtggatcctatattaattgtaaagagctaactattatatgggtgggttgagagaagactgaaaaacctttatagccaacaagttggctgtattattagccttgctcttagttagttttcataacattaaatataatgccatataagcaaataactaattaaggtagctagagaattaactaggcgaaataaaaaacgtgaagaaaccatttctcatataagaaaccaaccctacgtagaaaccaacaatgaaaacaacaaaatacatggatgaaatgagagagaagggagatgattggatagagtttattttgaagaaactactcattgagtatattttttttatacatgatatctaagtgacatgacgagtatgaaaaatattcgatagtttttgggttgggattgtcgtatgttttggtgatgtggcattcaagtgtgtacaaacatttgcttcattataagggaggagtagaatgatgagaggacaaaatttagtgatatgggagctaatgtatgtgccatgacaccgaaatcacggtggttttggttctacgctttgacattatcttttaaaaaaatattgtggagctgtgggcttaactaatttcagcatcaataaatgtcaagtgcccaattttgtagtccatgaacaatttgaaatgaacaattaatttcaagactacggttcatgaaacagatttttcgttcatgaacgtgttacatattcatcactacttcaaaagaaatagtttttgatatatttcagaaacaagcaaatgactaatttggatatatatatttaaaacgaaccgccctcaatggcgtgtaatatttccctaaatggaatgatacaagaaaataggctcgctagttggctcgccttgttagttagcccgtgcatataactttagaaaattcatacccaacatggtatattattttctatttttgtgtaacctaaagcagataatatttccccttgtcctatgcatattgtttagggtataatcattaaaagattgtgattctgcgttttgttgaaacacacttcatttatgtaaaaagactatggttgtatattgactaataccctcgtttcaatattgaaagataatatttgcctctttttaattaatacatactacctttcccttgtatttaattgttttaacattattatttatttttgctgtcaattttttaggccagtttaaaattttatttggaaatagaagtgttggtattttatttgataccaacattttttatcataagatgaggatattggtatttcaaaattttagaacacagagaagtgtaataacaaaaaaaaagaaggaaaaagaatgaaattggggtgggagtttggcccaagccagataggcccagtgcctctcctctgttgttgggccaaccaagttgcagcccaagtggccagttcgattcgcatgcgcacgacgtgagtaggggcaggggcgcgagcacacaatggagcggagagcacgcgtcgtccaactattggtgccacgtgtcatgcacttttgcatgaaaacccgccggctttagaatattagatatgcacaaggaggccacgattgattcagaatggttgaccttaagaaatgggcctgttttatttgctaataattgaatggctgaatttttagataatggaatgaaatattccgacagccaattattacaaggttcgcacaaaagcaaactcacactgtgagtatgtagccaaagtaacaaaaccaaaagtaaaagcaaactaataaaaaccaagcaaggtaaagacccaacaactattgaattctattggtgaatctccacccgaagttggcaaagagctacatgatcgtcgactcaagtttacgacacgtatcctttattagcttgatatgatcatcatacctttgtagttaagcacattcccgaaagtaatatgttgccctgaaaagaacctgcaaataatgaatagccgaatgttttaatttgtcagtactatttgagattacaaatgaataaattagctatcataaagttgaaaataaatttaaaataatagtttttttttaaaaaaaactcatatatatatttaaaaagttcttgtgaaaatcgtgtgtcatattaacccattatttccttttattcattggaaaataattgtttgcgtcacgtgtggatatccgtgtgtctatttttctttggttagctctagatctcaaattaatgactacccctgtttttctcttttgctcgatgagtttattttacagtttttgaaaataattgaaatgcgaccttggtcattactttttataactttgcactacgatacagtagcaaaacataatattatgaaaacattattactgaaaacctagatgatttcagatatactagtgatcaaacttcggaaaatttgatggcaggaatttttcaaaacgtcaaaataataataacaaaaagaatgacagcctagcttgtagtagtagagaaaaataagagtcgactaatactaaatcaggtgattacttgtactaatttgtaaaccgtgtgagcgtccgagcgatgatctagccataaatctttccgttgactctcgcgattccaaacacgatggcttggaattggagctcatacttcgatccattccgttaattaatccagaaatactccattaggcacttcatcattctccatttttgtttgctcctacaagaataatcagtagtgttgtgatcgcatcatcaattcattattcatcatacagcaatggcagctgcagaagtagaacacagcggcagctccctccccaagaagctcgtcacttttgctctctgcgccatcttcaccttgtccctcatctacttctcctcccctcctctcatcatctcctccaccaccaatcttctctcccaattccaaacacgcgcacgagctagaaccaccgatttttctactcatctcccaggtaattattaggatttttttttctgagctcaattgagcagcatttcttgcgatcttgattggtttcttgatttgtttttagactcatttcccaggtaattattaggattttttctgagctgaattgggcatcatttcttgcgatctcgatcgattggtttcttgattttgtttttagattcatctcccaggtaattattagattttttttctgagataaattgggcagcatttcttgcgatcttgattgattggtttcttgatttgtttttagactcatctcccaggtaattattagatttttttctgcgctaaattgggcatcatttcttgcgatgttgattgattggttatcttgattttgtttttaggggtagctgtttggaagcaatgcgactacagtgatgggaagtgggtgtgggacggcgaccatggcggcgccgccgccggcggcggctcgaggtacgacagcgagaactgcgacatgaagatgacgtacaagtgcgtcatcaacggcaagccggacggcggctaccttcactggcggtggcagccggcgtcgtgcaacctcccggcgctcgacccggcggcgttcttgcggctcctccggggcaagcggctggcgttcgtcggcgactcgacggcgcggaaccaggcggaggccctcgtgtgccacctcgccacggcggcgcggccggtgacagtgcggcgcgacgaggagcggctggggcgcaagtctggcggtgggcgttcccgtcgccgcacgacgtgaacgtgtccacgtactggtcgccgttcctggtgcggtcggaggggcactcggaggactacggcatggcgcacgaggtcgtcgtcctcgacgcgctcaccgagccgtgggcgtccgacctcgccgccatggacgtgatggtgatctccgcggggcactggttcccccacagcgccgtctactacgacgacggcgagatcgtcggcgtgcacggccggccggacatgaaccgcaccgagatgagcgccccgtccgtgtaccgcaaggtgttgcgccggacgctggagcacgtgatcaacgccaccatggcggacaagctcgagctcgtcgtggtggagacgatcgcgccggcgcacttcgacggcaggtacagctggaaccaccgcgacgcgtgctcgcgccagaggccgtacgacggcgacgtcgacggggaggcgaaggtgggggacaccgaggccgagctaaggaaggccgtgctggaggaggtggcggcggcggccacggcggcgaggcggcgctgccctgggctgcggttcgaggtgctcgacgtgacgaggctggccgccatgcggcccgacgcgcacccgggcgtgtacatctacaagaacgcctacggcggcggcccggtgccggagacggcggcgaacgactgcctgcactggtgcgcgccggggccggtcgacacgttcaacgacatcctgatgcagatgatcgccggcggctagctggccgccgccgcccgccgtcgtcgagctcgatccggcacgtgcggcgcggtgtgtcgccgcacgccgcgttgcatggtctctgcgtctgcgtggatggtggatcagatcacgagaatccgaagctgtcggttttgttctgactggttcttgaatcctgacaattgactttggtatgcgttttttataagcactttttcagttccataaaaaatatttcttcaaatacgtattactagagatatataagaatatgtctatattcaatatgagattaatttttgatgggacgagattgatttttgttagatggagggaatgttcttctgccaatgggattcagaatcgcagtttgcagatgcaacgtgtgctgacttcaatctcgatgccattgattggcacagtgtacaatggtctatttcaccttgaatataagcatttttatattatttagcagttaaggaaaaaaagcgtgctgacttcaatctcgatgccattgattggcacagtgtataatggtctatttcaccttgaatataagcatttttatattatttagcagttaaggaaaaaaaggctttagagtgtttgtacttgtagacagaggaaataggatatatacggccattgaaatagggaacttagccctgcaaacaacccaatctgaaatataagcatttttatattatttagcagttaaggaaaaaaaaggctttagagtatttgtacttgtagacagaggaaataggatatatacggtcattgaaatagggaacttagccctgcaaacaacccaatctgaaattcgctccataggagatttgagccctgcaaacaacccaatctgaaattcgttccataggagatttgaactcaagaccatagggtactactcaggtcactataaccactaggctatatccctttcgtatatattttattgagtatgtggtgtgttatggtgctgattttattgcaaggaaatgttacaaatttcaatagagaagtgctacacgaagggatccttttctatctcgtcctatacaaagggattgctagaaatataccattgtcacgtaataaaagtgcgagtacgtgtgatgccacgcggtgaggacgtgagaccgcttaatctcgtgcaacgaggatgcaatacggctacttcgcatccctaagagtatctccaacagcttcttcaaatcacactctccaaacacccatatagtcagctctccaattgatttggcaagccaaactcattcctcacttcaacagcctctccatctacactctctattatgagcctacgacactgagacccgcacatcagcctttattattctcatggttgtgtaggaggcagcatccttatgcgccatttcgtcgaacaggttgcaggcaggccacatcggcatgcctgggcatgtatctggtaggccaagcgggcatcgcagtagctgaggacggagcaggtgagctcgttggcggcggcggtggccgggtggacggtgagagcgcggcggagggtggcggccctggatccggaggcagagcaacggaggcaaatatcaatcgatcggtatgggttcatttcatgggttgggttcggtgggggattgcaatgcagactgcaattcccttctctctctctctacactttcctcttcctcttctctcttctatgcagtggcacggattctatgtggcggcggctctcttcggaggaggattctatgtggcggcggctctcttcggaggaggattctatgtggcggcggctctcttcggaggagaggtcgatggtggtggtggcggtgttgttctactgggtggtggtggtgaagccggagaggatgtggtaggcgggggaggacgccgacggggagtaggagggcgccagcgcaggaaggggaggggagcacgcggcggaggtggagcgcacggcggaggagcgtggccaccatggttggggaggcgaggtgagaggagaggatatgggaggaggatgacgacgcggcggcctcgcaatcagacgacgacgcggcggagggggggcgccggcggagggacgcggcagagggagtgatgccggttgtggctggggacgttggcggctatggatgcggcagcgccggacttggctggggacagaggcggcggtgccggatgtggacacggacggaggcaacggcggcggttgtggccggggacggaggcggcggggatgggctgtgcgggaggcgagagcgaaggaagaggggagcgagacatgtgggagggatagtgcgtggggccacagttggccagttccatgggatctttagctagccgaatggcttggccaatcaattggagagtatttttttttctctatgttagctataatttagcttggagagccatttggctactctgttggagttgctctaactagctaactcagtgattaatagattaatttgtatcattagaaattaattaattaatgttatttctttaataagcatcattagtacttaattaatcgataatatggttgattaatcactaatcactataccatcctgctagttggtgaagtgagactgcactaattattgccatttattaaatcaacatcattaataataaattaatcattaatctggtcgattaatcactatcattgtacaatgtcgcttgttggtgaagcgagacctccctcgcgccgcgggtgtcgtcacgccgtcgtcattttcaggcaactgtttaacgatatcatatcgttttcgcactttccctcagcaacgatgatatgttatatgtttgtgccaaaaaaatatacccctttatatttctgaggaaaaatagtaaataaaaaatatattttcaaatttaattataaggtattacactcggactagagtgtggtatcctcgtcatcaccttaaaaaaaggcttctatgactatgtcctttttttttaatcttaaatgtgctctttattagctcgttggtttggtacgatcacgagacaccagtacatttacagactctgggagggggtcagcccaaacatacaagtcccaacccacacttatacgagcaatgtcaattttttttaatgtctcacacgttgtattgatagagcagaaaaaaattacaagattacaaccctgaagggtcgtaaccaggaaaaagaaaaaaaatataccaccacccacacaccgatagcaccaacacacaagatcgggagaaggctaacaccggaccagccgccgctaaacgtgaccgaccgctactagaccaacaaaggaacacatacgagatcacccaaaagaacgccctcacaaccaacgcaaagccaactcctagagtgtgcttgcaccaatcgttcgagaggcttcggctagggtatgccaaaacgacgtcttcaagaagagaagcgacggaaaaccgccgccgccgtcagtcgggatcaaaaggagtcaagactgggctttcgcccggcaaccacccttgagggatgagactgcatgacaatgccctcaggaggggaaattaaccatcgttgtcggtccggccaaggccgggctgggttttcacccgctacttaccac

SEQ ID NO: 39015 - DNA, 1784 bp, Oryza sativa
tgcctcctcccacctcagccaccgtgcctcctcccaccgccgtctgtcgctgcagccgcaccagccgccgcagccaacagctgctgccgccaccgccgtcggcagtcgtctgccgctgccgccgtcaccaaccaccatcaccagccgccgtcgccagccgccatcgctagccgccgcagtcaacagctgccgccgccaccgccatcggaagtcgtcatcgccagccaccaccgccgctagctgctgccgccaccgtcgccagttgccatcaccagccgccgtccgcacccatcactgctggccaggcagtgtccgagacagatccggcccggcaaggctggatcccaccgtgtgggggccggatccgtggccgccctcgccggggcgtgccgccgccgacgagcaatgtcatgagcacaactattacaagaacgacccgcaaaagacagcttagcacttgggaactctaaatggagcagagctctaatatgcctgaagagcacgccacccggagagcagtcaaaatctgttgatgacaaggcacacagcaatgcagagtaatcagtctgatcaaaatgcgagaaaccatggtgagctgtgatccgtagagcatgcagacaagcttcattctatgactatgtctcgacgcccctggacatgtccaacccggacggaatagtcaacaccagccacaccatttattcatgctggggtcgtcattggcggggagcatgttacggggtaagaggcgaggaaaaggggatcgacgatgaaggtcatctgtgccttgggaatcatgtttggtacgacgattctcaaaactattgatacctggtacttaaaaagcatcagactcggtacttggtaggtactccctccgttttacaatataagtcattttagcatttctcacattcatattgatgctaatgaatctaaacatatatacctatctagattcattagtatcaatatgaatatggaaaatgatagaatgacttacattgtgaaacggagaaagtagtagcgaatatcaatcctaatatatatctggtattcgactagtactcatccggtatcatatggttttggaataagatcttgtacaaatgtacaataacaactcttatttcaaaatcgttaataacaacagcttatatagttatacagaatcaagttgctgtaggaccaggatgtcagatcaagcgttcacggatccaggccatgtattatttttccaacgagaagtgcacaaaagggatgtagtttttcaatctgccaagagggctttcttaacccatctctggatattttgcagtgggaaaaagtatatcgaaggtcacctcatcttgtcatcatattacaaaatcatctcccaaccgcaaaatcagatatatgtcatctcttaacttataaaaccgaatcatttttgttcaatgtggcagctgagtcaacgagggccccacatatcagtgaaacccaacctcttcctctcttcctctcttcccatctctttcccgtgtgagagaccgacgggaaacgatagcgtgggcggcgccccggcagggagaacggcaacggagaggagatacgtagcagcggcgcagacggagaggagttgggtggtagccgcgagaagctcctccgcctcccaccacagctaggatcactcccgagctcctctagagccgcctccaccacggcctccatatgcgtcgcggtggccccgcgagcccatggtacgcatggaggaggtgaggctacccccacgccgatgctgccgc

SEQ ID NO: 39016 - DNA, 2773 bp, Oryza sativa
atgcccctgagacatggaggggatgccgaaggtgtgatgggcgtggagcgggacgttaagctcggagacgacttggagcatggagatgcgattgtggaggtggtcgatggcgtgggggcgtggcgaccatggggacggttgggtggagcgtgaagaaggcgtccagttgcccgcgcccctcctcgccgtacaacttgtggatgaggaggtggaagggcccctgctcggagaggggccgtgacgggtttgacggggacaaggtccataccgcgcctaccggcgcgcatcactagcgacggctagttgaagcttcgggatgacacgcgctgggccgccgctcctctcctctgaccacgactcctctccccactcattttaaccatcgagggctcgtcatcgggcgcgcctcccctgtcgttggtcgccaagaagagagaggaagtgaggcggtcgcgtcgtgctcgggggcggcgcccgtgggtctaagccgacgcccaactcctctccgctggtgctggtcctctccccgctcgtcttcaccagcaagcgcccccaccgccaactcgtgcgtctttggttctccccacctatcgccgccagcgctctccccctaccgccgatcactaagaagaaaggtaaaaagagaagggttagtcgctgacatgtggggcccacgtgggttctaagctgacttagctgccacgtcgcacaaaactgggtcaaaatcacctaaggaccaaaagtgatacggttttataagttaagggatgacaatgataaaatgagggaccttggatgtactttttcatttgctgtttaatagtccttgacactttggtatgggcctaaagtaggtttccaaagcaggcctagtgcttgactatacgagacaatcgttagttccatacgtcacaccagataaatgggagtaaaattgctaactgttgatatgttttatcttactatatgttcaacaacaatacataattatgggaaacatattatatgcacataagttttctgtgcacaccaacaaataaatatcacgtaaaattctagaaaaaaataaaatgtactttcaatagtgctatttggtaaaatctaaaccgagagcgctctcagattaatattaaagagcgacgcatccgtgagagagggttcacttgcaactagtacacctacgtgagagatggtctagttgtttactactgcataaagtgtatctcttttttttcttgttatggacttttctcttaaaatatttattcaatctacaatctaattacactattatgtttgttgtaattaaatctttataacaagattttacatgattatattataataaaaaatatttatgttgtaaattacttttatcatatatgtaagttacttttatcatacatataaattacttttagatttgattaagttacgttttagacattcagtgaacaatatatatactttactttatcgttagttctatgatatgttgattagatttaatttctagataaacttaggtttttaccctctataatagatttacttttgatatcgtgacaagttatttttttaagttacttatattaaattacattactatttattgaacttacttttatatgtctaagaagtaatttaatgaaatctaaaaagtaatttaatgaaatctaaaagtaatttagatatattataaaagtaaattgtatttttcataaaaaatataaggcaaattttgctacaggacatcgcgactttgtggttttagctccaggacaccgacgaagttacttttagggaaaaacactctcaaaacatggctatttgccagtggacaccgcgtctattaaaataataatttctggttgaagagaagagagaaatcgtgtgaaatattaaaaatacccttgaacccatatgtcatctctcttatctctcttctctttttctccctctcccctcaccgacagcagctagccggcagcggcggtagcaacaacagcggcagtagcagcagtaaacggcagcggcagcagcagctggcagcggcggcagcaacagcagcggcggcagcagcagtagcagccccagtagcaagcagcagcggcggcagcaagagcgccagcagctagccggcaacggcggcagcaacagcagcggcagtagcagcccgctccacgcaatattcaacgggatttgcacggattggttagagttcgccggaaaaataggagatgaaatccgcttcgaatccacgcaatattcaaagggatttgctccaattcttgaggggaatgaaagaggaggataagacgaagaaatcccctcaatcaatgtttgaaacgagcaacgggattggccgaatttggagggggaggtggcggtgtggcgcacgggcatgagagctggaggttgaagacgttcagtagcgcgagggagggaaattagactttagatgtgcagggcaatttggtccggtcgcgtcaaaatatgggcccactcaagcctagtcagcacgaatacactaaacaaatgggcgcggtgtcctctggcaaatagccatgttttaggagtgtcttcccccaaaactcacttcgtgcggtgtcctggagctaatttcacaaagtcgcgatgtcctgtagtaaaagttgccaaaatataatcatgtgagatcttgttgtaaagatttaattgttacgaacataacggtgtaatcggatcataaatcggatgagtgatttaagagaaaattctataagaagaaaaa

SEQ ID NO: 39017 - DNA, 22010 bp, Oryza sativa
tagaatttttcatgatatttgctagttggtgtgcacagagtgctcacgagagaaacttgtgtgcatagatatgtttccggttatatgttcggttatatgttgctgagttaattgctagagatcctgacacgagatttcgttgttacaaggttattggttggactgctagccagtttttagatatctgatgcatgcatacatagaggagaaagtttatttgttactcaaggtcaaggggacgtcccccttcattttacatttggtcctatagtttgaatcaaataatttcttgttaatccagtattataaccggtcataacatacggttgcgattgttgctgcttgggggatatgtcgaaaagttatgtttttattgataattgttggtagcgtgaaagattgaaaaagccgtcaggtgtgctcatcaattagattaattgaacatcaaagggccatgatgttcggccacctgtccattccctgcaacaactgaagtactgaactgaccccttttcttctactttgtgttcatcgactcctgtaacatagctcaatgttgaaggttttccgttctgtaaactgcaaatttcaagaaaccaagagtatgaccattaattgcaatattcagaaatttctttcagttgttgaaacgttgtacgatgaaaaagaaaaaaaaacattgtaagaacaaatattccattggagttcgaatagtattacacttgaaagttcaggattttaggatatctggatcactgtttatatattcagtactactagttgggaaagcattagcactatgcctatataatacatcccattccaactgataaaaatcgacaggtgagacctttgcttccatggaagctagcatcaggtcagcaaaaaacaaatgacgccacctgccatctgttagccagcctacctcatcaaccatccacgggtcatttctccctccatatccaacacacatttttgtgcatgctgccatcccaagctttctcattttctcagatcatgacgcatatctatttttttgatagtggaattcttttcagaagctatagccaattattatagagtttacgggacggataactacaaattacataattcaagacaagaagacaaccataaagatacaaatcttcatctatggttgattagagtatgcataacctaccaacaacttttaagttgtacttagtctttgcgaatggcatatagtctagtggttgcaatgacctgagtagctccctaagattctgagtttaaatctccatagaagcaaattttagattggtttgtttgaaggggctaagttcctaattaaggatgtgttctttccggtgagttcccaactcacctacctcgtttttcgcgcacatgtttttcaaactattaaacggtgtgtgtttttgcacaagttttctaaacgaaagttgctttaaaaaacatattaatccatttatccatttttcaaaaaatagtaaatacttaattaatcataagaaaatatgtcggctccgttttacgtgtgcggtctcacctcccaaacacagccttaaaaggttccataggtgcagatttcagattgggttgtttgatgggctaagttgtcaatataaaaggctgtgtatattcggttggatatagaggccgggtaaaaaattctcttaaaaaaaaagttgtgtttagtctttatttttctcaaaccagaaaagtggaatctaagaaatcagcgaacacatataggcatatagctgatgtaaaacacggctcacaacgatcatcatcagctcgtcacatcacaatctcacaattctctcaggattggctcaaacacggcccagcaaaagtacagcatagtgacatgcttccggctgggcgtacatatatacgatctgaactctgaagtctgatctgcaactgagaagaaaccaatgcaaaaaacaaaaaacaaaaaaagaaagaaagaaaaagctagctactagcctactactacctaatggttaaaatcaagaactctttgaagcaaagtgagacgagacgagacgagctactgaactgaaccatcggcagaagtgtgtagtttggtgagctactagtgtcacagcgtgacagtgttaggctttaccagaagtgatgagccatccagcagccagcagtgaccatattattctcctcaaacgtccaccaaacactgcaatttcaataacacgtaaccggtcgatcgcaagtactccctctgttaaaaaaaacaaacactgattttcgtgtctaatgtttgaccgtccatcttatttaaaaaaattaaaaagacaagtcacgtataaaatattaatcatgttttatcatctaacaacaataaaaatacgaattataaaaaaatttcatataaaacggacagtcaaagttgaacacggaaacttaggatttgtctttttttttttttggacggaaggacgcacgcacaaatccttcaaaaagctggctgtggctgccggcattttatcgtcgtcatcgtccacacgtacggtgagtcgagtgagctagccatagctagctatgaagaaggcggccgccggcggcatggcgcctcttcctccgtcgtcgtctcctccgtcgtgcaaagccggcggtggtggtggcagcccgaggtggtcgttgcttcacggcggcggcggcgagtggggcgtcgtggtgcggcggaacgtcgtcaagtcgtcgtcgctgctgctgctggtgttctccaccttcttcgtcttctccgtcttgcgctcgtcgcagacgagcttagtcccgccgccgccgccggctgctgccggccccggcgagccggcgctggcgcagagtggtcacgacgttgccggcgatgatggcggcgaacatgtcgccgtcgcagtcaacaatgtggcagctgagacgcagagcacgccggatgacatctcgctgccgtcgacgaactcatcggctgcagctgttccaacaacaacaaacaaagctgaacaacaacaaacaggtgatcctggtaggtgcatttcaatagtgtattcattattttgaagcaataaacactaagataaattctttgtaagcagtggtagagccaaaaagtatcgaagcctaaagctcgaataggactcaactaatgagatattattttttttcaaaaaatatacatgatgatttaagagaatttaaacgtcaagccaagctatcctaggtttgcctccccttctagatgtaaaaccacataaatcttgatgcatattctctcgtttcttacatgtcacaacttctcgttatttcgagggttaaactttttggtttagccgatttaatcagatgtcaccgaaaaattagaaatttcggtccaaaattttaaacaaaattcaattgaatttgaacaaatattactaaaatttatgaaaaaaattgaaaatttttggccgaagtaatatcgtatcggagtggtccaaaattaccgaaatcagtccgaaaattccaaccatggttatttggacgcggttggtaaataactaaataagggatcaaagtaaatttttaccacgacaaatgtgaggcatttaactttgtgatgtttgatgtgtgctctggataatggcaggagcgaacaacatggaggagaaatgcgacatgtcgatggggaagtgggtgagggagcccaagggcccggtgtacaccaacacgacgtgcccgacgctgccggacttcaagaactgccagaagcacggcaaggatcccggccacctctactggcggtggcagccccacggctgcgacctcccgcgcttctcgccggaccgcttcctcgccgccgtccgtggcaagcgcctcgccttcatcggcgactcgctggctcgcaaccagatggactcccttctctgcctcctctctcaggtatatcatcgcacaggatttgaaatttcggtaatttcgcccccaccggtatgctcaaatctcgcccgaaattttcggctttttacaaatttttgtgaatctggtcaaattttattcaaattcagtcaaattttcaaataatttcggccagaaacttctgaaatttcggtaattttggtcacccccgacataaaatccaatttcaaaattgaaaactatgtcattgcaccggctagcttccaatgtcttagcaatggcggctgccactgattaatggcccgtgtcgtgtctcgtgtcaggccgagacgccgacggaggtgtaccgcgacgcgcacgacaagttccagacgtggcggttcgcggcgcacgagttcacgctgatggtgatgtggacggagttctacgtgcacgcggagccggtggtgggcgccgacggcaagccgacgccgtcgttcgacatccacctcgacaggctgagcgccaactggacgcgccgcctgccggagctcgactacgcggtcatctccggcggcaactggttcaaccgccccaactacctctgggagggcggccgccgcgtcggctgcgtcaagtgcggcggcgcagccaacctcaccgacgttggcgtcccctacgccgtccgccgcgtggtgcgcgccgctgtcgagggcatcgcgcggtgcaccggctgcaaggccggcctcgtcgcgttcctccggaccttctcgccggaccacttcgagcacggcgcgtggttcagcggcggctactgcaaccgcacgcggccgctggaggaggacgaggtgagcccggacagcgccgcgtgggagctgaggagggtgcagcgagaggaggtgatgcgggtgaaggagacggcggcggcggcggccgcggcgagcgggaacgcgaggaggttcgaggtgctcactgacgaaggccatgatgctgcgcgccgacggccaccccggcgcggccatcgacaagaggtggcagaagaacatcgtcagcgactgcctccactggtgcatgccgggccccgtcgacatgtggaacgagatgctgctccagaggctcaccgagatctccacgctggaccaggatgcttccatctttgaggcaccttaactttgtcacttacatgtaggtccggatcattaatgtatcactgcatacaatcatacggggaacgatgcatgactggtgatgctataggggaggtcttcctatccattgagaggacgtgcatatctctcaaatggttataaattttttgaaaaacaatctagatcaatatatgatgtatcactttataaatatgtaaattaaaacaaaacgaacaacaaacaagagactaccaatccatcagttagacgaatgtttgctacaaaaggatcaggtttttcaatggctaggactattttaagattagtactacttctattacctaattacgtccccgattaaattgacacaaacataaagctttatatgccatcacttccctccggctaattccccttaggccctcacttccctcccctctcccccactctcgatcactttgccagagccgtcgttgttattgtcttttcgatttctgatgtcattctctcgacccacgtctcctccatctctatcggatcgacggttactgccaccacctcttaaccacatggtttttccttgccctgaccccacccaccgtcatcctcaaatccctccttccattaccaccaacctaaaaaacctaatataacaaaagcttttttagtccaaaagtcgccaaaaatgagagcttgccaattaagtcaccatcgacgtttctattaccatagtcacatgtgagtacttgccatctttctcctcatcacttgctcttgctagccctagatctttaatccaatggtgttcatcaatcgattgataaatagcaaatcccaacgaacaaatatgaccatgaacaatacatatatagttagtgcaatttcttctttcttttaacttgtatgtttttaatttatcataaaattcataatgatttagataacatggatgaaaaaaggggcataccctagagggaaaaaacatctcctgatgctttggtttggtgatggtatggtcaaaagttttttggaagaaaatttagtccaaagttttcaaagtaaaaggatgttaaatattgtctttacataagatgaagatgctaattaaattcccccacagaaacttatcatctaaggaaggatccatgaaaacttatcatgactatttcaatgacttggcaaaatgagggatatcctcgagaggaaaaactccactttccttctttaatctctatgaatgatgaactacagaagtgaaaataattactcgagtaaaacaacaagaaagagatctactccctccctccgttttatattataagactttctagcattgcccacattcatatagatgttaatgaatttagacaaatctagatattagttcttggtacgccagatattctattgtgcacatgcaaattgcaagaggccggatttagtcgtacaatggaagaacggcctagatttggaggaaacgtttattatttctctggtttatatggaagagaaagaaaggaatgtattcaaggcttgatgatgcttgtgcaatagcaaaacagggatgagtacagctactccatttaatgctatggttatccctccaggatgaaatggatatcttcttattttggacacacataaatatataccaaaaaagttatctttttttttatcctcatgggtcattgaccctaagaagaaattaaggtcatatccataaaccttaccaatgtcctcaccaacaagtgttgttagccttagccatggcacaggcaagtggatgctgcaacaacaacgttcggaggcggtcgaggaggagaagaagaagcagccatgggcggtgggcaagaacgccgcgctgttcgcgttcttcgtcgtcgtgctaccgacgatgatgatcctggccggcgtcagccacacgccgccgccggcggcggcgacgacgaggctcggttggacgatgctgggtacctttacggcacgaggtatatatatctcccccggtatctgtgttcgatttcactgtccacaccaactcaaaagttatggattgtttggtttaaggaatagagtttctctatccgtttttccaccttgaatcaaaagctctctaattgaccaggataattttaaactttgatcattaataagttctaaattagcatattttctttaagaaaaattatatggctatgtttaatgtgcaacatactactataagttataaaacccagtgctttgctgtgaaaataatgtatgagtatatgttcaatgtattatagaaatgataatatttgatttttttaaacgatgtgaagaagatggtttgacatacttgaatattgagctcttcaatattatattccagatgatatatcatctttcatgagatttaagatgctagaatagcgatagttagtgggtgataatgtggtatatttagcttctaataagtggatagcaattatataaaaagtatagataattttcaaatgttcacaattacgtggataaattaaaagtagtaacagttgaaatgtaaatagtgtctcatgacaagtatttaaagagggggtataccatctaatctagttatactgccttatggttgacattgctttctgtttacattttagaatttgtctttggatggtttgttgtcaattaacatcgcccttaatagcttagattgacttcggaactaaagtggatctattagattcctacgagaaacttagaaaggggcatcacattcagtgccaagtttaatgatttaattaccatatacctcattgattgtactatgagttcgtgttacaatagtgtagattgatcattataagtatataacaatattcttttttttgaaatggaaccaacccatatagttctattttcaactaaattttgtgtagttatcgccgctcaatttgtacagaaaattatactagccatgtaacatataaatgtatcaacataaacacatagctatatttgtggatgttttctaacaacaaaatctgttgttgtttgtcgccaagccttaaggcttttttttttttgtgggcgcgcgcgccgtaaaaaaaaaaagtcaacttcacatccctcaggtagagttttattaacatatgtcttaacttttaaaacctaaacaaattgagtccttagaaatattgagaatgatttcggatgaagtagctcagcgtcggagtagggacatgtgacaatttgagcttgctgaggtgggcgagcggatcgaggggcctcccctttcgcaccatcacaacagggtcagcttgacctcgaggacaggatgtagtcggcgatggcagagtggatcataggggcaatgatggagcgggcgcgtggtggccttgttggcagcaacggcttgggaataactatttgccacttttagatttgacaattaactattaaccacccctatctacatgtgtctataatatgtggatacacatgtgtctatgacatgtaggtccagtgacaaatagttaattgccacatttaaaagtggcaaatagttaaatatatctgggaatccgggagaaggggagaggatgcacggtcttttgctgacacgtgggacccactatctttttttttatttcttttggctgactaggacgtcgcacatgacaaaaccaccataaaaaatatacaaggacgtaggctgatcgggttttagaagttaggggcacttcgtacccagtcttggaatcgcggttgaggacgcgtacgaaactcgttgagggaccataagtagactttctttacctccgtgtatgtgtcctgggccataaaatcatcgatctcacagaataagttcacttttgatccctcctcctcacgtcgagtttgaatcacatccctaatccgtaaaaccaagtacgacgcatcactcatctttagaaaccgatgcgaatgtagtcctaagatagtattgaaggtggctttgcccttacattctatttaggattaggaataggtgtaatcagacctacttttgacatatctatcatatccttatttgggtatcatatgcacctctttgggcttctattgaatcgagaaattggattgtacatctttttgatttttgatacatataaggtgtcctacggataatgcaaatcgaagctatttgatgtctgactcaggcctatatgaccgatcgatcgacatactccaagactccacctttgtcatatattccatatatcacattagatagatatcatattccatcatggaatatgattcactttcaagatgccttgatggtgaaatggtagacacgcgagactgaaaatctcgtgcaaagagcgtggaggttcgagtcctcttcaaggcataatacggagaatgctcataacgtggtacaagaaagaaaaataaaaaaccataaggaatatattgtatcatgttttacggtttaaggatatgacttaaactcgacgttaaagatgagagaccgcaagtgaacttatttgtttgctcactccagtagtcgatgagtcattcagtgcgttctgtgctttgctcaggtgcggtgcaaaaacgagccgaggaaaacaacaacagctgcgacacgtcggtggggagatgggttcgggatccgagtggcccggcgtacacggccgcgacgtgcccgacgctgccggcctccaagaactgccacaagtacggcaaggatcccggccacctctactggcggtggcgccccgacggcggctgcgacgacctgccgcgctcctcgccggcgcgcttcctcgccgccgtccgcggcaagcgcctcgccttcatcggcgactcgctggcgcgcaaccacatggagtccctcctctgcctcctctcccaggcggaggcgccgacgaaggtgtccgccgacgacgacggtgtccgggagtggcgcttccccgcgcacgggttcacgctcatggcgatcacgacgcggttcctggcgcgcgccgaggaggtgctcggcggcgacgggaggccgacggcgtcgttcgacgtgcacctcgacgcgccggaccccgtctgggcgagccgccgcctgcgggagctcgactacgccgtcttctccaccggcaactggttcttccgcgtcagtacttctccgagggcggtcgccgcgtcgcttgcagcggctgcagcggcgacgccgacgccggcgagctcgccgacttcggcgtcgcgcacgccgtccgccgcgtcgtcagggcggcgctcgaggccaccgcccggtgcggcgacggcgactgcaagcgcggcctcgtcgcgttcgtgcggacctacacgccgagccacttcgagcacggctcgtggttcgacggcggctactgcaatcggacgcggccactggaggaagacgaggcgccgagctgggaccagtccatcgggtgggatgtgaggagagcccatatcgaggaggtgacgtcggcgaggaagacgacgccggcgacgacgacgaggttcgaggtgctcgacgtgacgaaggcgatgatgctgcgcgccgacggccacccggggcggcactacgacaagaggtcggccggcggcggcgccaacgactgcctgcactggtgcatcccggggcccatcgacatgtggaacgacgtgctcctccacaagatcgccgagaccgcctcgccgccggcgacgaatctccggtgatgtcggcggtgatttggtgacaaatttagcaacaattgatgcaaaaataagtagcggaaattgagtggtcgtgatgtagtactgttgagtgtaagttaattacccgcgctttctattggagatgaaccaaccacccacaacatcacctccataagggacaaatgttttctatcactcaagaaaatatctactcgtttcccatctatctatctatctattatctatctatctatctatctatctatcttctattatatactaaaagtccatgaaacttcctaaaaatactctcaaaccgccacgtggcttcctcaaaaccctcctaaatcgccacgtggcattatattaaatagacaaaattccaaccattgattttcacttaaaataggtggacccattattttgagccattaaatttaagctaatccgtatcctctcatctccgaacaccgcgtacctcctccccgcatgcaaggcgtagatagctaggtacgcatccactcctctccatctccccttttttctccaaggttgttaagatacaaagcataatttattacaataagttagatagaggtatggagcctgcaggagctcgctgtgcaccatgcatgctacctaaattataggagtgatcacagtgatacacttgaactacacattcagtttattatacacttgaactactgttttttaatcaaatcaacggtttaagactcatattagttagctatattttggtggtaaagaattattacatgttgggctttttcaatttatcacatgcacgtatcattttcatgagtcctccccaaaattgaaggaaaccctaaaaattttcttcaatatcaagtctaattttttattcaaatcggtggatcaattatgatacaataaggcaatagtaactaattaactacatacgtactctctcatcctcctctcctctctcattcaattattcattcttctaatttttaactaattagcaacttaatataaaaacaaaaaaaaattagaaagctaaatgattataattcttaagttatatctggtttttaagttcaacaatataaaagtaaaatatattacttcacaaatataaatatatttagtaaaattaagatctatatatgataaatatccactcaatgttctttaaaacatcttctaaataattcaagatccatattacccatatttcactataaataatacgtcatttgtagacacctatgcgtgtcaaccaaataaaaaaaatcaaacaaactatatcaccttaaatcatcgtacattctcaatagagcacttacatgtcacgtgttacgtcttaaatttaaaaataaaatcttagaaattatagaaaaacacatttgaccactggttatgaattaaatatgtatatccattattttaaaccattagatctatttttttaaaaaaatcttaagccgctaggggttacattttaataattaaaaaaatattattcaaaattttaggaacaaaacaataaatcatcggttttcatttaaatcatttataaaaactaggaaataaaccccgccccaccccccaaacttcaccccctcctcacatatgcacaaacacaacactacccgtcccctcaccccttggctcgcactttcccctataccctccttgatatttttataaccaataaaaagagaaataatcaataatattaaaacatacatatcttttgaaccacacatctgattctaatataaattgctctatttataattaaaccaataatttaaagatccataacgcctatattttaaacttaaaataagagtagtatcaaaataaaacaagatatagaaaatatcaatatgaacattggttcctacttttcactaaaattagaacaattatacatgttcctattttttaagtgcttagatattattggttttcatgacattatgagttcctctgtacattattgtatatatataagccacacaatgtttgcggtttatagttggttgagaagttatatttgtaattattaaaatgttcagactcatattaactaggtattttttttaaaaaaagaaagatactatagatcacacatatattagggaagggagatctacgatatatctttagaaatttatatataaatatataacaaattgcgtcaataaaatatattcattaaaaaataaaatatattcattaacaataatagttatttaggattttctaaaaaaagaaagcacctaaacattttattaaacaagacaaaacatcacatgtttccaaacaaattaaatctaactcctttctagataatgaagagatcatagataattatttataggaatgtattaaatattatgtattttaaaagctaacaaatagattggaaaaattatctaagcaacactgatgagataagttatggataaacaatacttatgaaatgacaagtgtcatctggctgatattatgccattttatatatttttttcaaacataatttatagtacatgcctacgcatcgcgcgggctaccttcctaattatatctaaatggttatcaaatttttttaaaaaaaaaatatgacgagatagattaacatgaaatacattacttcacaaggtatacaaattcaaatttaactcagttttttttacaagttatagaactcgaatttcaacttgcattttgtagagtggtatatttcctattaatatgtattattaatttttttataaaaaaactttatgactatttaggtggcatgtaagaaatgagaagaccagccccggtcctatgattttgagggcctcagagtgaactcatcgcgataggccctctagactatatataaaattttatgatatatatagacgctaattttacttgcaaagcgaacacaaatccattgaaatatttaatttaacatatttgataattatcaaggaataaagacaaccaaaataacaatatatttgtgcccttggaatcaatatgattaccttaacaaagaatagaactctatcacatccattgcttcccatgaaaagatactcttcgagcatctctagggctgaggacgagacgatcagattgaaggcggcggatgatgaattgagggtgagcggaggaggaattgaggatggcgcctagcggctagcgtgaggaattgaggatggcggcgcctggcagctagatcgatctgatctgatctcctgtctctgactctctatctccgtcgcggcatttccacttccaccacaaagctgcgtccagagctggccctcctgctgcgagcctgcgactatgcatattggctagttatctgctattaggtgtgggccccgggcactggagaagacatttacttgagggatgaaaatccatctccagacaatctccacaattaattaagagataaatcaacagttaattcacatatttgggtaaggagattgaaggataaagggataaggttgaactcctcacctccataaagtgaggcaatctccttatgatcttcatcatacataaggttgaaatctatatcatgtttatccttcaagtgaagtgattgcctcaaaaaaatgaatcaattgataaggctgaactcttatcttatggtgaaataagatatttgacaaatatttattctacttaacataagagtagatgtcatccataacatgtttatccttcaaatcaagaaatatatgggtctgtgaatcaaggcagaaatctcctcagcaatgggaatcatggggaaatgggagagatgcatcggaggcagaagcaagccaatgtcgaggcagcgcacgcaggaggctctccgtcgagcacctggcgactccgaggtggacaggaaggagaagccatgggcggcgcggtggaaagcttctctgatcgcgacctgcctcgtcgcgctgccggcgctggtgttcctcgccgtcggcggcggcatgccctccgccgtgacggtgcttggcggcgcgggcgcggcgagagcaatggcggagtgcgacgtgtcgagggggagatgggtgagggagccgagggggccgagctacacgaacgtgacgtgctcgacggtggccgactacgtcaactgccagaagttcggcaaggatcccggctacctctactggcggtggcggcccgacgggtgcgagctcccgcggttctcgccggcgacgtttctcgccgccgtgcgcggcaagcggctcgccttcatcggcgactcgctggcgcgcaaccacatggagtcgctgctctgcctgctgtcccaggtggagacgcccaccgacatgcacgccggcgcgttcgtggacgcgttccggaggtggcgcttccccgagcacgacttcatgctcatggcggtgtggacggagttcctcgtccacgccgtcccggtcgtcgccggcaggcggacggggccgttcgacgtccacctcgaccggatcaacgcagaatggacgcgccgcctgccgttgctcgactacgcggtgatctccaacggcaactggttcttccgcgccaactacctctgggagggcggccgccgcgtcggctgcgtcgactgcggcgagcccggcctcgcccacttccccatggcgtacgccgtcggccgcgtcgtcggcgcggcgctcgacgccatcgccgggtgcgcggactgcaagcgcgagctcgtcgcgctcgtgcgcacctacacgccggaccactttgagcacggctcgtggttcagcggcggctactgcaacaggacgcggccattggaggaggatgaggtgagctcgggcgtcattgcctgggagctgagggcggcgcagatcgaggaggtgaggaaggcgagggagaaggtgacgacgacgatgaggacgaggaggaggttcggcgtggtggacgtgacgccggcgatgatggcgcgtgccgacgggcaccccggcgagcaccaccgcaggtggagggggaggaatgccaacgactgcctgcacctatgcttgccggggcccatcaacatgtggaacgacgtgctgctccggcggctcgccgagctctcgccgccatcggatgcacggtgagatagtggcgcgcgtggaaacagatcctctgacttatttgtcctccgattttgagtggctgacatgtagatctcataacttgtggacccacgtgttagtcacccacgttggaggagtttcttcatgcgtgcccactatgaagaggtttcctttgctagctgagtactccctccgtccaattttaagcgcaaccatgagttttcatgtccaattttgatcgtccgttttatttaaaaatttttatgattagtattttattattattagatgataaaatataaataataatttatacataatttatgctttatttattttttttaaaaaaaagataaataagacggacgattaaaattgaacatagaaatttatgggtgcacttaaaatgggacggagggaggagctgttgatatgcagttgattcaccaagttgcaatcttctgaaggttttttttttagaaaatgtgtcacaatgttgcagtggaggggactgaaataaccaggtgaattaattttagctttatgaggccattttgttgggatgaaattaagatgacagtttattaggttgtactcctgtttcatataatgtaagatattttggttttttattctaagttaaacttcttttaattcgatcaattttataaaagacataacaacattttacccaaaaaaaatattataaaaatgtattgaatgatggatttaatggaattaatttgacgttataaaatgttactgcattttaatggaactaatttgacgttataaaatgttactacattttatataaattttatcaaacttggaataaaaccaaaacaacttccattctgagatgtagggagtgctattaaccttcctaatacattacatggacaggatagtaatctactactagtactccctccgtcccaaaatataagtatttttagctatgaatctggataactgtgcgttcagattcatagccaaaagttgttatattttgggacggaggtagtagttaattgccaaacaggatatatataggttggaaatgcaactatcaaactggaacttttgagataaagcaattatcaaacacaagacatcattttgtctcacagacctctgctctgctcatcaaagaacccctcttgttcacttgaagcatactagccttcttctggacatgacacccttgcagctgcaatgccaaagaaaaaggacttagcatcttaaataaaaactctccaagaattaagcagaaaaataacagtctacatgactacaaattcacagacattgacgtgagaaagctaaaattttgcagcatattcactcacaagaaagaacatccgcgccgtgttttcttcttcttcctgtccctctgctttgttggaggcttgattactaccttgatggcagcatcaaacacagcttttacattctacatattattgatatttgttaagggattacccaagctatatcttcaggattgaaatgtaggcaccttcaggagcatagagaggcaacatgagaaattaacctgctgtgtctttgagctgcattcgatgtaacacgttgcgccaatgtgcttgcggagttcctctccctgcaagataagcattgcaggagaacacagaaatgtaagatgctggaatgcagtgatatctcaaaattttgcagagatttactgtgaaattttcagtcctcaggtatgcagagtgcataggtactggagaataatacctgtgctgtagtcacaggcaccaagctaggatggtcaagtaagtagtgtttatcttcacgaagatctgtatggtcgacaaaagttgtggtttaattgaacagtaactgattgagatttgttgcaagataagattgtaggcttggttttcaaaaaaaaaataaaaatccaaggcgaaatgcaagaaacttgaaaacatgatcagcataattactaggtaaatttcactagcctatttcattcaatattactgaagtgcaaccttccttttaaaacaggtgcaacatttattttacttaagtatttagtactagagaattatcatctgtttaattaattgtagtggttactatgttagatgattaactgcaaaggaatatagtgtctcccatctaggtaagagcttggaactttgagttccggaaaccgaattcttgcttcggtaagttactaacaaataagcttcaatttaaagcagaaaaagtccaaataaacccctaaactttcattgaaagtccatctagaatcctgaagtttgaaatcggaaattcaaccccctaactttacaataccattcatatggaaccctaaggtggttttacaaagttgttttatttaattggcatataaattggatgagctttgatcatgtgacatacgcatatgttaaaattttcacttaaatatttctttttatcccttgttcgctctcacttataccattgtaaaaataatatgacatcactctatattataaattgacaaactacaattgatgatacataaatgtattatataagttatttaaagctgcttgtttaagatcccaaatacgtaaaaccactattcaaaatcaccttaggaggttatataaacggcattgcaaagtttagggggttggttgtccggttttaaagttcaacgtgctaaatggacttctatcataagtttaaggaggtagttggacttttccatttgaagaaaacaagaattggtatttccaaacatcaattatggaggttttgaaattgtttgagtgaaaaaaaaagagaaagaaacctcattggctcattcataaaccttgcctctctttttttaactacgatttacttttattttgttcagagaaaataaaataatgtagtgcaactaatcttagtgaaataaaaattaagatagttccaaacaattccttgaggaatcataatccaacagtgataaggtaaattgatccgagccggtgaaatactactggcaaggtacaagacagaacgtacaaaatgcaatagttcctacttaaacatcgcaaggactaaatcttggtgagttatagtaactattataggtccatcaatatttttagggaccacacaattccatgctccaagaatgaaaagacaaaatcatccaaatcactaccagcaagtgacaagcttagacagaggatgtacagcacaccagttctattatcacagccaaggggatatgcaataaaatggaaattgtgctttcactgtcacacaactcacccaatttggtcccaaccaacacaattggcacccctggtgcataatgctgaagctctggtaaccacttcaaggggacaaaaagcacaaggtaaacctaactgaaatactgaatctctctgaatgcatccacattatgggtttaacagattaattgcaagagattttttttttctgaaccttcttcatgacattctcatagctagctcggctcactagggagaaggcaagcacaaagacatcggcgccacggtagcttagcggcctcaatctgttgtaatcttcctgccctgtaaacaatttgaagtccacactatcagcatcacaagaatgaaattttttttcagctggaaggattagtaaaattacctggaaatgtagaacaaacaaagcatctgcaaaggaattacaaaaattacctgcagtatcccagagacccaaattcaccgtggtgccgtcgaccaccacgtttgcactgaaattgtcaaaaacagtgggtacgtaatcctgcagaaggccaaacaaaaacaaaaagaagttataaacatgcaacaaatttgaattgaaatattaactgtgattcaggaagaaaacacacacaagaacagagtttttctgtaactcaacaatgataccacctcttgtttccatacaagcataccactataccagagtccccaagaaatcaagaacaagaaaggaaaatctagaagaagttacagctggagcaggcaaatgaagaatcccgaaatttcgacgaaatcaagaaaaaccccgaatcttttccgaaaggaatgaacagaaaacagataggatggagcaaaaaggtttgcattttgcattacagtggggaacttgttgctggtgtagcagatgagcatgcaggtcttgccgacggcgccgtccccgaccgtgacgcacttgatgaaccgcgacgcgctggacgccatggccgccggccgaatcgagcagcagcagcagcaagcagagacagcaagagaggggagagaacttgatagagaggaggaggtgatggcttcttggtgaagcgatggttggaggctagagagagagagagggacagagggaagtgtcacatgcttcctctctgaactgttctcactactgtctatactgattagctagagaggccatccatccatcttttatctttggcgtcctgacgccgtgttctttctcgctatggggggatctggatcatctactgttcatcttctgaaaatggggtctactgctccactagttatgctggtaggctgctagtagaattgcaagaactgtttgttgttgattgtgcatttgttgataccctgatggtgtctgatgatcctgtagttgataagttggtttctggttgtctagtgctttcagccattatatgatgctatagtattcagtctttagaaatactccttccatctctagatatactaatttttagagtttagaatttgacttgaatatagcaacctagtccttttgaaagatgacttttgttactataaactattcatattacccatactatcccttgtctctattatatttggaacttcggacttacacctcacctatcccgagaaaacaaagaagtattttacgacaatgaagtatattttaaaactgaaaatatatagaccacatggaccattataatttattcgatttaaatataatgagagtgtagattaaggcaagaagggttgacatcatagctgttctgccaaggattagcacaatttggtgcaaagttacaaaatgacagattgcatgccaattctgaagtgaacagaagaattcagacgccgacgatctgagtgcaagtagtcagtaggtcagtgtcttctcttttcgatctccatcctatggcgtagtggcttgcttagcaagcacacaagtagtaagatgttgcaagaaacaaacgcaagctgtagttaagctggattttcttcacaatttgtgctttacgtctttttctcctctctctctctctttttgccgtcttttgcttggaagtttgctgctgaaaagtatatacgcaccatgactactgattagcatctcttcgttttcaataaagcagattcttgacgctaaactcgcccatcatccaagaaaaatggagttaaattattttcgttagtgtgcttatacgatggcgaaatgaatgttttataagattgtaaagattcagggtcgattccctcgtttgctctgcggcttattagctgtaactaaaatctgaattttaaatcttaatttcagagttgatttttaaatcttttttatcacagtttatttttagtattagcttttaagtcgctaacaacaaatatatatatatttctacccacaatagcatcatggcatcatgctgtagatatgggcggatctagtacgggtgctggggggacccgagtccccttatccttctagatcaccattgatagaacgagagagagaaggggaacaccattgatagaagaaaagaggaaaggggaagaagagggaaagaaggataggagagcttgtgaaagaagaagataagtctctcctgtaattccattttagatctgcccctagctgaaggagttgatgagcagtatattatccttgtaaagttgtaatacattgactgtagatatatcacaacaaattgcagaggattaccaagcaaataactcctcaaattaatgaaaccagcatgtgggctctttgattctccagtatttttgttgattcttccaggcacgcttttgtcttccttctttggacatgcgtgcatgcaaggctgatggcccaaaagtcgatcctaatttgatcttctggccaggtgctcctctttgcagatttacagctctttaatcattgagatccacaaaagaggctatgatggttgattatg

SEQ ID NO: 39018 - DNA, 3723 bp, Oryza sativa
aaatatgaggattctggcgaacacatgggttcctaggtattcctcggaatacccgaaatttatattcgaccattcaatttttgtgcaaatataaaaaaaattaagtcatgctttaaaacatttgacgataaatcgaataaaaaatgataattacattttatttaacaagagaatggtaaaacgtactggaaaaagttaaataacattatatattgtgaaatcggagggagtatttggcacggatgcaggtcgtctgcagcgttgtatgtgcagttgcagtactgctcatttagcggtatggcatgggccagcgccttattaactccgcactgcagcagccggtgtcacgtacggcagcggcgtgcatgcgtgcatccgactgcaggtgatgcagccagagaagcttttgctattgctcgtgatgcccgtgagcgaggcgcacacacatgcgcacacagtcgcagtcgctcccagatcgacaccgtgcggcgcgcggcgatgaacgtctaacaggtggtggcgccgatcgaggcgcgaggttcgcgccttggcggtggcggctaactgcttgtcgttcgtgtctacgactgcacccgcaaaatttatttttcacccattccacgcgtattaatacaaaaccaacccaatttcaatgtaattattcttttctcaaagaaatatggttcaaaagtatacgcaaaaaacacgcgtacacttacatctataagcacacacgcatgtgtcgtcccatacgccctcggaagactcgccatcgccggtacatcatataccactgaaagaataatttgttgtaaatatgagcacttattgactcatatcaagtataggatttaatccgagtgggctagttccaccataacaaatctaatctgttggcactaacttcattcttttttttattcataatatcttgattccctactctctctatcacattttaaacgtagttataagtttccgtgtctaattttaatcgtccgtgttatttgaaccatttatgagtacccgtgtctaactttgatcgtccgtgttatttgaaccagccataagtacccatgcttccatggcatgagatgggacgtggggtcgctgcgcgtcagcgctgctcacccgacctgcaggagatgtcccgagtaaattgtgagatggcaggcgctgcactcgcacagtactaaaaatgtgcgcgcccgtgccacgtacatgcagaatagcagaattcatatgcatcttacaaaaatgaacgtgtaaaaatcaaacagagatagcacctgcaaattaatgaaatacaccagaaccaaatgaaagtgccgatggatgaaacgagtagtttgtgagaagataaccgactgaattttattactactgttccatcccataatataataaattttaactatgtgtctaaacagtccaaaaataaaagtagatacattttaaaactctatcccataatataataacttttaactttttagaacagtgatagtatgttgataagttgatttaaaaggttttctaagattgtcgtcaaaattacgataattgaaccgtttagtatcttaaaaagtatgtacgcgataattcagtgtccatagtagtaataataaaaaaatagcaggctcattctatcaaaataacttgagagctatgttcatcagctcctggatatccaatgcatggcaagtactcaaggtataattgggcagaaatactctcaagcagatctagaaatgtgctttccggaagtaataattcatgtgtatcatgggtactatcacatcgtgccagatcgaaagggagtgtccaataccaatcatacgaccatgcacaagactacgtagagatcaagcaattcactacctgtcaacactagtacaatttggatcaatgctactggaacgaaagggatatgaatcgcacaaacgacctgccagaatcatgccaaaacagtgtcagaaagacgaaaaggcattgtcgattttgcttcaaaaggaagggatacggcaagtgaggaaaaagttcaggcaagaaagacgtccaaactccaaatcaccttcccttcggcggcaagccagtctcttttacgtacaaatttgacatgacaactactttggttcaaagaattggcaagatcacaaaagtcaggacatgaaaacaaaccaaattctggtacaaaagacacttaaaaatatatgttttggccgccaaaaagcactttaacaagtactcctgaaagcaggtaaaatgcacagaaaagcatagcctcttgttgcaaaagattacatacgtctacaggagaccagatcaaacttggcagtaagaagagaacatgcagggacgacattcagggtaagttttctgatattgcctcaattaatcaaatattcaaatgggagcaaaacttttgtaatattccccaatatctcaagggctccttgctatcattcaacctaattaatccaacttgtgatgtgaacctgctatccttggctttctttggtgccaccagactccagtctgatctgcatccagaattcatttgacactcaaaatcccaaagtgaggcttctcgtctagtggacactgttaatcagttgaggcaaaaatgtgccatgtaggatcacatgacaatctcagcaagcatcttgctttcatcaagtcctcaaatcttctgacattgcggaaggtatacaatgcgttgtcagaatatcctgagtagcagcctttgccgtttttgcctcaagaacaaccagctgccagatgataccagtcaattggaaagtgctcacaggaagtagcattgaacaaaagaggatgataatttcactatgaacaatggaagagagaaagggcgctaataatccacatctgatacctgatcgtagtccatatcaaattttaagtattcctcgttacaatcttccaccatggttgccaagtgctttaaattttttactggtttgccattgaaagaaagaacctatagagaataaaaacagtaaaacacaattaatttaacacatcaaaggcaattttgttcagaaaattttggtcttctactactcttagatagtcaaatatagcaatcagaacaataaaatgtccattacacttggtaactaactaccaatgttgttagttccctcctgagatttatttccaccaatttcaaacagaatactgcttatggctgttaacttagctaatatatataacagcagttggagacaaccaattctgatcagcatcattcaaaatatgaaccggtgtagtgcaattgatacggtcagttgaagaacacccttttctggtatggagtatatatatgataacttgtgaaaataaatctcaaaccataaaaatactttcagtagtgatcattgttacctgaatattgacaatttcttcataaccaatgttgatatctgctacaagaacctgaaaattcatcattttttttcaaaaaattgtcatatgatgaaataataaataccaagctctaaataaaagcaagaaaggttagccatctcatttataacataaaaacataggttagtacagaaagaacttgagacctgtgacaccaccacaagctgctcgtcaggtgattgagccattgcatgtaagtgcttgtccaacaacttgacaggggcatcatactcatagtcttttccatactgatgaaataagattgtagttagt

SEQ ID NO: 39019 - DNA, 1182 bp, Oryza sativa
gtcaacattttcaaccaaaatcggataagcaactagtagtccaacatagaacagacatttgaaagatgtcattcaggtggcaatatcgcttccttctacaaggttggtgaaaatgacgcgtgaaacatatagtcattgatatttgtgaacatgactaaaaattatccatgttttcacacacaccagagcacaaacagaaatactaaatcactacaataaaataagttgacgataatatataaggtttgtgaaagtctgttaacaaaatacatatacaagactaagcacgcggtatatatatatattcaatttaaaaaataaagagataagttaaagatgaaaattacaattaagatcaagctttccaaaaatgcaacaaaattgtactgaacatcgtacagtagtagaatgaaaaattgacaactgaacaaggatgtaatatcttgattattatttcacacataaagctggacaagggagatgacagcatacctcagatcggagatatggaacagaaacaaccataaaaacgaagcctgcaacaatgtaatatgatggtggcctgccctttatatgagctggaatgagtcttttgtgagttgccagcttaatgttaaattcaagaactttcgaattccgcagaattttgacatgggccttctcgccagtgtacttctgcgaaatgaggtagctgaagccaatacgctccccatgtctgaaaggaactggataaccaagataaacaaaatgtaagccaatactctcctccttaagtcatacttcgtaggctacattggagacaaaccatttggagaactagtaataacagatgacaagaactaagacatgcagcagacttttaaagaagaaaaatcccaatgctttgtgctagacaatacgtgcacgttgaatgatgtcatttatggtcagtggagatctccattcaataaccccgcttagaacgaatccttccagaaccaaataatctagaaatggcacagggagtggggactagaagttgaacctgagacaatggaatctctcttgcatgaaacagagtgtcctagaatgcatgctcccaaatagatacaagaataactggccaaggcaaacaagttctaaaacaaaagcagtagaaataatcgctagttgtgtaaagctctgactaaccgggctgcagga

SEQ ID NO: 39020 - DNA, 3216 bp, Oryza sativa
  unsure (1)..(3216): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgacaagtcaactgagcagccattggagcctgaaaatgatgcatctgtcgaggatgagaagccaccggaaatcgaaagtgatgatgtgcatgataaaccatcagaaagcaccccagatactgaaaccctgcctcataacactccaaagagtagcataagcattagcgaagctgcagacggcaacgtttctgaggaggcaccacctcagagcagtgcatccatagaaacgccatcagaaagtgccatagctgtcgaggaaccaaaacacgacgacgaggccagcataaagccatccgaagacagcagtgctcttgaggagccgccgcaggacgatagcgccagcgtggagccatcagagaacactataactcttgagaaggcatcagaggaagatgagggaagtgtaaagccatcagaaggcaatgatgctcttgagaaaacattggaggaggatgaggcgagtgccaagctaccagaagacagtacgacctttgagaagccatcggagaaagatgatgctggcaccaagcagacagaggaccctgtaactcttgagaaggaaccagaggaagacaagggaagtgtggagccaacacaggacaatgctggtcttgagaaaccgttggaggaagacgaggcgagtgcgaagccatcagaggacagtgtggttcttgataagccatcagtggaagatgatgacagcgccaagccatcagaggatagcatggaccttgaaaagccagaggctcacaaaccatcagaggaagaagatggcgcgaccaagtcatcaccggaggatgctgccgttgaggaggcgccattgcaaggtgacacagaaacagccactgacaaaccctcactagaagcagacaccacagaaactgcctgagctggttacagttagttagcaacagtacacagtttttaacccagatgggtggatactactgttgatactttggtttgccattttgcttgttttcttgttttgtacaatgcttgagttgtaaaatttgagggaaaacagaaaaggaactataggtattgatttgatttgctcacaagcaataagcccctcccaatattaggaggagagcagcattgaggatttgagctttacatacttacaatatagattttgcgtgtggcttgattaatttgttgtacatcggatgatgtaaatgatatttatgcaaattactgtgtgcttttgctcatttgtctctgataatctgtggagctgttcttgattgtgccttgtggcttgtggtttgaatttcaattcatccacaaatttcagaaataatttcttggacaacctgtcaggccttctttgaaatgggaaaaatttaaaaggtttttaaaataactgaactagtagattctacgaaaatccagtaaattctaaattttagggttttaaaggaaccctgatgaagaagaaattctaaaacctccccaaaacccctgtggctctgaactctgaagtcagcgaggaagggagaaggcgggagttctccatggctccgaagcggaagccgccggcgagggcggcggcggcgaagttggaccccgacggcatgttccgcggcgtctccgccttcgtcgtcccccacgccgtccagtctcgccgcctcgaggtcgcggctccaccgagcaatccatcccaacccccaccaactctctctcctgtgcttagggtttcctggctttcgtcgtcggtgcaggtgtggaagcagaggctggcgcagatggggggacgcgtccaggagaagctcgccgccaagggcggcggcggcgcggtcacccacgtcctggccgccgacgccaaggcgctgctccgggagctcgacgccgcctggctccaccgctttcgcggggtaatcggcttggctccctagcttgaaaccctaatctcctctcggcaagcttggtgtgccttgctaccatctgcattttcacagcccaaatctactgctagtagtagtactacattgagttatagagatttcataacatggaaagatttctgctaacatcaagtgattgtgtttctttctataaggactggatttttgttgcagagagatctcggctaacatcaagtgattgtatttactactataagaactgattttttttttgattgcagagcgtggtgtcattcgagtggctggaggagtgcctcaaatccggggagaggctaccggagcacaagtttgctatcaactacgaagaggaatttaagccgaagaaggaaggtggtgctgcaggttcaggtgtgttgcagtctgcaaagaggagcaaaatatcatcagacggtcctgagaatcggaaggaaactgctgggggtaatcgagaatctcgagatgcaattgcacatccaaatgaagattcggatgttgtaaaggggcctagcacgtgtacaagtagccaaagtgcctctggagattctaaggaaaccatagcttctcaaaatgcattcaaagctgaggtataagcatggtcttataaattatagtacaaactaactgggctctaaagtctgggttatgttgttttgctgcacttatcctctttggtttgctcaaattcgtacaagctccattctgaacatatgtaaacaaaaaagaggaaacactttttagcttctcctttttgtaattagcttactctaagctctaagttacatctacactgacttcaacatgactagacttgagactgtttttcttctgctataaaaatgtacgcagttgcctttatctgttcaaaaatgaaaacactgctgtagcaactttaagacctttggtggtcagctgtatatctattttgcaccctcaatggtgatatattgctctgtaccatacaacatataactcctgaaccctgaggatttatatttcctagtgttgattcattgcttatataactaggaagcctcttctggagaatcctcaacgtatgctcctcc

SEQ ID NO: 39021 - DNA, 1702 bp, Oryza sativa
ccatactccctgatatttactgatttgcatatcaccttaaaggttcgaactgtcagcctatttggcgaagtttggggtgttggtcctgcaactgctctcaagttatatgataaaggacatcgtacactggatgaccttcaaaaagacgattcacttacaagtgctcagaggattggcctgaagttctttgacgatatcaaacaaagaataccccgacatgaggtatgtattctgtaagcccattgaattgttttcttttcctattattactagctattcgaagtacaatctaacattacacgtattttactctcctgttatctaggttagtgagatggagaagcttttgcaagaagttgggactgatatcttgcctggggtaagttccatatagtatttaaaggaaccatttgtctccattacatataactacacaagccattcaaaaactaatactgaagcatcagttccatgttcaatttgtctcaacatatgcggtggttattgtttcctgtagcagctagttgcttacacctattttttgtagttccctattagtctgaacctgactacttattttgtttggagaactagatgggttggttcatcaccattcctccagtcatcctctgaaagtacacatccagtacaaaaatgaggaatggggtcatcctatcgagatcctaggccgatttgattcttgaaaacaaatagctcatatatttaagattttagtagaacaataatttcccttaagtgattattgggttgttatacatgatcttttttatttggaggtgataattgtatgtgggggatcatacagacgtggaaaatcttcttgtggtgacatggatattattatcactcatcctgatggtgaaaggtatacttcaaaactttcaaaaattgttggttattgagtatgccacgtgatttttatttaagtatgatgagaaattacccatctgctgtgcgttcagtgtattctattgaattcaacactgaaccttggcaccacaccaaacagccatttagttattttacagtcatggaaagttattttctggcaacttgtaggtttggtttatcaatttgtcatctatcataagcataattattcattatgaccaagtttctattatgcggtctgcacacaacacatttttatataagaacatcaatgattaatcatctggacattgtaaaagggaccatacatttttctccagtcatgtaggctttttaccaaaatttgttcagcgcttgaagggcatcaattttttgagggaggatcttattttcagcatacacagcattgaggtaagttcttggccactactttcagagattttgagaagagtgattataaacaaatgggaaagatcacatttggtccctccacttctgcttggatttaatttatactctgaacatcaataccgcttagagcacatgtttcaaccataaaaactgttcaaataacatcccgagtatattttttatggtgattttgggtgacaaggtatcctatttacttatgggttgatatgctttaataatttaccaaagaaaatttttgttctggttttttccccaaatgaggtggtgtggataccatgattgaaaaggcagccacgtaatccagaaacactcaagaacttctatgaatgtaatttacactgctttgatagcaatggat

SEQ ID NO: 39022 - DNA, 3720 bp, Oryza sativa
  unsure (1)..(3720): unsure at all n locations
atcccccagattattagaacgaaccgcattgctcatctcaatgcagggaactgattgtggagttgacacatattttggtctttgcacatatcctgggcgtgagctgcgccatcgcatcgacctcaaggtataatattattccagcaggagtaatttggttcatgtcatcttcatttgacaggatttgtttcttattgattaaaactaaacaaatttcaatgttccttttgctgtttgcatctccagtgtcttcaatagtcttggtcttatgttcgtgacacatcaacaaagcactgctttgttctttgtccttttatttatggcattggcatgaatgtgattataaacttacaatccttcatcttggtaaataaaacaacatttatagtgatttccccatcgactatgccatgcaatatatgctgcataacattcatgtaccaactcatgctgataaaatggtgacaattcgatgttagaaggtatacccaaggaacagacatgcatttgggctgcttgcttggactggcaatgatgttctgaatcgacggtatgcatttgagctctttagtcatacacgttatcatgatcaggaatgcaagaccacagcttttttttacaagtttcgtaattgaaacatgcagattaagaatactagcagattccaaaggctacattcttgacgacactggtttgtatcttgctacaccgggcagtggtggaaagcgtgtatgtacatgtgatttttcattccaaatccatacaagttgtttgctttgctccattcattgtgagtttttgcaggggggaagatcagatgctataattaattgtgacaccgagaaggatgtgttcgatacacttggattcccctggttggaacctcacgaacgtaatctctagcctttgtcgaaacccttctgtagaaaatgcagtttgctagagctatataccttttgtatttcccctactttctattgccagtaggctggctgtttccaaacctgtctgtagaaattaggaaaaatgtagatgtagtttgctagatttttatagttttgttttctcgtactgcagaaaagcagagttgtttttgtctttgacacttgccgcaatggtcaaactctcttttgctggcatgtactaactgcagacaacagtatatatataactctgttgtaaatccatttcttatgacctctcagacatcacaatggtttgcaaagatcataagcagagtttgcaccgcagttgtgtctatttttcagtcaaatcaagattatttctaaattcaacaatgcaaggcctcacaaactatcaagcaaccatgcatgataacacaacggcaaaaaaagaagtgatgttaaaccatatcccatcggggcaacaatgaacacaaaacatacaagaattcaggcataatgtggttcatcttgaatgttcttgtgaaatttgacaggtcaaaaggcatttcttaacctgttacactgagataataatcacaatcctaaaactctcctttctcttgacattgcctatccaagttccgcatgcagactaatgataatgctgcatcccggacactagtagtggtgtcaaatttgtaggcataaacactcaaaagtcaagaaaaccctttagtccataagtagtaccctacatggatgtgatcatgtgaagattatttacatctctctgtgcctaaacctacaactggaactaagaagtggaactagggcagcaaaaactgtgatcatcagaagctattgctgggaccacctccaagcatctcctccctgtcgatgaagcgctcaagaagctccttgttcttggtaacgatgcattcatcatccttgccaaaccaatcgtagcgattctttgcaatgtaatcgtagattgcatcccgcagtggggcggggatgatcagcagggagctcaaagctgagtagggaagaggcaggtacgatgcaactttcaaagcagctgcaaccaaaacatggaagatttagtaccctgattaccacaggaaataagggtgggcaaatatgacatgattaaacagcaaaaagtacataaagaattgctgtttattttttttccctaaatgagtatcattaaaaggatccttcagttagtactttcgatcttccagttagtgctgctatatggacagtacaaccatatctataatctatgtattctgccagattaattggtgtctcagggaatgattgagctacattatgaaaggaactgtggcctctagaaatttgtacttttttgcaggagcacagcaatggctatcattgcaataacttggttgaacaaatgcatgatccaaaaaaaaaatactagagtgtaaagcatgttgctctcatgcattactggtaaataagggggcacacctatctatcacaaacctagcaaatgttgaatcctgcatttgacacaactcataaacaccagaaagaagttcagaggtgatcccattcagaaaatcaaagccataaccacagacactagatggtactgaaaatcacccaaagcatttatcaagtggcctctaaactccaatgccctccatgatggcattcttgcagaaaatgacaaagaaatccactgcatttcccaacgaattttgcctcatgccatgcaaaattgctacaaattcaaacaaggtatgcaaatccagcgagtacagggtactaactatcactcactggtatccatccaccaatggttgcaaatttttctaccactcttagatccccagcattgctaatctactagtccgttgatacagagcaagtttaatagtatagcccactactagctctaaatcatctatagccaatgtaatagccaattcatacaatagttgcttattacactattaatatctggtcccacctgtcatacacacattacgttttggagttcgtgctgtagctggttacagatctatagcccgctgttcttctctatcttcatttatctctttaaaatatatttatagctggcatatagtatgctattgtacctgctctaacaagtagccaacatgttcttggaaagatcacaacattgccccgatttccgaatcatcagagatgcaatgctaacctgtggatccctcgtagtaggcctcaggcccctcgatgaagaggactcgccgcagcacgtcctccctgtccatcccgaccagtctcaggtacggctccgcggccttggactgcacgcagcagaacctgatcttggcgtgcttgtccgccttgatcacccacttcacccctgcaatgcaaagccccaaaccgcatttcgatcacaaccaaatgcccccaattcgtcgccgattcgaggtagaaatgagtccccccacaattgggggcctgtacatgtgctcaccgcggtggcagaggtggcagacgccgtcgtagatgagcacgcgcggctgcaggacggtgggcgcagtggccgcgatggagacggtggcggcggcggaggcggaggacgcggtgcgcggcgggggctcctcgtcgccgacgacgacgaggtcggcggccgcgcggggcgcgtagccgcggaggcccgcggcagcgaggagggggcggacgcggccggcgagggttcgggtgagcattctctctctctctccgccggcggcggcggcgcggcgaggcggtggttgtagggggatccactagttntagcctggccgcc

SEQ ID NO: 39023 - DNA, 8738 bp, Oryza sativa
  unsure (1)..(8738): unsure at all n locations
ctcggccctgcactttagaattctaaaaggcacatttttttttgtcaaaatttgaataataaaacttaattttagagttaatttaaagatttttcatcgtattttttaaacattaacgtttaagttgttattagttttaaccgtaaattatttttaatcgataatatgttgtttggcgcattatccgtaattggccaaccgatgaaagcctgagaatgaaagtatatactaacatttatattaaaattatttttcattgctttcatcactaatgcttcgttcgttttttattaacttttgcaactccattcaccgtgagcatgctttctaaacatcaattgaatggtgcttttttttacagaattattttatatataagtttttttaaataattcaaataaaaccatttttttaattttgtaatagttaaaacttaattaatcactactccctctgtttcatattataagtcgcttttgatttattttctcatttcgtaagtttaaccaagtttatagaaaaatatagtaatattttcaacccaaaagttttatatgatcacaatatatttacattcaatgttacatttattgaaagtaaatttaaagttatagatattgttaattttttttgaacctaaaaaagtttaattatacaaaagacaaatcaacttataatacgaaacgaaagtagctaataacatgtctcagtttcatgtgcaagaaaacagctcagtacaaccgagtatatgtcccttttcaagtcacattcaaaatattgtaaaatattggggattctaaaaagttaaaaggcagttcagattgtaatcaaattaaaccttatcaaattttgtcattggcaacttagtaatattgccaagttttaacatgatttcttatgtatttattaaagtttggaactccctccgtcccattttatgtgcaaccatgattttccgcgctcaactttgaccgtccgttttatttgattttttttcaaaaaaattttaaaacataagtcacgagtaaagtactatttatgttttattatcacataacaacaaaaatactaattataaaaaaattcaaataagacggacaatcaagtttgtgcggggaaacttatggttacatttaaaatgggacggaaggagtaaaaactaagggcttatttggttctctaccctacctatttattggtagtgccaaaatctaggcaaattttggcactaccaattttttggtagggaaaagttaattagactacttttggtttaataccaatatggagccaaattttagtagtatggtgaagaatattctagaatatgtccaaattgagtatgggcactatcaattgtttggcttcaaaccaaactagcatatttactatttaaattaccaaaattttggtagggcacagttttagcttcaatccaaaacggtcctaaatagatgcacatctttaacgacatttcttaaaaaaaattggtatagtttaaaatgacatcaatctgaacaatccatagaaacatcactagcctaatgctgtatagagaccatgatccatggagtagttttttctgaaaaaaaaatgtttttttcatttttttatcacatctccttccagattttgttcctttccaaacggtgaaacggtagaacccaaaacctcaactccaggagcttccagctccagctcacccctcctctttcacgataagaggcacccagacgaacacctaagctacgcgcgcgatgctcccatgggcgccgccgccggcgacggcggccaccacctccccggcctcgtcggctccgctcctccgcgccatgccccggcgcgcgcgctctccgcgcctcccaccgcccccgcaccacccttcccctcctccgccgccgcttctctcggttggccccggggcggcgccgcgcgccgcgcgcccttcccacggcgacgtgttctgggaggagccggacgacggcggctccgggagcgacgacgaggatggggatggggcagaggccgaggccgagcggcaggaggccaccgggcggaggagcagcttctcctcgttcccttccccctcgctgttctccaggctcggcgccgcgcggcggcaagagcagcgagaagaagaggagcttcgaggaggtattggttcatctgctgcatgcgctagacaaatcaaattttcttttttcatttttcagtttcttgatcagctgaattgaaatgcttcatgttctacacttaattctgtcgaatttttctgtctagaaatcgagcttctacttgacgccctgatagataatgagnctatnncnctagngnattncagnanancgagnnacccctcgagatattccacccaaaatatcatcagtaagtgtcactctgtaaatgtctgacagatattatattttggtgtgtcataaatttgttacattgctacagatcttgattaaggaaatgtgcacaccattgatattttaactgttcccaattcctgaaattggactgttttgtgcagccgaaatggcatccacttcatagttacgcattggcgctgcagatacctctcatggacagcctgctcgatagtggtgtcgatatcaatttacttgacaaagtatgttctttctacataacatgttgaggaagcatgtttcatgctcatgattttctattttggtgcctgtgaaaaaccccatcttggattatgcctgtgaaaagcttttgcgcattcacgaaaaagaaaaccgtgttaattttgggagtgctgatgatacaggatggtttcaccccacttcacaaggctgtcataggcaaaaaggaggccgtcattagccatctcctgcgaagaggggcaaatcctcatgtcagagatagggtaaccttgcaaggctgcaatctctttctatgaattatgtgttccataataacattagtatgtggaatatagtaaactttgtgatgttagcgcctatcacattgatctggtttctctctctagcaacataagtacataacaatttccactccagtttgagatattttttatgtcatgttggcccttgaattaaatctgtctgatttgcaggatggagccacaccattacattatgcagttcaagttggtgccctgcaaactgtgaagttactgattaagaatagggttgatgtcaatgttgctgataatgtaatgtgctatggtgcttttttttttcttattagttcaacccttttcagtgccattgatttttcttttattttgtctcgtttcatgcaggatggctggacaccgttgcatttagctatacagagtagaaatagagatatagcaaagatattgcttgtcaatggtgcagataagacgagaagaaccaaggtatgttatgcccctatggtttactgggtttttttttccggaattgcattatcccaaaaaattagacctataacagctgcctcttgtgcactcagagccttgattttatttggcaaattggcatacattttcatgtcatttttagccgcttcacagaaattgacttctatggcattgtcatctcaaatgctcgtatttccatggacatcagctttgtattacagtctataggccaatactgctttctgatctcagatttggttacaggatggaaggactgccttggatataagcttgtgttttggaagagatttcaagtcttatgatttggcaaagcttgtcaaacttgttccggcaaatagaaaaatgtgactcagctctgtcacaagaatcagagaaaaaaaaaagatttagatgttagcaactgttgatttgggtcattcctcctattgtttttaatgggatgattcctccaatttgctatagttgcttgttcaatccatttttagaacctgtttattttagagaagttgtctaatcctgattcatgatcaacttatgtaaaggggttcgaaaaagctaatgccacaatggaagaaatagccaaatttagatgatctttttcttatttgcaaaccgaggttcctcagaggcgttattttaaacgtttgatgtgttaccgttcggctatgtgaatacaaagctggctaagcaaacaggacacctccataaaatgatctcactgagattgcataacagtcgttttgtaattggattaataaaagaagtaaggatcaccacatacataagcgagcgttaattataaatatatttttttcatatcgaagccaagttttaaacctcagatgatttcatttggcgtttagaaagagttgagaaatgcacctgtctaggcaatgaaacagaatgggattgcacataaacctcaaattttctgaacatgcaattatcacacgactagctacagtaagggcgcatgtttctacagctacagataagacacatgtttctacagtaattcatggggtttggcaacatgtcactgcaaacttccaaacagagcatgtaaggtagacaaacatttcacacatcattactatggtatgagtaactagtacaccttaaacagcaaaattcatgcaacataaatttgtagagatgacacaaaatccatacaataggtgcaatggcactgcaggctagtaaattcaagagttgcctactcttgcaaggagatgcgtctaaagatggcctggaaagtctgacctccatttcttgcaaccttctgaccttcttcagtggcggtagacagtagcttgacaactgggtctgcttttgtctcttcctctgggatagcttcgaacagcgggtgtttctccaggcatgaccgcatccattctccgagctcctccacatctgtgattgtatatatgattcctcccacttccatcacataagcatactcatctagcagctgcatgctgatcaccctcgccggtggttcttctccttgaagtgaggatcagggaacaggaagaacattttcgaaagctgagccttcctgaaatagtttggaatgtatttcatcgaattggtgcgcacgacagatatgttgtcgtactttcccggattcgatgctcttaaagccaaaatccgctctttgacatactcagtcacctgaaaaatatagacaacgaagaaaaaaatgaatcaaaagtaaatacgtactagctttgaaaagaaaaaacttccagttcttttgttaagtagaaatacatgtctattgcataatataataccatcacaaactaaactatgcaacttttgtctagtagaaatccatatttactatagaatctaaattggaaggcaacccaaattcccaatatttggtacactaaacattcatgaagtaaaagccatgcgcgatctaatcattctacaaaggaaagctcaaatggtctctatgagtaatgtaacactgaattcttcagtgtcaccttgtgctgttatccattcacacatgaatgtatctctactgcccaatcaaagtttagggggaaattctaacaaaccttgtccctgagctccatgccgatcatgagggtgtccgggaagagcgtagagaggccgacgagcagcccgccgaacccacacccaacgtccgcgaagcggatccgtggcaccgccgcgtcgccctggcgggcctcgccctcgccggaggggaagtaccgcgggtagtgctgcgagaggtctacctcgtcgggcgatatcgggatcgggaagtgcgagtcgctgagcgggttgctgtgcgcgcgcgcccggtagaaccgcttccgcgggagcttcccctgcccgccaccgccaccgccgttcgcgccgtcgccgctcgccatcgcgccgccgtccccgcctgcagctgcttcttggtctgggagaggcattacgccgaacacccggtgagcatgtcactcgacgcgagcggtgttgtgggagagggaagcgggagaggggtggggagggagtacgaaccggagagagagagagccctcgcgagtcgggagagcgggggattcgccggaccggtcggcggcggcggcgtcgtgggcggaagctggcttggcagcgagtctcgagccgcgcgggttagggcttggatgttggagagggaaatggaacgaggcgggggaaatggattgggccgcgcgagttggtttaggccctaagctgcagcccagcagcgacgagatgggccaagtgccgcgaaggccccgagcacaccgggtgttcggcgtaaggaaaaagttcagctgaggtcccttatgccttatcttgctatcgtttttaaaattattatccctgaatagcagatataacacatcccgaattttacaaaaccggatcacattggatcccgaggcagtattgcttctggttttgtacaaataggaagtactccctgtgtgtttttcttggttttgtcctttatcaaactatgcaaattttaccaaatctattaaaactgcgataatattacaatatcaaattattttatttaattctaccattcaatataattttttagaatatttttgtttagtaaacttgattaaacttgataatgtttgatttatgacaaaaccagaacacctgatattttaaaacggagatagtatatcactacgttagtcatcataaatacgtctgtaatgtcgcatgatttttttattatatcttggttgatgttaaaagtgataatcagaatgagttttgcaagagcacaaaaaagtggaattggtgaaaaattgcggctgcatgcgaagctatatagatgtagcagcatgcaagttgtctacttgtctgcgtataaatctaccgcttcaaatcaaataatgatgctcgtcatagtattatcatttcttcagaagaatatcttcggctattactccctccgtttctaaatatttggcaccattaactttttagtacatatttaaccattcgtcttatctatatgtatacatatacgtacatttaaaaatgaatcaaatgataggaaaagaattaataattactaattttttttaataagatgaatagtcaaacatattttaaaaagtcaatagcgttaaatatttagaaacaacggagggagtattattcacaggagcatatctctggccacatatatttctttacaggctttagcagtgaagattaatgcatggctagctagctagctactccctccatccataaatataaaggattttggttggatgtgatatatcataatacaacgaatctagacaggagcggttggatgtgacatattctaatacagctcctgtccaaattcattgtatcaggatatgccacattcaagcaaaattgcttatatttagagagagacatagggagtagttcgttggctctgcagactgcagcagtgtcagctcgtgatatactcctccccagtgtgttgaatattggggctgtcagtaaaaacttgagcacagaaaagggaccttactaaaaatggagcatacaacggtaaagttcacccgttgtggaaagttcccaaacgttgtttccataggagtcgggccgtgtttcaacaccgctgataattcaagtttagccagtcaatttcgtccttttaataaaaccagtaatcatgcacgtgcaatacatgttctttccatcataacatgtttcgactaaattttacaatttatcagcatgagcccttaaaaatattggcggttcatcttgagaaataaagcaacacttcaatgtgtaaaaatacccactattatacactggaatccatgtagctaagaaataaatctatttaaacagaagtgaaacaagcatcatttctattttcatgcaaacataaatgaacaaacaaccaattcgtgcacataggaatccatgtagaatattaattgagaaaacacactcattcttacaatctaatttgaagaggaggtatatattataaatccacactcacattattatcctttcatcacaacaataccatatagatacacccccaagtgttgcacataattttgttaaaacttgagtgccccgggccatacctggaggaccacctcaacaaatccacaatggatttagccatgcagaatcgatcatccaaaaacaaattcctaatacatgaataaagataggtcacaagttttagctgagaaaaatatcacacatatacaattgtacaaataaaaagttatatctgcaatcgtaccagcagacctgtaaaggcacctcaactctaatgctaacatatttgtttccatttggcagtggaactgatcatctgcacagtcagaagaaaaagaacataacagtagatttgtcaggatcaatggacgtgcaaaaattcaccgtataaatgttcaatgggtgaattaacaatgaaaactttgatgtcaggtcacaactctaggatcccacttacagaacaaccaagatttttcaagaaatttatttctgcttcaatctgcagtttccgtttaaccaatcatgaggcaagtatgccaaaattttagtggtttttcctaacaatattgcctataaactataattacttcactaatcctgaacctatttcgataaaagaaaacctagaaaatccactttgcagtttgcaccacgtcgagcattctcattctcattgaaacaaaataatagatatttttgtgtcattccaccaatcatatagatcatctcctccaaaactaatttgtgaactatgggaatttgtccatacatattttagatcattaaagcatctgat

SEQ ID NO: 39024 - DNA, 2878 bp, Oryza sativa
ccttcagtcttcttgtcagcaactccagttcatcagtctccacacctttgaaaagtggtttccactgcttgtctttgcactcaggatgttgataaaatacaaattaattagcctcattttgttggtaaagggatgatgcgagtactattgcaactgcctcctagcatcctttccattttgttttcctggccctttagctcattttcacttctagaaaattataattggtaccctttatatttagtctaaatcaagactaattacctcgtctgaatagaagccaaagcatgtgtaggcaccaattgttcataatttactttccaacttccttaaatcctaattaaaaaaagtgatcatgatataccggtaatcacatgacctgtagcagacaacgtggtatgttcaatttataaaagagcgtatgctataaaatttatgtgtattgctcatgtatcaacccaacgaattcattgtaatctagtaattcaggttcagatgaaagatcaacatattggctattcacttaataaaatagcatcaatatgaataccaggtataggtacataccaagaaaatgttcaggtttgctctgttattccaatttcttacagattttcctacaaaattaaaagaaactgcagtatttagcaccaaacacagccaatgattatgcattaaggaaaaactacataatttacaaatctaacctgaagtagttaatgtaaatcttcattggtcatgagagcaacatcatatttcaaatagcaaacaccatgttcaaaactattatacataaaaatattggtaattggtgcagcccactaattttaggatgattttttaaaaaattacctcaacacaattagaagaaggatcgatgtagactattgtagggtttacgcaaatacatggggtgcttgactgctcgatccagcggttgtggcatggcggttgtgggtaggataatggcattgatgttgtctcggtagcgaccggggcgcagtacaacggagtacttgaatatgttaaaatagctcttcaatttggtgctaatataaacagactcatcaaaattccccaaatctacctcttgaaatgttgatgctttcccttccttttcaatccatcttcccaattcccaaatccacaaatcaggtattacaatttgcaaatcacaaataagtatatgagaagagaaaacaggatcccaagcccagctagcaaatgctggccgactgatgcggtcctgtttgctgcttactagggaggcagctgattgctcctcggcgcccacccacgtgctggctttctgcccgcacaacacagttgcattgcgctcttgtggcgccgccgccttggcctctggtagtcaggcctcggcccaccaccaccgccaccgcctttcgtaacgcatgccgcccgtgcccgatcaccggcgccgcctccctcaatctcatacgctcgcggcggtagtggcggctagggacgacctcggctccggcggggacagcgatggagggcagtggcggctggggacaacctcggctacgtcagggggcagcggtggagtgcggtggcgggtggcggtggctacggccgggggcgaccacggctcggtcttcggtgggggtagctgtggagtgcggcaacagcggcgacagccgggggagacctcggttccggcggggcagcgatggagtgcggcggcggcaacacggctggggacgacctaggcttcgacaggagtagtggaggaatgcggcagcaacggggacaagcaaggaggagcgaggagcgcggaggcggagtcttcgcgcgagctaaaatcatgatggatggatagggtgaaatcacggtcgctgtgggaagggtgaaatcgccggtgaacggtgcggattagggattaggcgatgcggatgcggatgaacggtagggattgattcgggtgatttggcctgtaggattggagggggacaactcctcctttttatattagtatagatatgatgttgtaagtttaaccaccagccaaacaacgttcttttgctgagttgggatcctctcctgtaatgcatgtgcagtaagtgccaatgacatgtgggcccggtataggtgggacccacatgcatgtcagtgacacgtactgcaggtgcagtacagcagtggatttgcgtcctcttttgctaggttctcaacttctgcactccatcgtttttagcttcccgagctgttaaacatattttgcaaaaattttctatagaaaaattactgtaaaaatttataataatctattttaaaaacttttatttactagtacttaattaatcatgtactaattcattactctatttacgtgtcggtgtgaaatgttcccaacacagcctgacgaacgacacatcatcctcatctctaggtagcgctagctgcgcctctcgcagattcactacaaatgaagacttaccggcaccggccgcgggttttttgtcatggttgtacaatggcactgcttttatcatcatgctatgcacactactacatgaaagatttttctggacgccgaacccttttgtttccaggcggaccatatgtggaaccgcacaggaaaatggggggaccggcgctaggccatcgctcacacagaaaaatcaattttcatgtgcggttccacatatggtccgcctggaaacaaaggggttcggcgtccagaaaaatctttcatgtagtagtgtgcatagcatgatgataaaagcagtgccattgtacaaccatgacaaaaaacccgcggccggtgccggtaagtcttcatttgtagtgaatctgcgagaggcgcagctagcgctacctagagatgaggatgatgtgtcgttcgtcaggctgt

SEQ ID NO: 39025 - DNA, 9697 bp, Oryza sativa
aaacccaccgaataggattctagctaaatacactcacttcactttcatgaataaatttgtaagagtgtccaacatactatattattaataaagtatattatacaataagtatataaaaaatcccgttcatcatgattaaacgatttacttcctctatcttaaaatatagctatttctagcacaatatcttgtcccagaatgaagctatttctctaactacctcctcctctcaaccaatcacaaccattcttcttcacctatctcctcttttcaaccaatcacacacctcctccaatcattcccacctacttttttaatactcgtgccaaccttaaaagcaagtttaatagtacagctaactactagctcgaattcatctatagccaatctaatagctcattcatacaatagttacatactacactattaatatatggtcccacctgtcacacatacactgcgtcttggagtccgtgctacagctggctacaaatctgtagcccgctgctcttctctctcctcatttatcttcttaaaatatgtttacagctggtttatagcctgctattgtacctgctctaaaaatacctatattttgaaacggagtaagtagaagatatcagtgatcaaattaaagcatgcactgctactctaaattatagaatattatgaaacggagggagcacattcttttgtatgcgtatggacggatgcagccttttacatgcacctatgtacagtctgctcattgaattatggagttgctagaaatatggcgccatatgctacaatcgattttttttcagtcacttacatatgtaattagtatgtaattttagtacttacatatgtaattttaagacttacattataaatacactaaaattacatatgtaatttagggatttacaatgtaaatacatgccgactatttttttataaaaaatatggcgccataaatatagctacacccttgaattaaccaataaactttgcatctcgtacgcagaagttgatggaatttggattttggatgtttgatacggccgtcacactaatgtcattgggcagtacgtactgactagccggtaattacatgcttgtacgtctggccaattgcccaaacctggtgtttaccgaaatgattgtactgttgtgaaaggctgaaatggccttaagtgcgagtgtacaactttacctgctagggataaccctgatgttcatgtttatgtacatgtaggtgcatgctctttaacagaaagttttgtaagttgtacgttcggatttattgttttgattaatttgtttattatgggccctgcattgcagtgatataaatcttagcttctattttcataaaaacaattgtacctacatggctacatctattaatccgagcaatctatgccattataatttggtaccacaatgattgatcaatggtcagcgtgaattttttttctccatgaattaagttttgtttggcacaactttagatcagaattttttagagccaatacacttcagaaatatatggatctaaatttgttattaataacatttggataaacacttttctatatattttatatgaaatatatataaaattttaaaccactttattttaacttacaaagtctaaatctagtagttatatatgtggagtagtaggaccatttcctgcttcagctctagaaaaaaaagtggtttagattttactactactcccaaaaaaagctatgtggagtagtaggaccattatctaaaatctattactactccacgatccactttattttctgcttcagcttcagctctagctccatttcttagagctgaagtccaaccaaaaaaagagtgaaattctgtttagaaagctctagaatgtgaagactccttgtataatctttactccttaaattaaatttaggataatctttaaaccctcgaatgtgaaggctccttttataggctttgataacttgtgtttagccttgagtttattgtcctttttaaggaggattgaggcaagaggcagcactcagccaacgtacagtgccgttctgccgggacagacaaataaaaccaagcatcctgcaggtttcatttccagttctcatatccagcgaattctcagctttgctatcgcccacagtgatccgctgctccaccgctacgacgcacgccatcacacgcgcgcgcgcgccgtcgcatcgcagcctgcaccttgtggcggccgtagctcgctctcgctctcgctctcgcggccggtgaaatggcggcgcacgacgcaatcatgtcttcttgctagctagctagctaagttcgtcggcgcgatgatgtacaagcatgtcggagacgacgcacgcgggtcctccgcgggcgtagtgtgctgcgtggatgtcgtcgacgacgacgtcgacgcgctgctgtgcggcgaggacgccggcgagctggagcgcgagggcgagccggcgcaggggtcgtcgccgtcgtcgtcattgtcgtgcgccgccgcggccgccgcagccgctgacgacgacgacgaagacgaagacgaacacggcgtccatggcgaggtggtgcaggtgactccaggcggggaggagcactgctacgactacgactacgacgtcgacgtgcccgtcggtgccgagctcgtcatgcctgcttgctcgccgccgaggacagccgtccaccggcccggctggtcggagtccgtctcctggatcctcaaggtgaagctatagctagcaccgccgcaatctagctagctcgatccatggcaatctaattaacttgcacatcttaatttcactcgcctttcttctccaggtccggtcagtccacggcttccagccggcgacggcgtacctcgccgtgagctacatggataggttcatgtcgtctcgcagcttgccggtaaatcaatggccgcccacacttttgtctctagctgtgtctagttactggattaagcgcagtgcactgcagagagccagagattaggccttaaaaaaagaattagctgcagattacgaatcaattgatcagactatgctgctgtagcatacatacttagtacagagttggcagaatttgcagtaaaaaaaaagcacacttgcactatagttatgtgccgatgatatgtgggttagaatggtactgaatttctaagtaacttgtgtgtccgtcccaaaatatatatacttttttgagtttttcaaagtaactaaggagatatataaaattaaattggaaaataattgtgattagtttaatgagctgaggaagcatgtgtatgaattaaatatataaaggatgattgtgattgtttaggacgagagaataataattttattgtggattgtagggaataagtacctagctagctagcacacaaggctaacgaatgtttttggcagatgcaactagtagcagcaaattaattgaggtcattagggatggaattctgaatctatgttaggtggctagtagggcattattctctgtcagaggatgtgtctattcaacagggaattttaactttcccattagtagacaaaaaacatgcatgtgaccggtgatgccattttctgcccaggtgtgccaccacaccaagattgagaattatgattggcaggggcactattttgatttggatttggtctcaatccccgatctacatggtcactaccctgattaagaggtaggacaaggcactttttcatggatcgacgttctacatatttttgcatatgattatcatgatccctctgctacagaaagccacagccattccttttcttaaacggctccaatttataatcgtctatagaaaaggttggggccgttgtaaggtcataggctgcctgtgaaaatatgtcaccatcgattacttaagaaaaccgcctacactaatgaattcattattatttgcaaattcctagagaatccaagtcagtcgtaagttcataacagttaatatcaatctgaaaatgactctgtacaccacacttgcaattgctacatagagttgtcgttggttgtactattccatcatcaattctcattgtgatcagttgcatggtttgtgatttgatgttatacttcagatttttctcttcgaacaagatttcttttaatcgatctcctcttgttcctcaatgctcagagaatgcggtgcattctttgttaatgcagagatagacagctgaatttccagttatcttaagaactctactcatctgattctagcttattattgcaatttgatttctttcacccaggatcatggttgggcatcccaattgctatgtgtggcttgcttgtctctggctgccaagatggaggagtcctctgccccacccctccttgaccttcaggtaactaacttgatgtgaatagtgagtactcaatgtctttatttgcttttgttatgaatatgaatttcagcaaatgcaaacagattgaaggaacaagattcatttttgaacctcggacgatccagaggatggagctcatcgtcctcgtggagttggattggaggctccggtcagtgacgcctttcgcctttgttgatttcttcgcttgtaaggttggctcctctggaagaagctcaaggatcttggcattgcgtgcttgccaaataattctcagtgcaattcatggtaatgctaacgttttctttttgagggaacagaaaacaaaattttactctaggatgcatataggttgatcatttattcgcatgccatataatatactagatgaataatcaaaattgttttcgttagagtctagttaaaatatctaaaataagcaaaatgttgattatattttaattttattaccatactatcactagtagtaaaaggtggcataacataagtaaactaaatgccaatgtcaagaggtgcaaaatagtacaatgaaatataatttgttgttttcattgcctgaataatattatcattgcatctttgactctctattgaagtacttttttgttcccctctctttgatgaaaagatgaatcactggagttatggtgtgagtagtgagtactcaatgtcatggtcccgaaaactgttggttttaccggtcaataaccggatggcaaccagttccccgggtagttaccggtcggaaggatgcgaatataaataaaataacatattgtaaaacttgaatatagaactattctgttcgggaacatgtaaaattctaaatttagatttgaattcaaaattagcatttaaatttcaccaggcctgttcctgccaaaccggtattctgaaccttgctaggtagcactatttgcgtcaggattaagagggtgtttggatggtgaccacactttaccacaactttaccaaaatctgttgtagtacataggaaggagattattggatttccatttcaatcaaccagttagctggctaaatgatcatccactacctgggccaatccaaacacatttgtaacatcctggattcctggtgacagttcaatgtgacaagagatcagatgctttcttaaccctgctaaaataatagtacttgcaccattttctgtgaaaaactacatgagtctcatcatcattaattacatattgaaattaagtgctagtaattatccttaaacatcccaactaatgctaaacttgtccttgaatctcgctgcatccaatgctcgctaattgatccaagaatcttcttgttgccatccgtggaacagagctcgagttcctgaaccactgcgcctcatcaatggcggcagcggcggtgctattcgcagtaaatgagtcgcctgcagccatgtcgcacaggagcagcgtcagctctgaatcagctgcctcgtggtgcattggcctgactgaggtaagtaacctgatctctgacgtcctgaccaacccaacccacgacatgatcaattgaaagatcttgtagtttgcaaaactttgtcagttcgtcagtaactttgaaatgatcctttttttaaaaaaaatgtttttatatttgttattacaggagaggatcagcagttgctatcagctgctgcagcgagctctgaatgctactgcgaggaagaggaagcgacatccgatgatacttgcagcttgttcatcagtaacaagttcatcttcccggagcaaaaggcgcaaacttgatggccattttggagaagattgaatctttcttttcttttcttttcttttcttttatttgagtctgaattatattacattcctcggcgatttctgttcctggatgagctatttatttgtttatttttgcatccttgtggttgttgaagctttgataattttgtagcttaattcagaaagatgacatatttgaacataaatgtggggatcgagactaggattaaagatttctcaaagaaaaaaaaagagtaaaattaaaagaggagcacctgtatgatgaaatcgatggggaccaatagggcagcaacctgtgtgtatttctttctgcaaagtgatgcgaaagtgaagcaaaggatgcattcgatacgacactttggactattgggcacactgcactttgcagggctgatcaagttagctaccactagattagcaaaagcttcctccccttgtttagccctgtcaaagatttgtgtttgtttagctagttaaacctgattagtattatttagtagtactttttttttcactgctcaggaggactactcctaggacagtaggacctccattttcagtgacatgcttatactacttctgttttaaaatatagctatttctagcataatatcttgtcccaaaataaagttatttctccacatacctcttcctctcatccaatcacaaacattctttttttttttgaacggaaaaacagcactagagtgccttttcattgaatagagcaggagaaaatacaaacccctaggggtaaaaggaaaacagagaaccactatagaaccactatagctgtatagtgtgcgagattaactcacgcaaccacttagctcctgctaaagccccaaaggctcgcctcctctttgattttcattagtaggaagttcgttgccacctatttgtgatcaaaaatccgccgattcctctctttccaaatttcccagacgactaacagaatgagcgatcgaagtccttttctcgggacactaggcgtgtttgcaatgttctcccaccactgtttgactgactgggcttcctcccattccgttgggtccatctgctgatagcccacccatgcagagacgaggtgccaaatcctcttggtgtatctacaagtggcaacaaggtgcaatgccgtctcaatctcgcggcggcaaagagggcaacaaccattgttctgccatcccctggtcgcaagccggtctgaagtccagactctgttctgaatgatgagccaagcatgaaatttgcatttccccgacgcccaggctttccaaatcaaggaattgaattttgtgctcggcgccccgcagcactgtgcatggtaagccgaggaggccgtgtagtgcccgttgtttgtgaacttccaagtaatctgatctggttctctaacgtctaagtgcacatttcggaccacttcccacagtgcggctagctgttcgacaaggtcgattgtgatagatgattgtgaatcaagcttcaaatcttgcacccaggtgtcctcctcctttccttgccgaaggggttttcctctgttttttgagatcgcatagacaagcggcatgaggtctttgggtcttcgcccaccaatccacgtggactcccaaaatcgcaccgtgtttccgtcccctattgttatgtttgttgaggcggcgaagaggttcctatctatttcatcacatggcgtctccagccccacccaaggtttggtctggtccttccattcatgccacaaccatctcaacctcaaggccctcgtgaatttgtccagatttaggacccccaatcctccttggctggtcggcatgcacgtctttgtccaattgaccttgcatttccctccggtaataacacctgtgcctgcccagaggaagcggcgccgctgcttgtctagctgcttgagggattcctttgtgattttcagagcggtcagaaggtagattggttgcgccgttagcacatatttgacgagcgtagttcttccagccgctgccatattttttcctctccagcttgctacccttccggaaattttgtcaaagataggttgcaagtccaccttccacagtcttcccagagctagggggaggcccaagtacttgatggggaaacttgccctcaccacagggatgccctcaagaacctcattcaactcgatgccgccgcatctgatgggcgccacttgggatttctgaaaattggtgacgagcccagttgcagtgccgaagtgctgcaggatgtccgtgaaggccgtaacatcgcctcgggtgggattaatgaagatgatggcgtcgtctgcgtacattgagatccttagcctagttgttctcccccgaattttcgagattgcgccgagctctgtagccttgaaaaggattcgctgaagggggtcaatcgcaagtatgaaaaggagcggcgatagggggtcaatcacaaacattctgtttcatctctttttctcttctcaaccaatcacacactttctctaatcatttccacctactttcttaatactcgtaccaacctaaaaagtacttacattttgacacggaggaagtactaacaagataaattaacggttaagatcacttatatcgatgataatactaaatagtagtagataggggtactcgtttgagatcaccataaaggtaagtcgatcatttcattattcagagtacattttaagtaaacaaaataactataggactctgaattttcttttttcaggagaccatccatcctatgaacttgaaaagattcaggacacttcatattacatatttatagttgcatgcgtgtgttagttagacctaaaccactgtgctacttaaattttgcctatggcaacacgacaaccagttgctatcttcagggcaagcagcagagagaggccccaaattcttaccagattatttgtcctgcctttatgtaaagcagcgtcgtcgtcgtcacagtggcaaagatcatttgctcaccagctcgatgcgcatttcgaactgctgcctgcagccagccaagcccagcttcgtgacacacatgtatttatttaaaagatgatctgaacaatcgatgagatcgactcctttcccagacaaatgcattgccccagctgctactgaagctgaggtgtcgtttaatccctgcactaatctagctatgaaaaaacaaagctctttgcgtaaagataacctaatcttggtcagtgttaaagcaggcaatgattgttgatatattgagatagtgtgatgacactgtggttttgatggatctgtgcataatatcatattatcatgggagagatatctttgcgtaatctgttcagtttggggctttgtagattgtatcattgtggtgtttgcctttggcaggtattatctctgatgatggatgattatacactgattgattaagatccagcttagcaatgtgctatagtactaaaactaactgaactgctgaaggtgataatttatttaatttgcaaaagatgagaagtgcaggtgtggtgca

SEQ ID NO: 39026 - DNA, 6824 bp, Oryza sativa
tgtgggagccaacttatcacgtcaggcgaagcagtggctccgcatgaccacgcgtgccctagagaagctatggatggcttcccaaggaaaaacgttccgaagatgaagccatgctcaggtagctccattgctcgccgtcgtggttccaatctcatcgtcgatatgttctactgcgacctttgctcaaggctgctttgttgctaggacctttgcccagacaactccaccgtcttgtaatcaacctggttactccaccatcggtgccccttgatttggcctgatcatattcgtgacctgatccaatgagcacatgaccatattgctaggagctcaaccaccggaatctagtccgctcggagcgcggtggccggagtaggattgtaggaaacacaatggcgattgaggtagagatggacgatgcgcatagtctgagaagggagatgttggagactaggagaggatagcaatggtgattgaggtgttcgggagaacaaggaaacgacagcaccagtatggtaaagcaaccgacgtgaggcggacaaagaagcgaccggagaatggaggagaggagtcgtcaatgaacatatggaagaagggactgatcagagggggaggggttaggaaaggaaaaaagaaaagaaaagggagggtgactgacaggtgggtccacaagaagcttaagggtctatatgtatttcttttattataatagggtttaaatcaatttataaaaaaaatattatgagagctggtatataagctatccatggactcagccggtttgataaatgataatgaacattttcttcaacatgatatttttaaaggcatggatctaatcaaccattttcaaatttcaaattttttacatttgcatgcgttacaatctgataaaacgctgattgaaaccgctcttccacatgcaatggcagcttttaccagtcaccaccagtctaccacacgcgcgtgcatgccgacggacggtccgtcctcccctctcgcgcacgacaacagaacaagagatggggacgagaaagaaagagaccaatgacggactcacactctcgtatatcctccctcctctcctctttcccagtggaatccatggctcctctcgtcgctttcgtccctgcccatctcacacgcacgcacgcacatcacgcactgcgtctgcatgcatgcgtctggccggctccctccccctttcggcccggagaaaggcggagtacgtcagtcccatcaaaagaagccccgagtgcgcgctggatcgagagccgcgtgacacgatcgtcgtcgttgatccattccattctcgttggatgatcttggaaagtcatgatatgatgaacgtaacgtcccgttcttttctgattaagatgtaaattttattttcgtttttatttgtttgatttccaaactgctagaacagtgtatattttttcatcttaagtagaaacgaacatcacctaaaggtcctgctcgtcatggtcctagttaatttttacttccaaattttatactagtaagtggtaaacaaaattatgaagtgggtttttatgcggcagcgttggtaacgaagattcgtgaacggaagccggccgccattgatggaagtggaggatggcagtggcggtggagcagagtatgccacatgccacgctttgaaagcctgaatcaatcgggtattgttcgatcgatttgtgcgttctctgaagaagaatgggtggctctttcagctttggctgaatctccatcgatcgatcgatcggcaaggcaatcgatcaagctccccaacgttccgaaatgcagccgtcagaaaaagagggaaaaaaataaaggagttaaaagcgactttggtttggtcaacctggtaatcaagcactactgatcatcatcttttttttttacgtgccttgatttgtgtggcactctgccatggaatttggagctctttctttcacattctatctactgaattctgtaccggccaaccaaccagcaatgattgatttttttttctggtgctttgttgtacagccacaaacccatgttgttttggacagatgtgctatccaagcttctgaaactttttaggattggtatttgtaaatggaaattgtatgagtaggtttagctcgaaaagaacttgctttcctgatagcattatgatttaggacaccaaagttgtgtttgggacatgagagagtaggattcatcaagaaaggaaaataaattcagattagggtaattatccccaacagaacatatttgcatcatgtacaaacatggcatgatgctccagtgtccctttgatgatctgttctgtcaatcatttcagttcttcaactaccaaaccttgttcattgcaggggaactcgagttcaggtgttggcacctaacttggcaaatctctagcacttgtcttactaccaactgcatctgcaggaaacaatatacaaatgtgcaggcctaataggccgcgaatctgaagatgtatgcttgcttccaacacataaagctcggattccagctcctgtgttctatgattgcggcgatccaatgatcacaaattcggcacccaaagagcagcagtaaaatacacaagaatccttaaaaagctatctgcaaaggatgtactttgcatcttaaactgaatatataatagtacatcaccctgcttttgattaataaatacccctctgtatgtgccaactctaagatgcaatgcaaattaaggtaccaacttacttcccaagccagaaacaatcttgacctcagtaaaatggcctgagtaagattggtgatttcttacagtgacttggtacctactaactgaaactctgaatatgatgcattcagagctactgatcatcttcttctctgttgagagatgctgaacccaacacaaccaaactgaacatcgcatcagctgaaaatgcacttctgatgaaatgatgagcatgaactctaaaaacacagatcagttcaactggccggccactgacgatcgtgtcagcttctgacttcggcgatgctgtgcagtgatgggcgccattgacgatgcctagaatgtgtcgccgagctgctccgttggccgtctctgtcatgctgcaaaccacaataggatgggtggcagatgagtaatcagaattcagaacatggcactttgttaatcttttatatagtttaggagaccttggaatcaaatcaaattaaagataaagcaaaaattggtacaatccaaagaattagtgttggatgattcttcatgaccaatagttaatttttaggagttaggagtagctgcaagattttagactattgaaagtctggcctttcttggactttctgctatcatcttgtaaactagtaggttccatattccccatgtatctgacatcttacaagagaatgtcaaacttgcatgtttttatttaggagatgacaggaaagaaaaataagtaaaccacccatccatgcctttttccatgtggtgtgaggaaatcatggtatggcacacaaggttgttgtttaaagcttggtttgggaataatttgtccactaagtacataactaaacagagccattatatcatgtttaagagtacattattgctaaacatattcctggtatcatgatcaggtattatatgatatctataatggatctggttagttggttaggtactagtgtgtcacaaggagggtggccaactaaacatagaaataacagttgggttgagcaatagcctaagtaacttacttgcctcataatatactccaaatttagaatgttaaccaactatgtgctcacctactcctagactcctagtgttcactcaaccaaaagaaagaaattaattgcattggaacatagagctaaaattcaacatgcaaattcacaaatttaaatttcaaacatacaaaaatctgtcccttttgctcagaaattgagttctggatactttacttatgcaattagcacatatatcaatcaaattgttgcttccattataggagtataattaagttgatcgaatagtaggattataggagtaaattggccatggtaagaacagctgagatgatgaaaatcttgcagcaagaagattgtgacaaacctgatcaagattctcatcgagctgcgtgtggtcgtcgccgccggaattgatcctaactccggcggcgacggcggcggcggcggcgggcttggattccaggtgatgatgctgcgccgccgccctcctcgacttctcctccttcttcgcctgcagcgccctggtgacctcgtcgacggtgatgaggcggtaggcctggccgaggagcagcgtgtcccgcggcttgagcagcttcacccgcgtcacccgcaccgtgccggtgccggtgccgcgccgttcggcccgcgccggcggcggcggcggcggcggtggcggccgcttctcctcggcgacgcggagggtgacgagcgcgacgtagtggcccgggttggcgcgcatgacctcggcggcggtggtggcccagtagagccgctccacacgaccgcccgggtgctgcaccaccaccgtcgccgcctccgccgcctggcagttccccatcgagaaccgagaacaaaactaaagcttaacttccttcctccttgctggcggcgagcggcggcgccgcgtggcggcgagagcgcactggtggtagtacggtcgtcgcgggccgcggcggtgggcggtggcgcgacgcgacgcgacacgagagcgatgcgatgcgatgccgccgttggcgctcgcgttgggaactgaggagggtgaccgtttatatgtcgccgcgccagcgcggtgggtcatttacggcctaccgctcacaatttcgtcctactttttttaatgttttttgaggacaaagttttgatttttttttttaattaggcaaatattgttcaaacttagcaaaattttgtttaagttttttttttgttttcaaattttagccctctataattgtttactcatccagaaatatagttatatgctggcgcatatgcatgactttactctaatccatttgtcagggacttaaataagaggatcgcatcccgtataattgtggcatcacaatataaactctggtgggtttgagctatacaataagaggttaatgttgtttcccgtattcgatcgtttacatttcaacattaacctcttttttaaaaaaagattaataacccggcctttacatccacaaccaaagttaccctctcttttactctcttttacatgactgttgtttgggtttacttgaaaattttacttttccatgtcatggaagaagattttgcataagaacaaaggatggttctaaagggtcggtgatcatacatcctatcaatgatctatgcctctatggtctaacaaccaagcatgcagttttcaagaacacttgatcggaaagcaagaaaaaaaggcacaagacaaatgaaaagttattggcgatggcgtgtccagatactactttaatttctatttgacatctagtgttggcaatttgctgtagtataataaaagaagctttatgaagattatttaacttacttttcttggatacaaatagccgttttcggcgcctcatatctggaactgccttttcgcctcgttgataataatttttttagataataatggctgttgatagtagtgtctgttagtatagcctgtagttctgtaattattttttcccgttatatcgatatgaaacaccgaatcatattttttgtttgttttaaaaatatgtatagcagttgttgttactttctactctctctgttcgatatcataaactgttttagttttgtttaagtcaaatttctctaactcgtacgagcatcgatctctcgtgtaagatgttttcttagcagagtaatactgattaattaataaatgtgtccactaaacatgaacaattcccttgtacgagcatctcgtataaacagtatacttaatttctcattcaagtaaagactttgaagccatcccagattagtactgtacggtctgtaccagagcttacagccacaagcgttaccgtcagatttcagaagtactgaagcaaatgtcaatggtttcactctgaaaactttaaccaccaccgatcgctcggagtacaagtatatgtggtttgttgagattgtatacgaaatactcttgttgtatgacgttgttaatttttagacatgacgtatgatcatttatttggtttgaaaatttagtgcaaacacaaaatatatttctcatgcttaactcatcatgtacgtgagaagattgaggactatacgcatacatgtagctactcgggtttcatcaatagcactacaaaacgaaaagacaacatcttcatttaagttttggatgcatgtaactataaatattttatcttatgtgaaaaaagtaaaaaaataaaataagacttttggatgaagagaatacttttaataaaaaataattcacaataaaataaataatacttaatatcgttattctaataaaataattggtcctatgttatagcctagaaagtcaataactacatctagatttcctgaaatcacacacagccgcaggcatatgtcatttttggatcttcccatgaacattttccccccatcaacgcacaatttctccgccacggttgggggatcggctcggccgccacggtggcatgaggtcagcgccaatgggcctggcgctgacacgcgctaagccgacggcctatttttggttaaagtttttggcaaggttagtttcgaaataagttttcgaaaagggtcaatttgtcaaaaaa

SEQ ID NO: 39027 - DNA, 9777 bp, Oryza sativa
tttttattgttactgagattttaaaaattaaacataattatcattttgggattttttttttactttgtagaagtcccgctaaaccatccacagctttaccactgtactcctctatggctgcacgttgcctcccctctttgttgtcattgagatattaaaatcaaacatgattatcattatcttttattttttaccttttaggcgtcccgccaaccgccttgactatgttggttaacggcctgtccatcattcctcgttttaatcataattgggattctatttagagttttgttagtagtttttagatgcccaatcaaccgtcaccactcaactctttacatgcacattgcttctcccctctttattatcatctgtcatttgtcatcgttgtgttctatatgtactttatttttttattttgaaaatttcatattttcattccgatatgttttatttacaaaattatattcctacttgaactcttatagttatttttctattttcaaaatttattttatttgttattctgatttttaattaatctcgtcatgtgttctggatggtctcttctttcaatagtctttatttttttattacaaattttggttatttataaattgtattcaacttttttctaatttcagaatttattatattttccttttttcctacggttaatgtggtaatttctagcatccggattgagtttttattacatttgtattttgaatttaaaggatttttttcaagaatatgcaaaagaaacatagaaacaatatagatctggtgataatgcacatgttcttttgctagtttttagtgtgcccgttaatttttattggaaggtgtaaatcactgttaaaaacaatgataggattatacgcgtatgcaaaagaaagaaacaatctagatctggtgataatgcacatgttcttttgctagtttttagtgtgcccgttaatttttattggaaggtgtaaatcactgttaaaaacaatgataggattatacgcgtgcggtacaactattttactgctgcctcacatgaaacctactctagttctgtttcgttttgctaagttatattcctttccaaatagagtctggtgtcctgatgctactactatacgccatactcaatctgagttgtatcatactaacatgtccgcttctatagtgcttatgtggaacaacagtatatttccaaaattttacgcattaaatcttaacccttgagatctagatttactatgatttagtggtctatatttttctctttttctccgattaatgtgggagtttctagaccccacagcgaacgtagtgccttctttcaaaactgttttaataatataataaatagatagattatttagtgatatactagaattaaataatttaaccaggatcccgaccctagttaatagtactacgtatgaacgctcctgtgtataaatgatgagattgtatacaaaatactctcaatggttttaatatgtatgatgccgttaatttttagacatgacgtatggtcattcatctggttcgtaaatttaatgaaaaaaaatatctcatacttaagcacttttaataataaaataaataatccccgcaaaaaaataataaaataaataatatttatagttatttcaataaaattgatggttatatgctatagcctaaaaaagtcaataactacatatagatttcctgaaatcacacacagccacaggcatatggcaattttggatcttcccataaacattttcccccatcgacgcacaatttctccatctactcgagataccagatgtgactgatcgagctcaagctagctcgtggaatagaagaaaaataacttgcagctccaagtggccggcggtgatgtgagagctgaattaggttgatcagttgagaattgaatgccaagaattcagtcggcaacagcagaagtccacgtactgctcaagggacatgagaattgaggattcataaatctcgtacttgagtatcaagaatcgctttccgacgtcgtcaagatcatcaaggatgtagatacacgacgctatattcaattgtactgtgctgaatttaagaggccatgtgaggatcggtttgtgatgtccacgtattcaggattagaccacaggcccggctagatacagatgttacttcagttttcgttagcacgttttttaaattatattaaacggcatatttcatgagaaaatttattatataaaagctatttttaaaatattagataaatctatttttatgtttaaagtaactaaagtttaattaattatatgttaatgattttcttttcatgcccgtacttaatttactgcagtaaacttgaacggagccatagtagcactgtttccaggctattacaaaactgtaaggccttgttcggttgggccgggaacggctgggatcaaggtccaatccccatggatcaccctggcgaggaaacaatctcggcccatatgaaattgtacgttcggttaagccctagcgtaaattttagcccggcccaccacggggtttccctgtgctgtccgcccgggaaaaaatcacctactctccagaggagcggaaaaattcctcgagaggagcggcggcgcaacgaagacccggacgcgacggcgggagcggcgcgatccggaggcgcacagctctctcctccggccgccaccttctctccggtgagcacgcttccttcccccctttcccctcctctttcaaatttagggttagggtttccttctcttctccctttcctgtcgtcgcacgcaccgtgccgtagggcccggccatctggtcgtgctccggcgccgacgccgacgccgaccgcgtgttcagctccggctccgacttgggcggcttgggcttgggcttgggtggcttcggcttcggcggcgccttgtccttgtccagatccggcggcggcgccgggacacgggagggttcttggacgccggagaggagaggagaaggaggaggagagggttcttggttcttggcccgtagcatctctgtaagactcgccaaaaccctgatgaaattcagagtcatgtagatgtagttgcagttgcaggtttgcgaaatctgaaggaattcagagtcatgtaatggcaggtgcagtacagaggagtttcttctttcttttactttccaaagttgcagggttcgaacttgattcttctcaagattgcaaaatctgaagaaattcagagtcatgtagatgtagttgcagttgcaggtttgcgaaatctgaaggaattcagagtcatgcaattgcaggtgcagtacagaggagtttcttctttcttttactttccaaagttgcagggttcgaacttgattcttctcaagattgcaaaatctgaagaaattcagagtcatgtagatatagttgcagacttgcagtgcagagatttccttttttatttgctggtaataaggtgtcaacaaatacaggaagcttaatagcatcaaagtgaaactagcatacatatatctgtctaggggccgatcagcaggagcactgaagtgctaataagagttgttttttattagtcattagtttattgtgatatatatttgattaatcaatcagatttgtactggattaggatcctctgtgtttatctatagctagctcttgctcaaacttcagaatgtcacggtgtttagttgatacaaggaaccatgatgatactttagtggtgaaccttacatatgtgaaacttaaatagaagatgaaacttgcagggctttcctattaagagcatcgttttcaccgtagtgtatcatgttgtcgccagattcagacagcaaatgcagtcagtcctcactgtaaattttggtctaactgaagaaatgaacaagctgctttctcttcttttatctccatttcttgttgtgaaactggagcacacttgtatagctgtacttacaaagtagtgcttgttccagaaaaacaaaagccaattaactgtatttttgttagcttcctagttcatgaactttcaagtctcttttcatcttttgttctatcagactgttagcattccatgtagtgcatcagccttagtttggatatcaagtgtggctcttttctttacttgtctgctcttctgtaatctgtactctgcattaattcaatttgatatttggttgacaagaaagaacatatatggtgtatttctttttggaattgatccaatgttgttccctttttttttccagagatgggaacactgcagctgggtgactgaagctcatggtggcattagtgctaagcttaaacacttgcattcaatttgtagtttagctcttagctggctagttctatttattctaaaaaaacaactgaattgtaaccattttgattactttgtgaccctttcatgtatgcatttgtgaacgtacagcatacatgtgtgttttccctgtgctaaacaatgtttttttttactgtgtcctatggatttgatctgggagaatgcatattggttcattgcttacttgggaacgtacagctgctgccttatttttccccgtgctaaacgaaagcagggtttctatgacagggattagaaacgggcagggattcgaaccccgcagggattgagtgatatgggagggattcactcagtccctccctggataggttccccttgagatcatttcccaagcaaccaaataaggcctaaggaaaaaggttgcctgtagctggaaaagacggaagtcctttctatttcccaaacaggaatgccactagacaatgtgtatcaattttctttgtgagaagggtattttttacccagcctctacatccaactagatgatatatacaatctttttaacttagaatatagcctatcaaacagaaaacttagcccttaaataacctaatctgaaattcgctcctatagagattggacattgtatattataaggtagttggagtgttgtcggtggaaccggctcactggccgccggcaaggcggcaacactgccgtcaaggactccaggacccgttcagtttatcgccgcttgcaatcttaccaaattttaataacgcaacaaactcaacacacttcaatcattattatcttattaaattttgatatttctaaaagcttcctctcttaaaactctatcaaatcaaagccaacactatcaaaatttgaaaatgccaatatgtgctaaaatgtgacattaccaaaatttaatatggttgatttcggcaacgaagtgaacaagccccccagtctccgggctaccaaatggcatagcccttcttcatctacacgagtggaataagttcactttttttactctcttaactagtggtcgaaactgattcgtatccctaaaccacaatactggatatctcaaccttcccaactattaaaaccggaacagtttgatttcctcggtggttttggaggttcacgtggtattataattaaaaaaatttacgtgggacccatttatcattcacaccaaattattatatgacccacttatatgtggggcctacatgtcattctctctccttcccttcttcctcctcttccctctctctcatctccccccccccccccttcccattcggccttcctcgttgctcctcctttccccccaccctctgtctctctctccacctcttgctctatttgtagccgcgacgatgccgatgccaacaagctcaagcaggggagggcggtcggcggtttcgacggaacaggacctgggtgttggcgtggaccgagacagagccatctccaaccgaggaggccgaacggctacgatgcttgaggaggccattgccgccacctgggtcatgaccgtagcgaatcgcgtgcctcgaattgggaagggaaaatgagtgacgtcgtactcgcagtcgaggctctcgacggggcacacgtcgacaccgacgagggccacctaggaggtggtgttgaattgggagcggccggtgaggaggaacctccaccgccatccctgcacctctttgtcaccctcgtcgttctcgtgtgctaggtcctggaagaacgagaagccggaggagaggagtggagcttgatgtcaccctctggatccacctcaccatcatccccgcatgaatggtcccttggctccatcacctcagccactcagctccactgccgccgccgccaccgctggcgctccacaaacacgaacaagaaggggagaacagctctgccattgctcattggccttgtagcagtggtcgtagccattggagatcaccccggtgactgcgaggcaaggaggataagcagcaacacaggggccgccatagccaacgaggccatcgctctcgctagggcctacatccgcgagccttcgcgaggccgagtcactgccaccggttccgaggcaccctggtgggagctcgccgccgctgccgctcccctcgtcttcctgtcgccatcaccgccgctgccctcgtcctcccgacgccatcgccgttgtgcagaagaaggcggaaggggagagactcagcgagataagagggagagagagagagagagagagaaaagagggagaagggaataagatagaggatgacagatgagtcccacatgctggctcggtgtttagactaggtcaacgagccacgtcagcgaaagccaccctcaaaaccaccgaggaagttattttgtaccggttttaacagttggatgttcaagatatatggtattgcgattgaggggtacatattagattagacatatatttgagggattcaaagtgaacttatttctacacgagtagttcggtaattctggttcgacatgtgatcgattcgggatgtgcctcagttgggcctctagccctccacggaaataggccgaactaggcagcagtacgtagagcttaagggaaaaaaagtacatacaaggtccctcatcttatcatcagattacaaaatcatccccaccgcaaaatcagatgtatgccatcattttgggtcctcaggcggttttgtccaacgtggtggctgatttatcgcggacccatatggccccgcatttaagggtgaccacgttgtcaccccttctctttcccatattctctcccttccacctctctctcactcttctcataatctgggctggcggggcgagtcgggaaaggaggtctgtcggcgtctgccgtgaggcaccgccgtagcgaccagctatggagggcggcgggtggcaggagtggagctaggagacggcggccggcgggagaggacagccaccatggcctgctgcgggggtgaaggcgagcactgcggcggtgggtcgccacccgtggacgatgcccgtggggaggacctgaactcgctctgagtcgtggctccttagggcggtgacgtcccgcacgaggtcggtggtgggcagcatccttgatgtggcatcgatggaagtgaacaccttgaggaggaagacaagagaggggaggcgcaagatcatggacaagctccgctgccgctcttccctgtcggctgcgccgcgcgcctccagtctccccagctgtcgtccgtcttcgctaccgagcgtcgtcgccgctcttctccgcttcagctgctggtcgcgccgcgcgcctctgattctccccggctgccacccatcttcgccactgaatgctaccgccgctcttctcccccatcggctgccgatcatgccgcgtgccttcagttctcccccggtcgctgcccgtttttgcctcgaactcgacagactcgaaccccggcgccccgacctgctcccacattgcctgttgtcggccgttggaccttgtcctctcccacttcaccccgccggcctcctccccacccgctagctgccttgcccagacgaggaggagaatgagtgagagaggaggaagggagagaaggggggaaagagagagggtgataacgtgatcacccttatttttggggcccacgctaactcaaccatcacgttgaacaaaactagggtcaaaaccgtctgagaacctaaagtgatctggttttataagctgagggatgacatgtatctagttttacggttgtgggatgattttgtcaccaatgacaagaggacgaactatgtactttttccgagcttaaattggcctgtaacgacttcggccatggacaagtcggcccagtgctttatctaaattctaggagcaaaaaagttcactttacgtccatatggcgtctacatagcactaaaagctcgtagatggtttttggctacggaacaccggctttgtaagtttgagtgacgtgttatatactccagtatagtattgcagtttaaggataatttgaactcgacgagtcgacgttaagatgagggacctcaagtgaacttgtacctatatattttctcgatcggtataccggcccaagtggcttccgatgacggctataaataggaaccaattactgggcctctttctccagtagcgcagaaggccctctccctcatctcgaggcgggaaccgctcccgaatattctagaagcttcgggaagggcgtcccccgcgcgtcgcctctctgctctcctctccaccctctcttcatggttgcgtcggcggcggcgggggcgagcggcgagccccagaagaagctcccctcctggccctcgatggtccgcgacttcgccaccgacgagtcccacggcggtaagctagttccgacctgcctcgccgcggggccgccgctgagctaggctgctccagtgtttcgcgtcatcggctaggctgatccgtggcctccgtgcagagcgcggcatgtccgtcctgaagctgcggctcgacggcgtgcgctctgcctacgacgcggccgcggcggagctcgagaccgcgaagcgcgcgcgggaggacgcggagcaggagctcggcgggaaccaggtgcaggtcgccatcgccgtggtgtccatccacgggctcgaggtctctacctctcttcctcatctctcctcgattacggccagtttcgcctgattcgattgggtttatttcgtttcggtgcgtttaggcgacgatctcgcacctccaggaggaaatatcgcaggtgcgctctgatctggacgcgcttaaggtcagtaaattttggggtttcatctgcggtttgcagtaatattcgctgttcgatttttttttgtttaaatgtgacgcgctgatttgcttatgtttctgtaacattgcaattgggaaatggtgctgcgctcttggtgtttgatataatgtctccaaaagggcaagggagacattgagaggtgagtacgggagttttgttgattgccctgctgctggtctattgaatgcattttggtgaatacttggttgcaaacagctaagacatgcaacttgctccttgcagggatgagttcatcagccagatggatcagttaaacacaaagataaggtaagcaatgtttgtcctgccgttgaatctgtgaggattttcgcatgttgtatagttgcacattggatttgctacaacagatgctgcatctcttgcttctttgcttggagccagcttgatactctaaaaacatatatgttagtctgtattaaaaccttagtttagggcttggataagggtatcaatggatgtattgtctcgatctcgaaattcctgatatgcatgaactaaggatcataagggaatgaaaatgcttcaggtttttgttactgggggactcgtggtaataacacctactttcagaattcagatgtttcttt

SEQ ID NO: 39028 - DNA, 2028 bp, Oryza sativa
acctttccaggccaacaggtcacggattggagtgaggtcattgagttagaaggtagtttcgaagagttgaatggaaatgtgagcaatgctgattctgagaggtctctctttgaagaacaatatgaaaaagacgatcatgataaggttcatctctatttcccccaaatgctgcatcatatctcaaagaacactttgtacatgcaaataatgattatgaataaccacatctggcatttgaaaacatggagctaaaaatacttactactttctggggtatgcatctgctgataaatcgctataacatgggtttttagaacatttggactctcatcatctgcttgttggcttatcaaccgcagccaaaatttgaagtttgaaacttaattttagagttgatattggggttttttcattgtagtttatttttcagccttggcttattgagatggagggttttagtagttctttatctcgcactaatcaagaagctagtgcttaaggagttatgttttttgcattggtaaaaaaactgagtatttttggcttggttgcaggtgacaggcaaagaatgtcacagaaaaggctttaccttcctccgttccacaggcaagtttgagagcagcgatgaaggctctacttttagcgatgatgagaccattttagagttactgccgttaggaccatccacttcacgcattttggtggcatccacttctgtcaacaatggccaaaatatatatgcctctgaccagccactatctacattacctccacttcctgatttggagataccccaaagaaagggtcccttgtgtattgatggcgatgccaatgaaagtgacaatgatgatacagctacaaccagcagtcaggggtcctacattgagcttcataccattcaggatgagtatgtgataggaggtccttcttgggaagcaatgattgcgccaattactgggctcgctctagaggaggaggaggagttgatgatagagggtcaaatcttactggccaatgatcagaaagcgaaccgcctcatcactttgtttgatgaggaggaaagagccatggttcgaatgctagctgctcttggacagccattactgacaatggggacgtttccaacatcaaggagtttcctactcaaccttcccctgatatttgtttgcaaggagaaggacacagaatgctccatctgcaaaagcacgcttgctacaaaatatagatgtcatgtgcacgcctcccttgtcaacacgtattccatatgcaatgcatactgaagtggctcttggcacaacatacctgtccagtttgccgatatgaactcccagtaaaagacattcaggggtaacaaaaggtatgattactctcctctgcattcatcaacttcaagaaagaaagataggttcccaatccacacattagacatgaaatgtctcatacagaagtgatgctctagtgctagtggtaaaatcatttgttcttgttgtgttttaattcaaactgcattaggtacctatgctgtgtaggaagccaatggttattgtgatccttagtgaaaaaacataatggtgctgccagaaactgttacactttcattatcatggtactagtccagattgtattatttgctccgcatagcagctatttggggtgaaatgcttaggaaaaataagatggcatgattactttgacacttgtggcagatgaattatgctctacacaaaggatggaaaagtaacagagtattagagtccattcccatgagctaaaaatgaagcgggaaaagtgatgccagtactcttcctgatgtcccataagtccaaattactttcttcaccttctgaaatgattattgacttgccatgtaggtactcttcttttgaattgtgatactcccttgctaatcctaggatgtttatgtcttcttttgtagggttttacacatcagtaggcaactactttgttcctgtagtcttattatatgtacttgtctatattgtaggtttgctgattgaacagaaagaa

SEQ ID NO: 39029 - DNA, 1012 bp, Oryza sativa
gcggagctgccccaatggtggagcctctatagtctctcccctccaccacccgccgcgatgtcttccgctgctccgccgctgccgcgctcaccggcggcgacgcccgactcgacggcgtcaactgcccggacgcgcgtggtccgtgcgccctcacgaccgccgcgggcgccacgccgccggagtgggcggagcgccgccccgccgtgtccgtggactacgaccggggccagcgcgaggcccgcgccgaggtggagggcgtgggcgccgtggcgttccccgcgcgccaccgcctgcgcgtggaggggagccggtggcagcgggactggaaggtgttggaggccgccgcgcgcgtgctcgcgatcccgcgcgccgaggccggcgctgtcgacgccgtgctcaactgctgggccggccgcttcgcccgcggcaacttccctctcctcatccgcgtaagggcatcatcccacgctctgaagtatttcatgaattgaattgctgtgatatacatcgatgtggttgccatggttgcgttcttatgatttgccatcacgcaagttatcgattgcttgaaattacgaaaagcgtcaacaattctatcaatctagctgtgttgttcattcaacagccgactccgctctcagccgctgccgcggcgactgctgtatctctccccactgcgccggaagccgcgcccgctccgccgtcaccgcacacccacgtctacccgcgtgtgagaagttgagaagagaagagaaaaagaaaagaaaaaaagagatgtgggcccacatcattttctctcactgacatgtactgacatgtgggccctcacatatttattctattatttttttctaactaggataccacgtcagcaaaaccaaaaccagacatatatactgccttaggacctaaattagacggttttgtatagtataggggtgaaattttctaattttgtggttaagggacctcaaaaaacctcgctgttaagttgagggacctccggtgaatt

SEQ ID NO: 39030 - DNA, 705 bp, Oryza sativa
cacaacccgtcggacaagatcgataaaccagcaccagtctcgtgaattctctttctccaccaaggcaaaagctaaaggtacaagttggtcctccgcatcagctgataatgcagtcatcaaggcaccaccgtatttcccagttaggaaggttgcatctatagctagtactggcctacaatgcttaaaagcctcaatggaaggaccaaagcaccagaatgcacgcataaaaattttcttggtcactccatcaacgttgacaaccctatcaggatgagtatcgatgtggtagaccatactgggattcctctgcttaatggcttgcagcaaagtgggcaaacggacatacgcttcaccccattcaccgtaaatgagcttcatagcctcctctcgtgccctccaagccttgccatacttcaccctatactggaaaacctcaaatatatacaaagctaacgcagaagcagagagtgtaggttgcagttttatggcattgcataacctatttgctatgaactttgatgtcagttgccggtggctccctgaaccttcggcagtagcacaactatgttccttacctacccgtgatatcctccacgtgccactagacctcttagttgcatggaccttccatttgcaccgtgggttttcacatttaacagtgtacctcctatttgcggcagaattgacaacacggggtgcaggaat

SEQ ID NO: 39031 - DNA, 738 bp, Oryza sativa
ccgcataggcagagaggacgctggcaccaaggtggtagtaggtatacacaaggatcgctacgccagtttggatcctcaacacctcggcgtctagccattgacgaaagccggtcggatttgtaatgaagcaagtggagaagagagtactgaatgtgactgagttttgaaagattgtgaggcctcactcgttaaggcgacttatataggcgcaaaaaatcgagtgatacccctgacatgtgaacgtggtggggtatggtgggtacgcctgattggcgccgaaagatacatgcatgatcggcgccgaaagttacattggtcgtatgcgccaaatggcgggcaaatactcgtatcatacgcgaataaaggagactgtatcggtgcggcagaaagtagtcgtgcatgcgccgaaaggtatcgtgcacatataacaacaacgtagtcattacacaagcatacagtactggaaagtgaagcctgcaataacaaattaatatgtcattataaaaaatattacagtgcaactaacttatagtaaaacactgttcgtacctctcgacaaaggagtcgtgaaccgtgagtagctcaccgacgtccgtgcccggaacgtcccaagctgagccccctgcaccgcagtaaggtgagaccggtgtcggtgatctatcgccgggtccaacaactgaggtgtatcctgacgtgccatctctgaaaaatatagtgtttcgtgttagaacaattcaa

SEQ ID NO: 39032 - DNA, 5581 bp, Oryza sativa
  unsure (1)..(5581): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttttttgaatgtacaatgccaccttgctcattttctgctggtgatacatgacatgaaactaaagtttggactaatgtataagtatagagcataaaagacttcattttgtagtaagtatgagttcctatcaaaaatatgattgttaccatttatttagtcccaacatgcatgctaaattaaccactaattctacagttccctgacagagactacaagaatggatcagactaaaaaatacctccagaaaaaacaaaaaacttgatgctagcagctcaaccagtactgagatctacctctaggttaacagagctgacagcatccaactaaaagaactgcatctctaattaactgcaaaaaactgttactggtttgcagactaaaatttctcatatacctcactagttgaatgatcctcactgcatgtgtgataattcctcatttcttgggactggcacattgatctcatatatttagactgcactaagcatgataattacactgcagaaaaaaccagagcacaacctactccatcaaattagaacatcatcttaccaaaactcattcatgatctaaaacaagagcaccatacgcccacccatatccccttctgaatcgcttccataacaaaatgaaatgctactgcagggtacaatactacaatgtattagaaagaacaggagaacaaattacaactctcccaaaccaaatcaagaaacatgccatacatacaccaagaaaactaaagtactgaacgaacccccaagaatcaagcagcagctacaagggcacgcacaaacctagccgggcaaccgccggcgggcgtcgcgcagcgaggaggaggaggcggatctgcgcctcagcgcctcctctgccagtgagtcgcgccgccttggatcccccctgtccccgcctgcttggagccgtgtgcccgcgctgccggctcgccgcctcgtcgtcgttgcaccaactgccgcggtgccacccgccgcgcccacgcgttggtgcctgcgatgcaagcgctgagaccggagagcgagattgggagctaactagaggaggcggaaaccctagaggaggagaacggaaacccaggaggaggagaggaggggaataaggagaagagcttacccttctcgccggaggaggagtctcggcggtggcgcgtctcgccggagaaggaggcgtggcggcgcccgctgttgttcgcgcgagagagaagcgactccggttgcgcgagcgagaagcagcggcggatcgagagaggaaaaattcccgacctccggaggtcagggacctttccctagggtttccccgcggattgggccgggaaatccctgcctcgtgggcttccaaatggacatggaataaaacccgtgacaatttcccccgtgggcttttctcccagggaatgggctgggatcccggtgggatcccgggctgccaaaggagcctaagaagaggtatgggcagtattgtgattacgaaattcactgaaactttatgaaacatgacaaaggagtctaatcggtaatacagtaacacggagagtacaagagaagttacatacgacttgagcccttatttccaggtctttcggtgctgaaagtgaattgggagccaaaaattctaacgacaaaccgcgtgcaggaggctgctaagaaattattgcctagaattatttggttccaatgttgacagatgccaccaatggccaaataagttaaaacatctgtcgctgcaattccggagatactctgatagataatgacctagcttgactattctgatagatactccgaaaaagttgatgcatactcgcgcttaatttactgtttgtttttgtcgatttatgcaatgtaatatgctaataacgatagcacgatcgacgactagatttttatctaaggtgcatgtactgctaccggcataatctaaaattaatggacgctcttgattgctcgcagaggagaaaaaagaactgcttttttaattaaaagaatagtatattatatatttttactgtgaatatatgataggacgacacgcttaaatttttatctaggcctgccatctatcggtatgatctaaagctctgattccaagaggtatttcttccgcgtgcttttagcggttgcgttgcgttagccttcctgtgctattcatagcctagctactccgttagttcgggcaagcaaaagttgagttcactctactactccgagactcctgagtgtttctgcaaaaacttgaggagaggggagagggtgatatccatggagatggccgacccagctgagagaagacggacgatcctgcgtcgtcgtctcgtcgacgagaaaactccatagcgtttcatctccgcttggcgatcatgttggtgatgatgctgagaaagctattactaaataccttcgtttaccctatgcccgtaggcatttgggatgaacaatgccaggtacgtccaccggccagatgatgtacaacgcatgcatttcctgacgtggctgacaacgtgagttacaacgtaaaatccggctatgtcgatcatgaaactgatggatcaccttaattacttttgatgcatgcagctggtttataagacaattatggcggtactccatgcgctcaatccgatactacggccacgtacacttggtcacaactcaggaacgcgtcgtgatatcttcggctcatcgccaggaggaggagatgccggccggcacgttttggtcgatattctgtcccatatttgttttaaattattttatcgttcaagctatattctactcactccatcccaaaaaagaaacatatccggtgaaaacgagctaagagctgaaactcgtgaaaatcatacctcaaagttttataaatttataaaaaaaattactagaaataggtgtagatatcaaatacattctcaccaaatcttaagtttaaactcaactttgtttaggacttaaaaaaaaagaaagttcaggtaaatagtaacatgatactattcagccaaaatttgccccttttttctattaaacgaagttgagtttggagttaagaattggtgagaatatttttcatatctacacctatctctagtaattatttaatgaatttacagaacttttaggtatgattttcacgagtttccaacccttagctcgttttcactggatatatcctccaaaaaaaaagtcaacttatacaaggatgggacacttcctacatgttaagattcattatactatgaagtgtcccattcttatctaggttggttttttttgggacggggagagtatgttaaacatgtctgtttgattatgtatagagtgattttataatatttgagaaggtatatattgagagtataaattttgatggtatctctcaggaagtgtaaattaaaattccccttagaaataagtatagtttaacaaactgataccatggttgccagttcaacgtaaaattatggtcatgtgattgtttgtgtatttacaatatgatgaactcgaccgtcttacttttgctgcagttccgaagcgaggaatctatggccgtcagttgtcagcagaacgagatacgacttggccacagctcatcaggggaacgagtactacaccctttcgctagaggtggtgcaggtggcggcgctcctttcgctcatggggaggagcacattgccatcgatattgatctgctactgcaagccactcccaatatattttctgcgcgagaagctagtccaactcctgtaagttgtccctacgctgacagccaattattaatactatcattagctagttcgtgaattagttcttcacgggttgcaacttaactacgatttttttttctttttgcgaactagaacgtgctagtgcctaaacttattgttccaataacaatgccttttattaggacttctatatagggataatgcttctcaaccgacgcatcggacgccaccgtttgactgcataaatcagccaggcaaagatgctttatgtgcatagcctcatgtactaaggcagggtttagttcccaaattttttttttcaaaaacatcacattaaatctttggacacatgtatgtatggagcattaaatctctactattataaaaactacctgggtggcccgcataattacgcggctagtacccatataaaattatctatttttaatatggttttacttaaattttatttaaattttattaaatagttatcttgttgtcttaatattttgaaagaccaaagcttatcatctacatatttctaattttatagttttcaaaaatcatattagttatccttacttttttgtcacccttccttttttttttgctttctcgatctaccattgcttctattcattctcgttgaatcctttaaaaattagacattgtagtttttagattttattgtctcgttgggttttatttttataatttttagaagtcccatcaaacgatgccaccatactcctctaaggcccgtccagtgcctctttttttttactgtcattgggattttaaaagtcaaatataattatcttttgagtttattttttactttctagaagtcctaccaaaccatcactggctttgccactatattcctgtacagccctctcctttttttctttcaaattttaaaaatcgaacatgattatcataggggtttattttttagaagtcccgctaaccgccgtgatcgtgcatctgaacggtttgtctgtcgtccctccttttaatcattattgggattctatttgggttatgttaataatttttagatgtcacatcaatagttaccactctacttttttacaggagttttacttctcccctcttacttgtcatttgttatcatttgttaatgtttaaaagtcccgtcaaacgctgccaccatattcttctttgattcgtccactgcctgctctctttattgtcaatgggattttaaaaatcgaacataattatcgtttgggttcatcttttactttctagaagtcctaccaaactatcagtggctttgccactatacttctcaatggcttgcccactccctccctctttaatgtctttgagattttaagaatctgaacttgattatcatttttttttactttttagaagtcccgccaactgttgtgacagtgttgcttaacgacatgtccatcgtccctacttttaattgtcattgagattttattttgggttttgttaaaatattttagatgtccaatctaccaccaccactttactcctttaaaggcatgttgcttctcctctctttattgttatttgtcagcgtttgtattctagataaacttcttttttgtaaagtccatatttttcattccaatattttttatttataaattatattcctacttgaactcttacaagtatttttctattttttagaatttatttttaattattctcgtcata

SEQ ID NO: 39033 - DNA, 2893 bp, Oryza sativa
tctactattataaaaattaaagatgtttttaccggtattttggtacgtcatccgtgtatgagttagtttttaagttcgtttgattttggaaatacacactcgtatatgagtcggtttttttaagatcgttcacttctggtaatacagaaggaatcatataagaaatatgtttaaaaaaaacttgcatcttaacttgagacgatcggactccttactgcagctcatgattttctatatatatatatatatatatatatatatatatatatatatatatatatatatatatatatatatatatatatatatatatccaagtgaacttccacagtgaatttcatcttaactaaaccatataacaataataagattaaaatagacttaacctgatgcaacgcacgaatatttttttctattttttctagtatagataaaaataaaaactaattacatagtttgtatggaaatcgtgagacgaattttttgagcctaattagtccatgattagccataagtgctacagtaacccgcatgtgctaatgacggtttaattaggctcaaaagattcgtctcgcggttatttttcattcgtgtccgaaaaccccttccgacatctggtaaaacatccgatatgacatccaatttttttttttcccaaacaacacaccttaatgcattatgcctttccctgtgcaactggtgctatctcccccttacccttagccttactcttgcatgcatataaggcttaatttattagtaagcttaaaatatttcttctcttggattacttatctggtctaccatccaaccacatcattgtattcgttgcaattaaatcattacaataagatattgcatgattatattctaatgaaaggaaaacatatgtttcaacaagtatttcaagaaaaaatgttttaatggctaaatttgttttcaccatgtaaaatttaatgtttgactggtgatcaattaaaacatttgaccgctaatttttgggaggaaatcagacatcctattggtagtagctttggttgtaagaaataatctgtacttattttcttattcgatagatcatatatatctatttataccaccaccataaatattggtaatgaaattaagtgagtataatttattatttttactggtagtgaaatacatgaatcaatgactaagactagttctaccgatgagactactatataacctgcacgctgtgggtccatacccacgctaatactagcctgtgtacattgttatcaccatagttatattgtgatgcccttctctatctaaaggattgtctggtaacagattctgatactaactccatcccctaccactattatataacttaaagtttaattgtaactactaggactgtgtatatttgacacttattctaatatacgccacatagatcatagaatcatcatgttgatccaccgatcctttagacttgagttgtcttctattgcacctccaccaagaagcgatagttagcctcctgacgaggttgtagtaagcttacagccactaaaaatagtaagcttaccgccactaaaaataatagctatctcataaactactactttagtctgaactccatatgcaatagtgtaccctcacacctcgtaaagctccgactccaccttcactctagccatcatcaaagtcatcttgcccttcataatttcaatagtattcttattccaaccagcttgaaatattgacccttcttcatgcaaggtttcaaactaaatcacaattcttttttgccctgatgcatgcctggctccttgaagaacatattcgcctccatctttcgtcttggttttcacttctcctgctcccatgactagataccctgcgtcatgcctaagtagacaaaacaaaactcacttgactgattggcatgaagagaatcattccttcctaggtatcacataaaacgacccaaccgagtacaatatataaaacgacccaaccgagtacaatatatgcgcttccggcttccgcatcattaagctatatgattgataatgtaagaagatcaccactagtatctttgagtcacttgaagaactcaccgcattaaccctaactcttatccttcagtgttggacaatcttgcttttatgtcccccaatcatcacatctaaagcaatgcaccatattccttttttatttttctttaccttattatgccctgcatgcttttttttgactggcaaaccttctacccgagaagtttcatgttcttcgtttctttctcatctgatcagaaaacagcaacatagaagtgatatctttaacttggattattttcatacgttatagtagtcaccacatgctcatatgatttaggttattaactttcacacccatctttgcattgttcacatgttctggcggatctgactcttcctatatctttagccctaacaaactcatgcttcaaatacatcttattagttagtcttggacataaataagtcaccaactttttttttctaaactgtctttggtgagctctccctcgtcgacctgaactgagacataaccgtatatcatcatatggattgatatcctctaacttacttccccacatgtcagtgactcaaaataagagggaagtaagttagaggatcctcttccatcaacatatatagctgcctgcaagtacatctccctggcctcagtggtcaaatctattgggactatcatattcgacacttattctaattatactacctgcagtaattatgtgaattagaagcttgtaacttgtaagattttgctaggacaatattttggatgttggcaataagctctttaaacataaatgcattcatatcttagttcatcaccatataattaagggaaa

SEQ ID NO: 39034 - DNA, 15997 bp, Oryza sativa
ttaaattgcttagtttttgctataaacagctcattgccatattcattaatttcgttagttttactattaagggtacaggggcttagttttactacaagcagtgagatgccgtattaatgggaatcacttcaagggggcttctcagtgtctgacatgttaattacaccatattaacatgtaaggtgcagccagcgctggcatcagtcggctctgttacatatctagtgttgttagagcgagtacaatagagtcagttgtaagcacacatgtaagagaaaagagaaaagagagaaggaaagtgggctacatagttgtagccagctgcaacacagactccaatacattgtgtgtacgaaaagtgggaccatatattaataatgtagtatatacttataggtaactattgtatgaatgagttattatgcttataggtaactattgtacgaatgagttattagattggctgtagataaactgaagctgtagttggctatactattaaacttgctcttaagggcagtagatggttacgattttccttctagattctagtaatgaaatagcatgccgccattaattataaaccaaacatgttattctagtcatgcaaaaacatttaagggcagtaggtggttacgattcttcttctagattctagtaatgaaaaagcgtgccaccattataaaccaaacatgttattctagtcatgcaaaaacagtctcaaatctataattttgtaataaattaatcaaaatacatgtaattttgtgaaattactttcattataaaccaaacacgtctaactttatagcgtgtttgattgaaaaaaataatatgatgtgctaaataatggatttcgtttctgttaatttcatttgttgcaggtgactccagatgaccgggtcgttgttgcacaaactttgcagacaatattagctagtattttacctttatgtgctgcatcgcggcctctttttaaggatggtcctgagtacgccaaggtcgtgacgtttggttttctgggtactatcgttcttgtcgcttatgctggggtgtttgccaaggcggccaacagcaaggccgcgttgaggctggtggtttctgcagctattgctgccatgacatttgccgtggcctctcagctatctggaatagggtacattgttaccgcttcacttactggtgccatcatggcggccttcataatgctggcagtataattcacgcccggcccccgctgctgtgaacggtaagagaattcatttagcggctagtagcagtagctaaagttttcactgtttcatttactccctatggggtgtatagtctcgtgcgttctattctatcccagtttaattatcacatagttcttgagttctttccaaaataatcatcatctaacaagtacatatttatttatttatttatttatgtaaagagaaaatgagtatcattgaacgctacacgcaaccaactaaaattaattcttataggtacaattacatgcaatatttaaaccttgatgcaatccacgggatacaaatcaacgtattaccttaacagatgagaattaattacagaataacgaaggtttagttgtcaatggtctctacgctatttgtttaggtgatgatcaaaatatagaatggagggattatcatattagaattagtactctaattcctgcacatatctaccattcatccatacagagcattttagaattaatcttaattagttcacacatatctaaccattcaacaaaatatatcgtatagtagagttgcagttttctatattgtttaagtttaagattaagattttacctcaatttccgttagcatgattttcaaactattatacggtgtgttccgtgtgaaaactttctatatagaaattactttaaaatatcaaatatatctatttctagagttgaacaaactattttatccatttatagaattatgtatgctttataaaagtacataagaacagtatctttcatgaatgcttgcttctgattattttatcttttcaacgtcagcagatggagcgggcgccggccacctgagttccaggagaaagaagcaatggaaaccaattgtatttgactgggtgattatgttgacaagatttttgctgtgtagtccttttcaaaatgtaaaaaatgtacgacgtcgttcattttttttaaacgtttgaccattcatcttattcaaaaattttagtataagtatataaaagtataagttaagattatattttatttaaaacaaatcaaaaaaaataaatagtatttttttaaaaaaataaataagataaatagtcaaacgttatgaaaaagtcaacgaaaccatacattttgaaattgaggaaacatcacagttacatacattttaaaattgaggaagtatcacagttgacatactaaacctcagcaatgtgttgctgtccgatcgatccgtgccataagggcatgcgagaacatttcgcagacactggttgcattatcaaataactcgaatcattggtgtgcagactttgacgtgttctgttgcatctttttgggttacttgtcatttgctatgcactctttgctataagatgacactttactcaggtagtgcacacattgcttaggtgatcatacaataatatgagcttcgttttgcgtgccggttcaacccctcctcccgaacacagcctaagtcgcccttcttaccgtttctgtcgaagttgtcgtcgccttagtcgccagagcaccataccacaccacccccaaccctattggccatcgtctgtccgttacgatttacacacccgttattttggttcagtcgtgtgacaacacactccgttgtgtactattcgaagcaatgacaaatgaagcaccaagagcaaggttaataggagagcccgttgttggttccaattagtagccatgtcatctatattaaatcttatagccaatctgtagtgcaaaagatgcattgtaacacgaatattttattaattttgtgggggccgccatcttccccaatctcttcctctcatctcttctctcccggttgtggatgcagggaatgacggtgtacctgcggcggctaaggcggaaaaagacgacggatgtggcagaggtggaaaagagcaacgtcagtggctactgtggacaatggccgcagcggcggcagatagacgcaacgagcgcggaggacgatctgcggggaaaaaccacaacaacggtggcaaaaacggatgtaggcgaccgaggcaggtggaatactggaatagaattgcaacgggggcggaagagggcgacggcaacggcgcgatggacgagggcagcggcgacgccgggcataatggacaagggtggcggatgcagttgacggcaacatcggtcatggcggacaaacacagcaggggcggacgtagtcatcaacgacagtgatagtggccacggcggacgttggcgacgccggcatacatgacgactgcgacctggttgagcgcgacggcgacgaaaacaggcaagagcagctcgcgcggtaacggtgtctgtgggcacggtgaatgcagacggaagcggcggcgcgagcgagagtggtgagacaggcacaggagatggcagcggccgcggtggacgaggatggccgccgcgggcgtggatggcgagacggacgtgggccactgccgcggaggacgaggacggtggcgaacatgaacggggacggacgcaaacgaggatggagcgatggcagccgtggcgggatgactgcaggcgaagacggtggccgcggaagacagcaatggcggcggccagggaggacgaggacgacagcatccacgaccgcgagtggggtgcgggacggcggcagccaaggccgcgggcgagggtgcgggcgacggcggcggcctcagaagacagcgacgacggcagccacgaccacgggcaagggtacgagcgggggtggcagcggcggcggcctcgaaagatagcgacggccgcaaccacgaccgtgggaaagggtgtgggacggcgtcggccacggaagaccgtgaacacaaaaggatgcgctgagccactgaggcacgggcgccgctagcgcgtgccatcgttgtgggccccacgcctcgggccacgcatatagccaggcaactaattagtcgcccgcctgttctctctcttcccctctcttctagctcaacaaaaatcctacgtggatctcttaccatccattattgtacttgctctaatgtgataatgaaaaatgatcataataaatcaacgggaaacataatatttcgtattgtggtaacataactctaattttaattcaacaataaacgtgtctaagtgagcgtagcttaactgattaggtttcttgtggtgcaaccaggttcaagtcccaaatttaacacggatgctcgtatttacaagtaatttttttagtggtagacgacatacccgtcgacaacaagatccattttcacaatgcttattatcagcaggttatggtctttgcagtttgcactgaactatctcagacccaccatggatcatccgagcatcatttggtacattacatgctgtacaagtcacagcaagaaaaccctgtaagttccatcttgtcccccagtgttctagtggagtaatttcctgccaacctcagtctacttccctacaagctaaagtgtcactgatcacgctgtccaagaaacaacatggaaaaaaactcgttgttctgtgtgtctaatctttgttctttctctctaaaccaagacaggccgctcttacaggccctcaatctcgagtgccttgcgcactatccaaaccaccctctctgcaacacaacagtaataaagcctaagtgacaaaaaggaaacagcagcaaactaaaataacatacttctgcgctgttttgtttttgtttatttcaatttaaatcataaattaagctaccacttacagttattaatggtgtgtttaagctatagctagaggaaaaactccaaataatgaacaaaagtgcccctaaaataatcttataggcattgttaatttcattctaacaattgcattaatagcagtaaatctagctacagcttaactgatagtgtaagcctctattaaaaacaaattcgacaagaaaacgaactaacctctctccaagcgtcgtgcatcctggatagccactgcagcatacacaggtaggatgacagctgcaaatagaaggggcagtaacgacaggctatcaagccaggtcttggaataggcagccataacatagccaataaaaagcgcaagcaaccctccagcgaagacaatggtacgctgcaaaacaagagaagcacaccaaaaaaggaagggaatcatatatccatgggaagtacaaagattacattgcattatcagaattagtcattaactgacgactccttctcatttcgattttcatacggagtctattagactcaaaactcaatcacacaaattatttcattatgtcaactcagaaagggtatcttttttaagcagtcttagttcccaacttaaccaaagacaaaaggtatcacatgttactaacttactatatctaacagttttgcatttcgttaactatatcatgtattttgtatttatatgattttgtttatcacaagtaaaaacttgcccatttttaaatgcaaacacaagaatgaaactcaccatgcagaagtaaaaaacccagttcctagtgatcgcgacaaccgcctctgccgctgcggtcgccggtgtaaaaaaagctgctatctccatggggctccgcctcctcctaacccctccagcttccatgctgataaggtgtttggtttagagcagggaaagcatcaacaagaaaaaacaacactatccaccagctaacaagtgtttacacatgcaaaagcaaggaatcatatagcaaagataaaggataatgtcagggaggtgaggcatcggacttgttcagtcaaacaaaatgctcatggtcactagtgcttaaatctggaagttcacactcctaaagacagtttcggttgtgaaaagtttccgtttttctcattgcataatagtaaccagccaagcaatcaactagacagtcattaccacacaaatgaaccagatttgaagtcaaatgtgtgggggaaattttagggcttgggaaaataataccttcggtcgtggttacccgccgtgcgccgccctctcagactccttcagccgcagccctccgccgcgccgccggccgtcgggttttgggaggagtgggggaagacacagggagggagggagggagggcgccgcctccgcctccgcctccgacgtgcgccgccgaccccgacgacgacgtgcgacttccctcccgccgcctctccttcctttctcctgcttcgaggggtagggcggaatggggtaatggggttgggagttgggacggaaggggtagggcggtggcaatttacccgtaatttggacgaaacttaatgggtagcggtgtcatcatgtcatccggttcaattcactctagttcaatttttagttggattttcccaaaccgccggggcgggatcaccgcgccctgacgataagcacgaaaccctgtaaaaattatcaaaattttaaattatattttaactttatttgaatttaaggaggttaccgtggtttttcttttactataccccgtggtaagggcggttaccggcggttttgcaaaccctggttggatccttttgggcggaggtgtcgtattctctaccagtgtcttctccctcctaatcatgagttcacgacatccggcggcaggcagatgaggctaagatttataaaaagaacatctagtttgatcgtcgatttttgagattttggaaagatgagtgctctagcttctgttttctagtttattttctggattctagaattacagtttctcataatctaaacgaaaagtttaactgtttggaggagcttctgattctgcggctgctagaaactccctaaacaaggctacacaatgttggtaactacgacataaggtattattactgactttaattttgttaatttatgtgggaacttcattgaaaaaattgaaacggaactatagtaataaaaatataaactagagagatggaacgtggtctatatcgctccacagtttcactcaagagatggctcttgtagttagttgtaggagttagagtcttatcaaaccaaacatgccctaatcgtgtggttgtgctctagctctaataaaaggtggatataggagctagagctctgaaaaaaccgttagtttcccacgacaccttgttgagtttatctactaacatatgctaacacaggatagggatcgtcgtgtaataacttgtcctccagaaccgcacaacacgacgcatccgacgagcgggtccgcttacacatatcacccgaaaagcgaggtgatatgtgtaagttggcccgcctgttggataggtgaggctacaagattagaaatctaagtgggcctttgtagaaaagtggttccttaataagagaagcttaccaaagtcatcgatgcaaatttctctgcaacaacgagcaccacatgtggctcaccacaaggtcgtcagtactgcaaaggagctcgttggacaagacgagcgcataagctcatcaccatcgtccttgattgcatagtgctcatgccccacggagagagctgacatcgacaatgacgcgaggcatctagtggaataaaagcatatgagagagaacaacgaggagggtggagaaatatccactaaatacgtatgtcttttcaaaatttggcatccaatccacgtatctttcaaattttgctatggggatgcgaattactaagttccatatcactccgttcgttatccatcatcgtagtccatctcgtctcactatatgtctgcctatataatacatatgagtaaacaccattgtcagatgactagaatagcataaactaaaaattcgtatatctgctgacatggattagatagcaaattccgaaggacatgcacatttatacatatccggtgccaaaacagtgaaatttcacgggaagagcgttcaatccaacggctcaaatcagccaccaactccccctgaaccaccatcgctagtcgctacagtgaattattgtctgtatttctttcagtagttgtatattccattttggcaacgccatcgccacgtcgcctcgccacccgaagcatcgaacccgaaacgctcaccccaaaattccccattccccaagccctaaccctagctttgatccgaccaccgcttcccctcccctcccatggacgacgacgccggcgacgcctcgccgccgccggccgccgcgggggttggcgccaccgccgcccagtcgcgggacatggcggcgtcgccgaccagctcccgctccgtgacggagacggtgaacggctcccaccgcttcgtgatccagggctactcgctcgccaaggggatgggcgtcgggaagcacatcgccagcgagaccttctccgtcggcggctaccagtgggcggtctacttctaccccgacgggaagaaccccgaggacaactccgcctacgtctccgtcttcatcgccctcgcctccgagggcaccgacgtccgcgccctcttcgagctcacgctgctcgaccagagcggcaagggcaagcacaaggtccactcccacttcgaccgctccctcgagtccggcccatacaccctcaagtaccgcggctccatgtggtaagcaaatcttctgcctcgatttggattcggtcgtgaggttggtgagttgcgttttatccattcgaatgtctagtttggatcggttagtgctgaattgcggatcgatgttggtagccaatgtgctatgtgtgattcagttgtgattgtcctgcaatggcgatttgagtattggcattatagttttcatgagattattgaggttcattcatgtgaataccatcatatcatatataatacttggcatttgcagctttacatttttagcagctcagaataccaatatatgtttctacaattatttgagttgggaggtgttagtgcccttgcaatagtttgttgtatgccatacagcttatatagtcacttttttagcggagttgatgcaaccatcagaactgcataatagaatttatagcccttgtgtttcagaagaaggaatcttaaaccttgtcttgaaactgtcaccttcttatgctttatattcattggttaggataagtttccttcttctattggactggccagtagccacccctaaaaatatttcatactgccaacatgcaatttgtgatttggttttgccgaattcatgcaaccactgtgttgtttgatttacctggctttcatgctttgggattgcttcattggaacattatgcattagctactgtcaagggattttggaatggttttaaacttttaatgcaatctgttgtcagcgattttttttgaactgttttgttagtttagatgcgtaccaatagcttattgttgtttcagattcgtacatttgaatctaactgaagtgacagataccattttactgaaatacggaaggtgagactcctattctgtactggtatgttagatataaatggcaaagacttctatctgacaatcgatatgcttaatgagtgtccattcttgtgttttgaaatatacagttaactatcttatcagtttctgataatcaattttattctcctttctttcaggggttacaaaaggttctttcggcgaaccgctcttgagacgtcggactttttgaaagatgattgcttgaagataaattgcactgtgggtgttgtggtgtcgactattgattactccagaccacactctatcctggttccagactctgatataggctatcattttggtacgcttttggacaatcatgaaggggtcgatgttgttcttagtgtgggaggagagagatttcatgcacataagttggtgttggctgcacgatctactgtatttagatcaaaatttttcgatgatgaggatggggagaagaatgagcctggtgagaatgatgatgtacaagagattgttattgatgatatggaaccaaaggttttcaaggtttgttccagcttcttattttgaatttattttatccttgtagctttagaagttcagaataagcacttactaatgcgaatttctttgcaggcaatgcttcattttatctacagagatacacttgttgatgataacgagttgggtgggtcaagctctgagggctctatcttcgatacattggcagcgaagttgttggctgcagcagacaagtatgacttagcaaggctaagattgctatgtgaatcttacttgtgcaaagccatttctgtggctacagttgcaagtactctagcattggctgatcgacaccatgctatggagcttaaagctgtttgcctaaagtttgctgcagaaaacctttcaggtgtgtaccttacattcacatcaattctggtttgcattcattgcgtcctatgggcccaattttggccctattttatgtcaatcaaaatgcttcagcatggagctgtgaatctgcaaaatatcttgatttggttcaataaataaattttagccctgtgtgcccagtgtgttcatttgtttggtcatgttgccatgggaaaagttccttgtactcatcattaaaacttaacaattgttcgttgtagacgcatccatgctttcagtatctgaaccaataacaaattctttagaccagcacagtttcatgttgtcaggtttgattttttttcttcggcagcttacagcatgttaaaaatgtgcactggctgcaaatttcttttaaagctctcaaaaattaaatgggaagtagcatgtgcatacttctggtatcttgttgcatttgttctattggtgatacagaacagaatacctgaaacgtgttaaggaagaagcgattataaaactatttatgttcttaaactggactggtacagcttgctagataaatagtggttaagtttgcaagtggagaataatattatgagatgagcggcatttactttttggtcagaattttagctctgttaaaattccattaacatatacaatttaattatttcagtaatttcatattttaaccattgtgcctggaaaattattgcttccacgtgtcatcgattgaaatctttaccttttggttgctttctggatgcaattatgtttatacggtttcataacattccagatacccttatgtctctgcagctgtaatccggaccgaaggattcgattacctcaaggacaactgcccatcacttcaatccgagatactgagaactctcgccggctgcgaagaggagtgcagcagcggcggcaagagccagagcgtgtggggtcagctctcggatggtggtgacacgagtggccgtagggttaggccaagaacctaaaagacccaccacataacactgaccttgtttagcgagcacctgtgtaaatggcgacatcaatatcatctgtatgtgacaaagatgagatctgatagttgacttggacttcatctcatcacgctctttttgcatcgtaattgctatgctgtttataagtttagctgattgtatttgatcctgtgacccgttgctgctgtgcggacgcttccataaactcactacaaaatggtgattttttgggacttgttcgaatcagctttcttctgctagtaacagatttgttttagctctctttagtttcgacttggatttatttgatcgaattggatggttatgctcagaaggtaaaaacttgcaaaggatttttgttcttaaccaaagggtcttggtttagaaattttgatatcttagcatactcacgcctgtgtggctgtgtgtggtttatggacgcttcctgtttgattagttatggacacttacattggttggatgagacaacctcaatccccgtccacacacagggattttatcaaaaaaaaaaagaaattattgaataaaagtgtgaattagagaaacttcgatgtgacttgagaaaaccaaacatcctgcaaagcggttgctttctcacgatccagcacttggattggcagatcccacggcgacgacacccattccgcctccttccgcggatctaacgcccttgcgtcttctcagctccccttctgtagagttcacccatttgccatctttatccatgtcttgcacaagctcatcgatcttccggaattgataaggccatcttgcgttgtacagaaattgccgaagatcgaaccggttatcctcgggcgaatagctctacagaaattgtccaacggcccaggttacagcagtgaagaaaagatcagatgttcatacgcatatgcactgaaaaagggaaaaatgcagtacctccgcatgataggatggtgtcaggacagtcatcttatgccggtttatcgcgtagtacttgaagaagtgcttcactttgtcagccacttcggagggggatagtgtcccacaccacctgtggcacaggttctgcggcaatatatgttagcattgtagtttatgcgccaaactctgctgaaattttatgttttgcgttgatcataatagaatctgatgatttaaagatccatttcaaatttaccctgttagatcctacatttttcagatgtatatttcattagcaaggcaatgctctacaccaaaacagcattataaacaaatacgactgaacaagtttgagttaaagcatgtctaatgtatttattattgcataggttgattttttatgattatttaaagtactactactattgtttttaagataagtagcaggcagcagcatttttttccaaccttctctatcatccatcgctcatcctacaagtgaggtgaactgtagccaaccctttaacttactgtttacttcagtccattttatattacagttgttcttctatacttaaatataacaacagcagaatatgtaaaaagctccagaaaaagaaatcccataaaaaggaaaatcctcaacaaagcagacttactccttatagtaattactgaaaatgccatctcgtttggaacagtaaaactaccctttggtcaaatatgcatataatcaaaacagcatgactcggttagagagatgcatgagaacgctagagctctaggtgagagttcaagggaaaaataaactaaagaatacacaaagattaaagtttgctgtgataggaaatatcctcttctgattaagctatcaaaagcatatcaaattcatagagaccaacctgaaacattgaaacaggaccacaacggaaaattttccttaaccttccatatattgacaactcctcgtatgtcattcccatgtccacctcatccaactaattaagcacaaataatgtcatatgagaacaagactaaaacaagatgagcattctgataaaaaatgataaaattctgcagtagccaactaagctatttcatgcagaactgaatttaatgaataatctataattggaatgatcagttgcaacagataaacatatgtagttctggtttttaggccataattgtttctagctttaacattaaattcaagccttttgctgttttgcaatatgtgatagagctcatgattagacaaaccatgttgtaattttgaactggaaattagagatcaaatttccaggatatgtaattacctgattatagtccgcacggatcggctcaagctctgcagtaggtggcgccgcttcaacctcagcaagggaagaatagtgaagatgaactgctgcccatcgcaggaaagcccggaggtcctgcttacttacacttccaatgggatttatatctgccgagctgcagtcatacttcatagaagaaaaatatagttatttatcatttccagttagttccagatatgatgtacaaaatttacggattcagaattaagaattcattaaggaaatgctatatacgtggttcctcttatctttacttacaaaaaccaggcaaactggccaaggcattacatctaaaagttagaacatctgggttgcactagtatttgagcaacttactttcgtcaaataaccacgcaatccttcatccacatttgaacttcccagaacaagatagaacccggatttgttatgaacccatggcataagtgacgccatcataaaggctagtaccatcctgattcgagcttgaatattttgcaatcccagattctcagtattggaacccccatcaacctgaattattttagcataaatagtagtcaacaaaatgtaataagaatgaaatgataagacataagggagtcaccgctcatgctaacttccatgtttgcaatctgattttcagatgatgtcagataaaccattgcagtcacaattgttcgttagaacttaaaccaagacaataatattaagttttgtcctcgacaagtgtataaataataacatattacagtttatccaaagagcattgtcaacaaggtgtcaaggtgtgacaggcgtcaaggtgatcagttagcaagcttgtgtagcagatcacctttgccttgagaccagattaaaacaaataatagaacctgatggtgcatcaaccaacttttggggtggcagatcactaccagatcgtgctacatatccaggtcaccaggctctgtagcaagacctttggtagtgagctcagaccatcactgctggatttgactacatgtggcagccactttcaccaatactgctaaccatggccacagtccacttaactccttcagcaatggctggtactcagctcctaccactagctcactgctgtatgggtgcggtgagttggccatgtggacttattgggcatcatgggttatgaggacccttgccattcattggcaatttaactatccgataacctcttttatgagctatacagtaaaaaagtacttcgtatatatcattgcaataatgccaacacatcaatgctttactgattaaggattgtcctttcatatttcaaactaaaacatcatacttcattgccacgttccatgtttaactatttacgctatttgcattccactttagcccacaataaattaaagacagtggtctaactgaactacacagtagaacaatgcatgcactttcttggtctcagtgtttatgcaattactggtagatttcttccagaccagtcttcattgccctggatcatatttttactacacatgggaatattttgcatctcattgttgttggataaacgtgtctttatagcctttgcagaaaaaaaaacacttccaaaaggataaaaacagcaagtccgcacatgtcaactcaactcctagaatgcagtcatgcaatttatgtaggaaattagagtagcatatcacaaataccttgtaccgtgggcgtttcccagtcaatctttcaaacaaagaaagcaatgcagatactatactatcaattggtacatccaagtggaatgaaccgatctcttcagcaagcattttcgctcgtgatcgagtaccttcagaactgtgacaaaaaagtagaacagtatgctagatgaataaaaagttactgttatagcatatatagataaatttacatacgaaatcgagaaatagtccatgcatcattgacatagattgatcatcagcatgtgtagccaatttcctctagtctaagacccttttgtcgtactcgcttatgagaatttggatcatctatgcaaacttcagaaacaataatatgcaatacatgtcagaaatgttattttcagttatattagaaaaaatataaatgatacaggaaaatagggtttgttagtgtcaatactggttttatcatattatttactagtatgttctttcaaaggtgttttgagttgcttattgctagaatctagcattgtcttataatctggtactccctctg

SEQ ID NO: 39035 - DNA, 74999 bp, Oryza sativa
  unsure (1)..(74999): unsure at all n locations
aatcccttatattatgggacggagggagtattatcatgcaagatcacgaattcataagtatccaatgcaatccagtccagacttgcctagtatttggtaaaaaccgtgcctattatttggtaaactagtgtgtgtatagctccttattcgatatggcaaattgttggattatattattctgttgacaaaaatggcggttagacaatagttgctgaacttttatcgggtcgtcaacctagaatattctgaattccatcagaagctacaatgatccattatgggcacacgtgagcgcgcgcgcgcgcacacacacacacagagattattatttgtgtgtataataaatctatgaataatgaggcgatacagtatgctaaccattatcaaggcaattaattcacatgaaatattatttcattttcaatgcatatcaaacaacaagaacatacataaaatatatgatcttagaataaaacccacctattttcagtccccatgtaaacagtgtaaaataaacgttttgcgagctctctgctatctttagggaactctccatccttgtactggccaatccgcatagcatctgccttaacttgctcatctccattctctatatctgcatattatggggactgaatagtcatcaatttcgaaacaggcacgtcagttataaattctgatgttacagaaacaatttcacaaaaaagaaaagcgtacaaccataactgatcaactggcaaaaatgatctaatggtaaatgggcaacagtacagaaaggataaagcttcttgttacatgaatggcccactcacactttggcactaaatttacagcatcacttatctcatccatccagtagttctctgccccattttactattctgttcttattatgctagtcaacatgatttgactacgttttgaaggcatttcatcaaaatcttttgctaaaaagaaagaggaagaaagacaatttggactgaccttttacgacaagctggcacatgcaaccaactattgctgcaacagatgaactatccgcaccaccagacagtggcagcaaaaatcctgatgctcgacttctccgcagataatcccataaccaacaactaggtccaaatgcaatctcctcttcaggacgatgatacataacctaccaaagatagatgcggcagaaagatgtcatacaaccttttcatctgcacagtggtcaccacctatcctctacactttgaggctgtaaatactataaaaagacaaatggagtattttgagtgcattaacaatgacacagcagggattcatgtgataatttgctcaggatagaaaaaaactgtatttaagtaacttcaagttcagtgatattataatagcaattgtatttgcaggcctactttcagagacaaccgcaagaagatcagaaaagaaaaagaggaactctcactacactaacaatctaaataactaatctgtggcagggtctaaatgggtctagtggtacatctcaattagtcaaattcatataatccattcattttagccttctgcaccaattaccaagaccagtgcactatgctgagttcttacatcctaaatattgcttattttgcagtctaaaactatagtccatgtacacaaaattaactccacagtaaatggcacctctcccagcaccaacctagaatacctaaagcggcatctagcagagaacaaagcccataaaactacgtctaaaaaagaatggagggagaaatttgacaggaagtctgttaaaatcagccatgaaataaaggaaatttaataaatagcaatatattagacaatacatatgttgcacgatagtttatgaaaatgaattagctgaacccacatggaactagttttcaaattgcataatatgctaaacaattatatgatgcttaatattgttattcccaataattgatgcttgaggacatcttaaatctcttatatttaagaaatcatgtcaagatagaatcaaaatagatatataaacaggaactgacctcaacaggaccagttggaaccattccactctgaaatggcttacaaagcttatatggtaccttaacaaaaggtactttggttcggtgacttgcttgctctctaaaactagaaacagatgctcgataacttgatacctgatggtacaaaataaatactcagtttatgcaagaatacaacccatgaacttacatcaaagactcaaagctgaatcagcattgtaagaaccagtaattttaaactcatagagaatagcagaacacagatttatgacttcagagaactgcaagtagtcatcaaaacggtggaaggacaagaagaatttgttaacattagatgaagcaaagaatgcagctatcactgaataaaactcacttataataattcaatactgccccgggttgatttttacaagacgtattttgaattcaaaacgcctttagattaaattttgatcattgatttctcactaaatgtattcttaatatctatgaaaccaatattttcacttcgaatacgatatttatacacttaaagtactagtaatttaacaaattattggtccaaatctacagattttgatatgcctaagaaaaatcaatggagggactaatagtattctttccacactgaggcaagaaaaggaaacaaaaaaccgagaaattgtttgtttgtttgtgtgagcatagctcattggaaagacgcatgttacgaagggagctattccttcacatgttcataagttataacagataaccctccattttgtatatttaaaaactcataatatacaggaaatagtaacggcaataatagtatctcaatgagctcgaacttactgcatcaagatctaccagagcatccaatacttcaacgtcttttaacgagaattgagatccctgtgcaacaacgtctccattgacagcgatgcagcagcaaccatctagcaggaaccattaaaataactttgaagaaatgaattaacctttagacctctcagatgaaggcaacgaaaacattaatgtaaaaaaatagcactattgttgactccttaaaggtttgaaggatagatggcattcagaaactttagaagacaaaatgttaaacagaagtattgtatcttgggtagacagttttaggataattcaatgtagaactttaaacattccagttccaatatatactattcgaagtacggtccatacagaaaatcaactacaatcaccaatttagtgctgtccctctggggttcaaatgctgaaagacaagtaaactagcatctactactagaaagtgcatcctcctcccacagttttcatgcactagccgcctccaacaaatgagcagaggaagaaggtgtttaggtcaacagaaaaaaaatccatgctatcttacaataggtgacaatggacactttctgacacatgaaaataataacaagagtagttatggatgcagggcagcccatgcggcagattgggttagaaataagccacttaagacgggagatcatctagttaggaaagaagtgagaattgttaatagggattgagatcctataggtgtcaagtcagtcctcctgatatatagaaggatccgatgtaccccaattatcaatcaagcaatgatgaatttctaaagagggtaagcatcatatcccctgatctttactcttattctaacccaatcgataacaaagagacctgcatgtccaactggaactagaaacaagaccacatgcactacgcagcatttagtctaaacaagaaaaaaaaaagcatatcatagatcagataacgctaaaacaatttttacagcacaaaaaaatggcattttgatataccataataaaggcgtccaccatcacaaccctgttgattagcatacatgtaaacaccaccacatgcaagggttgcatttctcatcgaatcaatcctaagactgagcttccttaactgatgatggcttccacttgcattcacaaaaacctcaacaccattcaacgctaggtcaatgcgaggggcatttgcagtgaagagctcttcacaggtttcagaagccaatgatctaaaaacatatcaattgaaataagaagctgtaacaggatcacatagtaaccaaataatttagcagttgagttgatcaagagacaaataggtttgtagacaatgtatgaatttactggttaacaccatattagcaaagagaacatttgagcatgctaataacagcatcacagtttaactgtgttctgataccatgttaacctaagtggaagccaactcgattgttactgcacaagacccgatggcagatatggtgggtacaagtgacatgatagtttaactgtgtgctgataccatgttaacctaagtggaagccaactcgattgttactgcacaagacccgattgcagatatggagggtacaagtgacatgaccctagactatcaccacgggaccacaaatatctctagtgcacacatgctaatacactagtacctttacctcggttaaaaagagaggtctaaaatgcaactcattaaaccctaatggttgcaacacccatgcgattatgtagcagatagtgcgggcactttgatcccaataaacaataattagtagactatctggtatgttaaccaggcaatcgtcaagctgaaatcacatctacatataaaagaataattcaagtagtagtacttacacatcaagaaattgaataaaaccataaccaaaaggcacagtatcctgggacgtaacctccgagatatcaagagggagttgaaagtcaacaagtgcatctttgaatgtccaagcagaaaaccatcgaaattcccgatagtttccatcatttgcaagagatatctttggcctaatcatgactatcttgctgtttaagcagaacacctggcagttgtaccgtacactcttgaaaataaccggcattcctatgctgcacaagatgccatccgtatagccgccagacaaaatgtccttcaagcactcccatctgcagattagtcaagtacagtggttaagagttactggaacagaatataacagtacatagagtgagcatccacacgagcatacgagagagatgctaagatctgagtaaagagttctacccgggtttagaattgagggatgaaaactaaaccaatctaaaaaacaataggtgctaactaatcaacaacaattagttaacttcaattgcaatttctggacgccgaagccaactcaaccaaactaaagtggaaatacacgtattaatttatatgacattaatagattctcattctccatagtttcactcctcgttacagaaccaaccaacagcatccgccactaataatccacaaattataacaggagaactcctaaacccttaagcataggcagctgtgactgatgatgacgaagattcagttcagagaaaggggggataaattagttacgcgtgggcggcggtgtcctgctcgaggaagtggtcctcgcagccgtagccggtgagctcgagctcggggccgacgcggacggcggcgccggcggccttggcgcgggcgatggactccttgacgttgcggaggttggtgtcgaagtccatcgcccactggttcaggttgcacgtggccacccgtagaagcctcatctcgctcctccctcctagtccctctcggatcggagagactgagacggctgggggggttcgggaacgaggagagcggaggaggtcgttcccgccgccggcgggcggcggcggcgcgtgcgagggaggcgaggcgaggcggcggtgaaggcaaaggcggtgtgcgaaaaagattttttattttgtttattttttgaggtgaagagacgatgaactcgaatgcgatgccgtggctgcggtgcggctcgtgcggctggcctgttcctggttcaggtggtgttcgcaactgaatgagacgaggattatggctacgtttgttctaagaaaattgaggggaagagttacatcgtttttttgtatgtttttcgttcataagaagattgctataaaagatgctttgaaaaatcatataattattttttaaagtttaaaataattaataatcgattaatcatatgttaataacttatctcgttttacatatattctcaatattctctttttttttctcttaaacataggcaagtaagattgtgaaaaggattaagaatgtgtaaaatgagaagatcattagtgaatgattaattaagttttaattattaaaaatgtgaatatatataagtaacttctatataataaatttcacatgaaatgtacttatagcagtttaaaaagcatgctaatgaaagccggatttcagccggacgagaaatcgcattataattagaaaagaatagatccagtgtttcttctggcataggagagtgaggctgtgttcggaactccaagttcccaaacccctctccgtcgttttctacgtgcacgcttttcaaattgctaaatggtgttttttttgtaaaaagtttctatacgaaagttgcttaaaaaattcaaattaatatatattttaaaaaaatagttaatacttaattaatcacgcgctaataaaccactcctttttccgtgcagggagatgggttcccaaccccaggagccgaacacagcctcgaatcaacggagaaaaaccactcgattgcttgatctaacggctgagaggaaacaggatactacctccgtagcgattgtatttgttctcacaaaacatagtataatgcaatagaatgaatgtggcgatatctcaatgcaagttcactcggtccaaccaacttttgtggtgatccccatgcaaaaatgaataattcgacagaacattttccgaatctagacaaaaagcatcgaactcgaaactaaatagcaaccacacttcagcacttcacagacacacgaaacaccaccacaatcaggtaagcttgattctagtacagtctagtacaaaagaaaggattaacttcagcagttcagccacaggattccaagtacaaaataacaaaaacttcagcatatgctgcagcgaacgagaacacacctcctgggtttccttttgccccgggatattgctgtattagtagctttgatacgtaattagaaatatttctgtacactagttgttgaatcctttttctttatagaggaatcgcaagtactaataacgcgacgtcggtgctaaaagtttaatagtttgtctaacttcacgagttctgggcgcctcaaaattgatgttctctgtcaatatcaccgagttgcctgttgcattgcttgagctggctccacaatgttctttgctagcatggaagtccgcatgttaagattcttcaagctttcgataaactgctcgtggctgcaatgaaaaaggatatgttggaaaaactccctcgtaaattgatgatagaaaaatagatcagtattcaagtgatgcttgcccagaagttagcatgaattgcgtgtatgggtgattggctgaagaaacttacatgttaacatgattggtcgtcatgataagagttccagacactgaatcaatcttggcatcgagctttgaatttctaactaagttcattatccacaactccccttcatcatagcgcatgttcagtttctgagagagcatgctgttcattgcaaaaaaattgaaataacttcttagatttgaaagaaattgcattcctacatggtccatataatataaagaataaaacgcatgaaccctgagaatttaataaactgttcctaactgagatgacagaacagaaagatgcaacagataactgccaccatgtagcgcattacagttcttttttctttttcctttttttttttgccgctaaacatgaagtgttgtccctacaatatggaaagcagctgactgacaaaattatgcaagacccaaccaggcacagaaccgatttgtgtattcgatatacagtatgatttagtgaattgataattaataactgcagttccctacttttcatctataggggacttttgcatgttaccagaaaaaaaaagtgagtagtaagacaaaaacccccacccaatatcaatggaccgatgaatacggcagtaagtttcaaagaataagcaaacaagcattttcaaggaattcatctctcaaaggaacagtgatggaattcccttcctcaatgcgctttcccaggaaaggatcattcaatatgacctacaaaggcagccattaggacaaagaaatgcaagactgcaatatgatcaccattgagaagacagtgctattagatatcgtatagaaatagcctagaatttggtagtgcaaaatcaccggtatgcccagagaagtggttctcatttaatttaaggagggaaaatagaaaagtaacaacaatgagctaatgacctaacgttcaactctggaaattttacaggccaggacaccgtcagacaccctcagacaggcctttctgatataaggatgtgaaagctgaactttgatcgcaaaaaaaaaagttaggcatcatatagcagtagtgtgtgaacatataacttttttttccaaacaaagaaaaagaggggaaattatctttcaatattttatatttcaacaataatgcattaagtaaaaaacagattaatcatggggatggacaaaaggttcaagacgcgctaatatacctcctcacactctatgagtttctgttgtgcgccatcaaaatcatagttaacaaacaagcattccagaaattcagtaatgggatccttgtagctgtgctgctcctgctgaatgactttaatcaactccttaagcatattccttctccttttgttcacaacaactgctgtagcaaggtatctcagaagatgtggtgcatttgtctggattgcattcaagtacctgaggagacgtaaaatgcaaattgaaaagttagctgagataaaatttgatatcacagacaaacatattttccatcatgggaactagatagcacattacaaataataaagcaaatgctttacggacgacaatagccccttggctctataatctcctctttgattctgctgttattttccttcacattcagcttgtccagaaaaacctacttcaaaatttttcactctttttatatcttaacgtagttctatgtataccagcaaaacacatcttaagagttaactcaatgtacgaaaaatatatagattttttaattggcagctttgcatggttctatcctagacattaaaccatggggcaaattattaataccttaccagcgaaaacaagtcatttagtgttagtttttagcggcattgcttattggttgttgaaccagggtaccattggctgtgtaactgcataagacaatagtgaacacaataatcatgaaattttagtaaacaaacctctcctggaagaacagatctatgatcccatttctgccgttttcatggttgtagaagataaagatactccagtgcatcagccatatcctattctgaagctgatttagcggtgaagagaagttctgggagatgaaacaaagaagtaacaaacgaagttatataaagcagctggccactcccaacaggaactattgataaagtctccaatcagttattcaagcaaacctttgaatcaataatctccttcaaacggttgagctcctccagtgcaacatcccagttctgcatcaaaatctcagctgccagctttccccacagggcactcaagctcctctcaatgtttgtgcacagagcacggtattgatgcaagtactgagcagcaaatgagtaattcccacagtcaaactgaaatttggcatactgatacagagtctcaatctgatcaggaccaatctgcaatgttaacaagaatacgattattaactgcatagcaacctaaatgacttggcatatggtaactacaaaaattaacaattgaaggggaatatcaagagttgtccctcacataaacggatgcaagacatcagaacatcccccagacttgatggcaatatacaattattctaaccatatacaccatattaagatcaaacaacatctgaagctaagaatcatcagatatccttctcccgcagttttaattcaataattggggatttatcgactatgtacacagtacacaattgctgggcacctgcatcccaatcccccacatcacacattcaactgtgcccccaacaagtgaacatacttaaccaatcccccaaccttcgcatcgccatctgcaaactacaacgctactcaaaacctacatacagctaacaccaactagacgatgaacagatctagtaagccgcaagccctgcagctagatcgaggggggcgtgggggtaagtttgggcctgacctgctggttctggtggatgttgtcgatggcctcgccgagcgaggtgagcctggagacgacctcggcgcggcgcttgaccatgtcctcggggacgtcgtcggtgccgtagcgcgacttgtggatgtccatggcgtagtcgaccatgttggtgccccggaggaggcggatcttcgcctcgaggatctcctcctccgggtagaggtgccgctcctgcaggaactccagcagcgggagcaccaggtggcagtccaggtgccccgccatccgcgccgtcaggtcgtgctccgccatggccgcttccccgcctcccctctccggtggattggtgcgcgtaggcgctagggtttttagggttcgcgggttggtggcgcggaaggcggaagagcggggaatacacgggactggggtgagtgggtttgtttcaataaaaattttgattggtaggagggtttatggttgattttttaatttttatccaaaataaaatcttttaaaacttatttttaaaatctaaatccttgtagtcaagcaatcccgtctaatatggcaaaacaacactagcacactacctgcaggctgcagcggatgtgaccgttttatcctaccgtgctagcgagagcgatgtggccaaataacgctgccacactagttggaggctggagcagcatgacggtattgttttaccacaccagtttggttggcgtggccaaaatgttcatatattgaaaatgaattttcatgagtttattttaaaatttaaaaaattaaaaggttcaaaaaattaaaagaaactctagggtaagacatgttttgtactagtaaaaaaataaatttcataaaacacctattttatggtcaaaattttagagaaccacggatggtcgcgatgctccgccttgctttcacaacaagtgtgtgagcttttatggctatccggttaattattggttaatccatgagtaatgccatgccatacacatccgttctcccctcctctccccctcctcgatttttttgtctaaagaaatgcaacaattccgcttttaaatactttcaaatactactgcatagcaaggttaatagtatcgccgattaccggctgcaatagtgtccaagtaatcttatagcctgcatataataacttagctataaaggatggcccaccgaattgagctggagaataaataatattttcaggagcacaccgatattctctctccaccttatcactttcaccatcgcaccatgcaccatccatttctttcttctatgttcttctcccttcatccatccccttccttgatttttctgtacgaacataagcataagcatgcaacatccaacagtcaaagcttgctcccaagctcgttgtaggcttgttgcccttgtatgcggctgttgcaccagcacacacagcactgcgccacgttcaaggcaggtctcgccaaaatggcctcgagctcgagctcctgtagtctgccgccaccgaggatctcgagcttcatgggcgaggaagcgtccgcaggtgaggccacaagttggagcaagctgagctcgaggccatgacggaattgagctggaggacgacgactccgcgacgatgttttagctccttctatcctcatcaatgctttcatccagaaagcgcgtgctgaagccaaatagtcgcctgctcacgttctctctcccttccaactcaacactataaccgacgtggctttcttatcaccggtccgcgatggtttattgcacctgctctaagtcgatacgtcggtttccagaaaaagaggataggaatataaatttagtacttggacccaccgcaggctgcccacgcccaaaccacttctactcgtagtgttctcacacaccactgacctgtgggtcccgcagagtcactcacaccacacgtggaccccatctatcagtgataggaactcacctttccccgcacatgcgggtccatggtagtagtctgtccccacatgtcagtgagcaaaacgtaaaggtaaaatggtaccgtcctaccgggtgcggaacgacaccacacgagcacgtcgcgtcggcaggtgggtcccatcccccgtgggccccacgtgtcatccacggtgaggcagatccgcgcgtggaaacgaagcgaggttgcgggcccacccacgggcgtcgtgggctcgtggcctctaccctttttattttatttatttatttcatcgcccaaaacacccaacttttctcacgcgcagcgattccacccccaccgccacccgcgaccacagactccacgattctctcagagagagagagagagagagagaggggactcagcgagcggtgggcgagagggggagatcgaaaccctagctagggtttgcgcgcggcggcggcggggatgtcgacgccggcgaggaagcggctgatgcgggacttcaagcggctgcagcaggacccccccgcggggatcagcggcgcgccgcacgacaacaacatcatgctctggaacgccgtcatcttcgggtgggtgtcagccatggacgcggaattcccatctgcctctacctctctccccccctccccctctcctgcgccggccccccggtgttctagggtttcggtgtccccggatctcgggggacccgaggttttcagctgtttttttttgtttttttgttgtagtggctgtggtgctaacgaggaattgttttccgtgtgatgatgttttgcaggccggatgatacgccgtgggacggaggtgaggcttgctcggtttggttttgctccgatctgtagctggtttagtgattaggttgtggtttactaattccttggggatggttcgatgtggaaattggaatcgttaggatggatatagcatcatgagtattttgcccagggagatgagaccgagtgagtgggcagctgattccacataaacttagaaggcagatgaggattgtctgttgttgtctatgtcggtcttgtcggatatgtggggagatcgagccatgcaattctggaagggtcattacagggttaggctattggctagatgtatgaattccttaacacgtaaaattgaaaacgacaaaaatacatggcatacttatgatgcctgtcacctaagcagctctaattgaggtgcgctgaaactgtcatttggtaattttggtttatgtgaattctacatgataattgctagagtaggcatggtttcattagactagtcaacaaatgaaccttgccatatctatcacatattcaataacagaaatgccgatttaggtcctgttcgaatccactgaaagaagtgtataaacttttgggtaaaagtggcacgcttttcaaattgctaaacggtgcgtttcgtgcgaaagctttctatatgaaagttgttctaaaatatcagattaatccattttttcaagtttgtaataattaaaactcaattaatcgcactttattaccacctcattttgcgtgaaacacttaatccttatcttcatcttcatcttcaggagattcaaacaccaccttaaacatactctagaaattagagtgactgctgcatttactgtctaaaatggagtaataaagttgggagttggtgtgagcttgcctgggaagtaggttgcatgtttggttcaggaaggtaggttctactatttgaaatatattgttttggaagtgcataacacatgaaggaataaataacctacaaataattatggatagagttaaccatgttgccatgtgacacttattgtgcatgttttgagcatgtggtgccccgaattatctgttcgacaaatcagggcactgtatattttttgctgttttgtcttaatcagttcgcaacgaacttaactatttgactgaatctgattatgatctgcacatatataaatttaagttaagttatggtgtcagatattttccaacaactaacattgccctttttatggaaaagaactttctgtttttttctcagagttcaggtcttcttcttttcccctcttctatttgagttgcgtaaacctcaagttacgtcttagatatatgattgatgatactacggttctgttgcacaaaccaatttgtaaggatggatgttaaatcctctatgcaaatcttggtgcctgtttattttatactgtttatgtaggttttagtgtaagttgagctgtttaaaagatttactttgttttgcttttgagtttcagtcttgttttgaaaataaaatgagtacacacttatcttttaaatgcatagcttaactgcatgcctacagtgcaagaacccttaaaattcttaggccatgatcctaccaaaagaaaagagaatgtcatgatgatgtggttatgttatgggcgtagaaaaaggatactagtgggaatgcttgggtttgcgtcaaattttacttcatttcttctctgtggttgtttattccagtgttgttgaggcggtaatgcagtttaaggcaacccaccactgcgaggcgtaaggcgttgcgacgccctatgagatggttgaggcatgattaatggaggatatggtagagaaattaggaagaaaaaaagggaaaccggtaaaaggcccactaatccaggcagccagcccaccaaagcccaacataagtcttcatacctacgtgttctatgccctaagaggcatcttactccaccaggcaccagctgccatgatgagaagaggagtccccagctgctggcctcatccacatgacctctactagggttctaggatgagcttacctcttcttctttccctttctttattggttttgcttgtaaggcctttttctttccctttcttcacagtggacaccttggcctctgtgaccgccttagcgctatacgccttaacaacctgggtttattctttaattcttctcatgtgaaatccttgtctgtaatgtagtaatgttgtatgacatattatcttccctacaactctatctgcattatgtgatactgctgcagctctgtacccctatagtcaggccatacagttaaatactcagagccaggagagcttgcactagcactattatttttatatgatgaaagatgtggtcttttgtgtattggttcctgattgttcttatctatcattgatctattgcttatatgacatttctttagcctttgttgtttaatttcattagttatagatagccttgaatcatctacagtacggcaaaagtgatgaatgcagatgtttgggaattcgggattatggttattagtaagacaatagttctgatacaggacaacagacaaccaaaagccacataatgattaatcatgcttcaactttttgtagctaccagtctgccagcatggtaacttgagaagtcgactaacagttaactcttacgtatctgtaggcacgttcaagcttaccttgcagtttacagaagattatcccaacaagccgccgactgttcggtttgtttctaggatgttccacccaaatagtaagctctcttcccgtgtgattatatattgttcaataattaccttacatttgtaaacaaataaagatcttcgtttttgaataatggaaaacttatttaacatcatactattcatgcagtttatgcagatggaagcatctgcttggatattctacagaaccagtggagccctatatatgatgttgctgccatattgacttcaattcaggtacctttttgatcaattttcagactagcaaaaagcatttgtaatgccatgaagagtagtgcttaccatgagtaatgagatctttctaggtgcattattttacagcttccaaggtcatgcaaattactttttgtggagaaactttaaacttagttgcactgttgtgcgtaaaaacctctttacaacattgtcatggaaacctactagaatgaacctcttacactttacagattggcagttggagcattatttatctggcacatttattcttacgtaagaatgaatcctcctaaaaattttgcacttgaatggaggttttcccctgtaactttataactagctctggttgatcagttcactgactgggggacagtgactaaaattgaactcattttattggaagctaattccaaagctccctcacaaatgtccactacactatttatagccagttagcacttagcagggtgccattgtccgaactttgtaagcatgttagtaagatcatttgatgatataatcggttaggttgtttgcttctacacaccaccatttccaatggttgtataggctacgtagcatgcatgtagcatggtattgtatcaaatacttgaatcgctgaattgtgatgcatttgctttgcagtctttgctgtgtgatccaaaccccaactctccagcaaactcagaagctgccagactgtttagtgagaacaagcgagagtacaaccgcaaggttcgtgagatcgtggagcagagctggacagctgactagggcatgcagcagggcaacgggtggtatccaccatgccagaaagatgcaataagcaaccgtgaaaaacctgtgcgtttctggctctccagatttgctgtcatcttaaaacattataagatctccagtgattgcttgtagtccgttgatgtttttgtgttcccatgtcccagttactcttggctgcttttatgtagtggtgttgacctctcatgcactagggcattctgctcatgtaaaaaggggattatcatcataatatgtgaatggaagcgaaatgggtcatgagatttgagtctgcttgcacaatgcagtttgtctgcatgatccttttgccatgtagtttggctgttggtgctgtcctatgcacatgcttaatattctctgccgtttggattttttgcaacattttgtatttttgtaggaacagaaaaaaaaattcccgtgatacttctcatgatacaaatggtaccaaactgaaatttatcgttcctcgagtgatgctttcgtatggtataaagaagggtttttaggcccctttgaattggaggattgtgaattttggaggatttaatgtcctaaggattttttcctatgaaacctttgattcataggaaagtataggaaattttctttaggattgcattcctatagcccaatttcataggaaaataagtaagaggtttaacctcttggaaactatcctttgctttgtttgttttctatggtgatattttctgtgttttccattcctgtagaattaggaaaacatgccacatcaattcctacgtcgggtttttaggcccctttgaattggaggatttaatgtcctaaggattttttcctatgaaacctttgattcataggaaagtataggaaattttctttaggattgcattcctatagcccaatttcataggaaaataagtaagaggtttaacctcttggaaactatcctttgctttgtttgtttcctatggtgatattttctgtgttttccattcctgtagaattaggaaaacatgccacatcaattcctacgtttttcctattcctttgtttgtttcctatggtgatattttctgtgttttccattcctgtagaattaggaaaacatgccacatcaattcctacgtttttactattcctgtgttttttctattctgcgtttcaaaggggccctaggtaaagtagtgctcttgattggtgtcgggggcctggggatatctccttttacttgtccatgtaaaggtctaaaacaacaaatgcgatacatggtattgacaccattgacacaatgataaccgaagtgcccctacagaggacatgccataaacgaggtactgaaccatgattacatttagacctagattcgtagtgagacatttatagtcctagattcaaagtgggaaaaattacaaaattacagttgtgcttagcttcttacatattcaaaagaaacatatagaaaaggcggtaaaaaaaaagaagataaaaaaaatgtgaagaaagtaaaagagcccactgacttctactggtctacaccaagaaggccctatacacatcttatcttatagggtagtagtacaccatatgccagttccagtctagcttcagctgcagctgccatctgaattgttctctcatgttcggttcttgaaagatcacactgcaaaatgtttgcttcatgtaatgtttcccgctgaattgccgttgctgttcttgcctcaacctagaaatccaagaaaacacaagaaaatatcatctcagatcatagctgaatgcataacatttccctcaactatcagccatggatgatcagagcatgatagttcagatgctcaaagtgcaaggtttggtttgtttggtgatagatacctgcaggctatgatggagtatcatctacagatctactggtcgtcttctaagtctctggggatctgcgacggcgacagcggcgactcctcgctgctccgggagtcccctctccagtcatcctgcacctgcgcggcgaactgcaggttccacagcacgtcctccaccgacggcctctgcaccgcctccttggccaggcacctcaggcagatctccatcaccgtcttcaccgactcgtcggagcaccccttgctcaccgccgggtccacaaagctcctcctcttcgccgtcccctccgccgtcagcgccgattgcagctgcagaaagaacacaggtgagtttctttttttctttttcagaactttcagaagtggacagtgtgatggtagtatctgaagtctcatgaaaaattcagttcagtttcagtctttggagggagtttgtgttgcacctgttctttcattatctccacctcgtagatggatgtgatgggcctgcctgagataacctcgagtagtatcacgccgaaatcgaagatgtcgagcttatcaccgttcggtacactgcgagaagaaatttgcaacagaaaagttcttaagaaaaccagttgcttttagtataatatacatagattctgctgtaaggtgatttgtcaagtacctatcagatggatacttgttgccagatcctccctgaattcatccacaaaagatgatataaaacaacaatgttagttcagagttcagacagtgccaactcaaaattcagcggtaagtttacatgatcagagtttcctgaatcatacctcggatttcatggtttcagataggatggggatattgtagctgcctattttggcaacaagattctggtctagaagaatgttggtgatcttcagattattcgcaaataggccaggtatgatccctccatgcaagaattgaattcctttggcaacaccaatggctgttgatatcctctgcacccaggtgagctttctcccttctgttccttctgaagtcaaaagtatcaacaagttcagtgacattcagctaaccgagtaactgattattggagaccgatttcaggagaagatggtaaacttacgtgaaattctgcctctcaggttgccattctgaacgtattcgaagacgagatacaattgcgtgatggtggaatcgtcgagattgtattcgaagcagtgtccaagtgcactgaccaagtgcctgtgcctgagcttggagatcatctcaatgtggtgattgaagctctgggaagtctggctcctcttcaccttcagagacctgattgtcaccggagttccattgcttagccttcctcggtacatctgacagtaaaaaagagcaaaccattttagacatggagcacaacaattttagttgcaaacttgctatgttacaacttgcacatgcctcaaaagaaaaggtgattcttgaatagattgaaaaatatgtatggaaagatggctttggtactctgacaagaaaaaagagagaaagcttgtaataactataaaaactgttctctttaatctttataccccaattgtaatctagcagtagtatttaactcattagaataatcagaaaagtgaatgggggcataaagcatactgtcaattaacaagaacatgaaaaattaggttcagtgaagatgaagtggccataactaatccagcaatgatattctgaacaaaatgtccctggattgtcagtgggagcaatggtacaaggagtacctgtccgtgagaatcttgccccatcatatttgatacttcgaaatcattagtagccgcttcgagctcgaccaaagaaaatgatctgtatgctggaattcccagagctcccaatttcactgtctgagatatgtaacctgtttggttgttccaggtaaatgcaacaagaagttagtatttcagataaagtttcagaaaaaaaatggtgctatcaagttagttactcttaacactaggcaaagttccagagaaatgatgccaaagttaacgaatctaaaaaagagcaaaagatgtacagaagtttcagtcaaagaatctgaaattcaacaaaagtttcagagattgtgccaagttggtgactctgaaattcagcaaaagtttcaatgaatgactgaaatttagcaaatgttccagctaatgactgaaattcagcaaacttttcagttaatgaatctgaaattcagcaaaagattcagttaatgaatctgaaaattcagcaaaagtttcagtgagtaactgaatttcagcaaagtttcagttaacgattcaaattcagccaaagattcagctaatgaatctcaaattcagtaaaagtttcagtaaataaatccgaaaaattcagcaaaagtttgagagagaaattgacagggagcaagatcatacgcgcatcggcgaagagcttggaaggataggcgctcgacgcgtgctccacgagcctccgtggcggcctcgcctgcgccctcctcatgctcgccttcctcacggcgaggaagaccgccacgccggcgagcaccgcggcggcaatggcggccgccacgacgccggcgacgaggccggacctggcgccgctgggcttcctccgcgcctggtcgggcacgatgccgacggcgatggcctggttcttgcagaacggggacgggtgctgcgtgtcgtcgccggtggcgaggcagttcgccgagaagagcaccgtcttggaggagtcggagtcggagtccgccgccttgccgacggcgccggcggcgaggcaggtcgggaggctccccgtgaggaggttggacgagacgtcgacgaatttgaggttgttgccgcacgacatgttgccggagagcatgccggtgaagcggttgccggcgacgctgaggtactcgatggacggcagcgagagcagcgccggcatgaacgggccgacgaacctgttcctggacacgtcgagccgctcgaggaggtagaacgacgcgagctccggcgggaggccgtcgctgaacctgttgccggcgagcaccacgctggccaaccttccggcgcgagccgcgggaactccggcccgagcgagttgttggcgaggtcgatcacctggaggttcttggcgccgctcatgtccggcaggttgcccgacaggttgttgctcgccagcgacagcgaccgcagcgacgccatgtcgctcaccgaccccggcaaggtgccctccagcgagttgttcctcaggctcagcacggcgagcaccggcagcctccccagccacgccggcagctcgccgcttagcatgttgtcgtcggcgatgaacgtctgcaggttgccgagccgcgacagcgcgagggggagctcgccgtagaggtagttgccgctgacattgacgatctcgagcgcggcgagccgcgacaccttcccgggcaatgggccccagagtccgagtccggtgagcgtgagcacccggaggtcggggagcctcgacagcgtggtgaagaaggagtcgatggagaacgtcttgggcagcggcggcggcgtcggcgagccgccgccaccgccgatgatgtgcagctgcgtgacgctgtcgccgtagcactcgacgaacgccgacgtggtcttgtagtcgccgccgtagcagaagtcggtgtagttgtgccagtggccgagcaccgccgggtagccgagcatctgctggatcttgagcagcgaccatgtctgcgacgcctgcagctgcgtgctccctggcaccatcgccatcaccaccgacaccaagaacaacaccaccagattcttccctcccatttcttcagcttctcacaagatttcttcagctcctgatcagttcttgatgagcaccaatgtgcaagaaccagcagcaatttctgaactggagcagaggagatgagcagagcagggaagatagcaagaacagcaaaatctgtcttaactttttgtgatcaagaacagtgacagaggtgatagattctggtgatgtgatgaagaagggggaattttctgaagatttgatgctgggaggaggagcaaggagagattgattagctgaaggacagcatgatggcatcaagcaactgaactcttcagaaaaggctgagctgagaggaactacagttattggagagatagctactggtgacctgaaaaaaatgatgtgtgccaaattgaccaatcttttactacagggatctatctgaccactaattcatttcatcccaaagcaagaaagcactggatgccaatgactgcagcagcagaaacatctccagatttgcttctttccttcaagaactggcaacatgagagaagaaaacaaaaattatagtagtatcaggttagagaccaaagcatcacttgtgtaccaagatttgtagcactatcactaaactacagtacttgcaagaaacctcaccttgttatcagtcactgagaaaacataactactgaagatgaacagtgcattggataggtcaaggagatgaaatgccagcgagtgaaatgaaatgtggccaaataatatatgttttttgggggtttgtgagggaatcatatgcttagtgtcgtctactactgccctactgtcgctgagcaagtgagcatcacggggtggcacaaatatgaggcaaagagacaagggtctctccaaaagattgagctggaaaatggaggttggcataaggacattcagatgggagcccagtgcactcttttccttccattgtcccctttataattattcagaacttgaattatgataggaaaataatggttaactttcttttacttgtaattatgccctttttgtgataacattctttgcctgtgctttttttttcttctcttttttcattcttaagatttgctaaagcaagactacaagagtgtaacaaacctgttgttttcaccttccaggaaggaaagaaaaaacacaacttttgttttctggtaggtcaatgtttgcagtgcaatcaatagacatacaatttgtgaggtggtggtagagcacaacaccttatcacattgtatgctctacagttgcttcatttattatattactttgatctggtgtttagaacatgttgtggtttcttttgctttattcccttacttaagcgacagagagaatactaagtatgcatactatttggtgtcaattaatctatacacaatgtttagaatacgcataaatcatctcaagattgatgagtttatttaccaaatgagtgtataatgtgctaaaactctcttctaattactatacattttatcaaatatttatcaagatctgtagtggttacatatccattttattttcattctacctatgatttgacttaatccattttttctctcctttgctgccttttcctttgctttacttaaagcaggcaagacaatggaagcatcgctttctcttaggtgtcaaacatgcaccaacctctcctttcatgggctaagaacattccataaaaaaatatgaacaaatatagctcttgtttatttcccaacttttttttcaaacttccaactttttcatcacatcaaaactttcctacacacataaacttctaacttttttcttcgaacttccaattttagcgtggaactaaacacaaccacagtataaaattagctactatctggcaatctgcattgcaaaatgtactgtgcccagtgaaaaattgggaatctgatatatattcatcaatgcatgagtgttcccacatttgacttggatgaatgtttgtcagggtgtgggccccactttactcactgtagccttggaaaaattattaaatgatatattccccaaccacctttgggcaacttggctaacagtaaaccattacaatggtactgagggcctgcttggtttctagagacttattccaagtccctgtcacatcggatgtttggacactaatttagagtattaaacatacactaattacaaaacctattccataaccttggactaattcgcgagacgaatcttttgagtctaattacgccatgattttgacaatgtgatgctacagtaaacttttgataattatggattaattaggcttaaaaaattcgtctcgcggattagctctcatttatgaaattagtttttttactagtctaggtttaatactccaaattagcgtccaaacatccgatatgacatgggctaaaaagttttagccccatctaaacacccccgaatgaaatgtcccattagaacacacactttatgtgagacaaactgatggtaacacatggctgtagatgctcttggggtgattagttaagatgtttgcttggccagatttcctagatttgtggtccacaatataatattgacattcatgtgagtgttaaatacaatgtagatttatgtgagccacattgtaggtcgatattttttgtctcttttaagtcaaagcaacgaaatatataaccctagaatgtaaaataaatgaggagtgatgaagtaacattttgacaatttcagatattacatcttgatatttctgttaaaaaaatgctcttctcatatttctctcagtgaaaaggattagttggcgttattcaggatatttcgagcacttagttccttccaaaatacagaaactagaatttcagtttgccaataaatattttccttttgtttcaaaaaggaaagaaaattttccactttaccttacaagccatatactgtatgtcacatgagataattactagtaattcttttttcatcggaaaaagggttgcttttggagagatacaaaacggcaggcagtaaaagtgaagaagcccttttaactgacactaaaagaatgtgaagagaaagcagtaactagctctaataaaagaaagcttaaagaagaattaatttggtcgataaatgcgagcgtatgggatcgagtggcgccacattaccacgttggtgcgtgcgtctctattagggttggtgggcagttccttcgtgccatcactcaattgattctttgctccccttcttgatctgttcccaaactatactgccataacaaaaattcctgcagtttgatttggaaatttaggacttcttttactaattttactaataagttggttgaaatttcaacaattttgtagaaaggaaagaatcctaagaaaagttggatgacaattaggctctttggattgttctgtactcacgtgcagcattgagccaaggaccatgtgcagatgtgtgaccttgagcttctcttgcatgggtggggttactcacttaggtcctgtttgatttagcttatgattattataatctgaattattaggagtaagctgaaacaaacaaatagattattatgctagattgttataatctataagccagattactataatccaataatctcctctagaggagctttttccagattattgagtggctaaagaccccactacccttagatgcctctaataatccagagaaaccaacaactcgtagcttattttatatcagcttattataatccagcttagagtaatctgatttaataatctagattacaataatcttaagctgaaacaaacagggccttatttggatcagttgtagcttgccacttctttgagctatatcaactctgtttcttgcgtgatgaattttacgatggtctctgctggcagtatactttacctagattttttgttttttcctatttagtggaccacatctatttatcacatctatttatactaccactcaattacatatataaaaaaagctatatcgatgttattaagaagaaaggtgagtgtgtatgtgaagatttggacgcaggccttcgggcgaacaacggcaacccctgcccaccacgctacggtgcaattctctaccaccttaatacttagaatacgtattagtagagaccaccataaaattacccttctttatatcctcttaacttggggttaccattatgttgagcacaattaatggcatgccctcatgatgcttatatcaaggatagacatgaagtgaattggccttaatgcccaagagctccaaatggagtccctcgtggtggtggtgccatacacccttcgtctccgaatgatgaatcttttatggtggtgccatctccttcacctccaaatgatgataattcctgcaacagaattgcagtacacttgtgcatctcaaaggtttcaatcatgcatttattcagcaactgtgaattgctgccgtcgctgaaggagacagtggagctgcactatgcaaatagctagtacattcatcatccataattctgctcaaaataaataaaaaatggaaaataaggtggggaaaaaaggttctgttactgctgctgttagcttttttttttctctcaagatgcatgtagctactgtatactgttccatatggttggtgccagccactcttaatttgattagagagcacagtaacagtgacatgtcaagaaagtcagtagcacaatagaaacttatattagttcacatgaaaaatataggtcattatgatgtgtcctgtgtttggaatggtacataattgcatatgctaaatttcatccgaaatcgccacagtgcaggatgcgccccactacaattaggctcaagtgttaggcaaaaaggtttcttaaaaaaagtgttatgcaaattaaattcaggtgaatgacagacaagtaaataggtactaaagttctgcaaagcatttgtagttaagaactcatgatcagaagttcagaactgaatttttggccaatcaattgcgtcagaaatgtacttcacgatcgtcactgcagctagccaaaaatctgaaagactggaaggctcccaactaatgtggattctatgcatttcgagtactttaattaacgggaaaacagcacccacttgaaggtgaaaattcctcattcttgtcaaaccattggtagccagcttagctcagagaaagcatcagcaggcatctcatcctgctgggcacaagaatctctgacgacagtgtgaagagttcatattagcaaatagcaatatttgttgctagttgctactacttgctatcaactatttggctctgattattccagtttccaaccaacacaattagtcataaaattgtactactagattattcagggtgggtagatttgtcagctgtcacttcacacggaggacaattagattagtgctaatcagaggaggacacatagccacatatacgtactatcatgtcatgtgaatgaaccatgaatgcataccagagattcagagaatcagacagacagacatgcgtgaggtgaggccaactgccagcgaccatgtaatgtcatccactgcaagcctgcaagctgcagcaatcacgaattaatcgaggtgttaatcttggtttatgtcggtgattagttcccttggttaatgtgctctgcagctgggcggtgaggagcctggctgggccagagagcgatgcggctcgagctctccctggcctggttgaatccatggaagccaagggtatttcaggcaggtgatatgtaaaaacgtggtaaaattattttagtttgaaagaaatgaccgaaatggcattcaagcgtacatatcctagttcagaattgcaaactatcgaaactcatttgggagagatatttcgacgaagccaacttctaacgattgcatatatccaaatttctcgctaggagtggctgtgttagatgcatggggttgggaacccatctcctccgcatgaaaaacggaacggttcattactacatgattaattaagtattaattatttttttaaaaaaatagatcaatatgatttttaaaataaactttcatatagaaacttttttttaaaaaaaacacaccgtttattagtttgaaaaagtgcacgcgaagtaggaggaagaggggttcagtttgaaaaacgtgcacgcgaagtgggcaacaattacaaactaccgaaactcattttgaggtgatatttcggcgaaaccaacttttagttaacgattgcatatattcaaatttctccctaaggagaacataatagtcatggcacttggcagctggtctgttgagaagggcggcggcgagtgggtgaagtcggtatgtagtagccaagtaaggactggtttgcatacattcgatggttagcacttatcaggggtgtaaatgtatacatttgataaccgccaggggtttaaatgtatatacatttcgaccagcaccaatggcataggtcgaaataggggttgatacatataaatttaattatttaccctaaatttaaaccgtgatcaatgatggaggcaagtaggagttgatttgcatgaattcggtcagctgacagtaatgagattctgagatgggtcctatttgcacaatttcaatttagctgtatggcttagcttccccaaccaaaatttggtagggtagagatgagaaagatgtgttctagtttaatatcaaattatgatttgtgagttgaatagatagatacgagtactaaaacatgcttattgtagtatcctaatgaagtgtcaccaaatttctactatagtgttacgaattttgttagtagcatagcaaaccaaactaacactcagtacatatatagacaagtattatactgtcaccaaattttagtagcatagcaaaccaaactagtacccaggcaagtatttggtaaccaactaaccaggcaagcagccaaacacatagacattgacgtgacagttatcaacttctaatcccagtttgcattgtatagactactcgtcaagcttaatgacaaggtaaacaagctctctgaatatgaacatttaattatcttagcctttccagtcaagcaaatacatgaacaaactaggcaccaagcttattttctggaacctgctgtgcctgtccagaacaaaaaatatttttggagatacttaagatgtaggcagaacaattctaagaagcatgaatcaagcaagcaaagcaattgacgagctcaagttaattatgctggatatcaaaaaacacaagacgagtagtcgagtacaacagctatcaggacacacgatgaaacaggctatccaagtccctaactcttaacatctacgtacagtcccctcgcatagaaacaagagtgctccactgataataaaaggattaatatctcttctctgagctgataccgcaagaaaactacttgtaaccccaatatgagatagaacagtgaagcaaaggtggcaccggtgaatcttccatagttggtatagcaagaacaacctgtgaaggagagaacgaagagtcagtataaatcacagtgaaatatgtgcaaaatcaggtgcaatgaaaggctacaaatgtatatttcctgaaaagggttgtgatgcaaagtcatgaaaataataacattgccataacatggactcaaaactcaatgatctctgagactctgtgtggtagctctgctgttcagttaaaagtaacatacaacttcgaattgaatttgactaccagtaataacggtataaactacttatagtttcattcttcaatggttacaagcattgcatttctataatttgtatgatcatataactcaaagattgtcctctgaactattcttctagaatggttgataacaatagtagtcgtggaatgcaaggtttacagattaagcacatcgcacaaccacacagtacgccaatcaactaaaacaaaattttcaaaagcttgtacctacaacacttgtaagaatcaacagggagtacaacaaattagtgattatttcttaatatcatatttgctccaaacaagcactacaaataacatttagcagcagtgcagcacaaggtcaatgacataggggtgtatattgcaaaacaattcaacatatggcccagacataagcatgtctaataatacaaaatgatatgtttcattgaatttaaaacttctgtcaccgctaactggccactaaaagagaaaagtgcaagtaaataatatgagtgcaaggtataaggcacacaataaccacaaaccgtgacaggctttacaatgcaacaaactagggaaaaacatactccatccaaactaggaaaaaacatactccatccgtcccaaaatataaggggttttggacggatgggtcatcgtagtactaggaaatgtctcatacatccaaaatcccttatattttgggacggagggagtagaaagaaaatataatctactcatatgaagttaacaaaatctcaagagcaagtgattagcagaacatgtgaattatactatgtaacaaaaacattagaaacaggaagattcagaagacatcatcaacctataattgcaatttgcaacctacatcacataatatggttcatccatctcaaatgcataaatcattagcacaacataaccatctaacagatttaaatgcatgaatcattcaagtttaccagcaaagctattgcggagggttttgtccaggttgctgcggaccgggaggcggcggtggcatcccaggcctgaagggcggaggcggcatccctggcctcatccccggcggcggtcctccaggcatcccaggcctcacctgcggcgggcccatcggcggtggtcccctcatgaacgggccaggaggcggcggagggccaccagggaacgccggtggcacgcccggcgggcgctggaacgggatcggcatctgcggcggccgcatgggcggcggcatctgccccggcggcgggcgcacgacctgcgggtacgcgaccggcggcgccgagaggttcggcatcggcgggcgcgagatctgcggctgcatcatgccgggggccggcccgcccacgccacgcaccgggccggcgagccctggctgggcctggagcatctgccccgcggggacgccgcggccggcggcgcggcccaccccgggccccgccatcgccgcgccggcgccggcggccttggcgcgggactcgtcgggcggtggcgggccctcgacggtcatggagacgacctcctcgccgcggagcagcaggaggcccagcgtcctccgctcctcgcgctcgccggtggtcttggaggacttggagggcgggagcttgcggaactcctcgcagtcgccgaggacgaggttcatgtggcggtcgaacgccatgaacttgccgaccagctggcgcccgtcctggatcgtcacgcgcatccggtagttgacgaactggagcatcttggagcccttcgggttcgacatggcggccggcggcggctagggttagggtttcggcggcgaggcggaagaggtgggggaggaggaggaggttttcgaaggggtttgagttggcgtcggtgtctcgggttgggttgggtgtggaggaagaggtgggagtcgtgggctttgtgggcgttagtcggttggttatgggccaaaaagctcatgggctttagatgacctaactgggcgttgggaagggctttttggacgatgggtttcccctttggaataagtccactttgactccctaaactggtaaccgaatcagattcgtatccctgaacgacaattccagatgtctggacccctaactattaaaaccggtgcaatttgactccttttatggttttagagggcggtatcgctgacgtggcgcctacgtgacggtattcacccgtttttgctccacgtggtgttaaggtggcattcgaattaaaaaatatgtggaacctatttgtcattaaaaaatatatcatgtaacccactgacatacggggccttctctcgttctctcccctccaccgtgtcccttctccttcatcgtcgcttccttctccctccctctctctttctcccgcggagggcggagcggcggcaggcaagcagagacggcggcgagcggcgaagacgcgggcatggcgcgggggcccgcgagcggcggagacgtgggagtggcgctgccattcacaaatccaccgcgcccaaatcagaaggagaggtaggtgacgggaagagatggaaggtggaggcgacgacggccatggacttccacgcactctctcccaccgcgagctgcangcgatgtgcaagcgcaacgactgccatgccaacatgaccaacgccaccatgaccgatgccctccagttgctcccctcggtaagaatcccctgattgattgattgattgcgttgtttgatctgcccatttcgagagtttggatgattttgtgtggggttctcgtgtatatgttcgtcgtgtgatttggtatggtggtggtgattgatgagttgtgttggttgcggattaggtggatgggatccacaagatcgacacgacggcgctgtgcctcccgacgccgagcaggttgacgatgaagtcggctttaaggccgcctcggcggtcggcgaggaagagcagcagcagcacgggagcccactcccccgtggccgccgcgtgtcggtgaagtcgctggaggccatccagatggacttcgaggagggtgaggacgagatgaagcgggatcgtgaggaacggaacctgggcgtggcgctgcgtagtaccagccgccgcgcgagggccacgccaacgccaatcccaaccccctgcgaccactaggcagaccgccgctgcgcgcaaggtggagaaggcggcgccgaccccagctactctgcggaggagccagaggacggctgctcggaaggccgcttctccagacttcggtgcgtgccgccgctcgccaccgtctccgcttgcctgccgctgcttcggccctcaccgcccgccgcgggagagagagagcgtggtgggagaaagaagcggcgataagggagaagggacaggagggaggggagagaaagaagagagataagagcatttgtagtgtgtcgttgaaatagatggagagaaaaaaaaaaaaacgaaccaaccacatagtgggactgtgggagtcgactggtacgtgtcagagccgtgtcagaaaaaaatcgaattgagtttggaggtcgaacagaaggcatttaaataatatttgttggcatgttaccgttctaaaattaatcggctagcaatgtgatatgatagaataagcattgatacgaaggtcaaagcatgcatcggctggaggtccgatgccattaaatccacaagattgattaaacagtgtaacctttgttgtcatcggctaaatccaacttatatgtatatacaatccttataaaccgatgcaacgtccagataacttatcggctatcactccgataaaacattagcatgaacctatcggcttaacaagatttatattatcaacaacaatctagtaggtcaaacctaaccgatgcagcacgagattgtatatgataatctaatactcgatgagccgatagatctatctaatgtgatggatataacaaatctatttagaataacattgtgattgtagagatatattggctaagacagaagatcagacctaaccgagacagttccaactaaaccgatgcgtctctaaacacaatacaattagagatagaatcgagatatcaggtaggcaaatgtatcaaccaaaacagagtaatccaagagatcgaagcgatacagccttgaacagcaccaacgtagcagacagattcaccaggacaggcggaacgtaggacttaccccttcgccggagatcgaactgaaccgatgcagccccgcgtcaggtgccaaattccgtcggatgataagtaaaaacatcggtaaagagggtggcgatgcgccgagagtagttgtattgatctagagatgatagattacaatgaccccaggtgtacatatttatacccataggaagatactagtccttgtaggagaagaaagaaactttcctaaaaataaaagaaaaacataaagtccttattggacactaaacacactttcctagagataaaagaaaactaaaccatgcctaattaatagataacttgccatgccgcatcctccttggactcggactcttctagataagcttcctttaattgatccgactccatcaagaacacaacttctggcgacttgacgactcccatcgggtgattccagtactctaaagtcgatactgactcttagccgatgatgacttcggacttaccaaattttggcgttaacaatgttctatccatgacgtgcatggagacccacccaggttcatgaaaaaggcccccaaatatccatcatctaactctctgccaccgtacacgagaaaaataacatatgtaatttggatttcctatcgcaacacacgagcatctttgctattcttaaaagaaagagaaatgagagagatgaaaggaaatggttcacttgaggtcccttgtcgtcgagtttcaaaattgtccctgaactgaaataccagatataacagagccgtaatcttataaaaccaggtcacattaggtcccaaggcactattgctccccggttttggtgacgtggtggctgagtcagcatggggcccatgtgggtcccacatgtcaaccgataatcttctcgacctacacggcaaagagcgcgaagaagcgaagtaggaagggctcctgacacgtcgtcctctcaggttacactaccacatcgttgcgtggcagctcaccacgcccgcatcatggtcgcatgtcagccacacgtcgagattggtagaggatctccaagagttgggagatggagtacgttgcgacgcctgagcatagttgcgagcaccactgactccatgagtgtccgtgcatgcacacgaagaggatgccagacgctgaatcgcgggagaggtgtgtggtggccggtgaccagcagggataagggtggcggttgttgggtggcggcggtaggtagaagctcaacgacggcgcctagagatgggtggggagaaggctggtagccaacaagaagcttggcagtggcgagcggcggggagaatggcgcatgcattggggacgatgcgaccacaatatggtgtagatggagttgacctcgaagatgatgcgacggaaccacgcgtgcgcctctgcagacaagaggtagagctcggggacacctgaacacatcggcttttgagcagcttgacccggggcggggggggggggactatgagcttgggggataggagcttagtcagcgtgacaaggcagaagccccagccctcgcgcgtgcaagtgaagacgacattgcaattgtagttgggacccgcgccgcactccccgcgcgcgcaagtctatgatgtgagcgctcccgaccgttgggagccacgtcagccgatggcctccgccgtcgagcttttccccaccgaccaactatgttacccagatacggggatacggatacggatacgcgatacgtcgatacggggatacaccattttccagaaaatatagatacggggatacgcccatatatatttatatataagaaaattattaattcttgaaagaaaatagccgattacaacgtagcaatcttttgtaatgatctcttgtagttgattcaggtggagactagttgagaaatagcaccagcagtaaacagatatccatcgattaaaaaaactcagtgtatttcagcatactctgacttttctacttcttctctaacacttaaacatatcaccacatcccacaacggcttcttctcactatcatttggatgaatgatgaatttgctgctagattagcaaccgcgctagctctagatgcattgacacttctagtcacaataatcatcagatctataaaatatatatatactcaagcatcgaagaggccaacaagaaaacaggaaaggggaacaagaatagataaaatcacatgcagactcaagcatcgaagaggccaacaagtcaatcgttcaatggaacttgcctaactggggaacgaaggaatcaagtcagtggctgcgacggcggcgatgttgtgccatgttggcgttgcgtccggtggtggaggcgatgaatacacccagacacagatatgcattcagcgcctgaaggcccggcatgcagctacggcgccagcggcgttgcgctcggcgtttggtggcggtgctgagttcggccttcggcatggtgggcggcggcgccgatgatgggaaagtgccgcgaggtggtcggcctcgggcgagaaaagtggaggcaacgcgttcatccttactagggatgaagccatacggacgtatcgagaacatatctgatttattttaattattcgaaaattgtgaaaatcgctgatatgtacgggatcgctgatacgtatcggatagtatccgtatcccttcacgtatccgatatggatacgacgctttctggacgtatccaggtaatgtagccgaccaacacctttctccccaatcattagcggatgccctgaaggtttggattgagatgagagtagagtggagtgaggtggaagaagattgccggttgacttgtgaggtctacgttggactcagccgccacgtcaacaaaactggaaagcaatcctaacttgagataaaagtgatccggttttaaaatattagagggttcaacgacaagaaaagggaccgtagatgaactttttggggagatgaaaacattccagcctagtgcatatgagtatacggcagcagagcgctgcacgacctccgttccgcctccccaatccgtcccccgtctcctcgcccgccgccctcgactcccgtcttctcgcctcccgctggcatcctgctagcagaggtggcgccggcgttctcctgctcccgccgcattcgctcaccggtgagcatcctaatccatcccatccggcctcggcctcgagtttcgtctcctcgccgccgcttgcgccgatccccatcctgcgaggagaggtggcgcccggcgtcctcctgcttccaccgcatcgtcgctcgccggtgagcatccctccctacccacacctcatcagctattctgcgttatccctcaaaaaagtttcggggttcaaccgaaacagggttagatctgcctctgcccagttccacctactttcaacttgttaattttgatttttgtttttagcagatgtaatttggttactgaatctcatccaaacactcttagaatagttgcattagaacggaaaatgtaagctcacataatttgtactcatccaaactcatataaatttcttaagaagaatctataccacaaactactcatagtcacacaaaatagctttttattaaggtatattcttataagaagtttttattccacaaaattttctaaaagacatactgtaacacttgcaattaatctaattaaacattttttttctttattaggttataaattttctaaaagacattgtgccacttggcatgaatctaatttagcattctttctttatcaagttataaattgaaaccatcaaacttactttgtcttcccgtctctaaaacattgtgatatatctataatattttaatatttttgatattaaaataaatttagactaatcatatatatatatttaaattaggtaattaataaattcaaatcaactatacttttatataccaagtacaaatctaataacaatagaatgttagaaacaatgtgaattcaattttttttataaagtttaagtacgattcatatataaaattaaagaaaaatataaatttatatataagtgataacataataaaatgcaagttaaaattattaaaggaaaaatattattaataatcaatgttattgatgtatttctaaatattttcacgttatttttattaaatatcaatgagtaaaacggatgatttgccttatgacaaaataattattaaaattgtttttatccgttgcaatgtacggatatttcgctagtttatagcaaaacaaaaacacaccatatgcacaaacgcctttggccttttgagaattcgcaattccagccgatttgtaattttcaaaccaattgaataatactcctaaattgtttcagactagtacacgacatccgtataaaataatgccctacttgtcgttctttacttgtcattctcctttttcaaacccatggcctacatgtcatcctctacaaggcattctctacttgtcattctcctttttcaaacccatggcctacatgtcatcctctacaaggccaaagaaaagtgagcaactcatccttccttccccttcttctcatcttcagcgaggagcggagcaaatcctccgccgcctcgcgagctcccccaccgcctgacctatctccggtcgctggaatccgagatcggcctccttctcgaatccgcccccgcctgtacagtcgccgacggccgccccagctgatggttcgccaccgccccagctgatggttcgccttcactggaatccgagctgcttgaaggtgcacctttggccttttgagaattcgcaattccagccgatttgtaattttcaaaccaattgaataatactcctaaattgtttcagactagtacacgacatccgtataaaataatgccctacttgtcattctctacttgccattctcctttttcaaacccatggcctacatgtcatcctctacaaggccaaagaaaagtgagcaactcatccttccttccccttcttctcatcttcggcgaggagcggagcaaatcctccgccgcctcgtgagctcccccaccgcctgacctatctccggtcgctggaatccgagattggcctccttctcgaatccgcccccgcctgtgcagtcaccgacggccaccccagctgatggttcgccttcactggaatccgagctgcttgaaggtgctcccgttggtataccttcttgcttggttactgttttgagggtggctcttcattggtggttgctgtagaatgttcgtgctgcttagaaattggatatgaatttactgaattaccgatccgggtagttcggcttgatggcatattaggtttggtgttatgtttatgtagatccagctactgaaaatctagttgagtgactgcgtggtgggtgtagatcataccatctcccccaatccccttttaaagaagtgacagtattcgattccaaataagcaaagcaagtagttgtcttttcctgtcagttctaatcgattcatcgaggagaaaataatctttgattttgtgacgattccagcttcagaggattatagtgtctgcttcattcggaggttcatcgtcgccaaaaataaataaaatttggccgtgtcaactctacaattaggaaggtttcggatttctcaacgtggaatgataagaaatggcatacagagcaatgctgcaaagtgctgcggagtctgctatacagtccattggtcttggttacgacattgctcatgatatacgtctcaagtattgcaagcagcgcagttcgcctgacccgttgctcattgagcttgaccatgacgaggttcaggatattgtgctccctggtggactgacagttgcaggcgtgtccaagtcgattaagtgtgacaaaggggagcggacgcggttccggtccgatgtcctgtcatttcagcaggtacgtatcatatgcccaattcatatcttgtgtatactgcatattgccatgtttaagactgagaaatatatcgtaagatgctgtgtaaatgtatgctactatgatgtaacaataatcatgatgaatcccttgctatcttgatctaagaggttaatatgatagcattcatagttccaacttccatgatacctccaaagtaatataaccttttgcaattctataaattaatagaaaataggattattatttattgtaattaggagaatttctccagcaagaaaatagagtaggaacacaagttaattcagtatctcagaattacttgatatggatggtttcaacaatttgaattattagcaacatagactttaatctaccttgtattctaagtagatttggcataatttgaggcctgcagaagtgcagagatgcgagctccctacaaaatgataattccacacttgcagtgtccgtactagaggtttatagagacacacttccgttgtgacatctcaagttttgacagttaccagagcagagttatttttgctcaattgcatggctagacgtttagtcaaaactgtaggattctatccggtttgctggttgcgtgcattttttggcatgtggcactattcaacgccacctatctcaggccacagttatctgactcaggtgttgtggcacatgaatcaattagactctgcaatccaatgttttttctgttccaattcagtatgattctgtagtgatatctcatataactgcaatatatgtcacgcaagcaattcctatataccttgttcataactgttctatgtttgccaactgatgagctgtgaactgatgtaccattgctggctgaacattatgtctcaatgatacaagtctttgtccatgtcatgcttcttttcctcttcagctgtcatggaagccgctttaagtcgcagagtataattacatctataaaaggtaatatttgtgttcctgaagttgtgaagcattttgcagatgtcggagcaattcaaccaggaattatctttgtctgggaaaattccatctggtttattcaatactatgtttgaatttactggctgctggcagaaagatgctgctaataccaagtcacttgcctttgatggttggtgtatcacactgtacactgttgcactctcaaaggcacagattgtactccgggatcatgttaagcaggctgttccatcaacatgggaacctgctgcattagcaaggttagattcaatttgagtccacgctccatgtggtgatttaaattctgaatgaaaagttgaaaacttagtatttatatccttcagaaaaatcacattaggtttagtttttatgttctgaaattttcagaactgttctgagtgctcatttttcgttggtaggctggaagtgctcatgcctaataagttgctttgtaatgccatttttaggccttactaatttattgtgatcactgataaataacatcagtttgctttctacagttagtatttgacctattctaccaatgaatgaagactatgcacatcaaaacaagtgctgaactaaaattttgtttgatcttgtttgagaacaacgtactttactcttacaggtttattagaaagtttggtactcatgtagttgttggtataaaaatgggaggcaaggatataatttatttaaaacaacagcattcatcaactttgcaagctgttgatgttcaaaaacgattgaaggagatgtcagaccgaagatttcttgatgcaaacgggcaatctgacttcagtttcaaggattcctatggaaaggataaggtgattcctcagcgtctaaattttttctgccttcttttctcatggcatgatttttattcggcatcagtgatcagcattaactgctgtatttttttataagcatccttgtagccctctcaatagttaagagcatgttgtgtaaagatcctttttgttgaacacatctcattgtctcaccatatgtataattttcttctatagtggaaatgtggcttttcaccagttgaaattagtgttaccatttatttgatactattatcagaaacttatatcgttgattggcgccacattattttgagtttacaacttttaaagatttgaagtaagaaattggcatatgcatgtgctatgttctatgaggctgcatagccaaggagtatcttgggtttagcgatacagttataccatttcacaattattctcaatctcgatctctgtaagtctgtatatgtaggttaattggaatttaataatagatttactgttctctggcagactggcagtaccatttttgtacgaaatatgttggttttgcatcaattcctattccctttttttttctcttctaaaatttacaatcttagtttttctgtgctgttcagattgacacaagagagcatcggctgagatttgtggactccagtccattgaattcttactcttcaaaggaggtatagttcttttgtgttgatgcatttatctttgttcacattcatatcggtaagttgtggttgtgccactcaggatttggtgatgatgcctaagcggagaggtggaagggataaagatatcctttctcacagcgagtggctgaatactgttcaggcagaacctgatgttatctcaatgtccttcatacctattacttcactgttgaatggagttcctggctgtggatttttaaaccatgcaattaatctgtaccttcgatgtaagtcgagttttccactctacctctttgttagttaacatgaaactgcatctgcaattatgactaataataagagagcctggatcttcatcctcagtggtttacttttgctttgcacttctgttattggcataattgcagcttgcttattcatggtttataattgacggtagtgtctagagttaagaaaagacgattatggcacgctaatgtcaagtactgtctgtttttcaatatggcaggatttaatgttatctgtaggctgtttgaaatttgaacctggaccctatccacctcaaatggtcaaacatgtagaaagagggttgactggcttctctttcatatactaaaaatagtagtcgatgttgtttactaattctaataaaagaaggtgctgctggagaatagattatgtaatatttctatatttcatagctttgttcaccgactgtgcttcctatattttcttctgtggcgtgtgaaataatacccaatttagtatggtgtcacatcatcagctagtcagcttgcatttgcatggctctcttccccctgtggtagttctcatctttagtatggctgcaaagcaggtgttctctagtaatgagcttcagaggaaaaaaaatgtacttccaattgagttggatctttttaggttatgggtcactgtcgtatcatggcatacagacaatcattctagctaggaaaaagatggcattaggcctgaaacaacacaagcaactgtgtgacatgtgtaagttctgtgcagataagcctcaaattgaagagctgcaccaatttttggagttccagcttccaaggcagtgggctcctgtttacagtgacctccctcttggtcctcagaggaaaagacaaagcactgtatctttaccagttaatttaattggtccaaagctttatgtttgtaccaacatggtatgtatcttttttttgttatcataattgaaacctcccttgtttatatatttcttttgttttatccttgcatacttatatcataattattgtagtcttgtactcactataacactaagtcaggataggctagctctagaagcatttgataatgatgagttaatgatgatggtggtgatagtgttatttgacttttgcatatttagagtctgcattgataaccttgacatttttatctgtaaaaactgcaaaattgagttttcatgcaagtttgccaattgcactatatgaaaaatctactctaacaagcctgaaaaatgctgtaaccttttttactggatgtaatcttatcatttaagcagtattcgatgatggttttttccttttttttcttctatcactcgatttattttaaaacaaattggcacaggttgatgtgggcaaaagacctgttacaggaatccggctgtttcttgaaggaaaaaggagcaacaaactagctatccatctccagcatctctgctctcttcctcagattcttcagcttgaagatgatccttacaatgaccaaactccagaagcatatgaccgcaagtactacgaaccaattggctcatggaagcgtttctcccatgtctgcactgcaccagttgaatcagatgactcctccattgtcacgggggcacaattagaagtggttagccatggcttcaagaaaatactgttccttcgcctccatttctccaaggtctgcaacgccacttccgtcaggaaccctgagtgggaaggatctccaaacctggctcagaaatcgggcctcatctcaacactcatcagcacacatttctccacagcagctcaaaagcccgcgcctcgccctgctgatgtgaacatcaactcggcagtgtaccctggtggaccccctgttccagtgcagaccccaaaacttctcaagtttgtggatccaacagagatgatgcgtggaccgcaggatctgccaggttattgggtggtctcaggtgcgaagctgcagctcgagaggggcaagatctcgctgcgggtgaagtactcgctcttgacagcaatgttgcctgacgacgatgagtttgcgttcgatgaagagttttagaaccatgaaaccgagcgaagaaaagaaacccacctcattttgtttttatcatttatgtgcagctaacagcaggaactcgaatgctcaatctaggattttcgtagcatttgtaagtgaactagctggaagtctatgttgtatacagttgcgggtttgaaacatggaagcagaaatgaacggtctctggcttggatgacgcgagagtttgttgtacttgtaacaatgtaccatcccttcgcagcatctgttccagatgactaaggatagatgatcactagaggctggggcgagccaagccgcgccgcctgcatacaactcggttgattaggttaaattatttgctttcagactaaatcagtgattgtctaagacaaccaagaaaggactattctttcttgagcaaagttgtaggcacatgaatcgaacagcatacacaggttacccattgatgagtaatttaatagaaatggtgctaaagattctgatgagaacaaagctctcacccaccattacaaatttacaatcctaaagattatgcacactgatgcatataaaaaataaaatcagagttttacacgataaatgcactgatgtatatgtaaaataaaatcagagttttacacaataatgagataaactgatgaaaatttgctacgaggagattcactctactcttgcaaaccttatgtcacaacttgaacttggtcaggagggtcaggtcctgctttcctttgatgagcacaaaacatagataaatcatctgagggaccaggttattttatttctagtttattatctgtgaactttgtacaggcatagcagtcgaagcacaaaagaagcttccgaagaaaatccaaccataagctcgttgcttggtgatatttcgaaaatcatacaaggcgctctccacaaactactcttgcgggcatacataaatttctgtcacacagcagtctcaaactatgaagcatacatatggctttgtcatgttgaaaacataataaaccattcattatggacatgaaatggttgtcatcgacgaacaaatattacccaaatcaacattttctagaaatatattactgtgaaagagagcatgataggattatgtaaataagccaaaatatattccagagagtgcgatggagagggatatacctgataaatatattttagagtgcgatggagagagatatacctaatggtatcctctggtagattaagatgactctcaatgtaacgtggtactactccatgttcaccatttctgtaaaacatcaaattagtgtactatctaaagaccatgtcaaaacattgacaatactaaactccaaaagcctatcaaatacatcatgatgggcacactggaattgaaccctagcataaaggcagtgaactttagatgcaaccaaaaaaatggaaaaactatgtattttttattataaaattcttatgtagaactgcaaagcatacaacatacaacagtcgtgtgaaagtgcactttaaaatggtctgcttaatatgtttataagctagcaaatgacatgaccttgtttgtcacatgatatttcaaatctacataggaacatacaagatatgcttggttagctttttcttgtggttgattatttgaataaatgctataaaaaactttgcatatccattcaattgtataacaaacatgtgagggcgaaatagtgagataggtaaacatcttacttcagaggacctgcaagcagccgctgatttgagcaacagaatgaatatagtggtaaagtgtgaaaactaaattgagcagcaccctagtcacctgctagtaaaaatgtgctacgtaactccagacatagaggagcgtcgaactcgatgttctatgaggaacactgaactgttgaagaaaattctcattttaattccttctttcatataattatcctgcaaaactaaagggcacacaagtatatatgagttcaaatggatgcagaagtgcttatcacaccctctttggagaaaatggcagtgtaaagtatgattctacatactgattcatgtgctgtataaacaagaaacactaataaccaatttcgcatttgaaattagcaatccaaaaaaagctaacagagcaaggtaagcagtcgcagctgtagcaccacagtaacaacgtttctgagtagaatgaaaaggccggccagccaccacgaattttgttgaggacggataagagcatcccatcccctgggaggtatacccaacagcaagcaacatgagcatactctgaactctgctctaatttgctctttaaaaataaaaccccaatatttatacaaattttatgaggcaagtacatgaatttaaaatgacaagaaaaacaattgacaagttttataccttagatttcacatcaataatattacgtattgcaattgtataatatataacaaatatagcacataattcagtatgagtttatatgttcttaaaattgatcatagattgaagttgttgaacaaaaaaaagtactaattgttcacagtatgaaacatgtaaagaatggaaaatgataaaataatactaaattatataatttaaaccataactgtttggtagctactgctctaaaaaaataatgataatcttatttttcacttggaagaaattcctctcaatgaattataactgaacaatcattcaagcgttattgccttgtcttgtttcatttatttacagtatctaacagtactactatctttgctatacagattgccctacataatgtttatttttcatacctatataaccaaaaatgagacaccgtaaatagaaactaaaagtacctcctaagagtggctgaatttaccttggttaatagggttctgacataattatctgctgcctcctgaaatttctcttcttccaggaaatcaaggggtatgcgttgttgcaattagagacaattttagattcacagcttctacagtgcatgccccactcaccatatatatggatagacaacttgggattcagcaaattagttattagtgttgcaatatagaacgaataaataccacatatatcaagatactgttgtgtgcccggagaacccaacaatttaacatgaaggaacaaagaaaaaataaaaacaatttgaggtagtttaccttaacaacagatgaccaaccatattcttttttaagtgagctataaaatgtgcataatcggtcaacatcatcagtggaatactgaccattctctgagtatagaccaaggcacttttgaatagctatgaaacacctgtgtaaaaccagtgaaaataaatcatttcctagagtattatcaagaaggggtacaatgtaagtcagaagagtgctatatacgcaatccctgaatataagagaattccaaaattgagttgatatttgcatctcatatcccagtgttctgaaattattctgcaacagctacactttacctaaatgttctttttaagtcatagaggaagattgtagcaccaaaagatgcatcaaacttatcctaacacttagccttacagcatcactccacctaaaagatgagcccagttggcatggatgcagatggttccgaaagttttatgtccaactatctagggggattaagccaaccaatacgcatgcacatggatgcctattgcagtgaccttacttgcactgaaagtttgggctcttggacggatgctttctgacatggtatactaagcacctcccttcttcgccacttattccgttatacaagccttagcagacagaaaattggttcatatcaggccacatatttcagataccatgcacactaggtaaattctgaaaaaccagaggctaaccatcctcacttatcctaaaagggcaagccaagtcgttggtaagcatgatcaccccattgtttatatgggactactgggtttaaaccggccaccacccaccaggttaactaagaaccctcctacaagctaaatataatggtatagctcccctgtcctcctatgaagagcatgtgatatacatatattaggcaaagagagaacaaacacaagaaataacttaaatcaatcccatgcaaagttttgcaacatggacattaaatacgtgaaggactgaaggctcataatcaatcgtgataacatgtgatttttgcctcgtggatagttcatgtggttgcagaccaaattgttgtcatgattaactacagaatgcaagtaccgataaaattggttgaattagccgattgacaaacactttatttataaaatagagctagattatcatataactcataaactgggagatagtattttacagaagttgctaaagcatgcatcatcacaaaattctaaatttaaaaataacaataatctaaaaatcagatattatatatacgtcaaaaggaataaaaatggcatgtaaacaacatattagcataagtccatgttgaaattcaaaacccatattcactgttttcagagtttaccagaagaccaaagcaaagaaatttaagtgaggaaaaaaaagcagcacaagtgtctcacttgtagttatcaggattcataaaaagcatggacctatatgttttctcagcctcctcaaagcggccaactttcaacaaaacgtaggccatttgttctttgaatgatagcttgtcaacctagaaaaaaaaataattatgtgcgcccatctgtctgagtaatattttcctctttacatgattgaaaaagataagacttacaattttgctatcctttttctgcatctcctcaagagctctgtccagcattatgcattcctcgaacaatgaaatctgtggaacaacaatagcattacataacaagtaaagatgatgcgagtattcaaaataacacaaattctttccacctagtttccagagcatgaaaagtacttgtatataaataaaagtgatggcataaaatcagaacataagtaaaaaaaaagaattcattcagaaagttagattgcttgaagaagagatagccagcagcaagttttcaactaatatgaagaagagagtgaatataaatcatcattcgaacacttcatatttacagacagcattatgcaaaatgcagcgcataagttctatcgtaaccttatgcctagcatgtaacatatcatgacttatgtcatccttcgaaaaattgaaagatgggtgaaaggcaccgacatgcatctaatgcaccaaaagaagcaacaagaaaaatgacacttttttccgacaactcgattcacatagagcaatctgaagcaaagaaattctagtaaacaattaatttaggcacaataaaaaaaatatcatcagaatttacttgtgttttttgggtatagtacctttgctgaaaagacacgataatttcctggaagaccatcatgctacagctgtatgtccttattaatttggagaaaacaagagagtagattaggctgcagtatttactatctactatattgattagaactttaacacatatagccagatttgtcatttgtgatttgatcccaagatgcatatttataactcatagaagtaattaatctatgtatggaacaccaccttatttctatttcgggagggattatgaccctatacacataactaaatcgatgcagttttagagagagagagagagagagagagagagagatcaatttggcgctagatccggcggtggctggagcagggttcactctatcggttgaggtgtttgtatcgggggtcaccgaaatctgaaaatttcggtccgaagtttctaaaattttgagcaaaatttagttgaatttgaataaatattactcaaattcatgaaaaaattaaaaaatttcggtcaaaataatatcgtatcggaagtgaccgaaatttcggtccgaaatttccaaccctgggctggagtcgtcctgcaagtagaactcgacgatctccgacaggtcggcggcggcagattcgtcgtcgtcgtaggctcgtatctcagcatccccttgtttctggccgcctgcagccacagcaggtgctcgaacagcagtccgtccacggcgaccgccaccgcgccgccgcgggtctgccgcccggccgccgcgaggaggcgccgcacctccacccttcgtcgagcacgtacggccgggtcgatgtggaacaagctcctctcccccttcgtcgtatatcctgaattttattttttttatgctgacaatcatttggaatcggatttgtattccgagttgttgtaatattggaaaggaatagatctccactgtcgtcttacgtggctgattcagcttcggtttcggttcaaggtgattgcgcctctccattttatagggagggcctcaatccaatcagttcgtgcgtcgtcccccgtttttgaggaattttaaccctcacatcaccacagatcagccgatcagatcgatagccatcgccgacatggccggtcgtttcgtgttccgtaaattagcctctcatttgtcttccgaatcgaccaaggcttttccccggcgctgctgaggttcgtgtaccactcccatcctactcccatccttcaattcagttaagtgtgatttctttagataatgaaattgaatataagagtagttacttatacttcatatcttgcatctcaatctatgccttttactaaagagtttaggacgctaattcataatgtgacaggatgacatggctattctgttttaaattatttgtcgttttggatttttcgtaagtaaaacgttcctaacattgactagcttaacatcttaagatttatgcttttagattcaccataagaaatactttctccgtttcacaatgtaagtcattgtagcatttcccacattcatattgatgttaatgtatatgtctagattcattaacatcaatataaaatatgtctagatttattaacatcaatatgaatatgggaaatgctataataacttacattgtgaaacggatggagtatattcacaatatatattattcacgtgttgccaaactatatgaatttttagatattgattgtcaaagttaggaatgttttgatctaagacacagctaaaacgaaagtgatttgaaacggagggactactaaacaatgccaagacattatatcttatatatatttcatgtacttgcaaagaaaaaaacttggctcaattgcctgtcctgatttgttatcctgcctaatgcaggcgtcgaggaacttcaacaccttgccaacaactgggctgtcctctgttcatcacaccaataatcgcgtgatcaacacctatgcttgtgttagaggcgccaacacaaatgctttattcagtacaactgccaaggtcgatcgacttgccgcaacgtcagacttcactccgtaagtatatactattagcactaattaattaattatcttctagctatatgtatcgggtcatgtcctattatatatccatcactgtgaaactgcaaaatgtagaaaggcacactagcactagctgaatcaagtttgatgtgaactcgatcagaaaaggtcatcagtatcttttttatttactgtatgtaattaccctcttaaaccagctggaacattaatttgactagacaaactgttgtaaacaaaaatagccattactgtttcgctttcttaaactacacaaatcggtcagatagaattaatacgtggctagctagcatatagcaaatcgtatttgtagaatgatgattgattttagccaatttatctttttttcccctttgttcaggaggcgaccgatacttgataaagtactccatggcatgatcttatactcatatactatgggcctttgtggattgtttggtctatttctgtgcattgataacaagcgcgccgcccgccgaaattcaggcagcacccaatgctgttcaaagcaccagtgtagttccaatcatgaggaccaatgaggagctccaagtaccctgaggcagtggtggtttgttatttcaagataactgaagctttattgtactcatgtcaactactctctccgtccaaaaaaaaaagacaaaccctggctatgtatctggacatgcatcatacatgatgcatatataagatacatacaaccaatgagtgtgagcctatatatataagtgatgtttacatgttgtgtattttataagtgatgtttacatgttgtgtattttgttccatgtcactggcctacgagtgtattgagtgatgtttgcatgttggaaaactttgttctgattgaccaaaccgctaattatcaaaattgacctaattatgcagataacatttttcttttgaatttttattactagataaaatgtttattcaatatatccttttcttccaatttcgcgagacattgcctggctgtaattcacccctccctccctacgctcttttaactcttgtgtattcactgttcctgcttaatacttcctcgatccgtcctaaaattgaaatacaaggtattttagctatgtaaaatgcatagtcctttttattctttcacgaatttcaaagttaattaaccaagaagtttttccctcaaaaaaaactaataattcaacataatattagaactttaacatttatagtatcgataagaatatctcgtgcaacgtacggattagcaattagctagttattagtataataataacttaaaacttcaagagataaccaggaaaattattacaataatacctcgagagaacctaggtttcatgagcctgagagttttcaaaagtgccaatcacttttctcatccattggatatgatgacctaatatggttcgtcgcttccgtacttttttttattttaaaaaaatgtttcttctttcttggataactttctcacccaaacatgaaacacaattataattcaataaatttacaaacttacatgaaaaatatttaaacttggatataaaaataaaatcaagcttagataaaaataaattaaaaccatacatgacaacaaattgcacttaaaatacatagcaagtactccgtataggttaaaaataattatcgttttgaacgagaacatgatctttaaaaagtaacttccattactattttctattataactagcaaaatacccgtgcttcactacgggtataatgaaaggttaaatgctataaatacacagttaacatatatgtaataatgtttcaagatggacaaaacgtccaatgcaaggttaatgataatcaggacggataagaaacactattgcatattgatatactcatattgtcataacacacgctctctctcaactcttgcatggcaagcgtttgataatttccaaaatcgaacacggactcgcatggagacggatcgtttcacggctcatgcgtggactatagatggtgcgaactctaatatgttgtgttttgcagacgacgaaaagaaaaaaagtaattatgtttgattttcgaatttaaagctggttcattataagatttcataataactaaatatctgttgaagaaagaggtgcaaaacttttgatttttcaaccatcggatgtgcatggtccgtgctagtggcactggatatctgttgaagaaagaggtgcaaaacttttttgattttttaaccatcggatgtgcatggtccgtactagtggcactgaatatctgttgaagaaagaggtgcaaaacttttttgattttttaactatcggatgtgtatggttcgtgctagtggtggagagaaaaaaactaaatatctgttaagaaagaggtgcaaaacttatttgattttttaaccatcggatgtgcatggtccgtgctagtgtcagagagaaaaaaattgcgcgcaaataggatttgagacgtgggaggaaaagtagacttattccgagtaataataagcataaaagtttttgatagggtaatctggcctaggagagggacaacttttttgattttttaaccattggatgtgcatggtccgtgctagtggcggagagaaaaaattgcacgaaaatagaatttgagatgtgagaggtaaagtagacttattctaagtaataataagtgtaaaagcttttgatagggtaatttggcctaggagaggcccatagacagtgcaaatctatatctatatctatataccaaaaataagtaaggcttccgtaaatattttcatacgttattaagcgtgggcccacatgatatttcgtcgctaatcatgattcggaagctgacagcgatctcttaagcccgcaaataaaagagaaaaaaaaagagagaaagcgcatccaaagcagccctgatttgtggattagggagaaatattgcaacccatccaaagcaacagcaggccggcccagaaaaaagcagtcgcagcccaccagcgcgcccacagagcagaggagctacagcccagcacaataatgcgtgatactgtagcaatcaagtaggaataaagtttggactcatgcctaccaggtatcggataaaaaatagttcattttgtaacttaaaaacatgtaatcaccacaaaatgaactatttaccgacaaaataaattatttttaaaaataaaaaacaatcacatgtgtctttgtttttaaaaacatgtaatcaccaacaaaataaatcgtgtttacatccggatttttttccctcatcaatttctcattcgtcatagaacatctaatcacatcactttttttccattcattgtatgatttattctgttgttaagagtgaaagttattatgcgatacaccactttttttttctttccattgattgtatcatttccttctgatttttttagtgagcgattatgcaattggagtacagtgaggttgatctgatagctagcgaaaaatatatcttgtactatggctactctttataatatgaaaaaacgtttatcaataccgagtaccaaaaaataatcatgtattgcaactgactcataataatacatgaatcttgtactatggctactctttataatatgaaaaaacgtttatcaataccgagtaccaaaaaataatcatgtattgcaactgactcataataatacatgacaaaaaaagtagcaaataattatatcatgttagtgtcttatttgctcccacacactaattattattattattttttcttcacactaattattaggatggtgggaatcgaatcctggtggccagggcgcaaattttcttcactaaccaagtaggcaaactgctacttgtgcttggtggttacatgaaagaacacatattctatattaaccgcattttgtattagattggaaaatgtccgaccggactattaagggattaaaacagattttagtaatgggatcaggatgatgggcgaaaaaaagaatatccgaaaccttacatatctttttattaggtactagaaaaaatgcccgtgcgttacaacggataaaacctatttaatcttattattattatacggtttagctaaggtgaaatttactatgggaactctttttttttcaaaatcatgagctacaattagaagtccgatcgtctcaagttagcatgtgagttttttttaaagagatgtcttatacgacttcttttatatttctaaaaccgaaagaacttaaaaaccaattcaaacatggatctgtatttccaaaagtgaatgaaattaaaagccgactcaaatacggatgacataccaaagtaccgacaaaaacatcttcaatttttataataactagaaaaaagcccgtgctttgcgacgggtgaaggctattttagttttattgttgttgttatacggtttagctagggtgaaaatcatcgtaggaatttgcttggatctttgttttagaaagtcatgagttgtaattaggagtcgactcttatctcaaattagcatgaagttttttttaaatgatttcttatatggctccttttgtattttcaaaagcgtcataagttaccatgcaggtttttttaaagagatttcttataagacgtcttttgtatttcctaaagcgaacaaacttaaaaaccgactcaaacacagatctgtatttccaaaccaaacgaacttaaaaaccgactcaaacacggatgacctaccaaagtaccggaaaaaacatcttaaattttttacaatagtagagactagataaaatgcccgtgcgttgcaacgggtgaaatctattttaatcttattattgttatatggtttagttaagatgaaaaaaagttagcatgcgagttttttttaaacgggtttcttatatgattccttctatattaaaaaagtgaaggatcttaaaaaccgactcaaatacgaatatatattttcaaaagcaaacaaacttaaaaaccgactcatacgcttcaatttttataatagtagatagagatatatagatatattgagaaatatctacaaatatatgattttattgaagtacattttaagagtaatctacttaaaatctatatgtatggtctccatgtttctaacacaaatattttagaagttattcatagttgaatcgaagtttttaaagtttgacattgatattgtacaaaacgaatattattttcgagcaggagggagaagggagtagttttaggtgactgaaaatttgtaaatcttttcagccgcatgaaaatctaccttattataacaatatacttacaagtaacatgacaaattaaatgacatatatagataagccaagtgacatgacaaaatgatataatataatcaagcagctgccaacatccagcgatcgatcgactacctagctagaaccacacgagcgccgccgcagccacggcgccggcgaccgcgccaccgcgggccctgtagttgagccgcccggcggacgacgacgaagacggcggcggcggcggcgacgccggcgccggcgcgttggggtcggcgacgtcgacgacgagcttcatgcccagctcgcagtggttgtcgacgttgcagaagaaccacctcttgccggccttgtcgagcgccaccgtgtcgttgccggagttccacgtcatcaacgtgttgccctgccggttgcacgcgtggaacgctgcgccgtccacctccgtcaccgtgtgcttgcccttagtatacgtgaacactgcgattattaattaaagaaaacaaaaagggttggaaccatgcatataattcttttaaacaaaatggtataagtcagaaataagtatcgaaataatcgagaaatgaaaaagggaactattcggatgaaaacatgccggcatctattgggaatatgtaattcatgtcagaattgtgaaatataaaatagaatttaaaaattatcatgatgaaatataaaatagtataaattagttcatgcttatactatgcaaattgtggacaatctctcctttaaccacatactcaaaataatggtttaatgctagagttaattaagcacctgtgctatggatgaagtggagtcctgggccaaatgtatatattgtcacatttataagtacggtaatgtaccatattatataaaactttgcctgaaaaaatggcaaacctaaaactatttctggttccatttcaattacaaatataaaaccattttcagatgattcggcccgtaaaaacatttttttaaaaaaataaaaattaaaacgacagttggttggtcggaaattacagaaaacgttttcaaccccctaagtataaatacctagtttgtcgccgatttggaatgatttgccgtcggcccagttggtggaagggtactcgagagtccagccatggccatcgccgacggtgtaatccgtggcagagaccatcgccgggagcaacgcgacggcggagacgatggccaagagcagcacttgccgggaagccattggtcttgcggttggagatagcttgctcgaacttatatatcaacttaattctgcttctaaacagctcttaattagtatcagagctttattagcaagctgtaggattcaatgtcttggagagaagagtgtaaatgatcacatctatttatacagaggtaaattaagatcaatattattccatgacaggtcgagatagcaagatcgatgtgcaggtagctgacgcagcagatggtatgctagctccaggtggcgcatgatatggaggcaattaatattaattagttatttgtctgtgaagagttcaattaattaaattaatcttgtgtatgctttggtgctatcagtggctgggtgtacgtattatggctgaagccaaggggaagaaacgactggcacattgttgtttcccctagctagtagctaactcgctctttgctttttttcttcttctttattttctttttttcttttcttttttttttttgcttgggtcgacgttttcctgatgaattagctgggtcaatggccggcttgatcggttgtcagcaaaccaagttactgatccaacagagattatttgttgtagagggaattgaatatatataggtggctgattccattttaagtgtccatgtctcagtatatataggtggctgattccaacatggatacttggtggcatttggcaaaatttatgtgttttgttttccatacattcaactaggatagtatacgtagtggtgccacaatcttaaaaatagtcatgagacttttgttctgttttggataggacagtacctatagaattagtgcaaaaaatctatatgatttgtcttagtttttaattcagatggtcatatatcatacgcaatggtgctacactcttaaaattagaagccaggagacttttgtttcattttggatagcgtagtacctacagaattagtgctagaatttatatgatttgacttaaattttgattcaaatggtcatgttttacaaaagttggggaattgttccatcactcaatattgtttttccttttctttatcaactcaatgacttttgtttagaaaaatagtacaaattggttgcgtgtctgttgaaaaaattcgaagatgtatccatttccattatctaaagaaaagtcctcatgttttttaccaagcctgcaggatatacataaagtgaattggaatttcagtattcaggtttagaagtaggcaaataatcgttgcctgtcatcaatttcaattattacttggtttacttaagcaaggtgaaaatagtactgttagatctgtcatcaaaattactttaaactggtatgtttgtctatctatctgtgtataaatatttccaagaaaaatgaatagtcaaaacaaattacaaaaaccaatttcttcatatattaaaaaaacatacacacagagaaaacttctctaaagctacaatcaattaattaattaaacaaggctacaattaattaatcaacaaacaaaggatcgaggccttgttcttcgtcatgtatgatcaagctgaagtacgaaacgagcagccagagcacaccaactgctaggatgaagccacacatgacctgcacatctaaccgttgatcagcgatgctttgccctggattcgggtgcaccgtggagtagatcgtcgtgctcgacgccaatgcgatcaaggcgaagcagatgacctgcatgcaattaaataattactcctttcgttctaaattataggacgcccctctttttaaaaaaaattaaactcggtaacttttaactaataatcataataactatatctatattaagtattatgcatgttatatcactagattcatattcatattttaaagtactttcagtgatgctaattttatatttgttgggaatatatatacaatagaataaaatactggtcaaactatgttattgcaggccgtgtaaaaaaatatagggcatataatttgggacaaaggaaaaggaagtaataaactattgtcataaacaagttaatccatacatataattatctatatttgattattattacgagaaatgcctagggcatttctggtggccagctccacaaggtggtgggttaaacgacctgagttttaagcctcaccacttctaattatttgatattagctaggtcattccctaatattcactctttattattattattattattattattattattattattattattattattattattactactactactacttccttcgtttttcatattataagtttgattaagttaatagataattagaaacatttacaacatcaaattggttttaataaaactaatttttaatatattttttatcatatgtttattttgtatcaaacatattactatattcttctataaatttaatcaaatttaaagtttaactagaaaaatagtcaaaacgatatatttataatatgaaacaagaagtattaatttgatctatcgtgaagataatatactccactgtatatatatgatataccttgaagatgaataggacggtgcgaatagttttgttcgcctcactagaaggacgaagacgaggctgaaacgccgctgccgccggcaagatgcgaggcggcgctgcagcacgggctggcggcggcggaggtggcggcgcgaggtccttgatgacgtggatgatgaactccggtgagtggccgtcggaattcatggctgacacaccgaccgatcgaacgaacgaacgagcgtaagtgcaagcaaaagcaaaattgaggatggtcaatatatatcagcacgggattaaaaacaaattagtactctctcctcccctaaatgtttaactccgttgatttttttaaacatttttgaccatttgttttattcaaaaacttttgtaaaatgtgtaaaactatatgtatgcataaaagcatatttaacaataaatcaaatgataggaaaagaattaataattacttaaattttttaataagacgaatggtcaaacatttttaaaaaaagtcaacggcgtcaaatattttgggatggagagagtacttgtatatccgattcggatctatagtacttacagtgaatcgaattcctagtaggattcctctaaaattggacacacaagatcgaccgtccaatctaagcgttattccgtcctcaaacaaacctccgtaaagacattttatgcctcacataacatgcttcttacttaacaagtttcaggtattatgttctgtatcacaaacagaacaaacgcaacataaggcaccagaagcatgcgaagtatgcatacgcaaccttcaattgaattttttgagagctttcaaaagaatttgcagcaatgaatgttgttaacatgcgaagcggccaaagaaaaagaagtccaatctgaccatatgaaactgtgctgatctaaagaaattgtgttttcaaggtcttactagatactaagttatgtatgtacctaaaataagggagtatatgcacccgaaaggttttctgcagcaaatttgagcaaacagctttaagcactataccatggtaatgaccagccaatgtgagagtacgtgcagttgtgggtaaaaaaaacatttgcaatacaatatatccaattggatatagaggccgtgtaaaaattactcttctctaaaataaataaataaataagcctttgcaagtaatattcacatcgcaatcttctcgttcctaaatcatacttgtgaactgctaacaactttgctgccaacgtatcaaaggcagatctctgagcttgatggatccaactcgtcatcaccaacaagggtatatctgtaaatgaaatgaagcatcgcctgcaaagagtcagggtgcgcaggggcgagcaactggcgacgatggtgcgtggtggccgccggcgagctcttccggcgtttctatgaacacgagacgtacgtgagcgaggacgagcacgtgaacacgaccgtgagcaggggcaaaaacgtccgggataaaataaattggatgaaaaatgatttagaaatagcgaaaatagcattctagcgaatgcccacggcttgacagtggtattcgagctaatcccactttaacgacggtattctagcgaaactaatttttaataatggcagatatacaaatttctcctcgctgaaccaaccggtgggagagccctccaccttctccttccattggaaaaaattactgatccaccaaactaattcttatatatatttttgaaggaataaaaaacaatactataattcttaatttttcaaaaatattctcattgaaacaataaaaaataggaataggtatttgtttgttaaagtcaaaagaaacaacttcgttccctagttattataaggacttttattaaaataaaaaaaagattgaattattttacctcggtctgtttagttcccaaacaaaatttttcatgttatcacatcgaatgtttggatagatgcatggagcattaaatgtagacaaaaaaaacaaaccaattacacagttcgccaggaatgcgagataaatcttttaagcctgattgcgtgttgatttgacaatatggtgctacagtaaacatttgctaatgatagattaattaggcttaataaattcgtatcgcagtttcctggtggaatatgtaatttgttttattattagactacgtttaatacttcaaatatgtgtccatatatccgatgtaacattcaggggcaaaattttttgccaaccaaacaaacccttaggcctgctttagttccccaatttattttcctaaaaacatcacatcgaatctttggacatatgtatggagcattaaatatatattaaaaaactaattacatagttagagagaaattatgagacaaatcttttgagcctaattagtccatgataagccataagtgttacggtaacccatatatgctaatgatgaattaattaggctcaaaagattcgcctcgcgatttccagacaagttataaaattagtttttttatttgtatcaaaaaccccattcaaaatccgatcaaacatctaatatccgatataacatacaaaaaaatccatttcacgaacccgttagtatccttcccgggcggcgctgccgccatgtcccgcgtcggatgggatggaggagggtttgggaattttgggctaaggcatagctttggacctctcggctcggctcatctcctctcggctcggcttaaaaacagccgggcggctgccacgctagctgcctctccccttccctttctccccgctcggacttaaacccccccacaaaaaaaaaaaaaaaatcccccacctcctcggattcccctctcctcctcctacttcctctccggcgaaccccacgcggcggcggaatggggaactcctgctcctccgtcgacgagagcgccgccgccatcgccacattagcggagagcgctgctgcaggggctcgggaaaccgtcgccgacgagttcgccagggcagcggggtcgggagcgggagggcgaggcgacgtcnccggatcagcggccgcaggagtcgcctctggagcgggagggcgagacgacgccgccggggacgaggttgtgatcgctggcgtcctgtcgctggccgacgggcagaaagccgccgccgcgggcgccattagcggggtcgagtcgatgcagtcctacatgagaggtactcgattcttctgtttcggagagcgcgtgtgctcggaccagatggccgcgctcaagatggccgccgcgtgtggttcggccgccggcatgagggcggtagccatggttgccgcccgagctcggcacgccgcacggattgccgcgaatccagacgttgagaatcctctgcatgatatccccgaggtaattttctcttgtttttcatttgtgatgttgcaatcgatgcatttgtgtgtcaggaacccacactctaacctcaatagatagtatccaatacaaaacagtagtggatcggtgtggaattgatggtggagaaattatggaatacaaactgaatagaaggttctagtagtttctagataagtagaggaagaggaagggtagagaagaagatcaacaagggtgccaagcccggccacccaagtcgccgccaccgccgattccaaatgttcgatgcctctaagtgattgctgttgctgctcatatatgctgctagttgtgcttgtgtgggccaggattgaaacatgactaacttatcccatctgcagcccaactgtgttcctaacaatcccctctccttaatattcgacttgtcctcaagtcgatgcaaattattgccatgccaccaggatcccaaggtgtctgaagttcttgcatatagttagcaaccctctgaataacaagtgattgtggattattaccagcaacgcttctcgatttcatcttctggttatcatccatcagccaatgcaccaaaagttgattttagttgatttgcaattctcccttattactgaccttttctctccctttttccaattgatgtgctgttacaggatcgtcctgattacatgctatccgccgctgccactggagcaagagcaggggttctatgtgcacggatgaagatacaagcagctggtggtgattctacttcacatgttagtgccagatcccaactattttacatcttctttaaacaattagaattagggcctgtttagatcccacccaaaaattttacaccctgttgcatcgaacgtttgaacacttctatgaagtattaaatataggctaaaaaataactaattgcacaaatttcgactattttgcgagacgaatcttgtaagcctacttgctccatgatttgacaatgtggtgctacagtaaacatgtgctaatgatggattaattaggcttaataaattcgtctcgcggtttactaatggatactgtaattagttttttattagtgcccgaacaccccatgcggcaccctatataatacccgatgtgacatgccaaaactttacacccctggatctaaacacccccttcatcgtaaaaaaacacccccttagtatgctttataccaaattcatagtttgttacttacaaagatttgttgtttattgtattcatgactacaaatagtatcaaattaccatgtttgttgatgtttattgtaggcgaagtatgtcccttttctcgcaccgttcattggaggtgcactaccagggtcatatgcggcctatcacctcgtgaaacattctcctgaatgggtcatgggcgtggtctttggtagcatttctttgggtttcttcgcagcttgcacaggaactgtttctggtttactaggcacgtcatccgccacattccagtacagcagatttgctgccattacaaccttcacggctgtatggtttttattcagcttcgctatgacttccgtgttttcaaaaacatggcgcaagattctctgtggatttatatgtggtgtgcctggggtaactttcgtgggggcctggctatattcagggtggtaagagttgttaacccttagctagtaaaaatcaactcagtatgtaaattatttgctcatttttgttattttttttattgcaggtgagaacgagttgcaacaaccgtttcatctgtggagactatagtttaccatagcttgttttctttgatgtggttgtagagacttccatccacatagtacagtctttacttcagtacattttcgtagtgattacagaacatgacaaagggagaacagatcatagttcctacccatatacagggtgaaaaggtggtgctaaaacctctctttaaatcaaatattttccaatatgcaaggggcctgtttgcaaatctttttttgcccttgcttttggatgggaccattcctatcaaaacagtaaatactgttgttctgggtgtctgaactgtgtttcttgatgtttacagattttttcctccccgtatcaatgccaagttcttggttctatgtgtgtttggactgaaggttttgtgtgttgggtggcattataatcgatagttcaatttcagattagtaatttaatcctcggtaagacaaatattgactgaatattaagggctttgttatatattagtgttgagaattttgatattcgtgttctaattccaatactatgttcgctgaaagttcactgccatggtttagccccagttaattttacttatgtatattattatatattttctttctgcatatgctaatatattctttctgaagaatatatattaggtcttctgtaatgcataagcacatattcttcagaaagaatacctaatacattttttaagaaagaatacctatcatggtttacactgtagtgtcggtactgctaataaaaaaatattctttccgaagagcgagtaacgagttgctggagtgcattttctatatattaagtatacctgaaaaaatatgtatctgtactgcattcaatgtagccaagtaatgctcgatcctaatcgtactatttctacatcttatataccgaattcaggggtagaaccctggtatttgattgggccacatgccactaccattacaactgctgctgaattctcggttagagaaactagaatggggatgcgtggccccgcacaaccaccaccgcacacaaatctctactattataaaaattaaatatgtttttgccggtactttagtacgttatctatgtataagtcgatttttaagttcgttcgattttgaaaatacatatccgtatttgaatcggattttaatttcgttcgcttttggaaatacataatgagttgtataagatatctctctaaaaactcgcatctaacttgagatgatcggactcctgatgctcatgattttctagaaaaatatatatccaagcaaatttgaatagtgaatttcatcttaactaaaccgtatctttactattataaaaattaaagatgtttttaccaaaattgaagatgtttttgccggtattttagtacgtcattcgtgtgaaacaatgctaacttgaaacgatcgaactcctaactgcagctcatgattttctaatatatatatatatatatataagcgaatttcactttaactagaccaaacaataataagattaaaatagtctccacccattgcaacgtcggatattttcttttctagtataacttaaacataaattttattaaacacaaaaattagctatcgttgatcaaatgttctccatttcgtttaacctaaaagggtaatgtcaaatgtagtatatatataattacaaagtgtgtacagtatcaaccttctatgtgattggaccacacgcaatttaagactaaaggaggaagaagtaaaaaagctgcaaaaaagaagaaagattgacaacgatatttaagtcaagctttgtgaactaaagtacaatggtctaaagagagataaatccatgtgtagcatagcatattttgcatgaaaaaaagataatatagatcgctaatatgcatgaataccaccatacccatcacggtgagcagcattccaaggatgatcttcacggtgagggccgagtcgaacataacccagataagaatcaacatgcactcggtcttcatgtggccccaggaaaacttcatgatagtaactgttctgtctggttagcaataacttcatctggccttcagggcagcacagaaaatacaataccatctgaatccatgcagcaagattctttacttgttataattaagctcaacaaatataataggctttcattggctgattcaaattgttgaattgaagggtgcctataaaacaaagcaataaaaatgaattatttttcttgaactgttaattaaaagaacatgacaatataagagggaaaagaaactaatacgaaaacctcctgtaaatataataggcttccgtagggcaagttgttatttggttagtgatcgatctacggaagaattcagcagttccataccttttgatttgttagagagacaaaccaataacatatacatatttttggtgcaaaacacaaggcattttaaaaataagggatgcatgaaaaataagatctggaatagattaaagaagcaaggtcaacttctaaatttcaatgttgtacccaccacaagtgcatcgattctttaaaaaaaaagaagaggagttaacatatcatccagaccggtagttctatcaaacatttaatacttaaattatgtgtagggaaagtttatataacatgtaagtattccaattagaaatacatagaagtattcagattcaattcgaaacttaatcaactaagggttaaaaactgtaaatcaaatcaaaatttcttattgtggaaatataagtacccatacagagatatcagcagctaagcatgaccgttgatcattctgtgcagcagtacagagagcaatagaaaactccagctagaggctatggaggcacctatactcgtgaactcagcttcacctaatactaacgagccaagacctgttgcagttcttgtagtggagaacaaagtgaaagggcagatcgatcaatatagttgccatcactgcatgcagtttatataaatttttatgcatgattgacgaaaattatgaagggatttgcagtataatgttaaccatggattgatccatattagtaagatataaaactaatattcaaaaagaacaccaagccactaaaacttcttaatggagtggaaagaaggccaataagtaagcatgacgtgcgtacagccataactgaaaaaggccgaataatagacttgcagttttggacctttggtaggattatagaaggtccctgctataaacttgattgttgtagcaaatgaataagtccatcaaagaacatcttttggaatcacaaggccattgtttattntacagcaccagtgctgcagctgcaagagcattgagtaggaacatgcccatcatgaacataaaaatgggaagagaataacatcaaagtattgttcagcacatatacctgacaacgttctttgaaggtggctctaaaatactttgctctgactcccaataaaaatctcaatagcctcctcttgaaggaaagtaaatcaaaaggaacatgtcaaaactacttatcaaagctaaggatagtaatatttattcgaattgaagtgcataatagcaagcctagaggaagttgaaaaggcaccttcatcggtcttgaaatcaaatggctactgttcatcatatcccttcttcgaaaatattgtgccatcctgaaatattctaattattttaagtgtcaacaatgaatacaactttattattatcagtagtaatcacacgcagttgacctctagctgatatatgcacaagagaaaataacaagatcaacaaccattgtgctttagcatacttttgtcagctgcaccttcattgtgacgctcatacccttgaccctccttgagaactttgttcaaaatattttcttaatgacacccatttctatgagtatttctagtgaaaacaagttaagatcaagtgataaacacgaagagtggcattttatttggtggtacagcatcttcctcaatagctgtaggtccaccactctcaccaaatctatctaccattacaaagttttaaatcttttcaatcaactcagagaaagagatggcaagccatacaaaagagagtgtgaaatcaaagaagcttacattatggcttcttttcatgatcttgacagctttcgctagtgcaggacagaaaaaccctggaacaaaaataccgaactttcattagttagcaagcaaccgattgcgttcaatactatgaacgtgaaatgctgacagggagataaagggagatggataatgaccatcgttaagagtaaattcatcatctttaagaacacagcagaaagcacacaaaagataaagaaggacaataagataatcaaactcatgttatcatccagattcacaagaaagtctttgcctgactgctagaaagtaccaattcgtacaatacaaccgatctcacacattccaaagaattcatgatttgactaaagatcattttgtgatgatcatgaataacatgtacatgcaacaacgacgaatgactaactatggtctaagtactatgattactcaataatgataggtaaattatacaacacagcgccgccgcggatcacaacgccgccgcgaggagagtgggacacaggcatcggctccaacatcgtcaccggccacaacaccgtcgcggggggatagagaggaggaggaagggggacaccggcgacggtccccaaaccgccactggcccagacgtggccgcgggggagggggacacctacgccagccccgctgctgccaccgctgacggacttgcatctcggcggctctgcagcatgcccttttgccgccacagggggtagaagaagaggggagacgacgggcggcggtcgagcggccgatttcactgctgcagcagacccctttgccaccacatgtggcctgtggtgaaggggtgtcacgacggcagcagcagctcaagaaccgggcaattcaaatcacgaagcaatgggccgaacggggggtcggcccattcgttaatgacagcccgacaagcgctttccagcgagtgagtggacccagtaactatcggctgggccacggctagtgagtgaggcttgatagcgtattgctatataggccagcagcgatagagagaaggcgtattattataatcaacaaacagaaactcaattcgaatatctctgctgcttctatcgtcttcctcctctatcttcctcttcttcctcaacaaatccctctcgattctctctctctctcgaattctccttggtgaccaaatccttcgcgagaaagacctagaatcgtgacaagggggcgtcggctccgacggacgccatgcctatgcgctcctttgccacggaagagggacggcggaaggcacccgtgccaccgcagtctcgtgctccgccgccaccaacctcgtcgactcctgtgccaccgcggcctccccgatccccgcctatgtggccatcgtcaagttccacgacggcgaagcaggacttcgcctccagagggaaggggtagggggaaggttggtgctggaggattagggggagggccgacgccgccgtggggcatgggtggtcggtgccgaccacgtcatctccctgcaaccccagccgaagtagccgcgtgcggccgtcctggccttgcgtgcggccctgctgccttgtcgccgccttcacggcatggaggggagcctcgcttaggtgggcagcgccgccagccaccaggaggagatgctgaaacagcggttgcggcgatggcaggaggagggcgagaggcgccggtccacgggcggcgttgggatgggtaggcaggagataggatttggatgtgtttttgcaaaaacacccttgtatttccttggattacagtgccatccctgaaaacagaattttctctttttcgtgttatatttctcagaagtatatggggctttcattaaaaagtgtagtaaggtaaaaacggtggaaggattgcttcaagatttcttagagtattaggttttttctgcaaaaacaagtggggtgcgtgtggcttgcatgcatgcctcaaccgcccattccttgttaatcacaccggacacgaaggggatacatgtctatggaaacagagaaatgaccgtgggaaccgcgaacaaccagtcacattcgcgcgcacgaggagccttaaacacaaaacgaagacgtgtaaaaaatgagatagccagaaaaaattgaaaaaccgaagaaaaaggaatggttaggggagttattgattgatgatgtgccacgtattcacaggcctccctcagccgtttgattgtaaatcaatgatagatatgatgcaacggtccaatctgtgatttcttaataaatgattggttgttctcaatgcccatcagtacacggcacgtggcaaaacatacggaaccggaaacggattgcacaggaaaaaaaagaaaataaaaagaaaagaaccagaacaaaaggaaaaaaaaattcccattcctgatcgtcaacgctctcgccactcggccgctgcagccactcaatacgccgtggtacatggcggccttccccgtactggaccatttataacccaatgattaggatggtgtctatatcattgaataagttaccacctaagatgaaaaataatgtgtcaaagtgaataaatgaggaaagagaaagaaaccatgtcttgtatgagacatggtttctacacaacatccaagacatcatgtgagataagtagcattaaatttaagtatggaatagtgatgtttgcattggaagagtagtgtctagtactagtttttttatgatgtagagtttatggaaattatgtctagtgtcttgggttgtgaatggcctaatccactcattaagaagatgccacatcatcatccactaacaatcatcacatttaaacatcatgcaaacatattatatctttatagtttttatagtttaagagcttttcaaatacaaacatgttaaattatcacccaacataatttacataatgtttcaatgtatatctttattatgttttatgatatcctatatacttatatagttcatcttcacttagttagtgcttaaatgattaatctatggtccaaattatctttctccttttttcctctaattaagtcatatcacatcaattatttttagcctttagatgattaatctacggtccaaactatcttcctacttttcttcttccataaagtcataccaccttactttttacgtttgaatcatcattctacatactatttaaatttaaattagcataaaccataataatttacttaatctaatgttatgtagctatcttacacgttattttttttattgttatcgtactaaattcccgcagcaatgcgcggggtttcacctagtattactaatttgtatgcctttgtttgtcttaacaataatctgaaaatgtatgctttcaatcatcctctcgcttatgtttttccaaataactcattactatatttatctgtaaagcatatgtctttagtgattcacaagcaaatactataaaacaaaaaatttggctcagagtctaggaatcgattaaatatgtaaaactaagattcaactcgacaaaaagctggctggtgcataactaagatggtgaagaggaaattaggatacgcaaaacgagaaaaccattagcgcatgattagttgtcctttaattattacaaacgtgaaaaatgattttatttgatattttaaagaaatttctatgtagaaagttattttctgctttcaatatagttattttacgataaatagaaggagctaaaatgaatttattacgggacagaggacgtagaattcactattttttctaattgtttttcatttagtctattagagcaaaatcatgcttaagtgattatagataataagataaccactaaattttctgaagggcctttcacatatagatttgtcgggtcctagattttaaaacatgatcgacgaccgctgcttgatccatcttttttccatttcatatatgaactattttttaaataacctatacaatacttatgcacccaaaatatacaatatctacgggttatccattcagtgtgccaaaaggcacgcttattttctagtacttctctgaagcgagagctcatgaaagtggcatccacagaggagctaggatttagacacgagaaacgccttatatactacttcatccatattcgtagtgttgctgacttttttatttgaccatttgtcttattcgatttgttttataaatataaaaatatttgggcgcgactatgcatcggtcgtccaacggggagagggggaaagcgcccgatt

SEQ ID NO: 39036 - DNA, 16063 bp, Oryza sativa
aattgatttttctcttaaattacttatccaaatcatgatccgattgcacaattaaattcgttgcaattaaatcttcaaaacaagaccacacatggatatattccgacaaaatttttttaagcttattattgaattatttttaaatgttgcatgatgttccactaggtatattggaattgtttggctaagcagattaaaaatgttttactcgtttaaatcgggtgttgtttcaccttatataaaaacaatgtttcagcaaataacgaaagattgtttcagttcattgcaatatttgatccatatatagtgaaacattataagtacactaggtgaaacatttttcggtggaacaaaaaataaaacgaattcccttaatagggggtttcaaaaatatgtgggtttttttgttgcaatgaaatatttcagttcactgcaacattagatctatacatagtgaaacattgtgagtacaccaggtgaaacatttttggtggaataaaaaataaaccaaattcctttaatagagggtttccaaaatatgtggttgatttgttgcaggtggggacatgtattgtggtggggcccagcaatatcaccgcgcgcggggggagcgcccgatttttgctcccgccacccggccgctcgaagacaagtattttcgaaaatatttatgtcatgcttaaccatctgaccatttgaacatatgccttagactttgttcgatacatggggttggaaacccatcacctccatacggaaaacggagcagtccattagcgcgtgattaattaagtattagctattttttttcaaaaatgatcaatatgattttttaagtaactttcgtatagaaactttttttaaaaaacacaccgtttaatagtttgaaaaacgtgcgtgcggaatacgagaaagaggggttgggaacccccttcatcctaacgcagcctaaagaatattttatgataaatctagtcacaataaaataatggaaaatgatgccatccgggcgaccggcgtgggggtgccggatggggcgctcccccgcgcggccctctccccaagcgcctacatgcatgccgctgggctccaccacagtgcctgccccacctgcaattgcaacaaatcaaccacatattttggaaaccctctattaagggaatttggtttatttttctgttccaccaaaaatgtttcacctaatgtactcacaatgtttcattgtgtatagatctaatgttgcagtgaactgaaatattccattgcaacaaaaaaaatccacatattttggaaaccccctgttaagggaattcgttttattttttgttccaccgaaatatgtttcacctagtgtacttataatgtttcactatgtatggatcaaatgttgcagtgaactgaaacattctttcgctatttgctgaaacattgtttttatataaggtgaaacaacacccgatttaaacgagtgaaacattttcgatctacttagggaaacaattccgatatacctggtgaaacatcgtgcaacatttaaaaataattcttaaaaaatttttccgtcggaatatatccatgtgtggtcttgttttgaagatttaattgcaatgaatttaatggtgcaatcggatcatgatttggataagtaatttaagagaaaaatcagtttaaagtagttttgcacgtaaatcgggcgctgacgtcctcgcccgatttagcgcgtcctaaaataattaataattacattatttttttaataaaacaaatggtcaaacgtcgataaaaaaaagttaacggcgtcgtgcattaatataggaagaaaatattatcatcctagatgattattatgtgaaaacatagaagggttggccaccaggccactgaacatggccccttgtctcagctactgggttgccagcttgttgttcttcgtcgtctaggattacgcacttgtcatcgcagctgaagtaggaaaggagcagccagatcacagcaactgctaggatgaagccacacatgagccgcacacctgatcgttcatcggcgatgctgtcccctttgatagggtgcaccatgaagtagatcgtcacactcgatgccatcgcgatcgcggcgaagcagctgacctgcacgcaataatcaatcatatattataacaagttaatatatgcatatttaagaggatgactataggaaacgctatatcattactttcgaggcagatttagtaccaagggtataagataccatacccatacccatatgagtgacgcaatcatgccatcaacaatggtccaaggcccaacacttaaccctatttcgaagcctaactactaatttgaccctatttttttatttgctaatttaacctcatttttcaaaattgaatatgccatctgaccatatttgcactgcaccattaggatttcacaaaaagataataccaaaaaatcacatttcacttcaaccctatctctctcatctcccgacctcccttctcatcttctctggcccaaccctctctcttgcccgtatctcctatggcacgaccagctgccgtggtgcggggagggaggaggaagcggcgacgtgcgaagggaggcagcggtggcggtgctggcttgcaaagggaaggcgcggcggtggttcctgcgcacggaggtccggcttgcaaagggaaggccggcgcggcggtggagctgcgcgcggaggtaggcgacaacgacagcatcggcatgcggactgaagcggcggcggcgtgtgaagggagggcacagcggtggcgccaatgcacgaagggaggagcggcgatggggccggcgcaaggagggaggtggggcggtcagcgcacgaagggaggagggaagcacgggcagtggtgtgccgacatgtggagggagggggtggcggcgcgtcagcactcggagggagtactatatttttctataaactagatcacaattaaaaaaaaataaaaagtccaaattaccccctcgactaatgtggcagtacgaattaccgcttcattttaaagaccacacattctttaccctcagactacggagcggttttggtccatacgtgacgtacacgtaacagtccagtcaacataaaaaatataataaaaatggtggggcacatgcctcttctcttgatcaccacatctgggctctacatttttttatattctttatgcttactagactaccacgtgttcgccacgtagggctaaaaccactccggtggagagtaagctagtgtttgggtgggagggactaaactcaaaaaacataagtccctcccatcccaaacaccgggtgggagggactaaacccacaaaaatataaaagtcccttccattccaaacaccacctaacttatcaagtacaacaagttgagggtcgtttttgaattgagagggataatttataccgctattatagttcagtggggtaatttggattaatttcttaaaagaaaatgagtgaaaaagaagaccgaaacgaagatagtagtatatataccttaaaaataaaaagaatgccacgggccgctctgaccgcctcactaggaggcggaggacgtcgtcgaaacgccgtcgccggcggcaagatgcgaggaggtactgcaatggcgtttggcggcggcggcgcgagatcgtcgacgacgtggatgatgatctccggtgggttgtggacggactcggcgttggaattcatagccggcggccgaacacgtacgtaacgtcgacctagcaagatcgcgcaactccacaagacacaggtgccagagaaaagttaattaagggcgatggatgtatagtatagattgatactacatcaccacgcgatattatatatacatatatagtctacgttacgtatggtgaactaatcctagtaggattattggactcgatacggaggcgtgttaggagcactgatcagtgccccatctccgacttggagttggaggcgctcaaggcagcggcggcatgtggctctgccgccggcttgagggcggtggcaaccatggccgcgcgacgagaggaatttacggtcgttgagaaagtatctagaggaatatggtcgttgagaaagtatcttgcggtacttaaattttacattaaaatttttgatatcttgaggtatctaataatatctaaagacatcaaattttacactagaaaatatggaaccttaatatactttcttattttgaagcccctaaaagtagattgaggctatccccattttctaacactactacaaaacatcaaataggtgtcaccactataggtgccggtaaccttttctcacctccgcggattgaaatcgtaaaaaaccgatatctttaaataattataggtatcagttctaaataaaaaccgacacatattatattttgtgttagtttttttaataaaaccgacacccataatatattaaaggtgccgttttttttaaaactgacaccctaccaaacgagccgagccgagggacagccatatccactagccgagtgagggagcaaccttatcctctcacccgtgaggccgtgacctctctctttctctcacgctctccattctctctcggcctctctctctctgcgctttcgagggaggcgccaggcggtgcctgcggcggcgggaggagaggcggcagcggcgggtggcgacgggaagagagacggcagcgacggaaggagtgcagcaacggcgggcggcgccctcccctccgccaggtctagcggcagaggaggttgcgtcggcggcccggcggtggaagtggatgcggcggcggcgggtcggtggcgggaggggaggcggcggtggtccgacggcccggtggcggcgccctcccctccaccagatctagcgggagggatggtggtggcggcggctcggtgttggctcagcggcggatggtggcaacagcggcttcctcggcagcggcagcatagtggcggcgccctcctcctctccatccagcaatggcggtggtgatgaaggcagcctcctcctcgatccgattcattattgatgaatgtgtgttcttgatgaatgtgtgactgtgttcatgaatgtgctcttgatgttgatgtgttgttcttgatgaaattttgggatttgggtgttagattggatcggcttgatggctcaatgcatgcattgagccgattttttttttggctcatgggcgcctcaaaggccaaaactggcacctttgaccttgggaaaaccggcaccgaagggggtttcccagccggcaccctttagagtttctgtagtagtgtaaggaccaagaaatgcctccaactccagcagcaacccctatttcttagtccatactcttggttatcttgtattttaaaatacaatccatatttacactacgtttaacaccacaataattcaaacataaatatttctaacgcatataatttaaccatacttaaattcacaatttcaaacaccacaattcaaattcaaaattaaaattttcaaacatgtaaatatggtgtgggcacagtgccatatacaacaacaacatgcacccaagattcataattcaccaatgaaaatgaaaattgctcatcaaaaatagactttgtgaatccaatgatcaattatataaattaaaaataacacatcctacaaccatgaatggttccattataaataacaaatctgaaagtaatataaattattgcggaaatatttaacaaaaaagggctccaaaggccaatcgtggtaatgacatatcctactagtaaaggacacatggatcatccaatagaaaccaatttattccatcgaagtgctcaaactctctccattaccgccaccaaactcacctccaaagccactactcccatcaaatccatcattgagggcagccacatttgaagctacaatatgtgccctcatagccaaggtggaaacatcaaaaaacatgatcttatgttgttgatcccacactaacttacgttcagcaaataggagcttgcgctcttgaatctccttagttttcttccatctctcttctttcaattttgcttctttctctttggcgtcaagcaaatctttcattgcctccctgtatggtccatcttctcctccattcttcaacttctcctttgcttgcttcctacatattggtctctttttagcactcgcctgtgataaatcaagatttgtactcttgctagcatcatctccttcttcattttcttcatcaactctctcaattggtgtcgaagacttcctagaccttggcttcttgtgggattctagtgtttgaaactttggagaattcctcaacttgaaccaacaatgattaaattgaaatgccctgttctttggtgcattgaaagagtacaatgcctcagcttcaagaacctacaacaaattcaagtgttagttctcatacatacaacatcgttattaacaataacgaataacaatttaacatacaagctcttgatgttatatgccacttggatgtcgatgctcaatttgattgtagcagccctaaaacttgcttacttccttctgaatgttaccccaacggtgctcaagagagtttgcattcctatcagactctgtcgaggagtgatcctctctagcgggaggttgtgatgtcacaccctgaagttctcctcccaatcctaaaatttaatttataaatgaccctaagaaaataccggtgcaaatcaagagaaaaccctaagaaagtaatacaaataataatcgaatctggcatgtggaatttttcttgagttctacatgtcgaaattcactaacaagatttttagtggaattttcagagccctagaaataattttaaccaattaaaattgagcaagcaatattttaattccagggaaaatccttttcttcctttttctttttctttttccccctttttcttttcgagtgggccgccggcccattctccttcctcctctcccctccgctgggccggccgtaggccgaggcccagccaggccaccccgtctccctcctcccacccgggacaccgacaggtgggccccacctgtcgggcccgtctcctacctcgcgcccgtgccgccgcgcccacaaccgctgccgcgcccacgcctccgcctcctccgggccacgtcggtcacgcccgcgcatgcgccgtacctcccgcgcccactcccctctctctcccgcccgcgcccgcgcccgagatggccaggattcgattttcgaatcccgcctctctctctctcctctcccactcccccacgttggccggcggaatctcgcccctaccggccacgtccgggactcccctcccctatttaagctcagccgtcgccccctctctctttttccccatttcgccgaactccctcgtgctccccatcgctcccgcgccgtgcacccacccgccgccgcctttcccgccgctccggccgccgctagccgcccctaggctcgccgccgcaccgcgccgacgccgccgtcaggtttgcaaggacgaactccaccccgtccgcccttcctccgtcgggattcgtcgccggaattcgcatcccctcgcgctccgatgagttctacctctacaaacgccttcggccatggatgccggccgccgtggttcatctccctctctctaatctctctctcctccttccttagggcaccccgaagcccgtccgccggttgccgtcgtccccccgtggcttgccgtcgccgtttgccgtcgtcttcctccgcgccggccaccctcggtgaggcgtcctctcccctctactcccctccctctccttcctagccgccgcttagcaccgccgccttcacgtcgcctttgtgccgccgcctccgccgccggttgctgtcgccggcaacgcgtgcgcgcgcgccgtcgccatcgccgtggccggtcggccggccttgagccgagccgagccgggtcaccgccgcccgtccgatcaaccccggggacgatctgggccgtcggtcccgtggaccggcggtggaccacctgcgtggtcccagtccacggtggaccgcccccccttgagccgcagacgagtggggcccgcgtgccggcaccccttttccctctcccccgagccgctgaccggtggggccagcatgtcggcgccgcgcccccccccccccttgatgacgtcagccctgggaattattgcgcaataaattatttaaggactttttgttatagtaataaacacagtgaatcttctaaaattcataactaattcatccgagctccgtttaagcccattcaagtctcagtaaatcaagaaaaatgcgtagaatccattaaaaatggttttgttctctgtttgagtagtcttatagcctgtttgtattgtttgctttgtatgtcgcctagattccggttcttccgacgctccggtgtacttcgagatagtcgccaaggttcctccagcagcagagcaaggcaagtcatgcctgtcacttgaacatgttgatcctatattgcaaatgctctattgtttttcttcaaatactgcatcgttttataatattactatggggtgtttacctattgttacagccatgccatttttgataccatgctcctttgttagcttgggttataacatgaatagacgttggactaggagttgtttagccatgcttagttcaactagcacacaatggggaaatcccatttaaaatatagactgtaggttcatatgataatgttggtttagtaccaccgctttgatgttggttaattaaaatgaatcacggtgggctgtgggtgcatggttttgttggtcgcacccatggcagttaaggaccagttcgcgggatgccctggaagaacttatcgtacttaccacaagccagcgtgggcaacggctgggcttgcagtgtagcttttctctagccgacgcatccaggcaagggtgggcgtgatggagtttggatgggccctacgacggcctatgtggcttccggattcacctaggcacgagaggggactgcccgctgccttgcgaggagtggggtgaaacctgaggtgtggtgtgcttggttagagggggttatgcgaagggtcctgtcacggcttcttttcggtatgtcgtggtggcatgtcggcgcacggaaacgtgtcgtgaggctgtgtcttgtgggtacagttgtacacctctgatcagagtaaaactattcgaatagccatgcccgcggttatgggcggtcaaccagattcaccgtgattagtttcaccctagtttagtctaatgaaattggatagtataggtggatggttgggcctattgcaacgtgggatagcgttggacagcggatgatcaatattaattaattattgcaactgtttaattctttcaacttctgtttataaatgctcactttatgcaaatgaaccactctagctctcctttgataattccctgcatcatacccctattctggtatgacttgctgagtacagtgggtagtactcagtcttgctctattttccccaaccccagagtacgagtatgtgtccgatggcgggttctccgaggagtaggcttcgtccgtgccgtcgagggtgcctgtggagtggtgttcccactgcagttcaagtccaggcttagccccagttatcttttgtttttccgctgcatttatgtaagacttttatgatgtttgtaagacgtggatctgaatgtcaacattgtcgtttgtgtaccccggccggtcctggacggggattttaatgcacattctgcttggaattctattcgggaatttctgggcgtgacaagttggtatcaaagccgaccttgaccgtaggacaagccaaatggaaaaacctaagagccctctgaatccttttcattgcatatgttctttgcaattggatttgttccgggaaaattgggatctgttcttgtggttcaagggaaaaatcttggtcgctcgtttaagtgagatttgtcaaaacaagtcagtctagggttttagtaaaattattgagatttattcgtcagtcagttgggatttgatgggtgaaatgcattaggtcctagctcaggaatatgggttgcaaggtacttatgctcttattgttattattagtatgtatctaatttccccattattttatcgttatgtaagtctgtcttatttattcgctctcatgcaaaatgatctatgcataaaatttcgctcttattcgattctcttatttgagtcctttattgctttatttaaaattggttttgagcatgcattgatcctactcctttgtcttctctagatggccggccacccacccaaccaccgcggagaaggtatgattgactttgtggcagagttagcacgtatgacgctggtggtgggctaccccaacgcgccagagtacacgacggttccaccgctcagtggcgagcttcctcaccgtgtccgcctggaggtctatggctatgtgggcacctgcctcgctaatatggtggttgaggcgtccggaggcacagcagatcacgcctgtcaggaggcagcatacctgatgatggccagactacgggagcgccacaactacatcttccacgacacggcgtaccgatttcaccctcgtcgagccagcggtgatgatgtcagtactttccgtccgacagccggcgagaacttcaccacctttggtcacatgtgcgttgtgatgagggggatggacaggatgcactcggacctgcacaaggcgtccaaggccttgaatgatgggaagctcatgaggatcatcgctctgaaggacgagatagcgcgcctgaagagggagaatgctcagttaaagggtcttcccgcgccaggaggagtccggatccgcactacgccccgcaagtcgacaacggcacccgtgcgcatccagcttgcgcccaggaacccacctccatcagcagctccggcagcacctccagttccgcccgcagctccagcagttcctgcagctccagctctagctcctgttcccgtgtcagctcctgcatccgctctctccttcgcgcctgcatcagccgtcagggtcccctctagtggcaatggaggttggttaccagctactcccagtggcagtcgcgacctcagcagcagcagctccagtggctcagagccgggcagcggcgagacttatctgccaggctccaggagtcgctcagagggacctggtgacgagcaggaggacgccttcgactccaccgaccgcaggagccgttccgagcattaggctcattttccattagtttatcgactgtctagcatttgtttgttagtttgtgtgtttaggttgcttgcttgtgggtcagtcgacggtcgatatcatgtgcctatgatatgactgtcttaataaggattttttcttgctttttaagtgttttaattcagatcagaacaattgtagtttaaattcctatataataaagcttagttcttgagcatctgtttttcttcttttccccgtctgctcttcctccagatggtctacaccaggaatggtagccgtacaacaggcgagggcagcaacggcgaagagcgcactgatggtgtgcatcccaacagcgattccggcaatggtccgccaccacttcccgagaatccgacgctagcccaagtgatggcacatcagactcagatgatggcagccatgatgcagcagatgcagcagcagcaccagcagatgcaccagaggatgctgcaacacgccgaacagcagcaccagtagtttggtccccctccccctcagtccaagttgccagagtttctacgtgtcaggccacccactttctccagcaccaccaaccccatggaggcgaatgactggctccatgacatagagaagaaactgaatctcctgcagtgcaatgatcaggagaaggttgctttcgccacacaccagcttcaaggtcctgcgtcagcttggtgggacaatcacatggccacccgcccgccaggcactgaagtcacttgggcggagttctgtcgtagcttcaggaaggcgcaggtgccagacggggtcgtggcacaaaagaagagggaatttcgggcactccatcagggcaacaggactgtgacagagtatctccatgagttcaatcgcctcgcgcgatatgcaccagaggatgtccgcaccgacgccgagaagcagaaaaagttcatggcaggtctggatgacgagctgaccaaccaactgatatctggggactacgcggattttgaaaggctggtggacaaggcaatccgtcaggaggatcagcgaaacaaaatggataggaagagaaaggcggcacagttccggtccaaccaaggaaaccatcagcgaccgcgcttcgctcccgggcagcagggtggacctaccaccatgatcgtccgccagtaccgcccgttcaaccctagcaacttccaccagggcgccagtggcagtcagaaccaccatggaggtcagcccaaccgcggtgcagctccacgcctaccagtggcaccggcacagtcaggcccgtccgcgcaagccaagaaggagactggaacaaaaccagggtcctgcttcaactgtggcgagcttggccacttcgctgacaaatgcccaaagcccaggtgtgccgggccaaggtttgtccaggctcgtgtcagccacgcgtctgcagaggaggcgcaagcagcaccagaggtcgtactgggtacatttcctgttaactcaatccctgcaacagtactttttgattctggtgcaacgcattctttcatttcaaagaaatttgtggggatgcatgggttaaggaaagaagagcttaatacaccaatgagggttcataccccgggaaatagttcaacctcggtcagttttagcccttcagtgctaatagaaatccaaagatcaccatttctagccaacctcattcttcttgaatccaaagacctagatgtcattcttgggatggattggctgaccaagttcaagggagtcattaattgtgcgaatcgcatagtcaccttgaccaacgagaagggagaaaccgcagtgtacaaatcactagtctcaccaaagcaaggggtcgccttgaatcagatggaggcggaaatcccagtggtcaccgaggagaagaatccgaggaaattggaagagattcccatagtttgcgagtacccagaagtctttcccgaagacctcactaccatgccacccaagcgagagattgaattccgaattgatttggcaccgggaaccgcgccaatttacaagagaccgtacaggatggcggccaacgagctagcagaggtcaagaagcaagttgatgagcagctgcagaaagggtacattcgaccaagtacttcaccttggggtgctccggtcatttttgtggagaaaaaggataagacaaagaggatgtgcgttgattatcgcgcactcaatgaggtcacaatcaagaataaatatcctttaccgcggatcgatgatttgtttgatcaactgaagggagctaaggtgttctctaagatagacatgagatcaggctatcaccagttgagaattcgggaagaggatatttcaaagacggccttcaccactcggtacgggctatatgagtgcacggttatgtctttcggacttaccaacgcacccgcattcttcatgaatttaatgaacaaagtgttcatggaatttctggacaagtttgttgtggtattcatcgacgacatacttatctatccaaagtctgaagaagaacatgagcagcatctccatttggtactcgagaagttgaaggagcaccagttatacgccaagttcagcaagtgtgatttttggttgacggaagtcaaatttctgggccatgttattacagctcaagttcagcaagtgtgatttttggttgacggaagtcaaatttctgggccatgttatgtcgcaaccgagaaaaatacattttcccgaacgctagtgtattaatccccgtcccaggaaaagccggggtacaccacacaaacatgatataaaagacacatctttattatatcgataatatttacattattataaaggcacttaaggcctaacaatcaaaaataaacagcagcggactagcgggcctacggctccatcttcacaggcgctcaactggggtataagccaggactccacctaagacttcttctccaaagcttctcttactgaaggggggggtgaaagattgagcaagaatgagtacaaccacagtactcagcaagccacaccggcagatgcatgattaatgcaagggggtacaaggggtaataatataggggttaagttttgcagaaaacagcatttaaaagtcacttagttgcccaaagccattttataaagacgatcctagagttacacagtgttattaatcaaggccgtgaaccctcacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctaggcttgcccataaccgagggcgcggctattcgaataggttatactctgatcagaggtgtacatctttacccacaagacacatcttcctcacgtgtaaccacgtgccacataccaccacggtatacggacggaagacgtgacatagttcccaacccatcctagccataaacaagagtaccaacccaaccccacctacggccggaacctccgggacaggcaggcaggattgagcccctagcagcaggacaccagccctgtgccatgacatctcgactaccgggccacagctcgtgtagccttcatttgtcctagagatgtccatcgacccccgacttcgtccatcttcatccgtgtacttttgtttataaccagactgagccacaaactaagccttacccactagacatgtggaagtacggtagtgctttgcaacagaggcccgagcttaatccttatagtacccgaggtacgactaacaaaacccaaccacgcacctcgagcccagcctaaaaccattttgggggttttgaatagagggggagatgtgtgtccaattccaacataagccaaacattccatagtgtccaaatgatatgagaattcccaaagtctaaagttataaaaccacctaatgttgcctaattaatcagcgaagcatctacctaaattcatactagtggaaccatgaatagagtacccactagttggggtgttttttatcctagggtgaacaaggtaataataacaatagcaataataataaggtcataacaaaggtaaataggcatggctaaataaaacagtgataacgcaggaatttaaataaagcgataatgcattaatttaaatcaaaataattttataaactgggattcaatatgctcaaggatgatgtgacttgccttgctcagagagaacggccttccgaaccttcggcgacgaccgcgaaccacgcttcgggaacctctggaacgacagaagctacgcgaagcacacaagcaaagctacaagcctataaagaagcaataacaatacataaaaacaaagcacagggttctttaggttataacaaacattaggagacttgaacggatcgattcggagctcgtatgaccaagacatggtcatccgaagtttaatgctgttatatggagatttgcggattattataattaggttttgcaactataaaacatgtgtaagcgctagcctggaaaagacaggaaggctgcgctgttgacatgcggaccccacatgtcaacctaagggaccacggcagaccgggtacacagagacggtccacgggtcgatggaagcggatcccgtgtgtcaaccgaggcgagtggccgataaacggactccactagacaccgcgcgggctgcacacgtggaaaccacgtggctaccgagcgtgcacactaacacggtcaccacacgcacaagcgaacgactaccgacaccggtacacgggtaccggggtcga

SEQ ID NO: 39037 - DNA, 16778 bp, Oryza sativa
  unsure (1)..(16778): unsure at all n locations
cgatgaccggggccggcgaggaggcgacgagggacagctagcagcagctgcacggagacgaggacggcgtggaacacgccgctgcgaatccgacaacggaggcggcgcagcgagacgacgagccggcgaggaggaacgaccgaccggaggagtcgtcgacgaggacgaacggagacgacgataacgaacactggcggggttcggatggaggggaggcgaggccgagggcgaccttgccgctgcgatgccggaggtggagacggcgacgtcggccggcgcactggcacggcggacggggctgccggaggaactccggtgaggcggagggcgagaccgacgcgggcgacggcgttccggtgaaaccgagggcaggccggggtggaggtcgacgcggcgacgccgagggaggagacggcgcagccggcccgcacctgagcggcgcggcaggggcggctggaggcagtacagtggcggcaacgccactgttttgccggcgaggacacgtctccggtgatttccccgcgaaacggagggctgaccgggggagagaaggcggctgcgaggccgagggcggcgacggcgcgaccggacggcgctcgggcgaggagggagaggcggctggaggccggctggcgccggagagagagaaggagaaggcggggagaggtgatacgaccacggggaggctcgggaaggggctaaaacgatagaacgaaggatggggattccattttataggcgtggggagggatccggccacgggaggagccgggaacggcggcggaaaagccggccggcggccatggaaggtggccggagttggcgcgtccgttcccggcgattgggggcgccattcaagggggaattaagggggaaagagagaggagggaaaggggattaattccccctaataaattttggaattcccggtttgaatcacgtggattttggggaggtttggcgctaggtttccggggagagagagagcaggccgtgcgggaggaggaagacgaccgcacgtgctgcgcgcgtgcgaggagcggctcggcgtgggccaggtggctgggtggcgcggcttgggccgggcgggaaggagggaggggaggggcggcccagaaggaggaggagaggagggagtgggccgggaggggaagaggaggcccaagagaaggagagggagagaaagagagggaggagagagggacttcggccgcgggccgagagggagaggggagaaaccttgggccagacttggcccaaagggaaggagagggttatttttaggtttttctttttaataaactctgataattgttgttgttgtttaataaatatttttggtgctctgaaaattcaagtaaaatttgagggctccttttagaccaaggataatttaacaaaaattctccggaccacattcaaatttttctggcacgtattttagtgtttgtcaatttcttttcgaattttaattaattctattattccttttagaaaatgatttttattttgggatgaatttatcaggacgtgacatgttattacagctcagggtgtggcagttgatccatcgaacgtggagtcagttaccaaatggaccccaccgaagaccgtgtcacagattcgaagttttcttggacttgtaggttattaccgccgattcatcgaaaacttctccaggatcgcccgacccatgactcaattgcttaagaaagatgagaagtttaaatggacagctgagtgcgacaagagttttgaggagctcaaaaagaaattagtatccgcaccagttttgattctgcccgaccagatgaaagacttccaagtctattgcgatgcatcccgccacggacttggatgtgtcctaatgcaagagggcagagtggttgcgtatgcctcgcgacagttgcgtccacacgaagggaattatccaactcatgacctggaattggcagcagtggttcatgctttgaagatccggaggcactatctgattggcaaccgctgcgaagtatatatggaccataagagtctgaaatacatcttcacccaaccggacctaaatctccgacaacgaagatggttggaattaatcaaagactatgatatgagcattcactaccacccggagaaagccaatgtggtagcagacgcattaagcaggaagagttactgcactgccctaggcatcgagggcatgtgtgaggaattgcggcaggagcttgagcgtctcaacgtgggaattgttgaacacggattcgtagccgctctggaagcacggcctacgctcgcggatcaagtcagagcggctcaagtaaatgatcctgaaatagcagagctgaaaaagaatatgagagtcagaaaagcccgggattttcatgaagatgaacacggcacaatttggttgggagaaagattgtgtgtacctgacgacaaggaactgaaagatctgatactcaccgaggctcatcagactcagtactccattcatccaggcagcaccaaaatgtatcaagacctcaaagaaaagttttggtgggtcagcatgaggagagaaatagctgaattcgtcgcactctgcgatgtttgccaacgagtgaaggcagagcaccaaagaccagtaggtttactccaacctcttcaaatcccggaatggaaatgggaggagattggaatggactttataacaggactgccccggacatcatcgggtcacgattcaatctctgtcgtgaatgttaccccaacggtgctcaagagagtttgcattcctatcagactctgtcgaggagtgatcctctctagcgggaggttgtgagacccccctttgtgagttcggccgggggataaggcgcgatgatcaagagtgtatctccgccagggatctggctaacgagattgctcacaagcgagtgagagacaagggattatacaggttcgggccgctaggaagcgtaataccctactcctgtgtgtggaattaagcttgtgctgttataagggagttctaaccctaggctcaagcttctcaagtggcgtccctcctttcggtgggcaaggtcctccttttatagttcaaggggataccacatgcaccgtcttacacagttcatcattggatgggggcccacatgtcctgggtcgagctgtcgtccatgccttcgtctggaagcaaggcggtcgtttgcccccaggtggatcccaacgccgtcctccggctgacacgggggacatccctgtcattccctcttaattccatggagacttttgtggactcatgtacggggaggcacgctcggctacatgccgatgggacggggcatacccgcccccactccgcctgacagagggcagaacgtgggtgcgctaccacccgtcccatacgcctgtgaccggtcacagaccggtcaagctcgattgacgcacgtcaatcgagcggcgcctcacgtccgcccacgccacattaactttggcgggggacaattggggcgctactcatttaaggcgcttggcagcgcctctccctccgcccactcgaccgccacgtggcagccgagcgagcgcctcggggcagcgtgctccaagggcctgaggggtgcgacagggcaccccgaggtcccttggccgcttcatgaccgctcgttctcccccgaggtggggaggggggagggacaggccgcgcggccacgtggccagacgggaagatcctttccctctatcttgcgtacccccgggcccatattaccgacagactcataatcacggttagcatggcagtgctctgtgatcctcttcaaatatgccttccctggttgctcattgccaataataggatctgagctaatgctctgccatgaaatgcacaattgaatgtcctccttacaagtatagttgcttgattttttagtacttccttttgcaccatttgttgaagtacgaaggtctacatttggcattggcacttcgacatcagtgtcctcgaacatcatgtgcacaaagggatcacctctacttgtcattgcaatctagtcactgcaataaatatataaattgacaacctttccaatcgatctcagaaacatcaacaaatgattgtaatgtacattaggttatactgtttataacatgtatttgtttagcatatatattggttctacattactaaggactcagtacaaacacaaatttctctcttcaatattatatatgctctgcaagattagctctctgacatagaaaatgcaataaaaaaaagctataagacaccgcatataaaacatgaatgatagacaatgttttgccgtgcgaatgattttgatgggcctaggcacctagtaagtcttagattcagtttcaatcaaaatttcaatagctacaagacactgcatataaaacacaaaacatgtgcatacttttgtaaacacaaattctttgttcaaagtttgcactctttctattaaccaaaatttaagtccatacttgatttgcatattgctcaaacaaatatgaaaacaaggtacatcgatttgcactattgaattcctattaactatgctatagcttatattcagaatttagatggattgcaagaaacagtgatattgtccttaaagttgtaaaaatcattcagatttccaagttcagataacgcaaactgagcaggctatattatgttaatcacaatcaataaatgaactgtacttcatttgataattaccagtaataatttccaagtacagtgatgaagaacaaaatgataattaccagtgataatttccgcgactgagccctcaggactagggactcgagaagatgatttgggtgccttcctatgttggccctttagtagggcatctcagtttttcgcctcaactctcaaaaatcatttgatgctcttaaggatgtaaaaattacccgcgcgacgaataaatgcagcacgcgttggtgcaaacgtggatctcgagaatccggacatacccgaggtatttatgaatccaggaatctgctattccagtgttaagtcttgcatccctgatgtattcgaagtccatgaatacgcatttgtagtgtctaaatcgatcttgtgcatgaatataagtttctcattcatttaattttttttactgacctcacctccaaacatatttaattttggtcaattacagcaagtatttaaacgtaagccccaatagtactatgtagaattaatttgttaagataatgttaacttttgaaaacactaaatgtagtcgattggatgccaaatgaataaaacaaatagttatactcccttcggttttaatagatgataccattgatttttaatacatgtttgagcatttaccttgtcaaaaaatttgtgtaagtatgaaaaacatgaaacttctgattaaagtacatttaatggtaaaccaaaccacaataaaataaatggtagattttcttttgaatgagactaatggtcaaacatatttcaaaatgttaatggcaccatctattaaaaactgaagagagtattatattggggctagtgtattatggaaaatgtattagtgtagttatatttttatttatgaatagatggtgtagataaaattagaggtagcaactatctctactagtattaaatatgcttttgtgattctgccatgggcatgaaagtagataaaaaaaaccttttagggtgctttttttagataatagaatgaagcattccggcctttactcaagaggtagcttatctaaagtggatctggaagagtagctgtactatgaaagtaaaagtttttggctagcttctgctcattgatagattgaatactcgtgatatgcttgacagaaaattttgtaccccggaaggaagtgatttaacatgtgttttatgctcgacaggggaaagagagactcttcatcatcttttcttttcctgttcattcagtactgaatgttgggctcaatttggcattgtttggaatctctccctgtcttttgaaaatatgttgacacatgctaagaattcctatcaatcctcacacttcctggagaaggttctttatgtagcatggaatatttggaagcaacgcaatagtttcatttttttataatgttcaaccctctgtagcttcctggatgacattcttcaagaatgatctatcccttcttgtttatcatttaagattagatgagatatcagctttctgttcctggataaatcacttgtattttctgtatatattttccttaataaaattatttaactgtgggggcttcccctacagtgctttcctaaaaaaggcttgttgagatcgttgcataaatctatcatatcgatatttgttaatgctaaattttggtgctacaaagttctaacagggttggatgtatttggtttgaaaccttaacaaatgttggtagtgtttttaagagctttacccggatggacacacgacggatggcgccgggtcggtgtgggagtagctggtggagtatcctgtgatcagcgccgtgattgtacaatatatgcatattgtaccggaccgggtcctatacatactacttcctttcctttcatagttgagttatttttaaacagagaatacgtacacatgctagaattgaataatccactcgaaatcctttgacccccgaaagaaataccaataattattacttaaaagtaaacttgttttagaataacaagataaaaaatgattatccttgcaaaaagaaatagttacatatctcaggtcatctacaatagtcatattcgtcgctgaaacgacaattaattaattaactaatagtaggaataagcaagggatcaaggtcatgttccttttcatcgatgcataagcacttgtctccgtacctgaagtggataatcatttttggtaaaatttgctacaggacatccaaaaaagtgtaattagcttgaggatatcgtaaaaacgtgtatttgctttagggcatcgaaaaaattagtaattggctgctggacacccacgacattattttattatttttttaaggattaggaaagagaaacaatgattaaagacaagattgcccctttggctcaaatgactctgggccccacatgtaaccctctctctctccttctttctagacgggccaggtggcagagcagcgatccgcggccgcggcgctggccgcgttcgccgggtggggggttggggtgggtacgtgcagcctctttcccctccgacattggcggcggcggcgacaacgacgacgacggcgacgggagcgggtaggtgtagtagaggaccatggccgagttccggcagcgcggccaggtcccggaggatatggacaagtccatcggcaccgtcctctcctacatccacttcgccatccccgatgtgccggtctccggcccgcctctccgcgctcttgcccgacgacggcgtcgaccgcctcagcctcctccccgacgtgctctccgccggatcgtctcctgcctccccgtcaaggacgccgcacgcactgccgcgctctccacccgctggcgcaaggtttggcgctccacctcgctcgtccttgtcgacgccgaacaccttcccgtcggcatgtccgactccgatacctgcgccgcgcgcgaggatgcccacgccgtcacctcacctccagcttcatggaccagtaccagggcctgctcgtgagctcgttccaggtcctcgccgtcaagggcatccaggagctcatcctcgtcaatcgcccgttcccacccgttcctggctccaggtccacgtcccagctccgctctggccgccgcgtccggtacagcttcgtcccgcctctcgaaccggcacttctcgacggcgcgctcgactactccatggacggcgctcggggacgaagagaagaaagaagaaagagcaaagagagaagagagaaagaatgagggaagcataaggaagaataaagaaaaagaaaaaaaattcgaagggtagaatagtagtttctctctccaattccatcagatataataaaataatcctgcgggtgtcccgtacttaattagcagttttttggtgccctataacatacacgcgtttttacggtgtcccctaactaattacatgtttttttttatatcttgtagcaaattttaccttataataaacacacatgtcatccgcacgcctgacctttcatcagcaatactttcctcaggagaagggtgcaccgtgagatagatcgctatgctcaaattgattaccatcatggtgaacatgcagacctgcacacagtacatatatataatcaatcacaatattgaacgtagtctcagtcgatgcatatttatatagagaggtagactacctctgttttctgttgatttttaaaataatctttaaccatgcatattattaaaaaatattaatatgttaaatataagtcctacttaaattctttttaatgataaaacatgtcacaataaaataaataacatttatgtatattttaaaaggatgaatggtcaaatattatgtaaaaattcaactacgtcttctactaaaaattgagagtattaatttgattatgaagtaaattacacttgtggtttataaacttgtgagttgagtgtaatttaatacataaagttttaaatcgcttatttcggtgtataaacttatctagtgtgtgcaaatcaaagccaaaaaaacatgtcgtaactaattttactaagttgaacattgactaagatgttatgttagctgacatgtcaagatgatattatctaaatatgcatatgtttaattaaacataaaataagtaatgtcaattatacatatttttaatacatataaagggagtatgcaatggataaaaaataatataagaacaaaataactatgcatggaatgtataaaggttaattatttgcacataatatatatatatatatatatatatatatatatatatatatgtacatatatatatatgtatgtatatatatatatatatgtatatgatgcctcttgtgtgtgcgtgacattttataacgagactaactcaacatcatttggattagtttgcactccctacacaaatttatgtaacgagtattttacaaatttgtatactaatttgcactcacctaaaaagtttatatatcactaatgtaatttactcttgatcattgtataatcatagagaaaaaaaagtgtctgcgttcataaagagttcatggtatatagggaaaaaaatgatggcatgtgtatatacctgaaatacgaaaaggagggtgcgattattggtggcctcgtcccttggaggaggccgaggtcgtcgtcgttggactgctgccccgtgaaacgccggcggcgggagcggcaggatgcgaggagggacgagggccggctgcgctcgcggcggcggcggcggcggcggagcgaggtcgtcgacgacgtggatgatgaactcaggcgggtggtcgtcggaatccatggccaccaccgtgccagagcaaaaaggacgtaagatgaatagatagattataccagcacacgattaaaaagggataattataatctagtatacgtacgtgaatcctaataggatcagtagaaagagaaattcggaaaaaaaaatatcgaaagcgattcggaatccctttcgattaatactacagtaatgaacccactagcaaaaatattggtgaattaaaattaaccgcaaaagaaattagctatacgccaagctatttcctggaaataaatgaagagatccatattgcttcgcggttgggagggccaaaaatgacatgttaccttgatggtgtagatcatattaagttggtggttttatgatttcttagagctatgaaaagctaataacgaccgtaattttcttatcggacggactgctaaaaaaattcggtgttaaccgtcaatgaaaaggaatttccctcccgcgcacgcagaaaacagagcgacacattttcttatgattaattaagtatttaatttatttaaaaatggattaatatgatttttaaaagtaacttttgtatagaatttttttaaaaaaacacaccgtttaaccgtttgaaaaacgtgcgcgcgaaaaacgagaaatgtgagttggaaaagcatggagaaaaacacactcgtatagtagctggtggcgtctcctgtgattaataggcatatgtacattacagatatgcacgttcgtttgctcacgaccacgatagttacgtgccgtggtgacgtagtattgtaccggggcgggtcctatacatactactctttcctttaattgagttattttataacaaagagaatacatgcacatattagaattgaataatccactcaaaatcctttggcgccggaaccccggagcagtggcggatctaggaagggatagcaggggttctaaataaactagacaaagccacatacgatctttccatctacatgtagcaaaaaattttagcaagagttttgtgggggctcccatagtattcatgccagtagtgaggcctcgagaccccgctgcccctatgctagattcgcctctgctcggaaaaaaatgccagattgcttaaaaataaacttgttttgaataagaagataattgcacaaagaaatagtgacatatatctttaggtcatttacgatagtcatcttctaaaacaacaattaattaagagatttgctccggtccaataaaaatacctcgaggtaccggtacctcacggtattaaatcatttcttatcgttagatctaacaatacgcattctgtccaactagattcaacgatcggaaatgatttgacaccatgaggtatcggtaccccgaagtatttttattagaccagagcaaatctcttacagcataataataagcaaattattaagaggcaaagggtgctgatgagcttgtgtatgggcttcagggcccatcagcgactgccgtgccacctatcttgtgtgtttgatcgtagtaatatcgtacgtgaaaatcgtacgtgaagcattttcctttccgattatcagacggtgatcataaacgagcttaattatgagggcaagactaattaagtttttaatgttggacggttgcaaaatagatttttagaaacaaaattttctttaaaaagttttccaaaaaatcgctctgttcagttgagaaacgtgtccgtgataattcagaggagtggctaatccaactttcacttaagaacagtaccaaaagaatatccaagtttcagtggattccacatggatgcttggagtcactggatgacacaagaatcattcctttgaactttggcatatcatgatttgttttttgggagggttggcatatcatgattgatctgatggaccaacaaaaccaggattacagttaatcttccaggaacactgtactgtagtaagtagcaaccccttaattactcccttctcttgatcttgggtgattggtctcctctcaaatggccgagacagaaccaacataattttaccttcttcaaaatttgctcgagctacagcaattttactaggatttgtctgatcatatgaaggccaaagcctctgctcgccactgctcctctgtttatataaatatttcttttgcatgcatgacgcctacaagctacgcaaatcattttagtggctctcaatgcatcttctcgggcagttctttgccttgtttttttcctctgcgtttaatatattttttttgtcttctactcaactttaagttgttaataactagtttttcatatatgtgtccctatcaaagaaagcaatggctaggccctatcttaaaaaaaaaaacaatggttggttggattgtgctccggggtccctggaatatgcccaagaaaacagctgggtatcaaaagcagctggtctgattgctactataatattgatttattgaagctcaagtctgtgaaaaaaataatttattcaggagaattagtactttttcgtgaaaacggcctccagaaaattgaccattttaatttgcctcctgccggagtaaccaaaatgggaacttatcatgtacacaagtttcgggtacactcatcgtctacatcacctaacaagtatcgttgaaaaatctagaaaaactatatatatgatttcagtagtatttcacctatgtgtaaaaacgtcattttcgaagtcatcattcatagagaaaaatacaaaattctgagatttatacacataaaactgccggatattttttttatttttttgttaaagctaaaaaaaatatattattttaaaaagataggtgtaacactatactgaaagttgaaagtacatacacaattgttttagagtattcggtggcattattagcaagtactatttaattaccgataaatattccatagctcgaggaaatatataatacaaacctagaactaccatatgataaaaatagataattgagattcatccacgtcacctcaagtaaaattttactcggagtaatgttgacgagtttcaaatgtctattttcatttttcaatcaaacggtagttttttatttttcgatcatacggtagtttttaagttcgcactagatagataagtccccttttaaaacgcaagattattaaaaaaaaacgtcacggcgcttgctcttgaggcactcacatgtaaggccggtcacgtatgcatgcccatcttccatgttgactcttacatttaatccacgtcagcagacggatataagcacagtagaaggcaaattaattaacatttagtttggccataggttaatgaacattgtgcaaatggcaggcctgtctctttctcttaatcttgtggcgttcgtcgacgcatggtatagctagctactccctccgttttaccatgtaagttattttagcattttctatattcattaacattaatataaatatcggaaatgttagaatgatttacattgtaaaacggaggaagtaatagcgaacgtacaccaatcaaagacatttaaactaatttggatcatcactattttttaaagaatgctagttaatttaatttggagaattggagatgtcattgcgccaaaattaaaatatactatatatatatatatatatatatatgccgtatacatatattcaacgttcataactaagcccggtctttcttgtggtataatccaagcaaagtcgtcgtccctgcatgcgcatggacgcacaaacgtacgtatacgtgtttgaccgcttgattgatactacagttgtattgtgcacgagagttctcgcagactttttatgaacatgactttttctgtaattaattaatgttgtatgtactctcaggcacagtcaaactttacaagctattaaacacatgattttttttatatgctccctccgttctataaaaaactaacttctaactttaaatttagaagtaacctatgttcaggcggataattagaagttgattttttttctgggatagaggggtacatttttagaatcgagataggttaaatttagcaaaatctcaaacgggtttgaatagctagagatctagtagtgaaaaagctgaatacctctgaactattgcaaacggattcagaaatcagacattcgacgtcctccaatttaattttcatgccgcatccccctccaatttttccaattacctctaaagttgcatcctttaaaaaccatgacaacgtccacatcaacatcatccgtcttagaaataaataatttatagagatttgaatctggacatttctgggacggagagggagtatctgtgatgtctcgcagctacatttctagtctcgtgtacttacatcgttattactttgaagtaattggcatgcaatgacaagctagaaagctactctgatccatgcataagatgcgattagactccatatatacagtctggccatgtgcactaattaactaacttgatttggatcgacgaccctgaaatggagctctctactgacccaggaaatccattaaccaagacctgaaaaactgaaaccaaagctaaaccacacacacatatgcatatgcacccagctcttggttgtgttaattagtaattacgatatgattggtctatgtacctatactaaactattggaggtcgctgtaattaacacgtgtttagctaaaaataacccttggcatcttcctctgtttcttgttggattctgtcatggtctcatggccagtctggccattcaggatgcagattcagatttaggatgactttgatcagttcaagagagatagataaaatgatttaggacaactcaaatgacaaaggagaaacttatccgatcctcaaatgtccttccatatgcaacctggactattcgagggatgtcatagctagaagataatcaaattaaatcagaatcagcacacttagtttcttgtgaggttacctggaacacacatggtctttccagacttaatttgttatcaaattaatctttactagcatatagtagtcaccaaaataaaactttaacgactaataattttcattgctacacataccataaaatatagtcaatcctatattcctagtagtaaataaataaaacattgtaatatcaagtactatgtccatccgaaaaagatcacttctataaacaaccatttgtctagattcatgtaaaaaaaaaattagagagagaggtactagtagttttcgtgtaaaaaatatagtaaatttcacaaaactacaagtattttacataatttatcataaaactgtagatttagtgtctccgtttatcacaaaattataggtactttgtacaatctatcataaaactatagatttaataacttatttcataaaactatatatttagtgtattcgtttatcagaactacatatttagtgtcttcatttatcacaaaactataggtttagtgtcttcattatcacaaaactataaattttgtcttcctgtagttttgtgatacaaaacctgtagtttgtgataatgaagatactaaacatgtagttttgtgataaatgatgatattaaatatatagttttgtgatatattgagcaaagcatctgtagttttgtgatgaatgaagactctgaatctgtagttttgtgaaataagttcttaaatctatagatttgtgatagattgtgtaaagtatacgtagttttataaaatttactcgaaaaattaattttttttctaacggagtagattttcatagagaactataggtagagcatatgtgagggaaagtatggagtgcaagaaatatactatatagtattctttattagaggagtgcaagaaatgcaaaaaatattttcgagagggaagtgaaataaatgttatttatttactacttgatattacaatgcaagaaatatactatacaaaaatgtatgcacatttttgtgtcttctagccgggcacgtgaggcccatcgttcacaaaaccgcaaatacaactactcccgagtatgttttcgcaaaaatgatgcaacgcaccaataatagcattccacgtggcacatcaacctccttttccctaccatttttttcagtttccgtttcccttttgaggacacgtacttcgcttgctcgcttctctctcctccggaaactcccctcacctcaccctctctctcctagtctagagagagaaaaacacacacgaggcacgcacgcgagcgagcgagaggagagagagagagaacgagaggcgggtggagagcttggaggcggttcgtcccttgcgctcgcggagcatattccccgcccggatcccctcccccccgcgagcatatacgtgccacagagagagagagggagggagagatggcgtaggacagcatgtgttcttgacgagagttcttcttggctgggtccaatcccaaggtgagtggtggatggattgtttgttgattcttgtttgagagtgaggatgattggaattgtttctaggggggtgattgtaggattggggttagggtggtggcagatccgttttgtttggttggatttttgctgcgtttggtcggtggaatggcggtttggactgtttggttgatccgatttgtgcggtattttgaggattaatttatttatggttggaaatgtgtgtttttcccgtccttgtttgtgcctgcttcatgattgattggttgcccctgttgcagattgatactaggtgttattcttaatcatgaattactattgtttatcagagcttctaaaatttctatggggtgagtggtttgatgaaaaggatttgggggagacgtctgataattcacaatttttatgaacaatagttggattcatttgtagtcgcacatatgaacaagggtgggtgcaagagaaaaatgtcagtgtcaatggaacttctatttctctatcaaagtttggtacatatttcatagttttgtttgggtaggtcaatttttggattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 39038 - DNA, 732 bp, Oryza sativa
atcaacataagtaggtgcaaaacagagaatagtcaaggaaataagataaagagatccaggacctcatcgcacataaaatggcggtttggaaacatatggtctcatgtattttgtgaaaaacagaaatcttacccagaataaaaatagcatttgtaacaaggcaagttttcttgtgagccatatgaaaaagatccatacctcagtattttcaaacattctaagcacaatattactcatgtagtcaagctccctggttctatgcagtcggtctaaagcgctttggcagacaaggctatcctccccttgtagacattcatccaagttgcaatagcgaaggacattcattaaggagtgtatgtgagattcctgttaaagagaatgttagaataacaattaaatccaaaaatgatgataagaacaaaagcaaagctgaacatgaagtctcatgcatactgatgtgaaataaagccttgtccggacatgtctgtcaggtgtctttacattagcatacctggaataaagtgaattagagaaattaaatacacatgtgattaggattgattaggattgataaaaccaagggcatacttaggatctaagcggtatttagtttctctatcatcttcatcttcctgatccaatgatttctcacttgtggaactagatcttcttccatcctcatttctagtttgaagtttttgttggtactctgattctttcgttggtaagaat

SEQ ID NO: 39039 - DNA, 2813 bp, Oryza sativa
atcaagaattgtgggaaaaaaaatatatacacaattctagttcttacttgttggtcctttattgtttcccatttctttcaactgcctgacagtcacagtgggcatctttctcgtcactaggacgttggacatatacaacaaacgatatctaacatataaaatgcaatttcacaggcttgggggcatatgaacattacaaaataccaaatcaagctcaaaattttcaatcacgaattcaagatcatcaatagcatcactgatccctctattttgtttcatgaccagctacgcactaactagggatcttcaatgtacacaccagcagataaaagctctcttcctctgaacaatgcatcgccaattttccatagagacacataccagcattaccaataatggtcacctagaaatccattttttttgggcaatggacacaaatagaccaggccatgatttctggaggaatctcatgtcggtgagattggaaaagcgcacacgatgacacccaagctgcacaatggcgtatgaatcgcgaagaggaaagcaattctaactcgagggatcaccgaaaatgcggggcccttgctgcaggcgccagatctggtgctcgtttcggaggagaggagaggagatgagaaaaaagtgatttaccttgtaggatccatcgggctgcttctggccgagcctctggatctcctccttgagcttccccacctcctcctccacgttcatggcgtcccccctgttcttcgcctctctccgcttttgagttctttgatatttttgggtgcggaggagaagcagagcaggtcgaggaagaaacaaaatcggggagagatgaaagagcagttgaagtggctccaaccgtcgcgtccgtggagcgtgggccgtccgatcggaagatgaacgggtgagatggacgtaacctgccgcgctagatttcctggtcgctgcatcacactgagacgttttcacatctcgccagtgcatattttggttgatttggtttcaattttttgaatttaataatgtaattttagaaaatattctattcgagtccacaccatagtcacgtaaaacggaatcagtggtagcgttcctcgacccaagaacgttatacccgtcaggccgtcacggaaacacggggttattttcgtcccaccttataaaaccctctcacaaatagcgtaccacgttcctcagtccagttcctcgatcccatcgacctagaaactttgttactataatccataccatccaaatacataaaaccaattatggtcacattttccatcttcttccccttttttttccttcttctcccctctctcccttcccctcatgttgctcagccacgacagcgatgccaaccttcatcgccaccccacatctccaacctctcatcgacccaaaaactttgttaccatgatccataccatctaaatacataaagccaattatggtcacattttccatcttcttcccaattcttttttcttcttctcccctctctcccttcccctcatgttggtctgccacggcaacggtgccaacctccatcgccacccccacatctccaacctctctctctctcctgtggagcagatgacgatagtgcttgccaactcaggcgatactaggtgcctcatgcacatagctctgtccgccaattttgatggtagccccaaggaaacggtcttgagtcgccaaatctccggcgccgggcttgggtctctcatcctcccaccggcagtcgtgaagacgacgacacgatgaggacgagtggaacttgtgaagacgaggagggtgtcaacctagatctggcgagaaccgtcttcttcggcaccgggagcaagcggggccattgggaggagcttgggacgggtggcagcttagcggcgagctcgagtgggggcacatcgagtttcctccttccttctcgaaccaaggtgaatagtaccaacgcttcaccggtgcgttggacaccacttctccattcgcctccctcatcgtgtcctactcgcctcctgacacttttggttcagcgaggtggagagagatatgaagaaagaagagtgatggatagagaaagaagatggaactgacatgcgggtctcacgtctagcgtattttggtctatatgatagaaaacgtaacgtcgatagcatggttgttattttgtacgtattcgtatagcatggatacgaatatatgaattgtaattatatttttttaaatagtaatggtatgtatcgagaaaacgtctagaggtgtttcagctagctccacatgatgatgagctagccgacttgaattcgaagcctcactcgtataatcatttgatattagctcattctctaatattcacatcgtagtggtatgtatccaataaattttttaaatcggttttgtttagcatattcgaaagtaaagccagctgcaggttgttttaagataagattagcacacacactaatccaattccaacccaatcaggtcgctccaaactaatccacctcacctcgtcctcgtcgtcttcttctccccacgcttgcggcatctacgcttctcacgcggactacccccgcctgcctaacagtcactgacacgtgggctccagcattacctgtccccacatgtcagtgacctcaccctagaaacccgggaggccagcgtggggcccacgtcgtcgccgtggcagctaaacacaactcgcacccgtgcgtgtcccgctctcccactcccacccaccgccagccgacgcgacggcgacggcgacggcgacggcgacggcgagagcgcggggggagatg

SEQ ID NO: 39040 - DNA, 2816 bp, Oryza sativa
gcggcgctgaacgagcactacgcgcacaccatgagcttcggccggggccgtggccacgccgtgctccgcgccgccgccgccgacccgcggtgcgcgctcgcctcctccctcgccgcgcaccacgtcgccccgcgggaccccgcccgggccgccgccttcctcgccgccgccgccgacaacctcgtaagcgtcgtcgcccctcacgttgtcgctcgccgccttaattttttcccccctcctcgaatcctccatttactcggtgagcttgcgctttcgtgttgctctaaacttccaccagggtgcagcgacggagtacgagagggcggtgttccgcgcgctgtcggcgctgatcggggaggagagggacgagcaggtggcgatcgagcggcacttcgaggtttgggggtagcttgtctccattttttgtaaattgagagtatgtgctgctggataaattgattaatggcaagaattgattggtggtgtgtgctttacatgtggcagttgctgaaggaattccccagggatctcatgtctctaaagagagctcagctcatctgcttctacatgggacgccctgatacatcgctcaaatttgttgaacaggtaagttcactacaaaggctcgtgtatgtttatatgcttacaaagtggaaatatcgtatataactaatgaaaccgaagttgaatctaacactgtttgttattatttaaaggaacacccatggtagcaactttattgaatcatcacttcaaaactttggataaaaataaaatattttacaacagttgatcaaaaaagcatcacttttagtgctgggattttgtgtgcatgcgcgtgtgtgtggaatagaagaatgcaggattttctggatgtgcttcaaaacacttcctcttatcaatgtaccatagttctaggtactattcttttcattagctttgttgtactcattcttgatcaggttttgccagagaatcaagaccagaactacatttacggcatgcttgctttcccattactagaacttggaaggatggatgacgctgaaaaagctgctcggaaaggcttggccataaacaagaacgactgctggtcacagcataatgtatgcgggtggttttgacataattttgttattttaagaagtttatcggcataacagattgtgttatgcatttatacctaatcgttcatattctaccgacaaacttctttaatacaagcttcatctgccattccatcttgcagctgtgccatgttttccagcaggaatgccatttcaaagaagctactgagttcatgaaatcgtgttctccatcatgggcagcatgctcatcgtttatgtatacaattttccacatgatgctctctcgtttgatgctagtaataactaataaccacagaaatagttcttacaaaatcattttcttctttctgtaggctaacccacaactggtggcatgttgctgtttgttacttggaaggtgaattccctacaagtaaagttctggagatatacgatcataacttcatgacagagcttgagaaaagtgattgtgaggcagcagaggtattaatgctggccatttttcctgtacatcaatgttttagagacactgagtaatttctcatgcatcaggtgtaccttaatgcactagggctgctactccgtttgcatattcgtggtcaggttgatctggccaaagatagattggcagcattgctagatgcacttacgaatgaggtactgtctcagcttcaataatttcaaatatattcgtaaaaactgttcagatttaagcttcaataatttcaaatatattcataaaaactgttcagatttaagtaagctgtatactgctgactgccaagagcattttacaggtctgaactaaagctgtgcaggactcatttttctgactatttcgatttgaactttgtactttgttcagaaaatatggcatgtggaatggctccttgatctacttgtattatgggcactgtcaagtatgggtgagattacaagagcagacaacttgttggaatcacttaggtcaaggtcagatacattaaacttttcttcagggaacacaagactctgctattaatactagtcaataatgctagaataacccattaaccttgcagagttagttcgatggacacaaaaaaacagcaagtgatgcaaaaggcaatccaggtatgctgaattctgtttgcaagattaagtaccaagacacaagcaatatataactcatgcacaatgaaaagtgtggactatcatttgtctagtgtttctgaaaaatgaacaccattcacttctgatgcctcaatatcattacattgtatgtttttgtggcattactattacctgctaactaattttaagatatgtttgctttcctgtagctattagtttgtaatttatttaactttttacatgcatgcctactgtactgttgaggagtattttgaaagataaaattgcatatttattctataaaagatactatatttttgctgttatttaattctttccttggcacagctagcagaggctgtgtatgaatatggaaaaggagagcacaagaaagtctttgacatcttgggtccagatttcgatgcactcagttgtaaagtatgattaacaaacctgttttcgttcaagacaagtagttatcgtatttgttttcttttactgaacatcaacatacgtacaagtagatgattggggcatcagatgagcaagtggatgtcttcaatgaagtttggtacactgtgctaataaataccggagagagttccagaggtattt

SEQ ID NO: 39041 - DNA, 5263 bp, Oryza sativa
  unsure (1)..(5263): unsure at all n locations
ttgcctgaacatagcatttggacaacaatctactagtactgtcaaataagttggtggctgtgctataggcaaaatagaaatatttgcgtcaactttgtatcatctgtagagactgctggcatcatctttgcatataagcagaatgctacaaggcatttgagattaatacgtgtttctgtctagtatcaacacatcaactgatatctccatgccaaatgtaacatgtgaactaaggaatgaccttcggtgcaatcttggcctaaccttggacttcttgcaaacttattttatcggccagaccaattagtaccattctgatattcatcccaggccctattctgaatacaactaccctcagggtttgtggctttaaaaaggtcaagccaattcagttgttgcttggtaatccgtaatcatacagaagacactagtgaggtacacatatttccattgtatttctaataggatttagttgttttctctctaccaggagaaggcatactcattgcatggcagagctgcagatgcttcagtcgcatccgaaaaggcaaatgctctacaggctgcttattctcgttaatttcgagttatgaaatacagtataccaatatgcttacatgccctatagagtgcacattcgctgtttgacataataagtggccgcgaaccaatttatatatgatttgatgggacccttacgagttactccctccgtctcaaaaaaagacaaatattgggtttccgtgtccaacgtttaaccgtccgtcttatttaaaaaaattatgaaaaaaattagaaagacaagtcacataaagtattatcatgttttatcatctaacaataatgaaaatactaattataaaaaaatttcatataagatgaacagttaaacgttagacacggaaattcaggtttatcattttttaggacagagggagtacgaccggaccaatgagcaaatatgttgttttttcactcttgttctatctgatgctacgaggaaattgtgcccagcgttccctgcactgctgtcgtctgacagcattggatatgacaaaggaatggatggcagctactccctccgtttcatatgctttaactgaaatggtcgatttttttttaagtttgacaaaaatataaacattttaaacacaaaacaatcatattatcaatatatattaaatgtttgttttagttaaactaatttgatgttatagatgttagatatttctataaacttgatcaaactttaaaaagtttaactaggaaaaaatcaaagcaacttataatatgaaatggaggaagttgtaatttggtgaaatcatggattttcactccacaaaactgtgtgtacaagttctacgagattttgaaaatactaccacaagcagggaagtaccttgtactaccatgcaaaatttcaagagcaaaggattaaaaagtggttgggcccacgtgtcatatcttctctcatcctctattgccctcttctcccgagctcgaatggcagatgtggcagtggcaatgaggaggctgctgttgtggggaagaaaaagagagatgagggaggggaccgaattaaatttgaaactatactgtttattcaattttttgctagaaatattcgggatgcaaaatcttttacaaaaatataccatcggtttcgcacaacaattgcgcgaaaatgacatgaaaataacgtcgcgaccggtatcgcacaatgaaaatgcgagaccgcacggtctcgctcaagcaaacagcgataccgtgccttgccgatttaattagcggttaattatgataattaatcactaattattattagttaattgttaattaattacttaatcactaatcaaatggatcccattggacaatatcgctgatggcttctgcgagaccgttcggtctcgctcttccatcccacgagacggtctcgcgctgttgccgcacgagaccgtgcggtctcacgctttcgccgcgcgataccgtccgcgacgtcatccccacgtcatttttgcgcaactgaagtgcgacaccgatggcatatttctacacaagtttttgcatcccgaatattcctgaaaaaaagtgaatgaacagtatattttcaaatttagggaccatgacggagctaggctggtggctactggccatggctctcttctttggtggcggtggctgcggctacttccggtagggtgtggcgggtctcggcgatggtggcgatggtgacggcggcaaggtcacgaggcagctgtggaatttaatgttcaaaatttgatactgttggcatattttatggatcatgtgtggccatgtttgtgaaaaagaccagcataacatctaattaaacaacccacatggcacacattgatatattttgaacacacgaagtgaaattcacgatcagggttcacaatattgatattggatcaaaactgctccccagcggtatcttcggattttatgggaaaccatctattaaaccgataaaatcctaacaaatcttgtaaaaaaataaaaatcaacttgaccgaaaaattgagtggtttatgtagtccatgtttggtttcaatcggttctgtaaacaccgtttgtgacttgctttgcaattttacaaaataagtaaataaataatactccttattctttgtgtcgtctgttacatagattgaaaataagtctctttcgcatccctgaacttcgtgctggaccgtgctggcccagcttgccgaggtagtagcccaggcacagcacagctatcgggccgggccagcatgggtacaacccgactcccgagtcgaaccgtgttgtgcctgggacgggccaaatcaccgggccttgggtcaggccgtcggacctcgggccatatggccatttatacttgaaggttctgttctttgttatttttatttatagtttgcatacacttgtggtaccgcatcctttaggctacggtcgtgcactcaacccagtccaggtcagtcttctctctattcttcaatctgcatccttattttgcatttggtagcagttagtctattagaaaagacgagcagtcctttaaaatcatttaactccagtctagtaagtccactccaacctcaggtgctgtcctctctttcgctgttcatgcccagctaatctggaaatgctccaaacttctgattccccactctaggtcaggtcttcagttcttcacctgcactgtgtaatattgagtcgattaggattttgctaatctggattttagtttgttttagtctaatggattactggacgaagataagcagagcattgcaatcgttttgtcaagttcggtacaatgaattcaccctataaatagtaggagccagagctagtatattagtaattagcaaaataatttgttgtattgtgcttggttcgaatgtctttgttatgggctctaggtttctcacaccaattgaatgaattagatctaaaaattagggatgttgttagaggagggcacaactggttgtgcatgcaattttatggttgaaaaggcacaattggttggataggagtacactgatgctaagaataacctatggttgaaaactatggtattgaatgctaaaggataatgcgttgtggagttaaaatttccactaaattctgtatttttaattacatagaattataatagatcatctgcgtaccggtgagccagggcggccgcccggcgatggatccactagtgagtagacatggatagttttagcctttatgtttaagccctactaggcttgaagagatcctggcccaccactgatcatagatcttcgcccatatctgcttcaaacgagtacggatccttagtgtagaagatgtgccggtcaaccttatcctccgttgatctcttcccatatgccttcagtagctggacgtgctggatcttttcccactcatagctgccatcttgcaaggatatgagtttaagcaatcttagactgcagtaacgtccagcttatttagctctgtctctcgtaggtactctgggagggcatcagcatccaaatccttccaaatgacgctcctaagtgattgcaaatccttcactaccttcagccctgggcatctgataacgacgatatgtcgcagtcttggactgttggagatcctctgcagcttcgggttgtcagctgacgtgagctccacaagtgacgggaagttctctacggagatcaggtgcggcgcatttctgagattcagcacccttagtgcggttgcatggtgcacaagtccaagcggaagataacgtagtttacaaccggtgatggtaacaacgtctaaggcgggcatccctggtgtttgctgatcccagttctacactctccatcccaacatcccctttaaacccagtgtttctagctttggaaatgcaacaccagcatcaccgcgagaaagaccatggagctgcagcttcntagtgatccttgttccagttgtgactttctggtcatcagcactagaggaggagaggaagaggagatcatggccaatgctcacgatggatggagcatgatcaatccaaatataatcaagaaaagggagctggcccaagccgacaggcagctgcttgcagcatacgtagtccttcagctccaaacgccttaagcttggaaagtccgacattgttctcatccatcggggtagtcgatatccaaagtaaccattgaccgtaagacattctacgcaaggcggaggacagagattactcaacacaacctcggctcgttcctgctcctcgattacattgctggttccttcgatcatcccgttgtcggtgagcctactggcaaatgtcaagtctaagattttcaagtgctttttactgttgagcattgctgtagcagccatagagcctgaagatgcaagctctagacctcttaaatcaagccattttaggttcgacaaagaccgtagttcttccaagctgctccaggcatgtcccctgtcatccaaataagttgggaaccccaacatgttcaccaagttttctagctttcccatacctggaggaattgaggttaacctcgtgcccctgaagtcgagaaacctcatattctgtagcttcaagatgctgtcaggaagctgatgaaaattccgacaccccataaggtcaatgactgtagaattttagatttcctatgcctcgagggattgcagatatgcctgtatttgcaagccccaagtatcttagatgcttgagatggcatatatagtccggcaggtc

SEQ ID NO: 39042 - DNA, 10882 bp, Oryza sativa
aaataacatgtttaaatggatgataagtagaattacttatccttggtcagtatgccaaaataaaatatgactattaaaattagatggagggagtaattagtaatgtgcatctcagtactaattagtaattaactagctgggtagcccgcgcaattgcgcggctagcacccaaacaaaatcatatattttttaaatatgattttacttaaaatttatttaatagctatctcattgtattaagactttgaaagaccaaaacttatcatcctcgtgtttctaattatatagttttgaaaagtcacaccagttgctacctcttatgctatctctttctttatttgcttgctcgatctaccactatttctatccattcttcttggaacatttaaaaattggattttgtagtttttagagtttattgtcacgttgagtttcatttttataatttctagatgtcccgtcaaacgttgccattacactcctgtacggcccgtccactgtctcttctctttattgtcattgagattttaaaaattgaacataattatcgtttgggttcatttttactttttagaagtcccgccaaaccgtcagtagctttgccattgtactcctctatggctcgtccgctatctcctttctttattgtcattgagattttaaaatcgaacctgattatcattgttttttttttactttttagaaattccgaacctttaaaaaatgaacttgttgttttattttttataatttttagaagtcccatcaaacgaggccactatgcccctttacagcccgtccgccgcatactctttattgtcattgtgattctaaaaattgaacataactatcattggaattcattttttattttctagaagtcccatcaaccgtcggcggctctgcaactatactcttatacaccccgcccgctgcttctcctttttattgtcattgagattttaaaaatcgaaatgattataaatgttttttttactttctagaagtcctggccaccaccttacttgtttgcttcacggtctgcctgacgtccctccttttaatcgtcattaggattttatttgatgttttattaacaatttttatatgtcgtatcaaccaccaccactctacttctttataggcatgttacttaatttatttcgtcatgtgttttagatggtcttttattttaatagtctttatttttatcacaaattttagttatttaaaaattgtattcctaattgaaattttatttttctttttctaattccagaatttatttcataaaaaattagctaatactgtattgtgttcttttaatgtttttatttttttattttcaattttcgttgttttataattgtattcctacttgaactctcttttaatttttctaattttggttattattttattttttattctaaattttaattaatctcgtattgggttcttatatggattcttcttttaatattgcttattttcaattcctaattccagctaattttaaattgtattcctacttgaactcttcttttattttcttttgctaattttggatttatttttatttttattccgaattttaattaatctcgtattggattcttatatggattcttcttttaatattccttatttttaatttcgaatttcagctgtttttaaattgtattcctacttggattctccttttcttttctaattttgaattttattttatttttatttcgaattttgattaatctcgtattgggttcttatatgaaaaattctttcaatattgcttatttttaattaagaatttcagatttttttatattgtattcctacatggactcacattttctttttctaattttagattttattttatttttatttcgaattttaattaatctcgtattgggttcttatatagaaatttctttcaatattgcttatttttaattcctaatttcagctcttttttcgattgtatttctacttggactctctttttcttttttttcttttcctccgattaatgtggaaatttctagcctccacagcgaacgtggtgccttcttttcgagctgtctgatagtagatagatagatagatagataatagatagatagatactatgtgatagtcttacctgcttctttagcagtgaccaagaatcacctagatccagcttctcaacccggtggaggtgctgggctctcatcccacgagcaactccgtcgttcctcgtcgtcaccaacactcggcttccaggagcacaagcaccgagcggtgctcggagcagatcgctccacaccctatcgctccacacgtcatccatcaccagcaggaacctcttctgcctcacggcatgcttcaacgtgtcctcgagcagggccttgtccccggcgcagccatggtagcttcccccaaacgcggcgatcacgccgtgcaggaggtgaacctcgttgacctcctgattcacgctcagccataccttcttgtcgaagtggctctccaacacggcgtcgttgaagaccatcctggcaagcgtggtcttgcctatcccccagcgccggtgatagcgacggcgatgacatcgcctgacgatcttgcgcgcgtgcgaccatccgccagcttgttgccaatcagcagatcaacgaggttccttgtgtgaagatctatcttgtcgccgacaacatcggatcgaatgatggatggtcccgtcttgcggttgcggctgctttctgacgagcaagaacacatgggtctatcggttagacgaagggccgaggaggagtggattacttgggagacaaatccaaagcgggagctcctcttcgcgatctcctccaccctccggttgagctcctggatcttcctcccgatcttgcgcgtagcggcagggctgcggcggcagagggcgctccagcacgccgacggcgccggagcagctcttggcggtgagccggggtcttctccgccctccatggcgcggaagaggtcaaggatgtcgtcggcgtcgtacatggcgtccttgagctccctcacccaccgctccacgcccgggtcgtggatgcgcctccggtcggcgtcggccaggatgctgctcaggtcggcgagcgtcgtctcgagcttggcgatcgcgccgggcacgcccaggagcgtctccacctcctccttcgccatccccaccaggacgttcgccagcttggccgcgaatgcttccagcgccgccgccatgagcagagaagatcagacccccaatgacaatgttgtgtatcgctgcaatgataggggcgtgcattttttttttattctccgcagcatgattttgactttgacttttttttcaagtcgtcacatcaatatacgaatatatatatttaaaatctaataacaaaataaattgcagattccattagaaaactgcgagacgaatttattaagcctaattaatccgttattgctaaatgtttactataacatcacattaccaaatcatggtacaattagatttaaaagatttgtctcacaattattttttacctatatttaatactctattcatacgtttgatagggtaaaaattttttgttttgagaactaaaaagggcagcgatcagttgactttcctgtactctaaaaaaatatataataacggtggtaagtaataaatctgttcactccatcaccaactcattatcttttttacaatggaaaaaggacgaatggggtctcagaacccacattaaaatcacaactttttttaagagaaaaatgataatgtgaggaaaaatggttcacaagttagtaataaatttatataaacaaatatcaagagatgatgtataaaaataataatattaacaatggattaatgatagttttcattaattaagtgcaatgcgcgggcaatatgcccatcattaaaaataagccggttgagccatccgagaatggataataacattcgatcccgctaatctaatctaatgcagtataagtaaatatataatttcttaagtagattttcattatgggtcatcttttattacccatgtttcgctttaacatactttaaccaatgtatttactttggacgaggtaatcttgactttgttttattttggattatccttttttttaagcatatgaacgatgttgagtacatcggctcctatttatcaataaacttcctcagttgtatggtgtagaccgtttaaattttaaaatatactgttcattcaattttttctcaaaaatattcggtatgtaaaaaattttacagaaatataccgtcggtctcgcacaaacattacgtgaagatgacgtgggaatgacgtggcagacggtatcacgcaggaaaagcgcgagactgcgcggtctcgcggaatgaaagagcgagaccgttcggtctcactgaagcaatgcgcgataccatgccatgccgatttcattagcgattaattatccttattagcgtttaattaattattaattattaattcgttaattatgataattaatcactaattattattagttaattgagtaattaatcactaattaaaagaagctgtcagacagtgtcgctcgttgcttcagcgagtgtcgacgggtgatacccgtagaacggatatagagggtattggggtacgttggtacaaggatctacgtaatacgacatcgagcaaacaaaagacgaggattatactggttcaggccccttaataggtaatagccctaattcagttgatatgggattatatgatggaaaaccacaggttacaaagggaacgatggaactcgatgaaaccggcgagatcgtaatcgagttggttcgactagatctcccggcgacttggctcctgcaggctccgacttcgtaggctgtgggggtggtgttggctgtgagattcgatgccttaggtcttcccagggggtcccttttatatcgcagatcaggtggtctccagtagaactcggagacatcggaccctacacgatacattaacgaccctgtcttgtccgagtaggactcaaacactgtggagaatttccttagtgcatgcagataatgtccgtgtatgcgcgggtatgccatgtcgatatgtggcgcatatcgaagggtaaggggtatacctaatccgtaaccctgacagtagcccctgatttctgcttaaatgaactcgtgcgaccaatagcgacttctgatgtcgagactgatgtcgttctcggtgtgggaaccgtagagacaggacatgatcgagaacaccgtgtgaagcccaacggtcacgagtgaatttaaactgaagtctgaaaaactgccgcacgtaacggacccagaaatttccggcggccatctctctcctttccttggaattcgcaccgtcggtagtgcgtctatttaaaggaattttggggatccatcttgaagtccgcccaccatgcagaaaacattccgcctgtaagcgctcttcgccttcctcgctgccacaagaaaccctagttttagcaacatatgctctttctccggcgatcttcgatcagcgatggacctcggcaaatcatcttccaccagtgcgtcgctgaagaagcttcaggaagacggcgcccttcctggtcgtggaagcatggagagggaagcaagaggtattaatccccagcccgtcttaggtcgcatggttgcgatcgaagtctatattctctgcggttttctccccccgccttccgaatttcttctcctggttttgaacttctatggtctttctcttcttcatttgaatctcaattctatcgcctttcttaacatctttgctcatctttgtgaggcctacattggggtagagccttttcttgatctttttcgcttctactacgagttgcgttggatggagtccaacagggtatctggttgcgttgggttccgacttcgggatggcctgaagtcgcgttatatccccttccagtgcccttcttctcgcagcaaatggtggaatatgtggttctatcttgagatcaaagattcagaccttgtcttcgttgttcccgatgaacaaccggacaagatttcgtcttggactgcaaagccccctttgaccccctatcttcagtcgtttatcgacatcatcgacgatctccgattacggggcttgtcggggtatgaagtcgttgcagacttcgttggtaggcggatccagccgctccaggctcgggcccatccagcctttaaatattccggaccagaggacgcgacccgggtttctcctcggggtatctttctcgcatttatcctgacatgcttatgttcgcgttccccttgatttatcgaaacttggttctcgtttcataggtctgaacagcgaaaccgtggagcgccgcgtcggccaggtgatgatcagtggtccgacaacggcgagtaacatcctcgtgcccctttgtgaaaagggggcggctgaacgtgatgacgctatcaacgtaagtatactcgataggcatcccgcattttcctttcgagatcaccttatgacttgattaagcgtaggctcttcctctgactgacatcatcggccgctcgcggaccatcaggtggcagcgtctctaaaagagaaggtcgccaaggaggcgtctgatgctgttgcggccactactagtggtgacaatgttccgacaaaggggaggaagttctcctctgtaagcggacatcgtcgcaagacatcgaccccctcggtaagttatcctgtcgccagatcgtgccgccagaaggattttgccttacttcgcattggttgtctttcaggcctcggacgcgtctcccccgcctccacgacgacaatgtcttgtgacggttggcgagaagtaagtagatggatttttaggtttctgtgattccattcaagctttgtctgatccgtggtcgttccatagggaggcgcgggcaaaggctgcgcaaaacaagtctggagggacttccagcgcgtcgcctgccgcgccctcaacggatgtcgtactcgtagccgagagtcgggaggcaacgcctagcggcccagtcagcgatcccgcggcaggtcgtggtccacccgctgccgtcctcacctgggaggagctccaagtcgaaatggggcgcctcctcgaagctggtgctcgcggcattggccgcgagattgcagaggcgaggtcggaagtagtgttggcgaatgcgcgtgctgaccggctggtgcgcgagttggcggaagctcgtgaagacctcacgaagatgagggaattggtggccggcaacgagcgacaacgacaggggctcgaggactgtatgtcggaactcgggaacaacctgtcggaaatccgaggctcgttgcgggtcacctacactggcctgcaccagcttgccggggagtgtggcatcaagtctaccatcccggtgaatcctgacgaattctcgctgacatcctcccttgcggaactggcgacggcgatgggggagatcccctccaagcatgcggccaggatcgcggaggagacgtcgaacgggatctacaccggggcgtgtcatgtcctcgcgtgtgtaaagctgtcgcgtcctgaactcgatctgcgtgagatcttggatcagggggcggctagcaacacgcgtaagaaggtgatggaagaagtcggtgatctgggggagtctgttctccccctatttgaagagtaggacttcttgtacttccaagacacgctgtgtaaaacttgaattctgaccgccttcgtgcgagcaattatcattctagtttactcttgtatgttgacctcgggaacttttgtcctttgtagagatgtcgatgtcgaggatgtccagcagcgtgggcagcctaaattgtcagcgatccctccggatcttgcgtctgtgggacacgcgttgctggacaacgtgggtgaaattttgcccgcgaggacagggacaacgacgacttccttaggtttgtggtctcttcatcacttttcgctcctccgatttaatcagtcgtgttctcgagagagagaagcagtctgacgtagtcgtttccgtgttggacagacctcgaggacgcacttgctggccaagatcgtcgtatccaatattggaagacgaaatttgaagtggcggaactcgagagagccatgttggaagtaaaaaaggagcaggccgtggaaacgctccgaggtcgtgaggtgtggttaactcgtatttgaagagctgctgcacatccatggccagagtttgcagagaacttcgagtggtctgcggagaacctgaggagtcggcggctggatacatctcgtggctgaacgggtgaaggcgtcggcaagcggattgacgaagctctgaaacaggagtgccgtcggtcgagccgatatgccggagggcatgtgttggcttgcatacgagatcattgtccgcaaatgcacctcgagtttcttcatgaagggttcactcgttctcggaggactcctgcggagatagaccacctggcgaagtcgatggcaccgttagcggagaaggttttcaagtctatggactggcgttggccttcttggtagtattcgtacctctggatatagtgtgtaagagtgtttcctcagttcacgactttggtcagtcgtttgagtcgtacactctccctagcccccagccttgtcgtcggaggattcttctcgggggacaaggctcttggacctttgacctgccttggttgagaaagcactgatcctagcccccagccgtgaagttggaaagttaattttccgattacacggcttggttaatacgcacggcgagaactcttacacgaccaggtcttacatggtctttcgtctctacaggatccgacaaggccttatcggctctgggcgtccccagccgaagatcccttaggttcctcggaggccttgtcaggacggcgtaaagggacatgaggataggtttcaacgctaggtgtcatctaggtaagggatcatcaggcaggaacactgtgattgtaatatgtgcctaaaaataggctttattgatactgtaaggtgtcttacaggtatggattatattgactcatacatagaatttacgtagttggtcaatgttctaagagtttgccaactcgcggccatcgccgtctgctatcttgaatgcacctggtcacaagacttgtgtgatcgtgtaaggtccttcccatttgggtgagagcttgtttcgccctgcttggctttgaacccatcggaggacgtagtcgccgatcgaaagtatgcgtgctcggatgtgcttctcgtgataatggcggagggcctgttggtaactggctgctcggactgcaactcgttcgcgatattcctcgagtagattcacatcgtcgtttccctgttcctcctgatcctcgtcggaatacttctgtactcgtgtactttgatatcgtagctcgctggggagcatggcctcagagccgtacacgaggaagaagggtgtttccttgttagacgtggtcggtgtggtgcgtacggcccatagtactaatgggagttcttcgacccatttcttgtcgtgtgacatgagcctgtcgtagacacgggtcttgatcccttgtagcactatgccgtttgccctctcgacttgtccgttgctttgaggatgagagaccgaagcgaagcatatcttgactcccagcccgatgcagtaatcttggaaatcggcgctgatgaactgggagccgttgtcggtgatgatgcgatgtggtagtccgtatctgcaaaatatccctttgataaatttgatggcgttgtcggccttgatttcccccgtgggtatcgcctcgatccattttgtgaatttgtcgatcgccacgaataggaacctgtagccgccctgtcctcgtgggaatggcccgagtatatctagcccccaacacgagaacagccaagtaagaaggatagtctggagcgcttgtgtgggtagctttgtgtgtttactgtgaaattaataggcttcacaccgctggactatgtcgcatgcatctttgagggcggttggctagaaaaacccttgttgaaaagcattcccgaccaacgtccgaccggcggcatgtgacccacagatgccttcatgtatatcgaggaggaggtgtctaccgtcgtcggacgaaacgcatttgagaagtaccccgtttggcgctttcttgtatagatcgttgccgattatgcaatagattttggtttacgggttattttctcagcctctgcgtcatcctcgggcaactcatcgctgttgatgaatttgatcagtggggtgcgccaatcgtctgtggtttcaatatcggcaacgacgcgttctgcctctgtggcctccgagctgatgtcgggggcgtctaggttaacgtcgccgctgacctcttttactgatggttttgtcaggacgtccagaaaagtgccgggttcgagcggttctcgtctggacgcgcgccgtgctagatcgtttggctcgatgttgtccttgcggtatacgtgtcggacttcgatcccatcgaaccttttctccagcttcctgacttctgcgagatacttggataactcagggttagagcatttataatctttgtgcacctggtttgcgactagttcggagtcccctttcacgatcagtcgttgactccaagtgcggctgcagctcttatcccggcgagtagtccttcgtacttggctgtgttgttggttgccctgaagttgaggtggattgcgtgcttgaattgatctccggaaggagatgtcaagatgaatcctgcccctgctccttggctgttgagtgcaccatcgaacgccattatccacgtttcattgtcgatttggttgtctgatttgttatcaggcatagtccagtcag

SEQ ID NO: 39043 - DNA, 4786 bp, Oryza sativa
  unsure (1)..(4786): unsure at all n locations
gctgtcttctcttcgtcctctttcgccatgctgatttggtggtagccagagtaagcgtcgaggaagctcaatagctcacagccggctgttgagtccaccggttgatctattcgatgaagagggaagtgatccttgggacacgccttgttgaggtcggtgaaatcgacgcacatcctccattttccgttggcctcccgcaccatgactggattggctagccactctagatggagcacctctctgataaagccagctttgagaagtttgtcgagctcttctcatatggcttgttttcggtctggtgcaaatcgccgcagtctttgctttactggcttcgcatcgggtcgcaccatgagtttgtgctcaatcacctccctagggacccctggcatgtcggacggctggcaagcgaacacgtcagcattgtcgcggaggaaggtgatgagcgcgagttcctatttctcgcttagtgatgccccgatcttaacggtcttgttggggttgccactagtgagtggaacgatcttgatcgcgctgtctggtttcggcatcttgtttgtcttgctcactttcttgggaggctcagttgtggcgggtgggctgggcgtttgctcgaccatgtcgaggctcgacttgtcgcattgtaccgctagcttagcgttcccttgaatagtgattgttcctttcggtcccggcatcttgagcacttgatatgcatagtgagatgcggccatgaacttcgcaagtgcagttctcccgatgatggcgttatacgctgtatcaaattcagcgacatcaaaggtgatctgctctgttcggaagttgtttgcttgaccgaaagtcacaggcaacgtgattttgcccaatggtttggacgaggactggggagtaattccatgaaagggttgatcggtaggtgtcaactcgcttcgtgggattcccatcgcgtccaaggtgctggcgaaaagaaggttgattgagctgccaccgtcgatgagaactcgcgcgaccttgatgtttcgaatggtgggctcgaccacgatcggattgcgtcctgggatgacggcagtcttgggatggtcttcttccgagaattctatcttctgttcagaccacttcatcttgggtgcagccccctgccatgtcgagcagacttcacgttccactttcttgtattctcgcttggaggagtacgctgtggagcctccgaaaatgtgtgagacgtggaggtcggagtctggatatgctgagtctgattcctgagcacccgcctccacatccttttcaaccacgcgtactcgcttgcatttttccaacgccatatgtttcttgagcgacttcttcaaaacgagggcagtcttccaaagagtgtctatccgtcttggtattggcaccatgctttctttgcgtcgctaccctgtgggtctaggcatttggatgggttcgcgtattctgctgcgagaacttctgcttgagcttttcttttcccactcttgcgactttaactctagtcgtgatgcgtcttgtcgccaactcctgggtggtatagcgatctcggactccagacttaaaggcgcgaattacagaagcgtcggtgatctcagggattgtattcctgcactcgttaaagcgccgaacaaattcccgtagggattcacccgagttatgtgtcaacgcatgtaggtcatcttcaatcgcgtggcgcttgtaagttccttggaaattggcgatgaactgctgccacaggtctgcccacaaagaaatcgagtagggcgggaagtgcatcagccatgagcgtgtagagccttttaatgcagatggcaaataatttgccaacgcgttgtcgtccgctccggcagcatagagtactgtggagtagacttgaaggaattcttctgggtcagtactcccatcgtacttctctattgctccgggtcggaatatctcaggccatcggacatcacacagggaacgaccgaaagctctacatccagcgctgggggcggtgggttgtcggcgatcgtgtgtccttcgtggatgtctgtctgacgatgaggatgaataagaagatgacgatgacgatgaatcgcttggttccggtgtgggattacggggtcgtcggctgggttctcgagaatcctgtcgtcgccctccgttgttgtcccggcgccgatctccgtcgtcctcgtcgttatggcggcgtcctcgaccagtatcgccctgcgtacgcctctcgcgatcatcatgatcgtggcgattgtggcgattagcgcggtctcggtcttcgctcgagcggccctctcgttcttcgcgatgtcgggaagagacgcgatgttgggagcgattcccgtcgtctcgcatgcgccgtgcctctcggcggccgttgagatggtcacggagatcgccggtgccacgaggtggaggggtagcttgatggggtgactcccgctgtccgggattttcgccatcgacaccgccggttggtggttgttcccggtgcgtagcagcagcggcttctttgaacgcgtggctgaggttggttactgattcccgtagccgttcctgccaccacgcgagatcattgttcagaacgggatcgtaaggtctctctctcagtattgtgttaagggtcctgatgtgctgggccggtgtagtcacttgattttctgcctccgcattagcgtgtgctgacgtgctggtcccgtcgatagctaatacctcgcgtggcgtactcgttggagatgagctgtagtcctcgagtagatgcaggactgatggttcgtgggaatcgatgtcgattacgccgacgaatcgatctgagaccagcgttcgttgttccttgtcttcatctctaagggatatgcctgactgttggtccttaggaggtgacgtcttcgtggcgtgagaaagaccttgcagcttgagaggtcgtgattctttgttcttngtgaataggaccagataaaccatcaccgcgttggagaaatacgctgaattccacgctcgttgcaagcgcgaatttcggggcggacgttgagaaaaacccagcaggcttgcaaagtgtgtttcctggttttgtggataggacaccaggaccttgtcgcttcagaagttgttctcgtcggctcgtggttcttgtcggaacaacaaggttcggccgcattagaatccttctcgagcttagatgttgtcgacgttctgttctccgcttcggcgggaggatccttcgacacggagtcgtcttgggttgcaaccactgcgttctcgtttccggtcattgacggaccggctgagatcggtatcgtggtgtaaaccgggaagacgatttcaccgacttgagtccacaccaacattgttgaagcaggaaacccgtggttgaggttggtgttgacgctgttgtcaacgaagctggatgacatagtagtagaaccttgagcaccaagtccccctacctggcgcgccactgtcgacgggtgatacccgtagaccggatatagagggtattggggtacgttggtacaaggatctacgtaatacgacatcgagcaaacaaaagatgaggattatactggttcaggccccttgataggtaatagccctaatccagttgatatgggattatatgatggaaaaccacaggttacaaagggaacgatggaactcgaagaaaccggcgagatcgtaatcgagttagttcgactagatctcccggcgacttggctcctgcaggctccgacttcgtaggctgtgggggtggtgttggctgtgagattcgatgccttaggtcctcccagggagtcccttttatatcgcagatcaggtggtctccaagtagaactcggagacatcggaccctacacgatacattgacgaccctgtcttgtccgagtaggactcaaatactatggagaatttccttagtgtatgcagataatgtccgtgtatgcgcgggtatgccatgtcgatatgtggcgcatatcgaagggtaagaggtatacctaatccgtaaccctaacagcgagaccgttcggtctcgctcttccattccgcgagaccgtgcggtctcgtggcgcgagaccgcgcagtctcgcgcgataccattcgcgatgtcattcccacgtcatcttcgcgcaacggttgtgcgagaccgatggtatatttctgtaaaaaattttgcatcccgaatatttctgagaaaaaaatgaatgaacagtatattttaaaatttaattcttctttgatatatgacaaattagatgcaaatgaataaaaaaattaagttgtccaaaatgatacataaaactacatggaccaaagtaaaaacattacttgaagggtaatcgatagcgaaacatcggtaaaaataagtatcttaaattcaaatgtagtctgttaaaaaagtgaagcgaataatcggaaaaagaggtatacccacccccacggcccaccccgccaagctcatcgtgtggcggagcggggagaggacttgttcaccggtgttgtgagaagaggggatctttgacgcgtggggtggaaaaatgctttgcaaatggcatccaacaaattagactcgggaagaccaacgatgaagaaaatagttttgtcacttgcatgtgagctcgctagtttaaagtgcaaagatgcaaactttggtaacaaaacatggtctaaagtgaaaatattttctattgcctagtgcaatatgcaacttgctcatttcgtcctataaaaaccaacctagcactggatttggcatattctaaaactatgaattttggggctgcag

SEQ ID NO: 39044 - DNA, 2156 bp, Oryza sativa
ccctctcataatataaattttgactttttgcttgcactatttgaccactcgtcttattcaaaaaatttgtgcaaatataaaaaacgaaaagttatgcttaaagtaatttggataataaagtaagtcacaaataaaataaataataatttcaattttttttgaataagatgaatagtcaaacagttaaagtaaaaagtcaaaatcccttatattatgggacggagggagtagtacactataggagtcggccggaaatgctgttgggtgatcgatcgccctggggatggggcagcgatcgatcccctccctcctccctccctccacccctccacctgatttccttttttggcatcgcattactttcctatttcagtaaatttatatacctaaagttaatacgcctcaagtttacacatctaaagtttagagaccaaaagtttataagtcaaaagtttatatatccgattcaaatttgaatttgaattcaaatttttttatatataatatttctatacatctaaagtttatacatctaaagtttatacacctaaagtttatagacctaaagtttataactcaaaagtttatatacgcgtttcaaatttgaatttgaattatatctgattcaaatttgaatttgaattcaaatatttttaaagtttatacacctaaagtttatagatccaaagtttataagtcaaaagtttacatacctgattcaaatttgaatttgaattatatctgattcaaatttgaatttgaattcaaatattttctatatatagtatttctatacatctaaagtttatacacctaaagtttatagacccaaagtttataagtcaaaagtttacatacccgattcaaatttgaatttgaattcaaattttttatatatagtcataaatttttctaacttttgtttttcaaaaaaaaattgtgtggtgtactgtagtaaaaagaaaagaaggggaggaggaagggggagaagagagaggagtacagggggaggaggggcaaaccgatcactgggcgacggcaatcgatcgcccattagagcaggtacaatagcatgctataagccagctgtaaacatattttaaagagaaaaaggaagagaaagaatagcagcggactacagatctgtagccagctgcagcacggactccaagacgtaatgtatatatgacagataggaccatgtattaatattatagtaagcactattgtatgagttggctattacattagctatagatgatttggagttagtagtgagatatgctattaaacttgctcttataccctccggagtcggctgctatgtgtcagaccgaaaatcgacgccccaaaatgagtcgaactcagctgattaaacaagtgtttatcacggggagaatagaatggagaaaggaacggttggctgatagatcggcaaatgcagcagtatgggtcccacaaatcgacgccaacactggaaaaagtgtgacaagtctgtgtattcagaaaagtttggatttgatagaaaagttgaaagattgaagaataatttggaactaaacacgatggaaattggtttgggtggactcgtgatcatggacgtggagcagtcgcagaggtttggagttttgactatgtgagtatctgtcggcgcaagcaacttcaactctccgtctcttcctttttttttcccagcacagtgtgtcggcggcgatcatggcggcgatgctggacgccttcgcgtcgagcctcgcacgcattctggcggagacggcgaaggaggaggtcgaggcgctgctgggcgtgcccggcgagatctccaggctcgaggcgacgctcggcgacctgcgcgccgtcctctccgacgcggagagggcgcgcgaccgcgacgcggccgtggaccggtgggtgcgggagctcagggacgccatgtacgacgccgacgacatcctcgacgagtgccaggccgccgcggggggcgaggccgcgacgcccgttgccatggcgggctgctgctgctgcttccgcggcgtccgcgtccctgccctctcctgcttccgcgaccccgtccgggcacgcgagatcgggaaaaagggtcagggcgctcaaccggaggctggacggcatcgaaaggaggagctcccgcttcggcttcg

SEQ ID NO: 39045 - DNA, 2104 bp, Oryza sativa
tgatggatgacgtgtggagcgacgcggcgtggaacgagctgctcagggtcccgcttagccatggcgccccggggagccggatcctggtgaccacgagaaacgatggcgttgctcacaggatgaaggtgaggtacctccaccgtgttgacaagctgcggcgacaggatgcttggtccttgctcaagaagcaggtcagtatcacaaacaaatctgatcaattgtgccaattgcaagtttgggactgaaattcggatttcacacgatgagcttcgatgtttaagctattgtagatcttgaagaatccttaaataaatggtttacaactatctactttctaactgcaattatgagagttttttttaagtaaatcacatgataaaaaagcatggttgttattaggtaaaaatgaatgttgcaggtttttttttttgttgttgtttactgtatttgagaatagcttatattcaatggatgttattaggtatacacttcatttttaagtaagatagctttttactattccaacagatagttttgaacaagagtgatgaagctgaattggatgagttggaggatattgggatgcaaattgtggacaggtgtgatggtttaccgctcgcgattaagatgattgggggcctcttacttagtaagagcagaacaagaggtgcctggatggaggtttctagacattctgcatggtgtaaacatgaagtgaatgatgaaattaacaaagtggtctgcttgagctatggagagttgccttctcatttgaagcaatgctttgtgtactgctcacttttcccacgaggtgaggtgatcgaatcaagaaccattgtccgaatgtggatcgctgaagggttcgtgcaagatagcacgggttcaggattgccagaggctgtagcagctcagtactacaaagagttagtcttaaggaaccttttggacccaagtgatgggtactatgatcaactaggatgcaccatgcatgatgttgtccggtcttttgcccaacatgtagcgaaggacgagggattgtccattaacgagatgcagaaacagaccataggtgatgcacttggtactctgaagtttcgtcggctctgtatttcaaacaagcaagtcgagtgggatgctttacagaggcaagtatcactaaggacgttgatactattcaggagcatcgttactaagcacaagaatttcttgaataatctttcttgccttcgggtgctacatcttgaggatgcaaatctgatagtactaccagactccatctgtcaccttaagcatttgagatacctaggtctcaaaggcacatacatatctgcactccctaacctcatagggaatttgaggtttctacagcacattgatctctgtggttgcataaatgtgtctgaacttcctgaaagcattgttcgactgcggaagctaagatcactggacatcagacacacaatggtatcttcagttcctaggggtttcggaaagctagaaaatttggttgagatgttggggttcccaaccgatttggatgacagtacacatgattggtgtagcttggaagagctaggatctttgccaaatctcagtgcactacatttggaggttctggaaaaggcaacacttggccaaatggcagcaagatcaaagctcagcagcaagcagaatctcacacaactggagctgagatgcactagcaggatcagcgcaaacggcaccgtgcaaggtggtatcagcgaggaggattgcgagagaatcgagaacgtttttgagcatctccgccctccaccttcaattgaccgtcttacgattgcaggttactttggacatcggctaccgcagtggatggccacggcgaccgcctttcggagcttgaggcggctgtgctagaagactacgcgtgctggaccggctgcccggtggcttgggccaactcccttaccttgactacctctggattgagcatgcaccatccattgagcatgtcagtcatgatttcatcctccctccggtaggcattgctgtcgatggcaacgcaccatcgacgacgacaacaacaactaagactgaaggtgcaggcattgcgttgggctgcagg

SEQ ID NO: 39046 - DNA, 2313 bp, Oryza sativa
tggagtcgctcacagtggagaacagcaaactgaatcgtctccctccggggcttgtgtaccacaccagagcactgaaagctttggtgctgacgaacgccgtgagccttgaatccgtagagaacttgcattcgctggttgaactttacctgctgacaacccaaagctagagatggttgtaaactgctcgagcttgacgaagattgagatcctcagatgcccagagctgaaggcgtttgacaggttgcctgcagtccggagcatcgtttgggaggacttggatgctgacacgctcccggggtacttacaggaggcaaaggtaaagaggttacacataaactgcaacttgagcttgctcaacctgatatccttgcaggatgccagctctgaagagtggaggagcgtccggcatgtgcaacaattgaaggttttcgggttcaaaccacagagcgaaacgtctgaatgttacttcctttataccaaagagccatatcacgtcgaaacaaacatctccaaagcctgaacttctgctagatgtatttgtcatttgtcttgaaaaagaatgttgtattactatctgtttcctctactttgttattctcatttctgatttgcacgttctgtttactgcaatcaggctgattctgaagcttcagcagtcagcttatcgaatttcaccagctccatctgaaatgctttacatgcagaaaacagagagcttccaatggaaaatgcatgcgcaactgcaattttgcttttttttaaaaaaaagatcgttcagtgaacaatttgcacatacctaacccccaggataaaaattaaaagaaaagtttattcatgcatccatttcctttcaagaaaggagatgagacaactttcactttttaaggtgtgacattttgaagcttcctactgaacaagctattttatattcgttcaggggaaaagtggaatggaaacaacccattccatgaattcgcggtcagacgtacgaaaatataaaccataacacaatggtatcacacatgggaggcctccaatttaagggacaatacatataggaaaacaccgacaaaaacggataatctcaacaatcccctttgatgatttgatttatagattgtatgaactgttggttgattacatttatgttagctgagagagataaaaactactaattagatgaaacgaaacagttcctctgcagcaaccatattactcttgttagataagagtctatcacactgtgtaggactggtgaatggtatcaatgtccaggcccttcagcttcacaactgactccacatgccccttcagcgtatgaagctccctgagcctgcaagtgtagcatcaacagcaagaacaagcacatagttagttagctttacatcgttttcacgccacgtgttccagggggatgcaaattggcattgtgcagctagaaagggagatgcttcttgatcttggaaggaacatggcaaaagcaactgagaattgatgcaatataaaggacatggtgcttctatatgattcttaaggtgacagatcatggaaaagaattatacaagtgtctactgcagatttaggtcctaccttgcaatctcggccctccgtttcgcctcttccgccatctgattcagctcactgtagccggtcttctctgggaagggcttcgcatccggtggctgcaggccatggagtgtcctatgtgcatgtgcccacttgagttccctctcttccttgccaaaatccttcttccttgtaaacgcaatctgtcgaaatcgatgggccattagtcacaaatgcatggaaattcagtcgaaataggtaaggagccaagacaactatgcagggtgcattagcattactctctgctcaatgacaagatcccatgctttcccactcagagcatatcggatgaggaacttgatgatatcgagcgggaagtagaaaacgagattgtagagccacacgataccggcccagccccatccaatgcctttgattgaagtgaatgcccagttagcataaacagctatcaatgtagctatctgcatttgaaggggaagaaagttagattaacacaattctacccagaagagaatttatcagtttgcggtaatagggagagagcataccagctgtgcaacgaagaaagcaaagacaagtagaaagccagggcgttcgataaatgaccagctgcgagaccttgtgacaaagataagagcttggctgatggtgctaacttgaagatatacagcagatgcaagcttttggtagtcatcttgagctgtcttctcaaggctgggctgcagg

SEQ ID NO: 39047 - DNA, 12789 bp, Oryza sativa
ggcatattcatatgcttataagccaaaatttaaattttcaacgttaaatttggagctgattttggggttttttcattgaagtttatttttcagcctttgcttttagatcgctaagaacacatatataaaaattttattcacaaattaatttttgtttgcaaatattcaaaaaatatgccaaacgttgaggctggatatgttgtagtacaataaatgtttatatctggtacgatcgtacaagatcgatttattttgagacgtagcgagtatatacgatacgaggccaaattctgcatttgagccaaaggcacctagctatacacgcctacaccgggagaccaactcaatggaccgacgcaatgcaagaggcagcagcaactcgacacttcgacagcaacagaaaggtatgggagaaaaagaagttgaataaaaaagaacagttcgagctagaaatggttgtagctagttggagatcgagacagcaaaggtatcaggtaattttatagtaatcctgcctcttggtagagctgtccctcgtactaggaagctacgcatcctttcatccgcatcaaaacttcagattcgtacagggaaattaaagtgttttctcaaggataccatctcgtttatataaacatgttagctaaatagttacatttttaaaaggaaacttaataagatatattaatatgagataaacacctacaagcctttaaaagaaaaagaatatagctgtaaatttacgttaactagtttcggtttaatttgttctttcgctgcaacttgttcatatactactagtatgcatcatcatgcagtaggagtatgcatgatatatatggcccctttctttcttcatttctcatctctactactcactgatcccatctctcgacacgacgtagccctgaagcaaagctccctccctcactggtcgtcactgcctccctctttctaccccctgctttgatcgatcgaccatgcatggcaaagcatcatgcgtgcacactgatgcttcttaccgatcaaattaagttttttttttactcagatcagctcatatcattcatcaaaaaactatatttgattgattcctgtctcatttttttcttctctctttctctgtcgatttgatctcattgcaattgcgtagtagaccacttcaagacatcgacctcttcttatccctcctctcttcctcccgcccgtctctctccaccatttgattcacactatatatatatatatattttgcggcttaatttcccttgtttctttatgcttcttgttcatccaagctaagctgagctgagctgagatgggcgagagatgtagaagtagatagaattaagctagctagagaggtagatatatagctgtggtgaggaagtttccagaaggttctagaagatcgccatgggcaacacgtgctgcgtcgctccggctaccaccgatgaggtgggcgcgccgccgcgagatcatcatcacgcggccaagaagtcgccggcgccgtcggcgacgacgacgacggcgacgaggcagaggcatggccaagaacccaagcccaagcccaagcccagggcgagggcgaagcccaacccgtacgactgggcgccgccgcgggtgctgccggcgaggggcggcgccgccgcgtccgcggtgcgcgtgctggagggcgtggtgccgcaccacccgcggctgcgcgtcacggacaagtaccagctcggccgcgagctggggcgcggcgagttcggggtgacgcacctcgccacggaccgcgcgacgcgggagcggctggcgtgcaagtccatcccgaagcgccgcctccgcaccgccgtggacgtcgccgacgtgcggcgcgaggtggccatcatggcgtcgctcccggaccacccggcgctggtgcgcctccgcgccgcctacgaggacgccgacgcggtgcacctggtgatggagctctgcgacggcggcgagctgttcgaccggatcgtggcgaggggccggtacacggagcgcgccgcggccgccgcggcgcggacggtggcggaggtggtgcgcgcgtgccacgcccacggcgtgatgcaccgcgacctcaagccggagaacttcctctacgccggcaaggccgaggacgcgcagctcaaggccatcgatttcggcctctccgtcttcttccgacctggtcagcttcttcccttcttcttcctctgcaatgcatgcacgcttgaacaaaacttttttttttttgcctctcttccccatttaatttttttagaacatattctcaaaattttttagtggtagtagatattctcaaaaatcccattcaaagaatttttttagagattttcagtacctcaaaaaatcccattgcaagaaattttggagattttcactatatgaaaaattgatctgcaaataaatttggagcttttcacaataatttttcacaatctcaaagattgaaatgtaaataaattgggagctttttcaaaatatcaaagatgaaattgcaaaaaaaagaggatattttttccttcacaatgtcaaaagatctaattgcatgaaaacagagattttccagaaatgctcaaactagttttgcagttgtttttttgggttgcacgtggattctttgagaattataatactataagcacagttgggaatagttaattagtcccctgctacaacttttcaaaagatcccttctgttataaaaggtgaaattttatcccatttcttaaacacgttatcttttcacgggtgccaaatcataaagcacaaaacacccccaaatgatcaatgggtaggtgggagtacatataaaacctcagtagagccttttatgtttttatatatgaaaaacatatctttaagagaaattttatggtacttaaaagaggtgctctctccaatcatttgtacttgacgttggaagaaccaatcgtaattctgttaacgtcaaatataaatgaaccgcgagggagggagaatcaaattttgcagagagagataccgaaaatacgatgcctcataaaaaaccgcaaaatcactcgtattaaaaaagaatcataaacatcaataagaacacattatttctaacaaaatgtgaacccatagttggtcggctaaccaacccaaatttgaccccctcccttagtaaatttggtgtgcagtgaaaatagaacaggtcggcgtttcggtgccctcttgcgcctgaatttcactttcaccggtggaagaaattaagaacagtctgcatttgaaatggcagctgatcgtgacggtgagccgaaaaaccgagccaattctgcccgaaattttcagagaaaaagtctgtggatgctgggtcatcagatgatgctactcctctctgcagacacgcatcacgccgtcccctgtgtttagcttactcggtcagtgagttcgtcaacctaccacaaagctgaatttcttttttaattaacgatagtagaaaagaatataaaagtataacctgaatatttttattttgaaaaaaaatggattggaaaaccatgtgtttatatctagaccgaatatacgcagccacgaaaaacagtgattaaaaaagagaacaaaatcaccaccacacgccgagttttttttttccatagttgcgtccagactgttaagaggtcgtggtcggcagcagattgctgtcaagatcttaattaagataagcaagatcggtgtcaaggatcttacgataatagacgactcgctcttgttgagtcctcaggggagaaaaaaactgtcactcttgttcttaattattgttcctctttgatgttgcatggccgaatagattgagctggacagatcatttcagaatacagtcaactcgtaccgttattgcttggaatgtaagaatggtggtaaaacatatgaatagcaaataagcagagttttaatataaatacatttgcataacaaaggatccgtataataaaagaagtacaagaattggatcagagagacgggggttgttttaaccttactccaaaatattaatgcattgagcagtccaaaggaatttcatgagatttttagatctccaatcctttcctcaaataaatggaaagatttgaattctacaaaactccttgacaagtcctttgttataaacagaggctctccattttgcacattcatgttcaagcaaaaaaaaaagacattttgcacattgacatgatctttcaaacataatattgaccatcactttgcatcataatatatacagtgataaaattccagtgtattttgcttatccatcttgaacgtttaaaatggatttttatttataccttaagtctaaatgcatatctaaagcatcaaaatatggggttaagtatacatttgtggataaatttgtactaaccacagtacaatatttgtgacgagatagagcctagtgagagtgtgactctgagatgggccggcctacatgcaatctgtgcagataggcccagtagatttcatacggcccatgtttcaaatccagccttttcttcaacctcaccaaaaaactagttatacatttgttgtcaaagatgtaattatagcacaattgtgttgtaactatattataatttagtatcatgtaacttgtaagtaactttcaaaaatcaataggcgacatgttatttccatgaaatggaggtaatggaaccgaattcccttacatgcgtgtgcaatgtgattttttcttatctaccttgcatgaattttaaagcaaaatcgaacggtttaaaagtatgtgaaagttacgtacaaattacattatagttacatgtgtgattacacatatttacatttgttaaatttttatgagaaaatttgccgataaatatacagaaaaaaaagagaaaaaaaactgacttggcaagtgaaaggaaacaggggagaggttcagggagatcgtggggagcccgtactacatggcgccggaggtgctccggcgagactacggcccggaggtggacatctggtccgccggcgtcatcctctacatcctcctgtgcggcgtcccgccgttctgggccgagacggagcagggcgtggcgcgcgccatcctccgcggcgccgccgacttcgaccgggagccatggccgcgcatctcccgcgccgccaagtccctcgtccgccagatgctcgacgtggacccgcgccgccgccccacggcgcagcaggtgctcgaccacccctggctccaccacgccgcccgcgcccccaacgtccccctcggcgacgtcgtccgcgcccgcctcaagcagttctccctcatgaaccgcctcaagaagaaggccatgcgggtacgtggcgtgcgtgctctgctcttgatgtcgtctccggcgacggcgagcccgtttctgtgtctgaccgcccagcgatgcacgcaggtgatcgcggaacacctgtcggtagaggaggtggaggtgatcaaggacatgttcgcgctcatggacaccgacaacaacggcagggtcacgctccaggagctcaaggacggcctcaccaaggtcggctccaagctcgccgagcccgagatggagcttctcatggaggccgtaagcttctttacccttcttcaagatagcaatggcggcaatggcgagttcttgattttgcattggcaggcggatgtggatggcaatgggtacctggactacggcgagttcgtggcggtgaccatccacctgcagcgcctctccaacgacaaccacctccgcacggccttcctcttcttcgacaaggacggcagcggctacatcgaccgcgccgagctcgccgacgccctcgccgacgactccggccacgccgacgacgccgtgctcgaccacatccttagagaagtcgacaccgacaaggtaaacacacacgcttcccttccactactccatttgcaacaaaaatgttcttcaattcagctctatctcttttgaagcctagccagatagtttgaactccactcagaattagagtgaaattagttgaagcgctcttacaaaatgaactggagaaatgtaactgggtttagcctcctccacaactccacttcaaactcggctctcggagttaaatttaggcgttagagctctcccaaataaactctgaaactgatcaatctctgaatttgcatgcaggatgggcggatcagctacgaggagttcgtggcgatgatgaaatccgggacggattggaggaaggcgtcgcggcaatactcgagggagcggttcaagacgctcagcaacagcctcatcaaggacggctcgatcaccatggcgcgctagctagctcgacgaattcagtcgattcaggcttgagaattcattgagaatatgaggtcgatgcaatgctcgaattttttttttttgatgcatacttcattcgaatttgaatttgggttttccatttcgtccaatttttcttttgtacaatctactgtagatcgatcggtcgtctatctgaaccttctttgtgtaggatgtgttagtgaacgctgggattgtttcagcattcgttgtacgtgtttgaaattgcgtcgggtgtaattatgtggtaacggtggtaatcaagcaaatttacagcaaattcattgtgatgatctgtactaatatgcatatgaaacatcaggttattcacacaaaatctcttgtcagcttttctcgtcggcggtagggaggacacgctcttttttcatggcgccgccgaaataatctcctcgttggacagtttcactataatatcacgctgcacatagctttttttttttaacgaccacacacaagacagtgcgaagtttcatattcatcgtaggcggatatagagggtggtccggggaaaaacggcgatggacccgtatatattaagaaaaatgaaaatagcgatttttgaaaaggaaaaaaagcgatctaatcctcttcctcccgtcgttcccgagtcccgactcgcggcgcccacaggcccacacgcgatcacgcgacgcgagtcctcctcgcccttcgccgcgatctcatctgatcactccacgtcagacgtgacgcgacgcgatcagcagccagacaaccaatcacagggcagggccacggcgccagcggccagcccacgccggcacgcgcgacccagcggccagcgcccgcgcccggcgcccccacggccacgccgccacgcgcgagtcccgcactctgccgccttggccgctgctgtgctgcgtctggctggcactacattggtgctgacctgctgtgcgtgtgccgccgcgaggagccgtcgtcgagctgatcagccgcccgcgccaacaaggcaacaattttaggttttctatgtgtatacgtttttcaatttttagttttaaaatcttattaaactcttatgcattgtgatatatcatggtaatttttttacaatttggtctattctattatctatacttgcattgtatatattagtatcgttagatttactgtgtttagaaaaaaaaattaggtcggaccacccatatcctaaatgctagatccaccactaatattcttgcattgcacgtagctttgtttttgctcggcgtcctggttcaccatggcggcgagcttccatgccgctctcctcctcctcttcttcctcctctcggccgtggccgggcgagaccaccacctggtggtggagaagtacggtgtcagcatgaaaggcgccgacggcgacgtggtgcaccgtgcacctggccgtgcacaaacacgactactccttcgctggcttcgccaaccgaagcggccattggcacgtcttccccggtaatgaggacgtcctccccgacaacgccaggcgtctcccgttccgcaacacctaccgcgaccttattggcggcctcgagaacatccccggcctgccgctcaggagggcggcctcgctgcgcgccatcggggcactgtcctcctacgacgccggtgccaccggcgaggaggcgatgaggcgtggcgtggcaacactgtcgatggtgctgacccaagccctgcggctaaggccagtcggggagaccgtgtcgagcaggtgggagagcggtgaggcgcgcgtggcggcggagcacctgccgtacatcgagcactggtacaccatgtcgttcgaggtcctctggtggaggcgcaccgggaggtgggacagcccgttcactgagctgctgaggaggcgtgccggcgaggcgctcgccgtggtccgtgtgatcgcgaacaagagcttcgtgcagctgctgcgggctcacagccacggcgcctgatgctaaattactcgggcatcgctagctggcgcgtgagcgtcggcggtgctcgttttttcgagctaagtagttatactaatctattagtatattagataataacagtttaggataatgatggtagtagataagattttattttttctgtgagatttttttaactaacaaattaaaaagaaatctacatgtgaagttacagtttcaaaattttaaacctagatttgaaaactttcaactcgaaatttaaattttttaagtcaaatttgaaaactttcaacctagatttgaaaacttttaactcggatttaaaaactttcaactcggttttaaaaactttcaactcgagatttgaaaactttcaactcaagattgaaaactttcaactcgggattaaaaactttcaactcaaaatttgaaaactttcaattcgagatttgagaatttttaaattaagatttaaaaattttcaagttaagaattaaaaactttaaaaaaaattaaaaacacttgctgctggaagattaaaaagtaatcaggaaaaaacgcaaaaaaaaaaaggaaagcgaaaaaaaatcacggaaaaaaagaaagcgaaaaaaaaggaaaacggcggtggttaccgaagaaaaaattgcgcgcgcgtgccgcgtgggccgggagtgcacgctaccggcgcgcgcgagaattaggattctcgaaattactctggttgctgctttgctttgctttattgatcgtggtgcgtggctgcgttgctgcatacctgctgtttctctgaataaacgtatctctagtgtagtagtgtatccggtgcggagctagaatgaaattgaggagtgtgttacttgtttaatttactttatcatggatcttgtttaaactggtacggatgtttaagtttgtattgagtggatgtacaaaatatactagctataggttaaaaaaaacctggtcactcggcaccccttcgtatgctcaagttccgccctgactgtactagtagtagtgtctcagcgttcggttactgacttcgtgtgtgtttcgtgtttccattccgaacagacgatatcttaattttactgtgttcgagtccctgttgtttttgagatcacgccatgttcccattcaagacatggccgacagagacgaggatacaaaatagacttattttcagccatataagagaggaaaaagtacaccgaaggtccctcaacttgtcatcgagttacaaaatcgtccttgaaccacaaaaccagatacaacgtatctctcaacttacaaaaccagtgcaaactagatctcctggtggtttttaactctgattttatccgatgtggcagctgactcagtgcgggacacacgtggatcccacatgtcaacctcttattccccttacctcatctcgcgaacgagccaccggagcagctaaaacttccccgccgatgcaagcgccacggcgagcacgttgtactgccgggtggtccgccgcgcgcgcagcgacaggaggaggcggaacacatcgagtcgtcgaccacctggtccacgaatcccgcggaggcgaggtgctcgatgacgacagtgtaggtgcaggcattcaggagcgcgccttcgccggaccatggcgcggaaggcctccacggcgacggcatggtcacccgcggcggcgggatctggcgcccgtgccgtcggcggcggcggtggcggcagcatgggggaggctctcctgcttccgcgtcgtcgcctcgtcgcgcggccgcttccaccgccgcctccttgccgtcggactcccgcctcccccaccagcctcctcccacccgtcggctgcgctgccagtgcccagtgagagaaaagaagagcagagaggaagagaggtggagaagggaggggaatgagaggctgacatgcaggacccgtgtgggtcccacgctgagtcagctgctacatcggacaaaccggatcaaaaccgtcgagggatctattttgcattggtttttataagttgagggatacgttgtatctggttttgtggttcgaggacgattttgtaactcgatgacaagttgagagaccttcggtgtactttttcctataagagatgacccaacgagattagggaggcaagatatactttatttaaggaggagcacggtgggttttcgtgtcttcgggtcggtccggcacgacccgagtcttattggatcgtgcttgggctgatggtgcagcaagtaggtgggcatggcccggcccaccgtgtaggtcgggtcgtgccaacccgactgatttcagcccgggtccgatcgtgctctggccgtgccggtgaagcaccgaagactatcaacgagagcctggtgggccgtcacggagcggcttgaggcttcccaggccatgccctgtggatgggccggaattcacaagtccgggattaggtgggtggcactgatcagagcaagctccggcgacggcgagacgcccgccgccggcaagctacctcctgttcaccgatcacctccggcgcgcgtgatctcattcctcgatggccctgacttgattaatactccatccgtttctaaatatttaatttttttaaatatgtttgactgttcatcttattaaaaaaagtaattattaattcttttcttatcatttgattcattattaaatataattatatgtatacatatagctttacatatttcatgaaagtttttgaatcaaacatatgctaaaaagacaacggtattaaatatttagaaacggagggagtaattggcacactgaattaagaatatcgtcaggaacataaattctgtgcgctagaggctttgctgaggtacacagcgctgcattactttttttcgccgggtcctactctgtttttgaccgttcaattgtattctcgatttgttaaggctcagcatcttttgctcagcttataagacgctgctaaaatttaacttttataaaatatgattttgattttttttgtcatcaaagttaattttttaccattagtttttaaatcgtaatgtacacacacatattatatataagttttgtccgattcataagttatgaataatcaacatatgttcgccatttatctctattgtgttcatttgttattatgacgggaagatcttgaactaaatagcctggaatatacgtatatgatgaaatggactttttataactaaaacaatattattataagcacactaaaactcactgtactctgcatgtatataagtagaaaaaaaaacaggtgaaacaatttcataaaaataattctcataatttcttaataatgtcacattatccagctagccacatgcacgcagagatggaatccagcggtggttcctttcatggcacaacgtgacaaatacatgaaagaaagaagcaaggagaatcatctttgatctctacgtgtccattactctccgtaaaggtgacaacgatgatacgagaattatcacgaggcccactgctgcacaaacacatggcgattggcgccttattcggggaatgggaatggttaataattaagggcaaatagttaatacagtcctgaagtggatccggatcgtctgccgtaatgcagaagagcactgttcatgtgaggggaacagcagctaatgccatgaacagtgtctattttactgtagctacaggattcaaaacactgtagtacactatttggtactgttccgaatttactgtagcacacaatctggtcctttcactcttgatccgacggtccacagttattctaatgcgtggtactgttcatcctctgcattagtacctctaatgcagaggatccgaattatcctgaagtatcgcttcgagtttattttagtccttgaggttttaaattgtccaaacaagtcatctaaattaatcatttagattaatatagtccttgaaaaaaaaagtgtcacgtgagtataccaagtcatcttcgcatgcagtgctatgaatgaaatgaccattatacccttatataccatatagaaaagaaagaaaagaagaagataaatggttcacgcatgtatgattgttttagaattgtcacttacgattgctgcagccaagcactgatcacgtaaatttctttgtcagccacccattcgcaacaatgctgacatgggctggcctgtttttttatttgtcttttcttttttttctatatggtatataagggtagaatggtaatttcattcataccgctgtatgcgaggatgacttggcatgctcacgtggtattttttgtgggttcaagtattatattaacccaaatgattaatttggaggacttgtttagacgatttgaaacattaagaactaaattgagccaaagcgaaatttagggagattggctattcatccataattaacgtgcagtgcttatcgctaattgattttgcttcatttattcgcatttgtcctaatcctgcatatataaaaccaacccaagttttagcgagatgtagttggcc

SEQ ID NO: 39048 - DNA, 34816 bp, Oryza sativa
  unsure (1)..(34816): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggcgtagtagatgtgctcacagacgatcaattgcagaaatcatcatgtttgtgtgcttgatcgggtgatcaggccgaagttgcacacagcggaatgacgaaatcgaagccggatgccgatgtcggagacgcatagatgtcgacgaggcggtgggcgacgcagttttcacgttacgcagtatttctctcctcctattctattcaacaaacagattagcttggttctcggctcaacccctcacggcccgtttggttggagggagtttttaggagggattgggagtttagagggatgaggctattaagtgttttgtttggttgggaaacataggaattttggtgggatggggatggggaattgaggaaggaactccctccttttcaatacctgggtaggggcaggtaattgggagggaattcctcctttactttttctaagcaaatctcagccatccgtttttattaatgacctaatctccaactaaactccctatcaatttccatcacctctaccaaacaagatattagaattaaaaatcaaattctcatcttaatttcatcatcaattccctcgtgtaaactcccaatccccttccctcgagttaccaaacaagccgtcaggtatgattaatttgacttcatttagcttatcctagtactaatgactaatctctaaatcatatctttgcacctattcctgttcctgaaatatgctattcccttctcagatgtacggctgaaaatttgtagatctgaaggttccaggttctttgatctctaatttctacctattgtcttctttgcctagaaagtatttatcaggaagtgagaaaaggaaaaataaagaaaacgtgccgatgatttcatagaaacacaaagaggatccattgacaagttttttagaagtagtacaagtttttgtgtggaacaacctaatgatcatgattagatgaaatcgcttccggtaactaatgtagccatgagcccatatgatgtgaccatggctactatagatataaccgctgctcacaccaagataaagttgactaagttctggaatccaattcagccacctgctaccgtgctgaatttaaatggccgccaaatctgtatacgagctatgttttcggtccgtgagtacttgatggaaagctcttgtaatcctctttccagcggatccggcctcatcactaaatttcattcccgtcatccacaatcatagaaaaaaagtgttgcgtcgcttatattggaccaatgggcttgtaacttcgtttgaggtccatgtggggtgcgccccaactaggtggagcacgaccttagggacccctaggtcgtcctctcacttttataaatagctaggtaccccttcaaggtttcttgggttttgttgagattaaagtttagcttcgctactttgccgtgtaatcccgtgatcggttagatcgtcggtttgcctgttacgaaaccccggcttatcatttgtattcaattcctttttgcaattcaaattgctttcatcttgttattgtttgttttttcgatttgcttgcaggaataaggttgagtcacaccaacatcaacacatattctcaaaccaatttcattgaataaatcatttgcaaagctaattattcatcacaaattattaatcatgataatgattttacaagggtgacaacttcttgtaacgtgacgagcaaagcctccatttgctctattgcaattgttgagaggcgaggtatgaagcagtcttttaggcaattttggtcgactgaatgtgtgtatagtgcttcgaagcgtaccaacagggtattgtttcggagccaattgtccctgcagaaagaaccatgtgttccaacccctacttgtaccctcgactgttgttgggggataggcagtagcttcattctgaagagattgccagtgcggtccatatccaattggcccaggacgattcagtctgctacagatgaaaaatcctcttgattagtaattcattttgcattttgagatttttttttattccccaaaccccctgtccttcggccgacatacctgttcccaagccaccatgcattgcgagcccaaacatgtgtcttctcctggccagaggaacactcttgtctttttatccactgctaatcacactggccggaagactgaaagcaaacatgtcaaaatttttgttctcatttaacacccgagcccacatgtcagcctctttccccattcgtacaaatgagatatggggctgggtgacggaggaggcagacaagtgagcccggatggcaaatgagaatgaaaatttgaaagtgacatttgagcatgtgtattttgggaggatggtaaatagtaaattctcccgcaatcataggttgcagatcatgttagaattaaatgggctaggcccaaattaattctagcaaccccaaagatccataattaatgttaagagattaataccatcttggaaaccaacgagaaagacctcaacttaaatagattgctaattgagaacatctgttgattggttcagatggtggttggactgccacacgtgcatgcgccgagctgagccaaggcgagtcgaggcaaaagcataaccgttgggcatcaatggtgaagttactccggtaacggacgagaccataatgcgccatcaatcccataacgttatctcacatctccggggtagacagagggtacacttcctctattccatttcattggttgttcttctgttcttctcggttttgagtacctgcgtgcatgggtaatcgaaatgagtagggcctccggaactccgactacctgagtattttctacggtttgcatcttttccatttgaatcccaactccatagctttttttgagtattttctcccatctctgcgaggcatacctgagagtgccacccttcttagatctctttaggtatttctatgaaccgaggagacggatgccctttcctttgcaccttgcatgttcaggtacactcatgtcaacttcttggccacacagaagacagattctctatcatttccggtgctcttctttgccgagtttgacaacgagaagaccgagggtgaaccacctgtcttttgttgcaaggtggatatgcaactaccttgtgcaggtaattaagctttccatccatacatgttaattatgtatgcagataatttggaaagcatgtgtgttaaaaacattggtaatgttgagtacaataccaccaaacatctaatgactttcaaatttactcccaacaaagtagtatttacaagctaatggcatgcaaatgtataagataattatgattaaaaagttatttattatctacatggaagtgataagagagacaaaagacagaataatcacagagaaaatgattaactgaaaaatgcggtgccatatttttttagcaaacctgataatgataatagatatttcttttaggaaagataattagttatgctccctccctcgaactgagatatttcctgtgtattcaatcgtatacacgagggttgtcttctcctctgctctatctcctagacaggtatgaaagttgaattcgaaaacctggaatgagcgtagggatatagatccttcaacccaagagggtatgtatcccgtagcgagtggaatggaaaggttttggtttatcagttaggtttgtacacttttcctgtccgttaagggaaaggtaagtagtataaactaggatgaacccccaagaagttttggttcatggtgtgggatgaatatggtttcaagggcttaagctatataattaactagatgatgccccgcgctttcctgcgggatatatgttagataatggagaaataatgaaatgatttggaaatgataatttagcatgtgcatgtttaattttaaaatgaaataaattttagatataattagtatatacttttggttgcgtgcctatgggcagaggccggagatgtaatccatttccattatctaaaaaaaattactatatgcttgcatgtcgagttttgtgtgcttaatgggttgatatggcatgcatgcatgtagcttttagtagtgataataaatactatacttgtgtgttgagctttaagtatttagtgagcattaagtttataaaaagaagagattataccccttattcatactcattagtttttcgattcctttcatatacacattagataagtcaaagtcacaattatattttcgttgctcaacaattatttttagaaagtcaatacaacgattgaattttccgataatccgagtattttattttgaacagaacatgtccggcgcctgtattgtgaactgcaaggagcaaaggttgtgcatccagcttttcaaaaatttcaaggtggagacaaagaattcgaggaggctatgtgtgaaaaacattctcatcttgcaaatgatcaggttttgtgccgtaacgattatcatgtcctgagcctagctaggtgggcatgacgaggatttcatgtatgtggatactgtagcctctgaatgccctccttttgcagatgattactgagatggagtttactaattgcactttgcaaatattaattgatgcaacatttccttgagtatataacagccaagctagcatgaactccttgagtgtataacgtcaatgttaattagcatgtattatagttcaaaggttttttctactgaagatatcctatcttagtataaagttatcccccactaactccttaagcttaacatgcaaagatgctacaccatcatccactaacaagatgccacatcatcatacactaattaacaagatgccacatcatcatccactaacaatcatcacatttaaatatcatgcaaacatgctatatctttatagtttttataatttaagagcttttcaaatacaaacatgttaaattatcatccagcataattcatataatgtttcaatgcatatatttattatgttttatgatattctatggtccaaattatatttctcattttttcctctaattcagttggttttagcctttagatgattaatctacggtccaaactatctccctacttttcttcttccataaagtcataccaccttactttttacgtttgaatcatcattttacatactatttaaatttatattatcataaaccacattaatttacttaatctgatgttatctaactatcttacacttttttttattgttatcgtactaaattcctgcagcaatacgcggggtttcacatagtaacacaaacacttgtgtcttttctgccttttcctaattacgagatcagcaatttcaccattttggctgtgtttgtgctcaagatgccaaatttcaccatacaaatcaggcatttaccatattaccatccatggtacctccaaagcatgcatctttttttttaacaaaaatataaacaatgtacatgtacattaggaaaaaaaaacttgtgattgcaggttggcaaatctatcacataagttaaatgccctggtcttcaaaatctcccccatacagatcatggcatctgtaatttcaaaaattctgaacatattgattactattattgcagtccaaaatgaaatcatatgaagaaatcagatgatcataggcaagacgaaacggtggctcgtcagtcgtcaagctgtacgattaaactaatagagtgatgtgtatttcactttcatccctttagcatatacctaatgaagattctctaaaagccagcagatagatagcctggtaaccacagtatctgcccatgttgcttctcttttatatatatattgtccatcataggaagtgatgaatacaccgcatctgcataaaaaccacgtcaggattcactataaacccatatatgttgtgccaataaagtgcaaaacaactgacaaggcacgcagtaatcctgcaaaactgtgtgtgtctgattagtggagacactaacaataatacttgtatcttcttcagaaaccattcaatctcaagcacacctggatggcatattctctcttcaattttttttttcagtcttaaagaactctacttaagcagctgaacagatttcaagaaatacagactagcttgagttatcacagtgcagtgtagtagtgatcagccatggctgttgcactcgcgctcttggctgccatgtcggcgctctcgtcgtgcacaagtccggccaccgcagagctcacacggcacgagcacccggtggccgccggcgcgccgctgcgcctcctcgtcgtcggcgactggggccggaagggcggctacaaccagacaagagttgcagaacaggtgattttgctttctttgcatcaaacattcattcaacaattcaatcagagaatgttaatttgttggcaccgatcaaaagaagaaaagagaacaactgtatatcgatcagagaattttgtttgtttgtttgtgaggagttagatggggaaggttgcggaggagacggagatcgacttcgtcgtgtcaaccggcgacaacttcttggagaacggcctcgccggcgtcgacgacatggcgttccatgactccttcatggatgtctacacggctcagagcttgcacaagccatggtaccttggtaatcaccatctaaacctaattaatttccatttaatactatactattagatcatatggatttataaacttactatgtgtttagaactttttttttctttgacatggtgtgtttctacaactttagatggataaaacaagtcagaacaaaataaatgatatttacattctccttaataaaggagaatggtcgaatgtcccgttgaaaagtcaatatcattatgtatttaaaaagggatggagtactaactaaaggttatcaattgttttcagttcttggaaaccatgactacaggggaaatgtgctagcacagattgacccagctctgaggaagatcgacagcaggttcatctgcatgagatccttcattgtcagtgcaggttggttaacacatcaaaacccacaacaaaccttgtttcttttctcaacatgcagcaattaaaatctgtgttcatagctagaatctttgcaaatttacaatggaaatcttttctgattaatactagaatccactgaacaaatttataatgtccttttttctgtaaggaattgtcgatttcttctttgtcgacacgaccccgtttcagctccagtactggactgatcctggagaagatcactatgactggaggggagtcgcgcctcgggatgcgtacatcgccaatctcctcgaggtcagttcctctgatcaatatccactgcaaaaacaatccgctcgttgcatcagcaaaactctgtaatgagatgactgtctatatgattgtatcacctaggatgttgatgctgcaatgaagaaatcaactgcaacatggaagatagctgtaggacatcataccatgaggagtgtgagtgcccatggagacacccaggagctccttgagcttctccttcctgtcctcaaggtaacactgataaaaagtagtactttaatcttctaccaattggtttcgcatatgagcattcgatgaaatttacgatgatttcacaggaaaacggtgtcgatttctacatcaatgggcatgatcactgcctggagcacatcagcagcagaaacaggtgagcacactaataccttgtgacacaatagaggaaagaagggttcaagaatcttatgttcttcctcctctcttttcagtccaattcagtacttcactagtggaggcggatcaaaggcatggagaggcatttttcaacaaaacgaagacaagctccagttcttctatgatggacaagggttcctgtcacttgagctcagtgagaaccgagctcgattcgccttctacgacgttttcggtgaagctttgtaccactggagcttcagcaaagctaatctgcagaaggttcagtcctctgctagtgtaactgaagaatgagagaagctggagccttcagaatacattcccacacagctgagtagatgtctacctgcataattctacttgtacaattatgtcacattgtgctcatcaatactggatttgctatgaattagcaagtgtttgattctactagagaaagatcacagaatgaagcaggtgtttttgcacgaagccaaagacaatcactattaaatagggttcacatctgacttgaaggagcttcaggcatcagttgacacagaaatgaattatgcagactagtgatcttgtcttcatacctaataaagctttaatgtcacagcttaccatggcatgtgcacacggtaactttagtgcaaacactataccagtaatactgaattcacttcaattattgtcggacgacataactgacaaacacatctcccacggtaggatgcaaatttcagattcgttatgcaacaaagatgacatatatagcatcatatacaaaattttctttcgaatttctcctcaaattgcactccatgagcaaatgggaggctcataacatacaaaaattgatgcttaagctctgaccaaaaaaaaaaagcatcataattggtcccgctgctctaatgacgccgtagagaagatgaagttgtgtggtgagtgcagttttgctttcagatagctacaatgttcaaaactatttgatcttgagcatcacgctgtcgtgcaacatttccaagagcatagcacttactcaagaatatagcctgtgtttggaaactcctgtaaccacttggacaaaaagaaatttcaatatcttcagctatctacttttaagataacagagatcttgtagccagcctactttgcgacaacattctgctcctctaaacctccagttgccttggcatgggcaacagagctaccaccatctgaactcccattgcactttggcttagcttcagccatatcatctttccttgttggtttggaagaaacactaccattagccttatgtgcacgagcacttacaccagatgaagaggcagatgattcttgtggaaaaaatggtttagcatcagcatgttttacgcccaacttctgagctgggggtggattgcctgatccaggaggaaggaatacccctgtaccctgaagaggtaaacgaggtgaagcgggcctgggagcagcttctgcgatccatgcggctgtactgtttggcaatgtgacagctgatgcaaatggaacagcttttggagtgataggaagtggtgcaacgaaaactgtctggatgccattggatggaatatggtgaagtccaggggttgaaactgcaggtactctattgctagggttgtagacaagctgtttaggacttgagggatgaattgctatgttccctggcctcaatggtgcagcccaaggcatcggaggaggtgtcaatgggggagtgataagcaagctgctttccgactgaacgtgcttccttgacacagacttcccaaaacttagtaagatacgctgcttacttgtagcagggagtgcccgttttgctatatcagcgctctttccctcaaaaactagaacagacctggaatcaacataaaacgatcattaatttagaatggtcagcttgcccatcagatatgtcctgtccccgagccatggaggtaatacacatttactcatattggtggatggcaataaacaaactagatatacttttcatgataaatgcgaactagaaaacaagaacagagcaagcagcacatttgcattaatgaagtttgactggcgtacttttgtttactacttttagaatttttaccctaattaggatatccacttcagttaagaatgagttgatttgttcagtctaaaatatggccattgaagtggaacagatgatgcaaaaacatgataggtagacaggtaaaaggtgtgacaagtaatccatgatgaaatattcctttaattaaagaaagatggctgatttagcatccttaccctgtagagagtgagagtttcagtggacctgcatgatcgcctcggctatctgctgcaataacatggccaaataccatgtcgcagtcagtcaggcagagtgtacaaatgggtctaccataccaaggaggatgatgatgagggtgagaataatctccctgaaaatagtaacttaatcagcatcactataaacttcagaaagaatcaactcctagcccacttcaatgagaatttacctcattgaagatatcgataacacagtaatctggactggaagggacaactttctgatgaaccaagctatcaaacagattttgaagcacaccaggaataggatccacctttacctctgcattccaatcccaagacagatgacaggtcataaaatcttagagctatcatgaatttacaatagagtaaatattgacaacctggcttgatgtacctcttaaatgttcatcttcaggagggccttctgtgatgggaagaccaagctgaataatttctcttccatgacccttcattggccttttggcaactacaactgtttgccctgctttttatcatagaattatataacacagcacattttacaaagatgcactgtgaaggtcagacaggacactatctgctgacactaaaacgaaatgctggaggcagtcactatgatgcagcaaacaacatattgtctaacttttcagaccagcgcaaccccatacagaaaacaaaagggggaatgcttcttccatagggtcaatagaccataaaggaactcctaaggctaagatgaaaatagacaaagttgcgacgatccctatggttgcataataagtacatacatacatatccaaaatcattttacataaataggggatctagtgtaaataatttgataaaacccgacaatacaaaagaaaaatggtgaccgtgcatctccaactcaataaccatatagagcaaaggaaccaacaatgccgtaccttccagtcctggtttacgccgcatagtcttagcttcattcacaaaagaaagaacctttcctatctcagttagatctacataccctttatacaacttaagcccctctagaacattcacctaaaaagaagcaaatgttacatacaagataataaggtaaacttgatgtactgaaataattacttcaaagtggaaattgggaatctgtccagagaagtgacataccatcctgccatcaattacttcattaaccacaaagcaagttgggactggaaccacattactgattacatgaagtcctatatggaggccaaacaagacatgaacatacaaaatgtattagatgtgattcaatcatccaggcattttgttgtattacacacagaataccagtatagctttaagaaaaatagagcacctttacaacctagttaactttacaaacagcaatttttgaaaactatagctgacatttcaaaagcaccaaatgcgcctcatagtcactgaaagaatgatggcagagcttgttgaggtataggcagtaatggaagagggacataggctgttgatgtgaccattgtgtcttaaagattatatagaatttagaacaagaagaaagcagtagtgccataaaattattgaatggacacaacacaactatgcgcccagcacttattgatcagctgatattgttgttggcatggctcactcaggtatattcaaatatgagaaaggaagccaagtcagatcaaaatagatacattgaatacaaggatcttgtgagctcacagacggttttaacacaagccatgaacgccatatacctttctgaggttgggcttctgtagcatgtgaaatatgagaaaccaactgagaattctgagttgcttcagccgatgtctccacttccttcacacctcctgtaggcaagaatacatgagtacgagattgatgagacccaagcgcatcaacagtaaagtgtaaagatcgagcatccataaatgcctaacataaagagcattaggtgcagactacattattaattttcattcccatagcacctaatgtgagttggtttggttcttctaagaatcatcatagataaagaagccgtttctgcggcatcaatcgtgcccttaaaaagtgtatcctcactaagataaaaaaaaagttactactccaattaattgcaattggatagattagacgcattcccttcccccaaaagtagttcgtatacaatgtattcataataaaggagagggggcataaatcacaaaaaggtgaataccactggcaatcgcagcatcatctccctcggcaccggcgctaccgctcggggggcgcggcggcggaggaggaggcggcggcccctggcgcgcggcggcgtggtgaagcgcgagggcgacctcggtgacggggaagtaatgctggaggtggaggacgggggcccagtggtgccgcctgcgctggacggcggcggcaacggcgtcgaacccggcgggatcggcggcgtcgcgggcgtgggcgaggaggaggtcgatgatggcgttggccgccgcgaactcgccgcgcagccacgcgacgaggccgtcccggccgtccaccaccaccgcctgctgctgctgctgcggctgcggctgcggcggcggcggcaccacccaccccggccccggcgcggccatcgtcggcgggctcagagcatggcggggcaatctgctgctagggtttcgccaattctgatggaatgccggatgcgatggatctcaccttgcttctcgtcactagtcagggggaggggagaagaagtgatgagaggtggttgggttcctggtgagccactgacttgtgggcccatggtgtatgacgtgtcatccccgtgttggggtgttggagagagaatagattaacttcgatcgaccgaacatcgatttcgtggaaggggtatagtttcttattgacgtggcgtccctatatgatcgtttctgatttttttaggattattgaaaactgtatagtcatgttggattactgaaaactgtatactcatgttagtgactatcaaaatggtcacaaagatggagatcattaccatctatgcaagcattaaatgtttaaatgctctaattgaagacagcctatagccatcacgtcgtatgagttatctacaacattagctcctgatgacatggaaatatattatagatagaagctatctatactattaaacatgtcttatatgttttccatgtgttttagtgattgctccatatctaggaaggggactttcttcagatttcccctatttacagtggtcattttatcttttctacaaactagtgcaaagaaggcttatatgaaaatttattcatttcaagggcaccacagctgatgagagacacggacaaaatacatatcatgtggtctttgtggagcatcatcaaattcgtgccatctgctgttcgttgtacctcagcaagagaggggaaaccttcgaagttgagtttacctgatgagatcaaactagcaaccaatttgactttttttaattaattagtaagataagactaagagtcgctctattaatagtcaccatacgtaagtgtgataattcagtcatcgtggatcttgccatgtgaaatttggtagccttagatggttgggaggtgggtcctccagccagtctttttttttttaaaaaaaaaaagtcgcctcatctatctgctcgtgtgtgagagcccatgcctgttacaaagcgtgggccagtacacgtccgcagaaatcccattctggcccatgaaaactctcatagtcacgtggaccagccacaatcccatcttgcccattaaatatgaggtcgcaggactagtcaaaattgaaccgactcatatatgaaaatactatagattaataatttctgtgtacaaaagaaagccctcatttgtcaatcgtcgtcgctcttcggtatatgatatccatttaccgtaacaacaacctaatgtagttagatttacctaaacttatcaagacatatagtaaccagttgaaacaagtgaattatcgctcttactgctcatccctcaactttagtttttattcattgggttaaactggtcagtacatgttaagtcacatggtatctaagcgacatagtatgtattagatgcctcgattatccgttctgatatcatgctgaattaaaaatgtatcaagccaattcaacctaaaagtttaaaccaatgagaaaaaggacacccaatttaattgtactcaagcaaccgtcgatacataaaatgatatccatataccgtaacaattatccaatgtagttagatcttttttcttttttgatgataatgtagttagattttacccaaacaaacttttcaaagttccctgggtgcgccactgctgctgctctgctggtcccttcaattcccttggatctctcatatcatatttgtactgtacatgcatgctgcccctgcatcctgcataccggggcacgggcacaggtgagaccacacatccacagcagatgcagagcagagcaggtaactatgtatgtaacccgttttctagttcatttctcacatgatacacgtgatagtatatgaagaaaaaataaactagaaataggataaacgagcttaaaaaaattcgcttgccagtcccacttgcatctctaccggtaacggctatgctacctattctattcgacatttcgattggagggatgctcgggcccagcgacagtgactaaagcaacagtgctaccactaacaggtggggacacaaaaccagtgcaccacgcctagtgcctgtctctgtctgtggccctccgatgctcacgagatgcacagaaatttttcagaaacacaggcaaaaaaaaaaaaaaaccgtccccacactgtcacaaagtcgcctaaccgcgtggttaccgcggttatcgggcttatcgcggggtacggtaatgtaaataccgcggtaacctacttaaattcaaataaatttaaaaataatttgaaattttgatgaattttgcacagttttgtacggtttttcacggttaccgcacgataaccgtgcttaccgccagggcacagtaaacccggtcccagcggtttgggaaaccctgcctccaatcgcctactcccttcgtaccccaaaatacagtaacattaggcgtatcctatcaatgtgtctaatctgattctaggtgttattgtattttagaattgagacagcactgcatagtactccctccgtcccatgatataagggattttaagtttttgcttgtactgtttaaccactcgtcttattcaaaaaaaattgtgcaaatataaaaaacgaaaaattgtgtttaaagtattttggataataaagtaagtcacaaaaaaataaataataatttcaaaattttttgaataagacgagtggtcaaacaatgtaagcaaaaacttaaaatcccttatattatgggatggagggagtataacttttacgatgtgtgattttgtttgaaaaaataatagatatgtacattatgtgtcatatatctacttccacttcgttccagaatgtaatgtaatgtgtttttagtttgattctatattgaacttttctgccatcgaccaaatgtacttagtaaagtacaccaacattttacagcatcaaattagtttagtttcattacagttcactatgagatatgtcttgatatatagtacttatttgccacggtatatgttaattatttcctataaatctggttaaagttagatagcatttgagttaggataaaactttaacaccttaatttggatggatgaagtaccgtttaattgtcagtgataatgtggtgcaaattcaggcatatcttggattcagaatttcaaatcctttcccacaagtttagatcgcctgctacttcagatgattatcagatccctaaaaagggagagtttcccattacaactgcaacatcaacatgctctattgcagtagaaacttaacatcaacatttgcttaatcaaataaaaagttactcatattggtagagaatgaactttagtaaaaaaatcatgatattagctctaactgcagcatagcctagctgcacgcgtttagtggatgctagaaatgaataatccaatcagtgttccaaggacacagttactgctactacatatatatgcatttcatatcatgggcaccatgcattattgtcatacaaacgttctacaaaatcagcagactacaatcaacaagcctaaatgaaatgctaatcttaatcaatataattaataacctaactctattcaattctaccatcaccaaaatgcaaatcaatctaagttgcctaccaattcatgcacaacactacccacataaattcagcaaaatcatcacataagccacacaaaattaagggaggtgagcacacactgagccaattgtgatgatcagaatgctagctgccacatcaacacaatgtagctaagatcagaatgctgaatcagctggaccacgacggtggcgcctagctcgtccatggcggtcgatggacctcgcctcgcccgtggggaggaatagctcggcctcagggccgacattgcactctgatggaggtgtaggataccgaagacgatcatagcagtagccgtaagtcatgtacttcgtcctgaacctctccatcgccgatcgctgcctaccagacatggccacggcattgtggatgttggcaatgtccggtgtgcacatcggtgcacgggtcaaggtgtccatagcgcagccatggagcatgagttccgaaaactctgcgacgaaaggggcgtacttgtagttcaccttgtaccggccaccggaggtagcccagctggagccatcccagattgtggcgtacagcgacatcggtttggaagggaactgaactcccatggatttggtcctctgaacctcccggattggagtctcatcaatgtagaatctgcagagagacatacagtgagataatcatatgataagaaccagcaagaatgagaatggggagggaaactaacagtgctgagaggaaaggaaaaataggaatagattggaacattctaaatatgcctgaaaatctcagtatttttttttgtgaaacaatgattcatccacagtagcatacatgcgtatatcgtaagttagaacagtagagtacaaaacataacatccaatataattgttggtccatgtatgtttcttggcattgaatggtttgttattagtcaaatacatagtcacctactttgttgtcttcaaaagatctgtactgcatacggttatgccattatgaccatgggaaatttcaaacaagtacttcaagagacagctttcctgacctgtactgttgatatcataagtactactaaccaacaatgtcctgaagttaggtgctcaactatacaaacttccctagcatgaccacaagtaattgtgccaagttgtacattttgattttgaaaccccagcatattaaatttctgggtgcaaattcccctaagctgtgctgcattttgagtctgtggtttcaagaaagggaagggatggaagatgtcattttggatgcatgaacatgaacatgtgaaagcacatgatgaaagtggttgtgtggtggtagaatggtagtggtgacaactttttcagtttctcttctctagtacatgactccaaaagttttgcctgtgactgatcataatagctttctatcattgtcgacaaagcaggtttgcaatgaatggtagaacaagaatcttggcggaaggatcaggtggaggatgatagatcatgcaaaagacaaaggatggaatgcttaattaaatgcggaaagtaattttatgcagaatgaaatgtggtgctgacagagatgcatttggatgttttagatggttgaatcatactatattcaaacaaaagaagcattgaaccccttttactttgaaatgcataattactcgacgatcttttgtgggaataccatttaactcaacttgggtcatgagtagagtacattattaaagtggcaataatccaagggaacatacaagctgtaaagaatgggaaaatcactcctctcaatcatggaggaggataaagtagaggggacaaggaaaaaggtacttgaaggtaataatggtaattattgattgtttcagtacattacatgagtaaaaggacaaccagatcaaacacaacagatataatagtgccatcttcatgagtacagataccatctaaacatcagtatgcttatagctacaaactcatattaattctatgattatggtaatggattacacattacaagcaaaagtgtttatttgaaaattttcgttgcaaaagcaacaactgtatcatgaaaaatttcactacaagagcatgttatttctgtgtgcccgcgctatttgctaccaaggtttacctttttgatttcgaagtaaaaaccgctcctcactggtttaccgaaatccaaccgaaaaccaataaaaaccgatgattttcagtcaacactgtattaaaataggctaatactgaccggtttccacaaatcgagacctagcagtttcacgaaaaccgaccggttttcgcaaaattccatcggttttgtgaaccctgtttgctacatctttaacaaattacccttcttgaaatagttctcagttttattactcaatacatgttgttactcaatactatttattcaaagcatatcgcatatatctttgatttataacagttaatttttaccttctttctgttgttcagattcttaaagatttacacctcgtcacaaagtcacaaaacgaagatagtaatgtgtttcagtgcaagcgattaatactactcagattcatgatggaaaaatcacattatctttaacaaaacaagtcataaataaaggatagatgaaaggagaatatactaaaaagcttgatcatagtattaaccaatcatgcatgaatgtgattaaaagtagggggggggggagtttccttacacgatccagtcatggctccaaagaatggcgtaacgatggaaatcctccgtcggatcaaaccacaggccatacctctcctccctgccgaccgatgtactgccattgccatacacgttggtctgcactctccactccctccccttaatgttccctaggaactcaaagtccagctcatcatgcgtcttctcatacacatcgccattcgacatctaagtaaaaccacagtaaaattaacattgtgactgatgatgacattttcagatacaatgttgcagaatgtgtttgtagaactgaaacacataatgtattatgcacatcttaatcaaacagtatgcaaagccattttgtgagatgttcagaagtatgcaggtataatgcacaattgagttgtgcatttgatgaaatatgcaaataataattaccaacggtaacatattttttttaccaaacagattaatggagtacaaatttggttctggaaatcagaaatcagaaagaaatgcactgtctctgataggggtatatatcagcaacattgcaagaggaaagaaagaggagatatgttacatagaaggcgacgacgacaccggcggcgtaatcgggcggcagcttgatgctggcgctgaagaagccatgcagatacgcatcctgcgacgcgaatccggcgcctgagacaacaaagcacacagattagattatccatccaatccaagaactcaatccacaaagagaatccgaaccaccaagaggcagagagaggaggagcaacctgtgcgctcatcgagggagatgcggacccgcttgccgtcgccatggagcgcgaggttggagtcgccgaacagctgcgtgtacccctcccggaacgacgccgccgccggcctccgcagcctggccgccatggccagcacggcctcctcctcctcctccccagcggacgccagtaagggagatagcagcagcagcaggagaagcaagaagcaccgagaggcggccatggctttgcttgcttcttgatgtgctctgcttcttgctttccaatgctctggtttgccctgtgcttgcttgccttccttcttggtgtgtgtgtgtgtgtgggtttaatagagagagaaaggagattatcttttctgcatttggtggtgtgaatgcaggtgcagcagcaagctcactccattgccattggtgacctcttttatgggcacctgcaagtcttgctgcaccctctttctctcctcttctctcttctttctctctctataagacaggttgcatttgcattgcatgagagagagagagagagagagagattttgcagtggattgtgtgcagtggtggcagagtatgtctaataaagaaatgagatactacactattattatttggtatagtatcaaatggattattatacatttattatttatttaaaacatcattggagtatctcacacattagacattacctgtccttttgtctctagcaatgcatccatgggctctcatgtgagaaactgagaactcacaagggggaaagtttttactactagttactgtgctgattgaccaatcactgtagaagaatctttttttgttatatggcctaatcttttgtgattttcttgggaacttctttggttgtattattatatttagtgctatctatcctgatgagtttcatctgtgggtgggatatataatcagttgggatgcaatgcatgcctggcattttgataagcaattaatgtacagggattctgtcatgaaagtctaccaattttggcaaggagaggaccctttgcaacacggtacaccaataatacctcaaagttgcttgagttaaatctagtggggaaaatcctcaatgtagtatttggatttagaaaaaaaaagggtccattttactcccctcgaactattttatcagcgcacttaatctcctaaactatttgttgacacattttagtccccaaaatattttaaatgtttcacttcactccacgaagtatttctcttttttttctctacataagtcatattttaccctgaaatttggtaagagtacttctcaatattttttagaatactttttatcattgttacataggatggcatctcttattgatttaaacttcaagattaaagagttcaagcaaacaatcacgaaaatatttgaaaacctgtactcctttagaaggcactagttatggtggcagtgaatttgccactgccacccaccattcttttgtaacttttataaattagtccataatattttatgatattctggaatagtctagtatttgtttcaaataagtgaataccatatatttaaataaccaaacaagtgatactaacatatttgataaaaacgtattttatctataacatattataatatattttcttttacccatagcaaaacatggtcattttgctagtattttagaactttgactatgtgtcatctatggctctaaaaatcatcttgaattacaacttatataaatataaagaaaaaggagaaatattgttaggtagtactccctccattccaaatttatctacatatttcataggtacaccaagaccaagaaaagctaataactctctcatactatatttactctagcaacaaactcaatgcatgcaccatccccaatattttctagccaatagcaaatcaagatattgcatgtgggttataaatacttgtgtgcatagatgcatgcatcaatgtccatttactccaatgcacaaataacgaatagactcaataaatgaatacaaatatgtagatcatttaggaataacctcagaaaaactatatgtagatcaatttggaatggagggagtaaagtggattatttttaatagtttaggtgtgaaatgacctaaaacaatagggggaactgatccaatgaaatagttcgaatgagtaaaatgatttttttcattggatttatcatagtaattattcgtagtgtgttcatggaataaacggatttaaataggaaatttcggtcccatggtagtacatttttagataatgcaataatattttacactttttccccaaaattggatctagcatacttatataattgcacatcactaagtgtagttattaggaattcaatctcttctatcatgaagttacattacctctatgactttttaaaatgttttgatctatgctgcatgttagataatactaagagagaatctattctataccactgataagagagaatctattctataccactgagtttgatcgagttcaacgatttgccatcgacattgtctccttctataatataccgacgactttatcaattgttctacaatatgccattgggctgggcattcttttcaaaaatacccaaaatacccttagaggacatacaagattaacaattgatttatctcattagaagtttcaaaaaaatataaaattttttatgtggcctcgttacacaacatggaagtttatatacatgtttcaagtttttttggtatatttagattttagaaaataatatttttatgtggtatatgagagaaaatttgtttatacgagagataatagcacaaaaatatcttatgtagtgtatgaaagatgatttatattaaaaacatcaataaaatgtattttatatagcatataacaaatgagttatatatttttttacaaaaaatataaatgtaaaaaacttgaaacttctatacaaacttctatgttgtgtaagtaggccatatatttttttttattttttttgaaacttctaataggataaattaattggtaaccttgtatgtacataagggtatttcgggtatttttgaaaatagtgtccagcccaatggcgtattgtagaacaattgataaagtcactggtatattatagaaggagacaatgtcgatggcaaatcgttaaactcgaacaaactcagtggtatagaatagattctctctaatactaaccatctttgagtaaacccacatttatttccaatcatttataggctttgcatagttattctaaggtgcagattgtctaattaaagcaaaaaaaaaaatcttcttgcactctaatgtttagcatttcatcatgcaatttttccgtagtaaaatgcaggagtcccatctatatttatctccgctcttggcaccccttcagggcccctttgaatcgcaggattcagaaaatagaggaataggaaaaacttaggaattgaatgccatacttattggattcctatggaattttgaaacacaggaaagtcttcaaactgtcgtttgattagcacatagaaaaaacgcaggaaccttagacacatgaagaggaaaacatgaggtgagacctcatgcttattttcctctaaaattgctctagtaaggttcattccataggaatttcaaaggaattgataggaaataatcctttgattcaaagggctctataggattatttcccatagaataaaatcctctaaaattcctatggtttttcctttgaataaaggggacctcacagtgggaatttacctcactgtaaatacaacttcacatgatttacctacctggtggctaataaattatgcatgacacccaacgtgtagccttgaatgtgggtatttattgccaagagacccttgttcttggtcattccaactttccaaggatcagagcatagcattggataggattgcgctccagtaatgatccaactaccttccttcaaacatgagacgatcatggggacggcggtttagttgctgaaatatcagatggatactcatcaattcctcatcatctcatgtgctctggtacaaattaatcgaagtgacaataccatatagtactatgccatatagtaggggtatatgtctgcattcatgtggcagtactgcaggttttggaacgtaatagttattcaagggtgaatgccaacatatgtctgacctgatcaccaccaagaatccaagattcatgaagaaaggattcatacacagcatgcatgttggatcgtatgaatccctaagttctaaaatagttatattgcaaattctttgccagaatagttgtcactgtaaagtactaatcgtcccctcaatcacatcttattcaaatttctttctattgtatcctcaaccacccttccgcttctaatcaataagggttactttagtcttttcttatgaaaccttaatttatcctaaacaacctagaatgacaagtgttgtattatatactttcgggtctgtttgatagagctcaaactcctagatttagctctaggagttggatctgtagtggatcggagttgtggaacagcctaaaaaaacccagctccacctctagtttattctgtgagagcgctccacccatccccgttcccattttagatggagctggaattgtttagctggactctagctctagagctgtgccaaacaggccattcatttgtcctcaaaagacacttcaactttgactatgaatctagacgaacattttctttccgatattcatatagtgaaaaatgaggtccacagtgagaaatgaggtcttttggggatgatgtagtacatgcagaggattgagatcaaatgcagttgctattgtaactgcacaatagcaactgcacacaatcgtggccattcgttttcagatccagcggctctagatgactgctacagtaaaggcataatatagtgcatccctgctacagtatttttgctacagtaccacttcatatcctgaccttccattctagatcatttgatacacatataactgcttaagttacacttataataacaactgcacaggatcttgatccacatgcagaggtctttcacagaggttttatagttttcgtgttgattaatttgtagcttcagggaaaaaagatttcagggatctaattaattttcataatttttcaatcagctaaaattgtacattttgtacaacgaattctgtttttcttattcattctgatcagccattttttttcttttgtgcaagttacctctcttgcatgacacaagcaaggcctgtactgtactcacatgcatgatgatgacaaactagggttcaaactttggcaactcaatgtcttaggttaattataaattaagaacacatggcatatattatgtatctaagtgtatcaaatggtgctaccttgtgccctattctaaacaacttaattatgtagataatatagattattactaccactttcaaaagtatgatttctcaaaaacctttttacataagtattgcttggacaacattttctaaagatatttttttactttacaatatatcattattcttatgaatatttttatttatttataacctactatatctctatgtcatagtaaatgcatttctagctttattgaggaacaccaaagttgtttcttcttaaccttaacatctgcttaacaacctagaaatacttatattttggaatagagaaagtacattaaataagggtgtgattcgaagtgagagagagaggttaattagaggtaaatgaaaagaaatatgacaggaggtgatacacacttgtggtaacgtgagatgtgacaaacttagtcatcaatcaaataaccccttaatacacttattttgatagggaggtagtagggcacatcctctaagcctaagggtagtcccaactctccatgtcacgtagtgtttagtataacattatatacatcactactacacaaaagattttcctagatatggagtcatttagattgcagacggaccataactggtcgcgtctgggaaaatagggcccattttcgcgtgcggacctattaagagaactgcatgcaaaaatacccaccctttctttccctcctacccactttaaattttcccctctttctctcctcttccctcctctcctctttctctcctctcctcttttactcctctcctcattttccatgtcgtcctctcctctccctgagtcctgacggtgcttggcggccgtccccacacggatccggctaccggccgccctctcctcgtagtatcccgctccactcccctccccttccttcctccccagatctggcggaggggagcggcgccggcggcggtgtggccggaggggagcctggaggccgacgggagcacggatccagcggccggccgccctcccctcccctccccccctcgggatccagctcccctcccctccccttccttccctggccagatccggcggaggggaggggcctcagcggcggtgcggctggaggggaccgcggatgccggcgacgggtggcgcggaggccggcggcgacgacgacgagggcgcgggcggcatccccggccgacaatgacgaggaggcggcgggcggcgcggaagccggtggtgacaacgacgagggcgcgggcagcgtcttcggacgacgacgacgacaaggaggcggtggcgttgccggtggatttttttttgaatttttttccggatttttattttcccatgcgggcgacataggcacccacacgtgaaaatcgcgattttcgtagacccttgggtgcatacgggccgcccatctgcatgcgaaaatcagtttcaaccgcacggaaaaacccttctcctagtagtgtatgtttgtcacataaaaaaacaaagtggcaaaagagttaacaaggagagagaaggaagatgaaatcatctctcatcaagaaaataactttaggcatgaagcaagaacaaagacaaagggataggtgaatgaaagaagagataattaggagaggtgattagataaaaatttattttgaataaaccatccactgagttttatacaaactccatatttatacaataatttatgagttaggatcgacctactccatctcttccagtataataaatttgaacatacatacatttttctgttctagatcacattttatactaggttggttttttttgacgaagggagggactaccctaaggttgaggtcttgacttttgttgaaattaattgctgaacaatttttctcatcttgtctcccacgaaggggaaaaggctgacgtggctgtgacctgtgactggcattcatgtcagtaagcagagtgcgtagccggtagccgtttgatgggccgatatatgacccatggagccgatgagtgacgtcctaccaggacttgtacagcgagaagaaaataccgttaggttcagcgagtaaaatcaaatcgtttccatcgcttagcgtaaaatctccatctgtcctaaaagtaacttagcttgatattctggtttatataaaaaaataagttattttagatgaaaggagtaaaaatatatgcagtagtagtttaaagagttaaaagtgctattgtgctctgcgttcaaaaaaacagtgctattgtgcttgtctcctctcttgaaaatacttttaaattttgtaggaagtttgaaggttcaacaaattgcattaataattatgccctagtctttataagttccttcctctaccactgtttttaagtactcctttcgtccctaaaaagatgtatctagaatcagatgtaatcttatgtatatttagattcgtagtactagaatgtgtcacattcggtactaggttagtttttttataggacggatggagtatatccctagctactaattactgatggttacatatacagtatgcatctatacatgcatgcatgtcacaaagctagagcgggtgtgccctaccattttcacaatcacggtcacagcctgcgaaatattccaagcagaagcagccttgtggcatgagacaacagtaccttgcaacttgctaatagtgtagctctagctagcagccacttttctcaaattcatatatgtcaattcacaagcaataatgtatagtacatccactctgcagctcaggcgccgtttaggtcccatcccaaaattttacacccagtcgtatcgaacgtttaaacacctatatgaattattaaatataggctaaaaaataactaattgcacagattgcgactaatgtgcgagacgaatcttttaagcctaatccatgatttgacagtgcggtgttacagtaaacatttgctaatgacagattaattattcttaataaattcgtctcgcggtttactgacggattctgtaatcaattttttattagtgcccgaacaccctatgtaacaccctatataatattcaatgtgacacgccaaaaactttataccctggatctaaacacccattagcgagctctcgttgccagcttcgttcttctgaaacaatccacaatttttatgtctagctaggtttgatctgattcaatctcaaaacagctgatctgaatgtgttcaacctaattaggagtacgtcatatattttcctgattaagatgcataatctatcttggtcttcatcatcacatttttcaaactactaaacgatgtttcgtgtaaaaaaattttatatagaaattactctaaaatatcggatagatctatttttcaagtttgtaaaaacttagaactcaattaattaattaattatatgctaacgattttcttgtttttcgttccctaactttgttctcaccttcattagaaacgaacaccatcactgggtataccgaaccgattccttggttgtttttagctgagtttagctatatatgtatatccacaagtcggtcatggaagcagctcctctgatgtaatgtcgcaggacgtgagtccctaataaatggggttcatccttataaatccacacatcatagatatatgtggctctgatttatgttagaggagcctcatcgatccgccatgcatggaggaaacaaaaccatactgtttaggtgtagacgtacgtagtacgttgcctgggcgatggaggccaacatcgacatggatcaatagagccaataatcgatcgatcgatcgccaataatcgcatggcagtcgacagcggcatacgtatgtatatgtcgttatttaattaggtatatatagtcatgcataatcaacatcatatatgtccctgacctacctaaacttgcatccatgcaaatatgcttacccatatgtgtgtatctgtgtgccgtagatcccgtgaagctagctagatactccatccgtttcgaaatatttgactctgttgactttttattacatgtttgaccgttcgtcttatttaaaaaatttaagtaattattaattcttttcctatcatttgattcattgttaaatatatttttatgtaggcatataattttacatatctaacaaaagtttttgaataatacgaacagtcaaacatgtgctaaaaagtcaacggtgtcaaatatttcgaaacggagggagtatatatattgggtaccattagccacactggctagctagcagccgcatgcatgatccatataactccactatttaattacttaatcgatcaaatagacataatatgatatgattaagctagtagtactatgatctctcgtgatcgagtttgcatgtatagctagctagggaccttccttgtcaagttgtctcagattatataaccttcgttacaatcttaactaaggtttggttcatgcatctcacggtgttctccctccggttcttttttttaattgatgttttggatacgattttaaataccaataaataattaattaggattcttattcttttttctcatattaaatatattgggggtgacacaattaaccaacagtcccttgcatctcaccttgttacagtcttggtataactccagtttttataggatcatgcatattgaagccatgaagagtagatatttaatttcacgggattttcgttcgcgagactttgcagtgcttattttttttcctcgcgtgttgaactttcgtgagcctattttttgtttgtttgtgtttggtaatgatttttttttgtgtgtgttttgccactggttttgagtattttggcatatgttgctatgcccttttggcgattaaacatccttcctaatacttctctatttaaacccatgtaacctaggagtaagaacacaacaacatgcacttgaacccaaccagagaaactaagtagcatggacttgagccgccagggggaatttggggctgaaccaaaagaagaaatgatcgctgagatcgatctaaacatggacgtatattattgatgacggcattggtaagtgttatatacttcttgttcttggcaatacaaccatgtgcttgtttgtgcaaccacaaattttacgcaatcctttttgagctaacaattgcttcttcttcttttttttttgtttgtggggggggggggggggatgacgatatgtcaatgctcttgtaggtggttttgatctgaactttgaaccaccccatgttggacttaacttgaacttggagctggtagattatgagaattttgtctaaggttggatcgtaataatgagcatgcaatccatccaagctatcgccaacaacaatgttatccaaggtaaaagatgacatgaatcttgtttttctattttgttgtgccttgttgccccatgttaatggtttcgtacaactttttatgtgggaaagatactccaaacaatttaagaaatcgcatatatcaagttttgttagtaaaaaacacaaatggaaaactaaagaggtatgttaccaaagaagtttttttataccagaacaattcgaagtccatctttgcactgtttggcgtttatggcagtaggtacgagcatcctcgatcaaagtattttggttgatgtttctagtagaaaggtgtagcaaagtgggcctaagcgagttccattggatttagaaccattatgcaatgttccttttaagaatagaacaacattagaagatatatgtatgttaacaatgctagatattagtcaatccaagctattgagatatatacaagaaggtcaacttgtgcgtcactcaaatagtataaagccacatttaacagatgcaacaagaaggctaggctacaatggtgtgtggatatatacttgaacatatatggaagcatgaatgataatccaaggtctaaggggatgcttgatgttattttcactaatgagaaatggttctaccttactataaaattaaatcagagaggtattacatgcttccagatgagggatgagcccttatgtacatgcaaaagtaagaacaacatccctaattaagcttatgttcttgattgtaattgctcatagaggaagtttgcattttttatagaaaattgggtgtttttctttggttgcatagggaagtagtgttaaccggctaactaggacaatggaagtgaagcccatcacttcaattactagggatctccttaaacgtgctaacagtaatcgatctccttgatcctatcgctccagcaataccatccttaatttggccaccattatctgaaccttttaattagtcttcctctaaatccgccccctaattccatgccactaaagagaatgtcgtcactttaaccatgagcatgggtcgccatatagtggaaggtgactcattatcgcggtattagattgagtgagaacaacagagggaggggggtatgagcaggagatggaacatatatataatactccctccgtcccagaatatagcaacctaggaccggatgggacatatcctagtactacgaatttggagcggttaaacatttggtgggtattgaggccttgacgctcgcgtcgcctcccgctcgggcgactcgggcggcggacccaagccaccgccgccgccgttcttcccccctcccctctgcctcgccgccgcctgagcaaacggccggcaaagccggcagcttgctaggatggcggcggcggccaccctagatctggcgcgggcggatctgagggtggaggccggccggagttgcgccgtcgtcgaggccggaggcgtgcagggtgcgcgggcaacgccggcaggtggacatggtggcgacaggcggcgcaagggcgcggggttggcggcggcaggcggagacgggaggcgacgcggcggggtgtgggccgcggtggtgaaggcggcggcgacagagcctgcgacctcgggcatcaccggatctgcctcggccatcgccggatctggagccaggtacgggagaggaggcgggtggcggcggggatgcagtggcggcggcaggtggcggggatgctggcgagggcggcggggatgcaggcgcggctctggtggtggtggcgcgtggaggatcgtggaggcgaggccggcggtgtggaggccggtgcagcccgtggagatgcggccggcggcatggcgtggaggccggtgcggcctgtggagcatggaggccggctcagtggcgtggaattaggtgcggcacgtggagcgtggaggccggctcgacagcgtggagatgctgccgacagcgggaggccggtgcggcacgtagaggcgcggccggcagcgtggaggctggcgacggcgcgtggatgtgcggctggcggtgctggtgctgcgacggaggcggttgcgagaggcccttgttggcgcggtggcagcctccagctgcgcccaccggcgtcttggcggcggtgcagcggggctgcgggcgcttgtggcgacggttgctagccgagcttcgatgaccggtcccttggctgccttggccggttctggtcgatgcagcagaggagtgtgggtgatggcaggttgcgtcgagggttgactgcttgtgagacgtcgtggactattgtgtggccatcgatgtgggggtacttatgtgggtaatgtgcagacgctggcgaaagccttgccgtgcctttggccggttcgatgacgatgacgccgttggcgccgtttcccttcttgaaggcgttatcatggcgctctcccatttgccccacaaatctccaggtgaaaaccttgctccggttcggacgagcggcggcggcgttacgcatcatgtcctccttgggggcgtcgcttcggggaagttcctttacatcgatgactattgatggtctctttggttcaaaagctttctttccttggtgttcagcgaggcctaagcctcttaggtccacttcgttctgtggtgggcgacacactctttggttgtttctacgaattaagtcggagctgctcgctgttggggtgcggcgacgcttggcaacgatgacgtgttgtagtctcttccaaagagttggtgctggccatgtgaaggaagtggctctttggtagcttggctaatgtccattgtggaagtcggagttgctctcgctttggcgacttttgtggcttcagtgtcgctgcggtagtgaagtcggcgctgctgggtcgcttgggcggctagctcggcaacgataacacctcttctgtgatgtcggggctgttatgccgcttttgtgtttagcttggcaacaatgtcctgcatttgggctccgctgttgttgttagttgtgtagttaggtcccatgctctcttctgtctgttgggtttcagccggttccccataattaaccgtgcagctgtatagttttcgggcccagtttcccttataaactgggtcattgtctcttgtctgtacagtttctccttctcttaatataaaaccagcattgctggcttaggtttcaaaaaaaactacgaatctgaacagactaggatatgtcccatccggtcctaggttgctatattctgggacggagggagtacatatgtattttgttttgaggtactaaggagtataagtaagaagcaggtggtgagaagttaacggttgagaataaaaggcttaaaaatattgtcaaattttagattggataggatgccagttaatataggtgataattgaaaatgatcatttatactgagaaaagtatcacgagacatgcgagtattgcctggccagctagctagattggggcttagggctctagattctcacgtactgcacagtacaacactgcatgtctgagactctgagtcatactagcgtgtaaagcccaatgaaatcaaatcactgagtttgtcgcatttctagccttctttattttcctttgagtaaagtatacggccggcccttaaaattggagcggggtgtcaattagatccataatctagaaaaattgttattagggtccacaatcttgtataagtgaatcatttaggtccaaagcgcctctggccgggctgactgccttacgtggccgtccacggtggcagcatttttgcattctagccccccccccgtgcatcttggctcccccattcccgatccaaccattctcccccaactactccgaggaagggcgacgattagggcggagtcggcgatcggggtcagggtggctggagacgcgttctggacggtgcgttgggccgccaaccgatcgggcgccatcatcagaggcgtcggaggcgcgagttggacctcaccttgtgagatgaaggtgcacctgcgcctgtttatagtgagtgtcgtcgtcatcttttaatccctttcatttggcaagtttaatctgt

SEQ ID NO: 39049 - DNA, 9185 bp, Oryza sativa
ctgtgtgtgtgccctccacataattttggcatgcaataagtgtgggtaatatgggcatacacatctagcctgactcttccagtctccactcttcaccatgtaggaacaacatatttgttgctctatttaattagagaaaggggcaactattaatcagttgcctgatatttctctatccctccgtcgattttttaatgaacaagatctcatcaagattagcggaaatcaggtaaccctacctcttcttctcctgatccattctggcgctgccaatcacacccaatccatcgcaagcgcctccatccatgtcaccagcatcgccgccagcgaggtaagactcaccgaccacacactctcaacctctctcccttctcatactcctcgtctacgttggtgacgtcgccctcctaaacaactccgccaagcttcccttgctccacctctcctccccgtgtttggcgggggaagagaggtgggggcaactaggattcctatttggatgaagcacatgcttcaacaaccacgtatacttacaataaaaatcgaaaataattcaatagcaacacaatgaaaatatatagattagaaaataacatccaatctgaggaagacacaggtgaccttggctcaatgtcctactccatctcgtgcatctttgcaatgataatcagagaaacaattttggggtacattggaataactgaattaataaaaattggtgtcatttataacaaatttgaccagctggatggaaaataggtgactcatcaatgttgtcgcaaacagtgaaagaaactgtcagtatttttcagtatgatctactttgatttatatagtgtcttagagtttttgttttgcacatattcaacactaatattattataaatgaaatataaatatattgcaaaatttaacatttgaaaacataaatttcacttttaatattaaaatttccaaaaataataaaaatatcacgaagattaacattttgattggtgcctatgggggacgtacttacggtattttttagataatggaagctttgattgaactcagtcaattacattaaggtgatacaattatcttgagaacactttcggcctctgcataactaagatgcacacaaccgaacatacaaaaccacactcaaaaggaaaaaaagaatgacatggaatatggagaaccaccaatcccaagactaaattgccacccatgaataactccttaaccatctcctccaaaagcacatagaattaagagccaccaatcctaagactagattgccacccatatccctgggtaaaaaactccttgaccaccttctccaaatattgacatgccgcaactactatatcccgcgaaccatacttctgtaggatagcccatgtacaaagccaatggataagagaatatataacctgcaaaggtgaagatatgactatttttttaatcaaaaaccacattattcctgtatagccaaagcaaccaaatagtagcaaccgctcctaacagaacatgtgctttcaaattattatgaattccatcgagccaactcccaaacatatgcgctacacaatgtggtggaggaagtccagatgccacttggatgatggaccaaacagaatgggcaaaacgacgttcgaagaaaagatgtctaattatctcatcattgcaacaaaaacaacggttcttattgctttgccatttccctttggatgaatagttaatttagtccctcaagtttcaccgaaggctcaatttagtccttcaggtttcattttgtccacataggtcctctaagtatttgttttggcttaaaatcatccttgggcccacttaatgtgccatatggctatttctagtcaacaattctattagaaaatatccattttgcccttaatttgtataccactatacactagaaaaaagaaaaccaaaatgaataagcaacattgtaagtatacttcccattatttcaacatgtgcacataaacttgggcctaatggctatcgaatacacttgcaagtacataatttgtttttgttttacataaattgctatgcagtatctataaaaagaattcatagcatgcatttttttctcttatatatgtgaatgagggggtataagtgtcatttatcaagagagttgttggttatgtgggttcaaggataagtttgaattaaaataaaatcttgaaggactaatatggacagattgaaacattaaggactaaattgatccttgcatgaaacttggaggaccactttggctattcacccttttccttttgtcaaattgtcctttgttaataccactccacgacgcaagtaccaaagaaaaatcttaactcttaggggtatatttaattttcaaagacgcttattaatgttaggaacatgctgtgaattagagctagataatgagacttcaccgagaactccccatttgaggttaagtcccaatgaaactcatcttgttcctgagttaattgaaaaccagtgttacacgtggtaataaattattccacgccactagttttgatcctataaggtctcttctccatgaaaaagatggaggattgtttttgaagacttgtgcaactgtagcctgcttacgcctaactatgttgtaaaggcaaggatattgtgctttcaaggttgaattgcccaaccatttgtcttcccaaaacctgatttgggagccatctttaattataaaggatccaaaacggagaaagtcacatttcaccttcatgagactagaccaaaagtgtgagtccctggccttctactgagcttgagaaagaggtttatcacctagatacttattacgtatgaattgttgccaaaccccttccgtggagagcaatttgaacaaccacttactaattagagccatattcttaatttctaaatcatgaattcccaatccccttgttccttggggcggcacaatatgttccatttagcaagacgatactttttttttcgaccatcactttgccggtaaaacagtatatgctgtagaatggtgtgttgcttagctgtttttattgtagtcaactttttgagtagttttcacgaaggaactagaacctatgttgtttgggcccactttcgtattctgaaattgtaggggttcataataaacaattatatataaataaaaattctaccatgtgaacaatatcatacccccttcctgggaaaccatctctagtgtggtggtggagtcgttggtgcctaactccatccacaaaggttcaaagactggaacatatggatattatgtacatacaaataggttttcaataagaatttagtgagattagatatgtccaactcattttcgtctctttgagcgtgcgataagaggcgcatttgcggatgtaagtgtggtgttgcgtgtataggtgtgtgtgtggaggtctgccatgtaaaaaaggattatcacctccttctcccaccatcgaggcgcttgcatcccaacaattgtgtgcgttcatatacctcatgtgagatcttaatatcatttatcaatttttaggtagagaaattattttgaagagaaagttacgatcttcaaaagatgcactttatttagtacatcaaagtttttcagtttcatgtcgaaatttcttacattctagtgaaagtttatatccataattcgtgcagagagtttgttttatagaaaatatatttttagaaagtttattctaataaagaaagagtgggctcatatttttctataaaaattattttaactcgttgttgcaggtattatcacgcacaagattcaaataattataaaaaattcagataaaaagataatatagttacgtctctcttatgtcttcacaaccatataaggtcaaatttaacttaacacaagaataaaaaaatatagattacgataaagaaacaaatatagattacgataattgcaattatatatcacgtcagcggttggagttttgttgtatttgttttcatgcgcatgtgcatagaacaaatttaattaacttcgtctctagatagagatatgcgatacaataattcatgtgcataacttttttcgcaaatcatagaccgcatatgacgaacgagacaagtttcccgagcaagtcaatataagacagtgacttccacgtgtcatttggcatgtggtgtgtgactttttgctgcacaacacaacttcataatatgattccttgtcagcaacgcgtggagacagggtacagagattccttgagtttgtgcacaaatcggcctgctcgctccgccacctatgtgcacacgggactgtgagagcacgagtcggtgtcttgcttgtttctacgatgtttttggcaacaataatgtgatagccgtggagtcgaaattgttgtgtcgctaggcgacaagctcggcaatgataacactcgcctcgcgaagtcgaagcctttgtgtcgcttacaacaagctttttatcgatggctattttgagctccgccatttttacggtcttgttagcttaggttagttagagtgttgtggttgtggttttcgtgcagtttcccctaattaactgtgcattgtaaggttttggtcccgttttctccttaaaatgggacacctttttctttatataaaaagtcggcaacagcctgaccgtttgaaaaaaaagagcacgagagtgagaatgagaggtaggagattaggttaacaaagagatgggctgcctgatgtaaaattggtcaaattgagtggttgtatagcctgagaaatgtgcggactatccgcgccaaactctatactggataattcgtttaaactatcagataatcagcatccgttggataccaccgataccacatttgactccatatctacatcctgcatccatatcacacggatatctaaaaacctttaccatgtcttcaatttggatggattcggagtggaatggatcggataatattcaatccgtgttcacccctagcccataattagtcatactgatattatatggcccaattgagacatattaatcaccgtattattactatagattatctacttaattatcttgattcattaaatattttgagaaataaattataattggtccaaactattacatataagaaagtgtgttgagaaaacatattcttatagacgtggagcagataatcggcgataataatttggtgaagtagggctctgtaatgtgtcgaagaaaatgagtagatgatgagcaccgaagaattgctccaagctcagatcgagctctaccaccactgttttgcctatatcaagtacgtggtactttgtactcggcgaagctttcccacatcgatccgacggctcatgcgtgtgctcactgtgtctatgtaccattgaatgtgatttatccaatttatatggacactatcttttttttctgaaggatataattgaggatctagcaccttcactctcaagttctataaaacattggaggaaaaaaaaaggacatgccccattgatcctagtgggtccaaatgaaaataatgtagaatgattgctacaagaccctttatatttgtaattgcatatttataaaaaaatacaagaatgagatttatagtaaatataattattctttggaatacattttatgtaccctttgtgcatgaaattcagttagttatgttcaatgtagggttgcacataagactgattaacttagacgcatacaaattattactataatatcatcgttggacgaaattcaaccatgtgtagacggttcagtttttccattttctgtgagtacaagtgagaaggcacgcacgcaccacactagcatcagttgcatcctagcatttgccaagattgtttagttaaataaacaatgttggctttatcttttatgaataatagaaagagctagtttttacaccttaagggaatgctcgctctatatactccttgcctctcaattctacatctatctattatatactaaaagtccatgaaactttctataaatactcctaagacgccacgtgtcactcctacaaacactcctagaccgccacatggcactatctaatctcacagtcgattttcagttaaattggtggacctggtattttggaccattagattagatctactatttaataaaaataccttcctatgctgtgggccaaaaaaaaaaaagaacgtacgtagatacatataactttgtataactgtggtatacacttaataaacaatgaagtttacctacttttcacatagaaaaaagaaactcgcgtacgaacttaattacgataaaagcggtaaaatagaaaaaaatacgtacatggtgccattgaaagaaaacgatggtattaaaaataggattttatattatactatttaaaatatcactctatatttttgcgcaaacatacacaattaaaatatattttctacaaaataaatacaaaatattctttcaacgctctttaaacgttctatctttaaaatttaaaaattatataccaaaagttcatcgagctacaattgctaacaaggtatttgtgcatcatatcgaatatcaaagatatgatgaacatgtgtactattagacacataatacagataaaggacaatttataagggacatttgctcatttaacccttttctaaagcttaactatcaatttgatccttttttaaaaaaagtttgctcatttgtccatgtttttcaaaatagaagttgtcgtctgaccatactttcactacatcgtgagtttttcatttagaaaaaaaaagaaaaacatgtatttacaagcccaaatgactaaaatgacaccgaatacatcaaccttatcctcaaccactcatttgctcattctttatcccgctctctctcctctctctgtccaaagcgcgatgggcaggaggagtggtggcggccgcatggcaacagctgcggagggccctcggctgcttcgcggagggtaggagcgatggcagagaggcaacattgtgtcgccgacgaggaggaccgctggcggtggtggaagaggcggcgacaacttggcagaggggaagcagcagctccatgaagggtaggagggtggcgtcggctcagcgacgaggaggaccgtcggcggtggcgaatggaggcggcggctgcggaggggtggcggtaaccacggatatggtaggaggagaggaggcagagggatggcgtcggctcgatgacgaggaggataggcggtgacggtggaggggcggcggcacggtgacaaggaggaccaccggcgcccacgcacatctctgccattagcttgctacctgcagtttcttccgcacaaaattggacctaactttggaaaaataaggtcaaataagtatgggtagaagtggtatttggggcttttgttaacactgattaatgctcttaagagaagagggttagagtgtagcttcggttttgaaaagaagggtcaaatgagcaaagtgaccaaaacagggtcaaatcggtagctagacattcaaatagggtcaaatgtgcaattgctccattttataatatagattatatcattttgtttcattttataaacatacatagccaaagacacgtgtgatttactttgatctatctaaaaaaacatgtctacggtaataagaatcatagaaatttaaaagacagaaaaactcaagagcatataccctaataataccctaaaagtaaataaaaattatcaatggctaatccctacgacatataaaattataaagtattattttatcggtttattaaacgccctaaagaaccctcctagagcatctattaaagcctttaacaaataagaggaaactttaaatttcttctgtaacagataaagcatctaaaacttaatcctcattaatttaatgctcccattaattttagccattgggtcatttcaatgggtatgtgtatacatacattatttaataaaaaaacattgatgtcaggtgaggttgtattgcatggtttagagggttgttgtcaggatgactagcgttgagttttactaggttgctagccatccaatgcatcacaaaaagagcccataggagatattgtgttttgttgatcgagcgaccatcaagagaaggcaacgaaccccagtacaaatattttttatgagtaaatcttctcttaactgaagtatctatgtaatattatttaagtcgcattagcttgaagcatgcataatatgataacatggtatatctagaaggctacatgttagaacattcaattaacccatcttagaaataataatacttagcaataactcaagcaggtaacaaatttctatctttaattttgttatcaaattttaatcgttggaaagggggggatagagtgaatggttcaaacagttatgtgaatattgtccaatttgcaagctaaatgttttttttaaaaaaagagatatagcgggttactgattttgaagtattatcatactattcaagagcagagcaagtagtaatcgtatccaaaatacatacaaagaaccatgatacataattttaatattcggaaagatagaaatgcccgcgcaacgtgcgggctaccttcctagttattagtgaaaagaggatcccaagatcccactagtataagccacgtcatcaaataaacacacgatttaaaaaaagtaactgttggatcaaatgagccaaacatcagtcacataaagcaaataatacattatgggatgttttcgacccttcatgcacatatcataaaatgtgtggaaacaaagatatggtaatgaaaacaataccttcaaaattatccttataaaaaaataccaatgagtattcaatagtaattctactatatcaacgataacaagtatccgtgaaaatattcatagttacataacctaatacaaccgtcgattacttcactacatcttaaaattaaaaaaaatcatgtgacatggatgacataataaagtttgtaaagttgatttaaatcatatgattataagatttactataaaaaaacatacatatacttctcaactggtgatagcagaactacaacgcgtaacaaatatggctatttacattattaccagaaaggaaaaagtaagaattacccccctccccccggaactatcgcggtcatccgaattactcccctgaaccat

SEQ ID NO: 39050 - DNA, 26584 bp, Oryza sativa
ggctgggtcgtcatcatgcggtcgtcatccccccaccaaccgcctcaccgccgctgccgcctcgcttgcctcccctgccgccgcgctgacctcctccgccacaccccgccgccgctcgcctcctcctccaccgccgcctcgcctcgcctcgagcagtgtgagctcccgccgctgctcgcatcctcctcctccttcaccgccgccgcctcgcctcgcctcctccgccgccttctcgtctcacgccctcgtcctccccgcgtgcacgccaccgagagggaggggggggtgaaagccacgccgagctcctcatcccccgccgccgccgcctctgcgtcaggcggcagcgccgccgccgctctgtgtccccggccatcgccaccgccgagagggaggggggaagccgcgccgagctcctcatcccctgccgccgcagcctccacgtcacgcgctgctgctgccgccgacccgttcgacggtgagagagagaagagagagtagtgtgtgataagtgggtcccacaatttttttttataaagagaatgcttactggactgccacgtgtacgccacgtagaccaaaaccaccgcggattagttcgagggggtaattcgtactttttcctactagaaatgacacatttagatattatagaaggtaattgtcccggtaatatatgattgatgatttgttgttacgataatattcttaatgataaatcaagatatataaatccattaatgttatatatacaattctgaaaaaatatgttaaaacatatttattcataattgttattaaacatttacgcctattaaaataaataacatataaatatatttaatagatagagaggtcgtagtcgcgaacacacgacttaagatgctagttgtcaatgaaatagttgtactaaaacaaattaatcgcattggtacaattatcatctgtcatccaccaaatatcaatcatgaatttggtacacaaattgagaaagaaaggaacaattaaactctgagtagtaacagcacgtagctctgttagttctaatcaattttttactttttgtttgaacttgtgtgtgtgtatatattgaacttagacttgcatgccgatggagtgattgcatataggttttgagttaaatttagtaagaggtccaatcaaataatcatttctatatttttgctatgttttgcaatcctctattttacacttagaccctgtttagttcacgagacgaaaagttttggtgtgtcacatcggatatacggacacacatttaaagcattaaacatagactaataacaaaataaattacagatgccgcttgtaaactgcgagacaaatttattaagcccacttaatccgtcattagcgaatatttactgtggcaccactttgtcaaattatggagcaattaggcttagaagattcggctcgcaatttacacgcaatctgtgtaattagtttttttttctgtatttaatacttcatatatatatatatatatatatatatatatccaaacattcgatgtgataggcaaaaagtttttgtttggaaattaagggcctattcgcttaatttcaaatcatagcaataggaaaaacgaaggaataatataggaatgcatatgcaaaactaaggataggaaaagtataggaatgactcttatagatagttggtagtaggaaaaatacaggaatctttgtattaagttaccacaatcaagatttgaatactctaataatttgtgtaacttaggttcagatacataatgaaacaagtgatttgcctcgatcctacgcgtaggaatagaaaaatgagatccaagtggatgttaattttcctaccaaaatccataggaatcacatacaaaggaattcttcctttgccataatcctacaaaacgaatggatgaacagtaattattcctataagaatggtttttcctccatatttcctatgaaacgaacaagccctaaacagagccttacattactgttaaaatcatatgtttttcctattcctctattttttttatttctactattcaaacgggcccaaacttatatttgaaagcagcaaaatagaattaaacaaaaaattgaagtattaacgcgttaattgatttgtattaaagatgtactagtataatatattaccagtaacgctaaacaccaagcatcatgctacgcattacgtagagtacctcactgtggccacctttctctctctgtttttttttcctagtttccccctcccatccctaattccctatgggtccgtatcagcaaagtttggcttaggttgaggggtgcatacgatttttcagcagcacgtaaaatgtggtaagctattaaatactatgttaattgagtattaattattacaatcttaaaaatcaggtctatttgacttttttaaagaaaaacttttatatacaaagtatttaaaaacataacgttgggaaacgagttcacggtaaatgaaggaatattttggtcgagttgtagaatcaaacttagtctaaatctaaaccatccataggtgaatgttttttttttaagactgatcaccggagaggatagttccctcctgaattttcattaagaaggggttaagtacatagtacaaagagcacatcaggttacattaattagatcctaaggaggagagaagatctctgtactatgtacttagattaagaggagaaaccaggcatctgaaaatgcttagcaggcacctgcgctggagcaaccagccttgccaggtctttggcacttatggtattgagctgaatttccatggagcaccagaatgaggccgcgaacgaacactgaataaggtcctgttcgagaacccaactgaggctgtgtgtttagatccaaacttccaattttttccatcacatcaacatgtcatacacacacaacttttcagtcacatcgtatcaatttcaacccaaacttctaagtttggaaggaactaaacacaacctgaggtgagattaagttttaaattttcgtggcacgcttttttcaagctgttaaacggtgcgtttcgtgcgaaaattttctatatgaaagttattctaaaatatcagagattaatccatttttttaagtttgtaataattaaaacttaattaattgcaagttattaccatctcgttttatgtaaaatacttaatccttatcttcatctttacctttaggagattcaaacagagccttaaatatgtgtgatgatgtttcatcagtagcattgccgagctcacattgaggcaactgtacaatcttcttcttgtggacgtttgtggggaggcgctctttagcaagaagccatgcgaaaaactgaatcttttggtggagctcggttcttctagacaaacacccaattgctacatacctctacgagtaaacaagagggcaaatgcagaaaaagtaagcatttaccccttttcggtttaaagaaaaatcagaaaactcacagtaccctctccttaaaaataagaagagacaaagattgagagttcgggaaaataacatgagatatatatagattggaaatattacacagtaaacaaattattttgacaaataaattattttctcaatggaagctaccaaagcaggaaaaaagaatagctaaaataacccctctctaaaacaaggagaaaaataaaaacacaattttttttctggctaaaagaagaacaccaagcagtgctccatctctatcaacaacggagctagctccgaggacagttaggcgggcaccgggctttatatcgctgtcattgcacgtttgtagaaatgacatcagtgacagggaaatattagcctgtttctttctcggactattcattgtactattaaaatgaattatttgctacatgcttcaaaaaatatttatctcgaaaaacttttagaaaatttatttcttaagctacttgttaagctatttattaaatatatttattcattttatctctataatagatacttcctccgtttcacaatgtaagactttctgtcattgctcacattcatttagatgttaatgaatctagacatatgtatgtatttagattcattaacatatatatgtatgtagacaatgctagaaagtcttacattgtgaaacggagggagtaacttatactactaatccactcgataatcgtcgtatgggcttatgaagatgctactggctcagtcatccgtctcatgactccatgttcgacgcatatatcttcatttagaggatgaataatggattgattgttgttatatgaaagttctccataactttactccctccgtttcattcattttacaagacatgtcttactttattttgaagttaaactttattaagtttcttttaccatgtttagagaaaaatatagtaatatctataacaccaaattagtttcattaaatttaacattaaatatattttaaaattatatttattttatataaaaatattgctacatttttcatagaaagaaattaaagtcaaagtgaattataatacgaaacggagggaatactctatttttgaatcggaatctctacgttagcctctaagaataaaaatatatgagaaacgttgcaacagaaaaatcatcacttgcaagggatacttccaaaggatacatgcaaacaaatggtgcaaataaattgtgaaaaatctgttggattctaatttactttggttggtcttagcctaatataatcacctatgcttaacatggaaattaatctactgagctgcttgtgaagctattgaggccggtttctttgatttatatcctacttgcggtttttcttcttgtctctcttacagttttccttcttatattctctgtttgacatagtgaaaaagcttcttaatgccagctacactaccccaagataaccacataaaagccttccagcgtttaaccgatcgggcgattaaggtttagagttttgacgcaagaattagacatcacctctactctacattttctcctatatataaacccactggtgaggctcaaggcttaattattgcctactccctccgtcccaaaatataagtatttttagcatagtgccaagtcaatcatttttaactttgactattaatagcaaaaaaaataataaaaaatcatgtaaaattgatgttactaaatttatcattaatcaaactatcataatatgcaactctttctatttaaaatattttatttttatagatattgttggtcaaagtagtatttcgaagactgtatcgagatcttaaaaatacttatattttaggacggagggagtattatatttaaactcaatctgtttctaccgaccacacaaacaaaatttatgtccccgatcacttcttgatcgggatgaaatctggtggtttttaactcctgccaatctgtaacgacagtggccgatacaatcgtccgacaaaatcatcccttcttccattgctccattccctgaaaattattttaaactgtgccacggtgtcttccgtgtggcattcaagcatgtgatgtgaatgggcagtcgacgtggacggctacggattccatggagtttgtgtgcaaatccgccactatcttgaagattgatactattacaacaaaggacacaaaatgattcgaaggataggaccacattttttttatgattgatttggcaccactgctacaataatgcatccttggttagcctaatatatgctgattataaaccatatgatttatcagaaaaaatatattttgtagataaaacttttatacatgtgtgtttagagatttaaaaccgaatattagaaaacaaactattcaaaactactaagttttcaaattaaattttggcagcggcttaattataagctagtataggtaaatggtgggaggagatcattagtaattttaattatgaatataaacttgcacgtctactgatcctatttaagagccttagctcttcgccataagattgcacttgtagtactttactgcacgaagaacaccatggcacaacgtgtccaagaagaagatgagcagatgatgagcaccgatgacttgatccaagctcagatcaagctctaccaccactgcttcgccttcatcaagtccacagcactttgggccgccatcgacctgcgcattgcggatgtcatccaccgcaatggcggagccgccaccttatccgacctcgcgctcaacgtcgggctgcacccgaccaagctctcccacctccggcggctcatgcgcgtgctcaccgtcactggcatattcgctgtcgaagaccgcaatggtgaggccatgtacacactcacccgagtctctcgccttctcctcaacagcgatggggagggaacgcacgccttgtcccaaatggcgcgtgtgttagccaacccactcgccgtgatctctcatttcagcattcacgagtggttcaccaccgagaaggcaaccaccatgacacccttcgaggtggcgcatggttgcacgcggtgggagatgatagcgaacgatgccaaggatggcagcgtgttcaacgccggcatggttgaggacagccgtgtcgccatggatatcatcttgaaggagagctgtggcattttccagggcatcagctctcttattgatgttggtggtggccatggcgctgcagctgcagccatagcaacggcattcccaaacatcaagtgcactgtgctggatctgcctcatattgttgctgaggctcccgccactcatagcaacatccagtttataggtggtgaccttttcaagttcattccagcagccgatgttgttctacttaaggtacatacttaagtgacctttgatatgctgtgctttcagctgttgagtagcttctttaatttgtgttagttttgcatgtgatttcagtgtcttttgcactgttggcaagatgatgattgtgtcaagattctgcgactatgcaaagaggcaatcccggcaagagatgctgggggaaaggtgataattattgaggtggttgtcgggattggatccgaggaaattgttcctaaggagatgcaacttttgtttgatgttttcatgatgtacatcgatggcatcgagcgagaggagtatgaatggaagaagattttcttagaggctggattcagtgactacaaaatcaccccggtgctaggtgcccgatcaatcatcgaggtttacccttgatgcttctgaaggtgtacatgtgcatctctccgtggaacctattctagttcagacaattgaactaaatacataacatgttggttataaacatgtttatgttagtcttttgatttcctttcgttcatgagtcagtagccttgaggcgtgtgcatgttcacactgaggccatcgttttttcgtttttctgttgtcgtatgagctacagtatgtgctctgtgggatggtacaacttatgtacgtcgtggcttgagtcttgggcatattggtagcccgtgatttccatttttattttcatcacaataagaggaagagaaaactgaaaagctgcaatgcagttcgcagcgccaaatctctctcgctttgtctgcacaccaaatgttcatgtgtgttcatctgttctggcgataacaagtggtattagagcaagcatcgaagatcggtcatggctctatgcctggataggagaaccatttcttgacagggtcgaggagttgctcccgctcaccactgccacatgcatgcctcaacgatggccgaatgaggggtaacgttggcaaagaggtcatggtgcagtgggtggtatcccaagctaacgaggaaaaactacaccgaatggacaaccgtgacgaggatgagcttgcaggcgcaggtcttgtgggaagcctgaacaagcttaactaaacaatactacccatattctcatatattggcatcaaaattaacaaccaaatttttttctttaaacatggctaaaatgcacgtaaatatttgccacaacgtgtagtcaaaataaggtgcttaattcgatactactgacacctcaatgatttgctaacacattcgtaatcctaaaatataattatttcctagttacaaaggaaatagctaaattttaaaacaggggactgtatatttatattttgagaaaatatatataccgctaatacactaatcgtgtctacgtggtaaatttattttggttttgctaaaaaactgtttttatttagggaactttcgatttttttcatgtctgatgctctttaagattcatgcgcctttttagttaggaacttttttgattttgttttgtcatcagatgtgctttaagattcgtgcatgggaacctgaagaggatcaaaccagttacctcgcgtgagtggcatggctacattttgtttagttatattctatgaatgtattgtagttacagtataattgcactccaattacagtatagttactttgaaagttttccaataaaaaactgtcgaatgctatatagatactcctatttattttccacatgtggtggtgaacctcgatcgtttatcatatatagcaacaactaaatattatggcttgtccctaaaccctaaactctagcaccaataattcatcaagtctaaccattaaagaagatgtttaagaaatgaaattttgctggttgctcgatgcttttttaggccattctaagaggataataaaaaatgatgtgcctaagtataggtcagtgaggctggcggcaggccaaaggcagcccatcagtcgacgcccaggccaactatccaatgccaaactcttctcccacgcaaacgttgcccaggaactactgcagtgcagggattctcatggtggcaatctggttcatcttcaattcgttgtcaacgattgtgtcatcttcctgcaaacaaaagttagttaatttaaatcttaattagttatcaaaactgattctctggataggcgtgcttcccggccgcttgcagtttggttcagaccaatgtaattacaaattcatcacaatttatttcgaatccaagagaaagatgagcacagcacatcacaatttattttactagcttcagcaggtgaacttcagcagtatccatccatttccccagttgatgagtgcataatatttctctttgatgtaaaaatgatctcagcgtaaacatcgcacattgttgaacgatcctttggtgatggctctgtgcactttagcccaagcttagccaattctatggatgtttgcatttcaaccacagcatgatttgggtcttcaccttcatgataataggtgagagtaggggctctaaaatttcattgatttgatgtggaaatatgctgactccacaaagctgtgaagttagggcgctttcctatgattatctctggaacaataattccataactatatacatcatcctctattgaaattttgcaccccaagccatactctgcgatcaatattaattatgcaagttgataatctttcttagtcagtcaaaatatgatacagttttgcatcacttccatgaaagataaaatagagacaatagaaatggacaaaataagaatgaagcaggtgatcacctggtgcaatgtatccgattgaccctctcagtctggtagtgcttgatgcatcacccaggcttataatgttgttctgaagaaactttgcaagtccaaagtcactaaaggattcatcattcaaaaggatattgcttggtttcagatcgcagtgaaccaagggaggaatcggttatgaagatagtccaatgtagtggcaatgtcttcagctactcttaacagttttggggggttttgactgcgcacttttggattgatccagacttcaaggttgccatttgatctaaactcaagaacaagtgctttgaattcatccccgcaaaaaaagtgctttgaattcaaaccctgatgtatcaaaggttgaacataggccaaccccgatggcgaatacttttcaatgcctcacattcaacatagaaactacttgggtgctccattttggtcaagtctaaatacgttaattgcaacattgcgtgcgccaaacttcaattgacctttatatacaaacccaaatgttcctgaaccaacgagacttcttgaagagaaaccatatgttgctttgtacaaatcattgtatgataatttactaaaacacttgaatgaatggttgacaataattctcttaggcccatttctcctcctcaggcaacacatgccatggtgactataagaatggtagtgattgcatccattacactgtgaatataggatgtcttcttcctgttggatgacagttccttgcaaggtggtaattgtatcactagagaacttacacacacctctttatttccttggatgaacacatcgcttgaatttgcaaacacacctccttcagggactggcccctcaaggttatttaaggatagattgagagtgcataaagattcaaaagtcccaaaatatactgggatgtcaccagacaagttgttttgggaaagatccatttcatcaatgcctcttaaactcataggagataaagtttagtgagccgctccaggttgccaattgattgagggatttctccagaaagcttgttgttatataagcttaagatcgataagttttgaagatttccaagtgtgctgggaattttgccggaaagtaaattataatccatttgcaagacagtgagactagtgagtttttttttatctctgaaggtatgctggcggttaattggttttgtattagagtctttagaaggatttggttttgctcatatttctgaaaggttggcaatagaacttggtattattccttttagattgttttcatccaaccacaaattttgtaagtgggtgcagtttgttagcgaggacatgaaagtccaatctccagcctcaagcttattgccacctagatctaagtttgtaaacgtggacaaggatcccaatgagggataacatcagtgaaagagtttatgcaaaaaaatctctctgagattcaaagcattggctaaagaaacatgaattggtccttcaaatttgttccctcctagtatcaaatttgtgagtctgggaagggtatagccaatgttagtgggtgttgtcccaacaaattggttggcaccaaagttaacataggtaagatttgaaattgtttaaagtccttgtggaacgacgcctaataagttgttataactcaggtatagtatttttttttctaatcaccatgttgcacgttttgcttggctatgtgtcttctttgcctttaatgtcctccctccccgcaatgcaaaagatattttggataattggctaaggggagcgccttggcccaccaaaatattgattttatttggagttagtgcgctttattggtcaatttggaattaccgtaatgatagagtttttaacataagaaattgtctaacattatgcaggttatcatcatgtgttccaatcagctccactcttagtatttgatgctttcataggaacaacaggatattatgcgcattggttctacatgcttggaattggtagtcaagagcttttattatactttggatagcgtagtacctacaaaatttcatgctagaatctatgtgattttaaaaacattatttcagttgatccttttattggcgaaagttgggaatttgtccaatcacatctattattaattccttcctttttttattacttctaaaacttgttggctgtgtgccaatgggcagaagctggagatttaatccatttctatcatctaaataaaaaaaatgtagttctatgagaaatttaatattaaatatatactattgtgatacatcacgttaaatctagggttctatgataatttagttttatgaaatctatacctaataaaaaaattcattaggtttccgggatttttactcgtccgtatcaaatttccgttcatctcctgattcgaccgtctgcgagatcgcatcacctcgtttctgtcccgtacgcacgtacagatcaaacatgtccccttgaactagagatcaaatctaatccattcaactttgtacaatctatcacaaaactgcatatttaagaatttattttacaaaactatagatttagtgtatttgtttatcacagaactatacgtttagtgtcttcatttatcacaaaactacagatttagtgtctccgttattaagaaactacaggttttaacaatgctaaaacttgtagttttgttataatgaagatactaaacatgtaataattttgtgataaatgaagatattaaatctgtagttttgtgaaataagttcttaaatatgtagttttgtgatatattgtgcaaagtacccgtagttttttgtgataaacgaagacactgaatctgtagttttgtgaaacaaattcttaaatctgtagttttgtgatagatcatgtaaagtatttgcagttttatgaaatttacttgtttttaaaattttattatgttttagctctcaacaacttaggtaaaagaaaagaacagatggtgcgtttacatgcttgagtggtgagcagattaccggattggtcattttatatgtcagctgtgatttttattttccaatctgtatttttttgtttttatattttttatttcgatcctttttgggatggatcgtacttaatcttggctaataggccgggctggtcatcattttatctcttagttgtgaatttttcttttcaatctgtaattttttttgtttttatcttctttatttcaatcttttttcggatggatagtacttactacgtattttctctcgtatagaaacggtagattagaagtgagagattatattttcatagatctaataatctaatggtccaaaacaatgaatccgcggtttaagggaaaattatgggttagatgttttacttttttttcttagaaatctctaatttattatagcgccatttggcgatgtatgagcatttgtagatagtcacatgatgacttaaccgtgtttataggaagttaaataaaattttagtatataatagatatactgatatacatgatgtttaatttaatagatatttattattaatggagtagaaattaaggaggccaatgtgagcaaggagagaggacgtaaaattatttgtcatgacatcacagtatatgttattaatttttgctatttgcaggagctttgtcaagcgatgtatttcttatatatcagaacacattaccaatatagataaatagaatatgtttaaaaaatataattatttagttatctattttttatattataatttttttatctagaaaattagaagatggaaggaacaaagaagagagaggatgtgaggggaaggaacgtacgtaacgctgaggagatgaggcccatgagggaggggagccggacaggatttttggcagatgggattttgctttattttgtttaattaaaatagatctaatggtgtaaaataatgggcccgctatattaagtgaaaattgagggtcagatattttgcttttttaaaaaaatttcttggatttctctaatttattagagcgccaagtggcggtttgagagcgtttgtagaaagtttaatggacttttagtatataatagatagatagatagatgttaattgagtattaattattacaaacttaaaaattagatctattttatttttgaaaaagaacttttatatacaaattaattaataaaattattgtttagtagttcgagaaacatgttcatggtaaatgaaggaatatttcaggtgagtattgtacaatctaactcaacctaaatctaaaccatccataagtaaatacttagatacttatgggtccgtctccactaccactagtaaacaagagggtaaatgtgaaaagtgagcatttaccccttttcagttaaaagaaaaatcacagtactctctccttaatgataagaagagccatgcattgagagttcatgaaaataaaacgagatatagattggaaaattatcacagtaaacaattttgttgacaaataaattatgttctcaatggaaggctggaagctaaaataccaaagcaggaaaaaagaatagctaaaataatctctctaaaacaaggagaaaattaaaaacaaaatttttttctggctaaaagaagaaaacaccaagcaatgttccatctccatcaacaactgagcttactccaaggcgagttaggcggctgccgggctttctcgctgtcgtttgtcgaagaaaatgagtagatgatgaggaccgaagacttgctccagctcatatcaagctctaccaccacactgttttgcctatatcaagtacgtggcgctttgtactaggcgaagctttcccttgcacatcccatggctcttgcgtgtgctcactgtctatgtaccatcgaatgtgattatttatccaaattgtatggacactatttttttctgaaggatataattggggatctagcacattcattctcaaggtctataaaacattggacgaaaaaaaaaagaaggacatgccccattgatcctaatgggccaaatgataataatgtagattgattgctacaagactctttataattgtaattgtatatttataaaaaatacaagaaagatatttatagtaaatataattattctttggaataaattttttctaccctttgtgcatgaaattcagctagttctgctcaatgtagggttacatataagactgattaacttagacgcatactaattattaaaataaattatggaggagttgcatcaatcaaagctgcagtaccggttctgatgccgtgcatgctgcccacacatgatgaataaaaattgcgaaaggatttaactgatctcctgataattgttccttattaaatcacaccatgcatgcagcatgtattatgtattgtttagtagttcgacaaacgtgtttacagtaaatgaaggaatatttcagccaggttgtagaatcgaactcagtctaaatctaaaccatccatagttgaatacttatgggtccccctccactaccactagcaaacaagagggcaaacatgttaggtgagcatttacccctttttagtttaaagagaaaaatcacagtactctctccttaaagataaagaaaagacatagattgagagttcatgaaaataaaacgagatatagattggaaaaattgtcgtagtaaacaatttttttgacaaatacattattttcacaatggaagctaaaataccaaagaagaaaaaaacaatagctaaaataatctctctctaaaacaaggagaaaaataaaaacaatttttctttgggctaaacgacaaacaccaagcaatgttccatctccatcaacaaatgagctagctccaaggctagttaggcggctgccgggctttatcgctgtcattcaccaaacattcctagaaatgacgtcagcgacagggaaatagcctgtcttttttggactactcattgtactactagaatgaattatttcctacacgcttgaaaaaaatagttatctcgaaaaacttcctaaaatataaggctcaataactcataacataaagaccaagaaataatttaatcacaatcttgatttgatcacatccggcatgcacagtgtggaagaaaagtgggtagtaatatgccttactaccttctttgccattataaaagtgggtaacataggaggtagtaactaatactatactagacaatagtactactacccggtaataagcataaaaaaatactaaaaatctctcgtctatcttttttgctcaactattgttttacaagtacgtcatatattactattgtcggtgacatgggaccgggagtatcatgacttagagacttgaggcagacacgatcacccacgtgacctaaccccctcgggggggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccgcatttattgcggtttggacgagcgcgtcacgccacatgtagcgcagtatggcacgctcgtttatccggtctgtgaccggtcacagatcggtcagattgcgggttaggtggcaacaggcgatctgacacacgcctcgccccgtcccgtcaggatgagagtctctaggcactcgtccctagccggagccagcgtgctagctcctggagatggcacgttggtcctggtcagatatatgccaggctttatcccaaccattataagcaagacgttgtatgaagaagggcgaacatgcagattgctaaactgacacgtggtggacaaaggtgaccggtctgtgactggtctgacactggttatgtcgccggaagacaaccgtgttcccacgttgcacctgcttccggcggaatggaggtaggtatgggccgtcccatcagaagggtcactcgggcagcagccgttgcaaatctccgcccatttatgaagagatgacagggtgatccccgaggtcagacgaacgaggacgcgtgtccacactcaaaaacaggcagtgtttcagcttccaagagaaggcaagccaagttttactatagataggatgggcccccacccaaaaagagagagagggagaagtggtgcatgtggtatccccttgagatataaaaggaggaccttgcccacttaagagagggggctggaaggggggaggatctggagagtagatcccacgagaggaaaaaagggagaagagggtttctagagtaagagctctctggctctccatctctttgtagcttcttcatacacagatccaccataacacaggagtagggtattacgcttctcagcggcccgaacctgtatacatcgcccgtgtcttgtgctttttccattctcgcgaactttccacagactaggagtttagaatctcacccagggcccccggccgaaccggcaaaggggggcctgcgcggtctcccggtgaggagccccacgctccgtcatctggcgcgccaggtaggggactctgcgtgtgtttttctaagctctcgcattctttcgtgtgcgccaagcttttcctgttcagcccaatggccgaacaagcaaaggcgcacaacctctctccgagtgttagcggtgacgacggggaaccgaacccacgccgtcgagctcgtactccaccgccccctccacgccaaagtcctaggcgggaggaggcgctcgagagggtcgaaggatccgcgacttcgacatccacgggtgatggagaagggcggcgagatggggagcgtcgcctcctcgtctacggcgacggcagcacgccccagggcgcgctccaaactgcgggcgcgctcctacgtcacccgcccattgtccctgacccggagtctccagcccaacgttggctggacgacgtggccaacttggtcatgacggcgcggcagcgcctagatgctggtgggcggtcctccgccaccaagacctctggtactgctaccaccggctccgcgtcgtcaagacggagggcgcggcgagcggcggccgctgttcgccattcggccgccactccttcgtcagcgcctccgacccgagaagatctgcgtggggggccggattcccgcatcagtatcgagcgccggcgtaatggccgacgtactgcccacgcaacggagggcgcctcctcgtccggagtgtcacctcaacacggacgcggggatcagccctccgtgcccccggttggtggtgtcggctgtagagcctttgtggcgagccttcggaacgtccgttggccccccaaggttccggcccaccatcgccgaaaaatatgacgggagcgtcaaccccgccgagtttctccaggtctacatgaccgggatcgaggccgccgggggtgacgacagggtcatggcgaatttctttcccatggccctgaagggacaggcgaggggttggctaatgaacttgccacccgcgtccgtccactcttgggaggacttgtgccaatagttcaccatgaactttcaaggcacatatccgcgcccaggtgaggaagcggacttgcacgcagtacagcgaagggatgatgagtcacttcgctcatacattcagcggttctgtcaagtccgcaacaccataccatgcatccctacacacgcggtgatctacgcgttcagggggggtgtgcggcacaaccgcatgctcgaaaagatcgcctccaaggagccccagactaccgcggagctttttcagctcgcggaccgagtggctcgtaaggaggagtcatggacctggaacccctccggttccggtgtggcagcttcggccgcccccggatccgctgctcggacagggcggcgtgacaggaggaggaagaaaaggtcagcccattccgacaacgagggtcatgtcctcgccgtcgagggtgcttcgcgggccacccgaaaggggaggcctgcgagcgacaaaaaggaggccagcgctcccagcagggagcgcccaaccggcaagtggtgcaccgtccacaacacctcccttcacgacctcgcggactgccgcgcagtcaaaagtttggctgagcagacgaggaagtgggaggaggagaggaggcaggagcgccgagagggcaagtccccggcggttccttccggcaatcggcgaagtgaggccaaacagaaggcccccgccgaggacatcgatgacggcgatgatgacctaggtttccaagagcctggggccaccattgccactgtcgatgggggagcgtgtgctcacgtttctcgccggagcctcaaggccatgaagcgagagcttctggccgcggcccctactcatgaggcgacgcgccgggcgcggtggtcggaggttgccctcaccttcgaccagaccgaccacccaccgtgtgttgcccggggaggacaggtcgcaatggtggtttcccccactgtttgcaacgtgaagctggggcgtgtcctcattgatgggggagcagccctcaacatcctttcccccgcagcttttgacgccatcaaggccccggggatggtgctccggccgtcccagccgattatcggtgtgacgccggggcacacttggccgctaggtcatatcaacctcccggtcaccttcggtggatccgccaacttccgcacggaacgggtcaactttgatgtggcggacctcagtctgccctacaacgcggtcctagggaggcccacgttggtgaagttcatggcggcggtccattacgcctacctccagatgaagatgccgggccccggtggccccatctctgtccatggcgacctcaaagtcgcgctcgcttgtatggagcagcgcgcggaccacctcgccgctgcgtccaagcccgagggtggcgacgagaggcttggcacctccgtccccgtcgccccgaggcagcggatagtcacgtgcgacgaggtcccggtcaaggaggttgccctgggcgacggcccgtccaagaccacacgaatcggtggtcttctggatggcaaataggaagacgcgctcgtctccttcctgcgggcaaacgctgacgtcttcgcatggagaccggcggatatgcccggggtccccagggaggtgattgagcaccgtctcgccgtgcggccggacgcaaagccggtccggcagaaagtgcgccgacaggccccggaacgtcaagctttcatccgcgaggaggtggcgcgacttctggaggccggattcatccgcgaggtcatccatctggagtggctggcgaacccggtggtcgttcccaaggcgaacggcaagcttcggatgtgcatcgactacaccgaccttaacaaggcatgtcctaaggacccttacccccttcctcgcatagatcagattgtcgactccacagcggggtgcgaccttttgtgttttctagatgcatactctggttaccatcagattcgcatggctagggaggatgaagaaaggcttgcccagccgtcggcgcgacctgaccccttaggggagacggacgcgcctgaccggcccccgaggcccgtcggagtccaggcctcgggacccgaggggagcgctcccagctcccttagattgattgcttggatcgttgagatccaagcatacctcacagataagactctacccgaggaccgcgaaggaagtgaacgcgtccagcgcatctccaaacgctacgtgttgatagaagggaccctctatcggcacgcggctaacggaatcctcctgaagtgcattcctcgggaacaaggcgtcgagcttcttgctgatatccatgaaggcgaatgcggagcccactccgcctcgcgcaccttggttggcaaagcctttcgtcaaggtttctattggccgacagctctcaatgatgcggtcgacctggtccggcgatgcagagcgtgtcagttccacgccaagcaaatccatcagccggcctaggcactgcagatcataccactttcatggccgtttgctgtctgggggctcgatatcctgggaccgtttaggcgggccccgggcgggtttgagtatctgtatgtcgcgatcgacaagttcactaagtggcccgaggcttatccggtcgtcaagatcgataagcactccgcacttaaattcattaagggcatcacagcccggtttggggtgcctaaccgtattattacggataatggcacccaattcactagtgagcttttcggtgactactgcgaagacatgggcattaaactctgcttcgcctcacccgcccaccccagaagcaatggccaagtggagcgcgccaatgcggaaatcctcaaaggccttaaaaccaagaccttcaacatcctcaagaagcacggcgattcgtggatcgaggagttgccagcagtgctctgggcaaaccgaaccacaccaagccgagcaaccggggaaacgcctttcttcctcgtctacggcgcggaggcggttctcccatccgagctcaccctgaagtcccctcgggccaccatgtactgcgaggctgatcaagatcagcttcgcagagatgacctcgactacttggaagagcgaaggcggcgcgcggccctccgagccgcacactaccagcagagcctgcggcgctaccatcagcgccacgtccgggctcgatcactctgcgtcgacgacctcgtcctacgccgcgtccaaacgcgtgctggattgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccttaatggagttcgggtgtcaggtttcgggctcgggccaaccccgcacccccttcaggcgtgcagggttggccgggggctaccacatatgcatattttttcttctatctgtatttcaataaaagcattttcgatttcctaaaggctgtatctgtgctgttgtttccttttgaagaatcttgacttgaaataggtcacttgtgctcaatcctgccctcgggggctcgggtcggctaaaatcgccaaaaggggcccagaaccgagccgtgccccggggtgtggtgaactccgggggggaatcggcaaaaacccacaatcgggtcacccataaccctcggtcaccacgctctcggcctggccagtctcgacacgtggatctccccaggcactagccccgacccgcgccttttgaggactgggacctgggcacgagcccttaatcaagttaagacacaaaaggaccacggcacagatcatcctcatctcatacacatagcaaaatgaaattgacacagaaatttctttattttgattgcagattaagttaatctatacaaaaaggaggcccgaaggccttggaagaaagaaaagaagaaaaaactaaggattggcgggggcctgggggctcactccgatgcacccgggtcgccagcctcgtcgccactgtcgcccacaccgccgtcatcgccctcctcgtcggagttgaaggcgaacgcgagccgaggggccgaaccctcgaagctgtggacgatatggtcggcggcatcccggacctgcgcgcgcgcgccgtcctcggtcccgggagggaactcgtccagcgccgtccatggggagaagtcggggtccctggcctggtaactcgccagtacgagctccaccgctcctcgggcgaggtccctcgaggatgacttaatcgtcccctcgagctcctcggggagccgctggagagtcccggccatcttcgagaggcgctgggcgaggcccccctggttggcggcgtacttcacagtccgcccgccccagagacccgcctgccgcccggcgcggtctaaacgggacacggcgtcgcgaagcatgctgggccctatctcgcctgccaggcgaagggcctcgacctccccggtggacgaatccagcgcgccctgcagatccgcgatggtgtgttcggtagctgccaggcgagcggctaagtcgctgtcgcccgtagccgccccgccgctacgcgcccttgcatccagctcccttgcctgcgcctcgagttcagcggcccgctggttcagtgcggccctctcggcgcgggcactttccagattgcgacgcgcttgttcctcttgcgcagcttcgcggagggacgcgctctccgctagcctctgcgctgtggcctcggcctcctcgagggctcgctcccgctcggtgagcgtatcctcgcggaggcggagtgcggactcttcttcggcacaggcggcttcgtgcgccgccagtgtgacctcccgaatagcaacggcggcctcgcggtccgccaggtccctctccacgacgcgggcacgctcttccagcgccatgtcacgggcctcaagggtttcttcgcgccgccgggatgccacctcggtctccgccgcccgccgttctcgggcagcggcagcgtcaaggaccccacgggcggcgtcgagcttcttccctagctccgcctcccagctcccgtattgaaggcggaggtcgtcctgcgcctcgttcatcacggtagtggcgatgagggcagcccccctctcctcctccacctccctggcgatctcccccagcatcttccgacgggcttcgagctctgagacgtgccggtggtgtgccttgcggcccacctccaccatggcctccactgagcgtcgcccctcttcaacacgcgcccatgcggcgtcgagctccgcccgctctgcttgcagggcctctatctgggcacttaacccgtccaacacagtggtgttagcgacggccaaggcctgcagaagaggctctgcgctcagtggggcaacggaaggcgtgggggagagccgcctcggtgaggatgccgcgcggctcggcccgctgatggacgtgccggactcagggatgttccccggacctggcttgtcctgagcgtcgcccgagggagtgggcccaagcgatgcagccgcggcctcgtcgcgagctgcctcggaagtcgtcgccgcctcggcctggcgaagtctggcctcctcccgagcggcttcttcagcttggcgagctcggacggccacctgggcagcttcctcggcttcccgaaggcgatccgcagcttcttgccgatcagtctcgcgggttgcctcggaggatgtcgtcgcctcggcctggcggagtctggcctcctcccgagcggcttcctcagcctggcgagcccgggcggccccccgggcggcctcctcggcttcccgaaggcgatccgcggcttctcgccggtcagattcccgcctccgagcctccgtggtcgccgcgttctcggcctcagattggccggacttggattggcaagaaggacgcgacgggatctcgctgaagcagaagaaaagccagaagacaaacaagatgggtgaatgaaaacttgtgttgggagaatgaatatagccacaatgggcgtgggacgaacctgcgagggggtcggttaaacgaccaccttggaggggaaataaggtttccccgggatggttctgtcccccccatcttgcggagccgtttcttctttcgctccccctcgggctgcggcgtcggcgcggccccctccgggcgcctgctgctgacacgcgccgccccgccccctcgggggggagatggggaggaagtaccctcttgcttcctcttccctcgggcgtcggcagggcggctgccccccgagcccccatcacggggcccggaagcacaaccccctcctggggtagattgatctcccttgcggctcccgctcacaccgtcatggccctcaggagctcgctcctctgaggccccgaccgccatcatgatggacaggatgttggcgcgatctggatcgctgcagagggggaggactccttgggggatgagggatgcctctgcggagctgagattcagcacccgttggatcattaccttgaagtcttcggggacccagtcccatttgaccccccggtgagtcctcatacagtcctcggacccggtgtactcccaggcgccccgggcgcgccgctggagtggcgcgatccggcgacgaaggtagtcactgtacaccatggcccctgtgagcccctgggatcgcaggcccgccaggcggtcgaggatggcatcgtagccatctcccaggtctactggcgcccgccagctggaggcctgtgctgggggctggctcggaagtcggaggcgcgcttcgtcggcgaggggggtgtagaaccagtcgctcttccagtcatcccacttcttgcggtggacgcagggaatgtagcggttcagcaccggcccccgcggctggaagtagcagccaccaaccaccgacggcggcgacaccggctgtacggtgaagaaccaccggaacagccgaagggatgggcgcaccccgatgaacatctcgcacaggtgcgcgaagatggccaatgtcattaccacgttagggatgaggtgcgccatctggagatcgtaaaactccagaacatccatgaagaaagaagaaaatggcggaaccagccctaccattgcgaaagggaggaagaagacggaccgccccgggtagtgtggcgccgggcgtccctcacccagtgcgaccacctcccggccggtggcagattccggcatgaagcggcgcgcaagccggcctgcctctcgctcacgatgcgggaaggcggcaacacgctaccgtcaagcggaacggaaccccgtgccataacgccggaagaagagatgtttgagagcgagcgcgtgtggcgagggtagggcgcaggaaagaaggagttagggcgcaagcggcgaagacaaggggaataatggcgagaggaaggaagcaaatctcttcctcggcgactttatacccttgccaacgctctgcccggctcctcgtttctcgcgcccactatctcgccccctcgtttctcgcgcccacgttttcactaatcccattcgcccgtttgcggtgcatgaggtggatatgcggctgtggcagtcgagatggaacatatcgtgcgcgcgttaattacactcgccgaccgaagcgccatcaccatatctccaggaaaaacgaaccggcttgtcccgatttttgtgagtaatgtggcagtcttgaagagaccgctcattattgacagtcgagttaccaatgccgatatgcgtgatttgcgaccgattggttttctttccaactgtagagaccggccccacctgtcaccaggccttaggaagaggcgtcacgcccgaccgcttccctcgaggagggcgatcgccctggcataacgccgggggctactgtcggtgacatgggaccgggagtatcatgacttagagacttgaggcagacacgatcacccacgtggcctaaccccctcgggggggtcgggcccgagggtgatacggccgcccttctctttgtctccccgaggagtcggaccgctcccgtctcggccccgagggccgaggcgccccgaccccttgtgggttttgcgccgcgtatatggggtaggtgagcatagcggggctcacctaaccgcatttattgcggtttggacgagcgcgtcacgccacatgtagcgcagtatggcacgctcgtttatccggtctgtgaccggtcacagatcggtcagattgcgggttaggtggcaacaggcgatctgacacacgcctcgccccgtcccgtcaggatgagagtctctaggcactcgtccctagccggagccagcgtgctagctcctggagatggcacgttggtcctggtcagatatatgccaggctttatcccaaccattataagcaagacgttgtatgaagaaaggcgaacacgcagattgctaaactaacacgtggtggacaaaggtgaccggtctgtgactggtctgacactggttatgtccccggaagacaaccgtgttcccacgttgcacctgcttccggcggaatg

SEQ ID NO: 39051 - DNA, 3734 bp, Oryza sativa
gaacacaggagtagggtattacgcttctcagcggcccaaacctgtatacatcgcccgtgtcttgtgctttttccattctcgcgaactttccacagactaggagtttagaatctcacccagggcccccggccgaaccggcaaaggggggcctgcgcggtctcccggtgaggagccccacgctccgtcaactatccacatattgtgagaagtaaaaacaactataacatagttttgtaggtcccatcttgctacccacttgataaacatacattgatgatgcccaagtaagcaatgtgattggagaacttgaaggtagaggatttaaaataaaccaaatttaaatgactataaaagaggtgataattaatatatcatgcatacatgtcttatactatgaaacatggaaaaaaatggttgttccaagttatagtaataatccactcattaatcgttgtatgggcttatgacgatgctactggctcagtcatcgatctcatgactccttgttcgtcggatatatcttcctttagaggatggataatggattgattgttattatatgaaagttctccagaaatcaaactttactaagttttttaccatgcttagagaaaaatatagcaacattaataacaccaaattagtttccttaaatttaacattgaatatattttgatattatatttatcgtatgttaaaaatactggaaagaaattaaagtcaatatttattttatgtaaaaatattgctacgttttttacggaaagaaattaaagtcaaagcgaattatagtacgaaacggagggaatactctattttggaatcggaatctcttactaattccatttgaccgctagaagtaaacaataaaattatatgagaaacaatgcaacagaaaaaccatcacttgcaagggatacatccaaaggatatgtgcaaacaaacggtgcaaataaattgtgaaaaatctgttggagtctaatttactttggttggtcttaccctaacataatcacctatatgctttaacatggaaattaatctactgagctgcttgtgaagctacggaggccggattcgttgatttatgctacgtacttacggtttttcttcttgtttctcttactgttttccttgtgatgttatctgtttgacatagcgaaaaccttcttaatgccagcggcactagctggagatagccacacgaaggtcttccagcgtttaaccgataggacgattaattaaggtttagagttttaatttgacgcaagaattaggcgtcacttttactctacattttctcccatttataaacaataaacacactggtgaggtgaagtgagtgtagcttagacaatctcaagatatatcggccccggtgcttatactggtaggatacgtgtgtataggtgagcgtgttgcaggcgcctatgtttgtacagtgtttcaagaaaaaataaacacactggtgaggatcagggcttaattattgcctattatatttagactcaaaatctgtttctaccaaccacccaaacaaaatttacccctccgttctcttattgatcagaaagaaaaccggtggtttttagctcctgaaaatccgcaacaacagtgggccgatacaatggaccaacaaaatcatcgcttcttccatatagctccgttcaacatcgagaggcactgtgccacatttttttcatgatgtaagtaggaccacatttttttcatgattgatttgacatcactgctgcaatgctatatcatgagttagcctaacgctgattataagccatacaaacatataaaaaaatgtattttatagataaaacttttatatatgtatctttagagatttaaaactgaatattagaaaaaaaaaccacgatgaaaaaaaactaaatatcaatttcaaaatcaagttttaaaatttaattttggtggcttataagctagctatatggtaaatgatgggagcagatgattagtaatgttaattatgaataaacttgcacgcctactgatcctatttaagagccttagctctcgccttaagattgcacatgtagtacttaattgcacgaagaacaccatggcacaacgtgtccaagaagaagatgagcagatgacgagcaccgatgatttgatccaagctgagatcgagctctaccaccactgcttcgccttcatcaagtccacggcacttagggccgccactgacctgtgcatttccgatgccatccaccgcaatggcggcgctgccaccttgtctgacctcgccctcaatatcgggctgcacccgacgaagctctcccacctccggcggctcatgcgcgtgcccactgtctctggcgtattcgccgtcgaagaccacaatggtgaggccatgtacacactcacccgagtatctcgcctcctcctcaacggtgatggcgagagaacacatgccctgtcccatttggtgcgtgtgttagtcaacccgctcactgtggcctctcatttcagcattcatgagtggttcaccatcgagcaagcagccgccatgacacccttcgaggtggcgcacggttgcacgcggtgggagattatagcaaatgatgccaaggatggtagcgtgttcaacaccgccatggttgaggacagccgtgtcgccatggatatcatcttgaaggagagctgtggcgttttccagggcatcagctctctggttgatgttggcggtggccatggtgctgcagctgcagctatagcgacggcattcccaaacatcaagtgtacggttttggatctccctcatatcgtcgccgaggctcccaccacccatagcaacatccagttcgtcggtggtgactttttcgagtttattccagcagctgatgttgtgctacttaaggtatgtacaataattcaagtgacctttgatatgctgtacttttagctgttgagtagcttcttcaataattatgaatattaatatgtgtcagatttgcatgtgatttcagtatattttgcatgcttggcaagatgatgattgtgtcaagattctgcggcggtgcaaagaggcaatcctggcaagggatgctgggggaaaggtgataattattgaggtggttgttgggattggacccaaggaaattgttcccaaggagatgcaaattttgtttgatgttttcatgatgtacgttgatggcatcgagcgagaggagcatgaatggaagaagattttcttagaggctggattcagtgactacaaaatcacaccagtgctaggtgcccgatcgatcatcgaggtttacccttgatgcttctgaaggtgtagatgtgcatctctgcgtggaacctattctagttcagtagccttgaggcatgcgcgtgttcacgtcgaggccatcattttttgtttttctgttgtcatatgtgctatagtatattgtgcgttgtgggatggcacaactcatgcatgtcgtggcttaagtctcgggcatattggtagcctcgatttccatttctatattcatcacaataagaggaagagaaaaccaaaagctacaaggcagtttgtagcgcccaattaatctttatcgctcatactttgttttgtctactcaccaagtgttcatgtgcgttcatctgttctagcgataacaagtggtatcagagtgagcatcgaagatcggtcatggtgatgtctggataggagaaccatttcttgacagggtcgaggtgttgctccc

SEQ ID NO: 39052 - DNA, 5588 bp, Oryza sativa
acatggctaaaatgcacttaaatatttgcctatgaaaaaagtacaacaacatgtagtcaaattaaggtgcttaatttgatactatcgacaccttaatgatctgctaacacacttgtaatcctaaaatataactatttcctagctacattttaaaacaagggaccatatatttatatttacagagaaatttatcactaatacaccaatcgtgtctacgtagcatatttatttttccacatgtggtggttaacctcaatcatttatcgtatatagcaactaaatattatggcttgtccatgatactctagcaccaataattcatcaagtataaccattcaagaacatggttaaggaatgaaatttagttggctgcttgatgcttttttaggccattttaagaggataataaaaaaaagttcctttacgatgcaccatactactagtgatctaacgattaagatctattctatactaaaaattccatacctatagtatgggttatatatatcactagtatgaccattgaccagtataggtatattatggataaagaaagaaatggcatatatgtattttgttatgtacacctaaggtttgcccttgaactcgatctatcccaacatctccagcaaaggctcccacttcaaagtccccaaagattaaatggaggctacccctatttggtgaggcctcaaataatgactccattccagcagtagccactatttcttatcctctatatttttttttctcttctattttgacatatactccatatttactccatgcttcacaccacaatgattcaaacatagatatttctaatgcataaaattcactatatcaaatccacaaattcaaacaccaaaattgaaatttaaattccgaagtttctcttcatgttgctggcaactacgtcaacacattcttcatcatgaatctccgttgtttctaccctacccgattcatcaacaaacacatcaaccttacatcaatctttgtggtctgaggtaggcactgcgatctgtcaaccaccttgcactacactgccaaagttcgtctgagactctgaagaagttcgaaatttattattggaacctcctgaagacctttgcagcctgaacataaacatacctagtatagccaccagatgcaaaaacatcttggttgttctagatattgttcaaccatgcgttgctacggaaaactgttgctacggaaaactaatactccctccgtttcgaaatgtttgatgccgttgactttttagcacatgtttgaccgttcgtcttattcaaaaaatttaagtaattattaattcttttcctatcatttgattcattgttaaatatatttttatgtagacatataattttacatatttcaaaaaagtttttgaataagacgaatggtcaaacatgtgctaaaaagtcaacggtgtcaaacatttcgaaacggagggagtattatgataaacaatcgagcagagttcaactttcagcatccaagtgctttaagaaaatattctccatgctgcgagcgaatacaatctcgtgtcaagatacagacaccaggcaatttttcatttcaaaacaacctatttcacgttataccaggtaaattatcctcgttccaaatggccccactggaatttattttttgtatgttccaaaggagcccttaagtcgctagcatatacttccatcttcatcgactgtggatcagggttttgctttctatttaaaaaacacaaccaaattttgataaaaataaaagtataaaatgattgaattattattaaccggtactccgacatgttttccgagtcaaaattaaatcggcgtgtttttacgaggaaagagatcgattagctttcggtaattaattacgaaccgagtcgagtaggtttttgcacactccgatcgatcgacggcctctgtcgagttatcaaaaccggcggcatcgtcgtcttctccccccatcgatcgatccatcgactcaagtctcaagtctcaagtgatctttttagctagctaattaattttttttagataatactctctccatctatttttgatagtcatatttctaaatctgaaaaatctatttttgataggcatatttcaatccaacaacctatcatcttaatgattttctcggatttaatgcatgactctccattcttccatacaagattggttgcatggacatcgagaaatgtaaatattaatgaatcgcttgtttacgaggaatgactagtagcatgtttaaatgaatgataagtaaaatcacttatcattgttctgtgtgtcaagataaaatatgactataaaaaaaaagtagatggagggagtactagctagctagctatagttaataagtagtcatgatgatgcgcgcggtggcgacgtccctttgcatgctgcgcgccgccgccacggtctgcgccgccttggccacccgcgccgccgtgcgcttcggccgccgcctcgccgtcggctccgtcaccggcgggatcacgctctccgacatcctgctctacatcaccatgacggaggaggacctctcgccggacccggagccgacagccacgtactacgataagcttccgacaaagcgagcgctcgccgccggcgacgtgcaggcttgaggcggccggcgacgtacggtcaagctgccacatgtctgagagatattatttgacttgtactaatacgtgcgagtgatagtctcagtaattaataagggtagtgggttactcgtcctaaccggagaccacctcatcccgtatataattctcccttagttaatgatgtgtgtcttttttttaatctctttagtgatgacttatatcttttatatattttgaatcacatattagttttaagattaatttgcatcattgtactctactcaaaatatgtgacaaaacgagacccatgttggatatattcaaatatttcattgatccaaaagtaatttatttaaattatggaagtaacttagatatgcaatagaagtaactctatatagcattacaaataattacattacgactgagttgatgtaagaaactatatggaataaattcatcaactatatggaataaattcacaagcaaagtgttcagaagatttttaagtaaatatatttatgaaagtaaattcaataaagtcagaaagtaatttatataaatcataaaagtaaattagcacaaaatggaagtaagttgttacaacattagatataaatccgttatagggacaaaaattaaatttaatcagcataaattatgaaattaactaaaaacaataaaaacaataatagcaaattaactaaaaacaataaaaacaataatagcagtaatcaactcagagctttacttatgtgaacctaattaatagtctgtaaacatatgaggtataaaatgaccattataaaagcaaacagagtctgcattagttaaacagattgagattatgcatggttggaacaacagatacctattagtgttatcttatatttgaacccaatatcttggaagcaaggcagtaacatgagctatatatgcacagcagagagacaaataagaaggatttgagcaaatttccatagagcagaaaatgattcactcgttgcaacaatttgtctcaaggacatgaatataagaatgttagatctctatcataccttgggtacgatctggtcagaaatctgcatacttgttaacaaccaaatttcgtaaattctatcattattggcatcggagatgaagatcagatcgaagtggaatccaagatgaagatcgttgcggaaacagagtaagaatcggctgcagtccaaatcggctaaggttaggtcgacagagttcgagtcggacggggctagccgatacagccgattagccgatacagccgattccgataatatgactcggtgtacgtcatcgggttcaagttgatgtgcttcaagatgattgccacgcatggatagagtcctgggaaggcaattgtatctattaattaggatattctatgtaatttctttagagatatgtttgggcaaaagtctgccgtaaagacttatggtatcttagagtttgttagagataatagtcgtgtctgttatggacgtatcttgtaattctcgggtataaatagacccgagccctatgtaaaaaagaacaacacatccaatacaatctcgacgcatcgccacactttatgctttacttttatttcgacgagttcgtgctctcgggttgagctgcatcggtttcaatcttcaacaagaggtaaaacttgtcatgacgacttatgttctcaagattagtgcttccatctttatgacactctaatcttgtctatataattcgtcgagttatcatatatctcacataatctttgataatatcttcgtctaacctataatcggctaacatctgttaatggaaggcagccgattaggttagataatgatgttaacttagactatgtgatatatctaccactctatgaaacttccaacggcttgattgtctagatattgtttttcttttcatacttaatgctgcatcagttgagtttgatctattaagtcgtgcttagaattgcaatctctagcctgctttctggttgcttatcagggtagtatcggagtttcagccaatcttatctgattcaactacttttattctatatgcttgattgacatgttaaatctgccctttatgttaagatcttgtcgcatctaagtatattaagcttatgtttagtatattctacttactgtaaaataaaatcttagtatagagtagtatcggagtattagccgatacatgctagatatacctgatcggctatgctatgaatgtatataatcctactattaatatatatttcgatctaagtgatttatattgtctcggcaaggcgaccgatctatcccaatcatttaatttaagtatatatcgatataaggattatatatcattaatatctacagccgatcgagtagatttagttctggtttgcttattgatatttgtcgatcgatgtacacatgacaccggcttgaaataaatgatatgtcatcggcacctagccgatcggctatcatttataggattaattgcggtttctttgttatttcttgttgattgcaagatcaaatcaactggcacgctcatacatctaaaggcgagctttggacctgcactggagttaagcagatctcccaggcctcgtgttttctgtcaacaatactataaagacatttgccccttaaattaaataaatacattcagatattatgagaaaaacaattgtgcagagatataaaattgtgctaaaagcagcaattaccacccatatgaacgtaccagcaaagcgcatcatatcatcaaccaaaaataccgttcttcttaccactttcttactggataactgaaacatttggtgcatatctaagatcaaatatgccgtaggccatgaccagcctggtgattacatggtgcagtattttacaaaataatatcattgatcttacattagccacccatgagcaagaagaaaaaggcaagattggga

SEQ ID NO: 39053 - DNA, 5108 bp, Oryza sativa
ggaggagtacacagggggtgtcctcaaaggaagggtgcctgatcacatcctcaaacaaatcccggctggcgatcatcttgttgcagggttctcctgagctctgcacccatgtttggtcgtagtccgcaagcgagatgcagaagattatggcacggatgtcctccagcatcccgaggcacttgaagcctccagttagccccttggagttcatgcggatcagttgatacctgcagaagtgcagagatgtaacagaaatgcggttcacatccatgaactaccattcagatttgctggacttggttaatgcaatgatcgatcgatcagatagtctgaaaaatcttactttgtttgtatggctggattgccagctttgtcagcgtatgagtcagagaggggacctcggtcatcaagcgagaattcaagtgtagagaggccattccattggtttacaccctctgcatacaagatatctgtctcggttggttcatattcattgctggatatttcaaccacctgcaaacatatgcaaaaaatccagtcagggcagttgactacaatctcctgccttgataaatttgcaactaaagaaataatattgaattgtgagttgcgacagaagagcgttggttagagccgattacagaagcaacaaagaaaattgtgcatgtttattataggaccaaagcatttcttattacaaggctggatgcaacttaagcaattgctccctaatcactaacgataagctcaaaagcagagagaactccattcaagcttatctagcaagaccaaagtcagatgatctgtaatagttagacaccatttacaatcaagaaacatccatataatcataatctgtatgcacatcataaattggagggacgctagatatcttctctttttccttcaatacattaagccaacatgtaatttatatattttagagagcagctagattgtagttaagtaaaaaaagataatgttttatcaggaattatgaataattcagcagaaaatacgttattgttactcaggtcaacaaaacagtttaaacaacatgaatggttaggtggtcaatgaagaaaaagaaaatcagggctatagtttagttggaaaactaaaactaatctggctcttgtgttaggagcacatctatttgtgatagttacaagtagtcgagtgcttacgcaatgaagaatggcatgtgttaaagagacagaaatgtaaattcacacaaagaagatagtaacaaactgttgatatgaacaatgtcagttataaaatgttgagcaccgaaaaagtggacaacagtagcatatcataaaatcaatcttaccctatcaagaaaataactggcgacatcaggaagaaagtgcaactcatttttccttttatatgtggcttgaatagctggatctttccaaacctcttcaacgataggtgcatactcgcgagttgcagcaggaaaaaaggcatcaaggttacccagggcaactatctccagcaaccaattagcaaagtgcatcaatctttgatttagtgaatacaaagatgacgtgctctgcactgccttcggttcccctgttggaagttcacattctgtaacattttctgaatttcaaaaaacatttggcaacatgcacaggaatagaagaacaataatgttgtcactgtttattttattaagtaataaatagccagtacaactaacatggcccactgtttcataaaacaagagcaagttttcatggcctcaaaatctctaacccagtccagcatcagtttacagaaattgatgtgtctagacaatttggtggtccaatatatctaacagggcattacatactagtcaataagtaatgaaaagtttgctgcagtttttcaggtaaatatgccttgaaaagctaataacaatttgaatatcgtgttttttctatagaaatcaaagagtaccctttgtggtaaccggtaaaaacagaaaagtcaaagaaaatggcacttcatagtatattccctgaaaagtcggttcagcatttctgatgtctttcgaattttattaagtgaagaagaattttatgcatgtgatatctgttgcataactaaagaaatgaacatatggcaaaatgaattcacagcaaaactgagccaaatcgttaccatctcccttgtgattactcatgccaagctctttttcttcctccaaagcctcgtcctcaaagcactcccgccattcaagcaatgtgctgaggtatttgtaaacattgctttgtatcatgagcttcaaattaagtatttcttctggggagaattcagttccatacaagaattttgcctacaaaaggaagtacatacacaaagccacatataggattagcccgttcttcatctaagacaagataagacatatttactgtaaatattagttggacgtagaacttgaccactatccattgagaaatttagagatatgcttttggggaagcttacaagtaattctggaattcaaacaatttcattcagatgatggtctcagtactagaaagtcaaacctaaagaaagattgtccattactactaaaagtcccttaaaacttgaggattaatacttctgagcatatgtaaaatccaaaactaccaataacataatgtacttgacaaccaaagctctcacatttgcacattagcaagggaatagacattatcatcatcccatcttaatgctttttgaataaaatttcacataaaaatgctttgttctaagctatgttctctgagcaataatatggcaaaactaatacaattggcaatagacatggtaaatataggcaagtaaaaacaaacacctgcttaaagattgtgctggatccagagccttctagtccaaccaataaaagtttctgaacttttttctgctcaaggtattctggaacaaacctacttgagtacaaagtagtatcttctttcaaaccacgggggattggcagtgagaaaagggtagcaataagacgggttgatgcctggctgaccaaagtaaatgcaacatattactcagctgatttacatacatatctccaaccagaaaatttttcagaaaacagatataccttttgccaaatatttccttttattatgttctggccctcctcctcgtacgagccatcatcatacaaccagaaatgagtatttcgtgggcactgtacattggccaactgaaggaaaagccagtaaaaactctgatcaagatcttgaagaggtgatgaatgatcccctaaaaagttaagttgcccttttagattcaacagcaggaaaaggattaatccgctaagcatacatactaatgtgagatcaaactttaaaactctgtccagtagaagagtagaacataacaatgaaatagatgggtttgtatgcagtacaatttaaaatggaaacaaagtccaatagaaagctgtacgttattttagattcacaatccttatcccaaatgctatatatagtagcatcaatcacccaccaaggcaacaataaaaaatatgctaatatatcaccaagagaaatgtgttatcaggctcctgtatcaacctctcaggggaattcctgagataaaccaaatgcatacagacaaaacttaccaaggaaaatcaaagattaaactattggccaaaaaaaattttgtcgggctaccttcctagtttaaataaaagagtggagcaacctctatgttctcatcaaagctaccgtgtagaatggatcagagagcacatgggcttgactctacccaaatattaccttaagcatcctaagttcggtctttgtgatctcccgcccatttatgaacacctgtgtagtgccattgctagcatctgtttgtagtttcccaccaatgctcagctttgaactaacaatcctatctggcctctcgccttcctgataccagatgttccgttaaatatataaccagatactgctaagttgaacatgaggaagttgcaggacaatgtaaccattcacggagatatgaaggataacaccatatgctagtgaaacattattgctcttaggagcaaacgttgattatttgcttctccattaatggaaacacttgaagacgtcgaacacacctgtctaataaaagaattactaaacaaaacatacatccgttctttcattcttttaaaaaaaagcacagttgagtttctgaattagaataatggctaaagattctgtagtaatgcttggtgtccataacaattatagttgtgactccagattaaaaaaatgtcattgttagatattgtcgtttgacttagtcaaatgtggcagaagaagaaaaccaatataatgcagctaggtagcaagcctccaaagactatctgattatgaacaaaaacaaaccatatacaggagacttttctaaaagagaacaaaaataaacactactttttctattcacaccacattcctacgcttcagcattttccctaaaaattcatgtattcaacatctgattctactaatagattagaatgagaaatgcaaaatgtagctgtagactagagaatgccattgcagccagctcttaccttgccccagagcccagagtccttgtcgtaccagtagcggccggcagcgaggcgctccggcggcacggcgcagccgagcagcagatccagctccccctgcgagaggccgcggccgttgacgaggatctcgcccggccgcacctggttcgcggcgcacccgcgctcggcgcgcatcacctggcgcacctccgccggcgcgagcagccgcgcgagaagccgcgaccccttccccagcctcgcccgccgccgcgcgtccgccacggggcggccgatgcagccgacgcacttgcggccctccggcatggaccccatcgcccggagcacgcacccggcgcagtaccgcgccccgcatgccaggcactcctccctctccccgagtatccccaccccgattccccccttcccgcacctcgcgcacgccccccgccgcttgcttccctggttcaatggcgcctccggcggcggcggaggaggaggaggagcagggggtgacgaggaggagcaacgcggaggggaggacgccggg

SEQ ID NO: 39054 - DNA, 8633 bp, Oryza sativa
ttaccgggcgattgattttagatttacggatgacggggacgtctcgctgcgttgcgtgtgggacccgatttagtcgctggctggtggggccaagccgtcggggaggagcagagggtgtctcagtcactggcgtgtggggcctgtcttaggtggggcctggttgtccgtgagtaggcatgtggggacacgcacgcatggggtggcagggaggaggggagtaaaactatgggatggatggggttgggaatttaggaggaatggatggggaatccaacgttgtttggtaccacagcagttgcagcagccaaatggtgggccccactgcctttataacaccgtaaaaaaaatctacacaactttatgtaatttctcttttttgcacatataggcatatagccattggtaagtttgttggttaattcgatactatgtgccattataaggcagtgttcaagtgggaaagataaagtgagaaaattccacgttttttgaactaatacatgatgtgtttttaataaaaagttataagaatgttactttcaaaagttatactcccccgtcgcataatataagggattttgagtttttacttgtaacgattgaccactcgtcttattcaaaattttttgaaattattttttattttatttgtgacttgctttattatctacagtattttaagcagaactttacgttttttatatttgcaaaaaaaatttgaataagacgagtggtcaaacattgcaataaaaaacttaaaatcccttatattgtgggacggagggagtattaatttatttttcaaatttaaaataatcaatacttaattaatcatacgctaatggcttatctcgagttatgtatcttctcaatcttttccatcctcttctctcaaacataatcttagtttatctgttttgaaaaatatcattactatttaactatatgtgattataatttagcaggaatttaagatgtacctctacttatcctcctttgatacatttttctagatttgttgttgattgcgactttattgtatgagcgaaatcagaagctgacttcatgttaataagactaatggtgacatgttaacttgttagtgcttttcccgatttcgtaagaatgaaaattacgaagggatcactatcaaatgggccttgaatcttgatttcaacaaagccggacgcgcccatatcatcggaggcaactaactaaagtagggaagatcagcccatagtagacaaaactgatgcgttgttgtgaaagtttagtaatccctccgtattttaatgtatgacgccgttgactttttgataaacgtttgacctttcgtcttattcaaaaaacttatataattattatttattttattgtaacttcatttatcatcaaatattctttaagtatgacataagtatttttatatttatataaaaaaataaataagacgaatggtcaaacgttgattaaaaagtcaacggcgtcatatattaaaatacggagggagtatatattaaccagctttgcatccctaagcctaactaagcaacatggacatgtcattatccttctctcgtctctgtacggagagactaggtgattttgtcaaggtagtgatatagcgcctattgattgacgtataatatacccgacttgtaccgactattatcttgtacaattgccgccaatttgttcggagcctcaaatatgatgcctatatacccctccgtactcgtaaaggaagtcgtttaagaccatgcttaaatcaaaccttaggaatataaatcatgaataactctcaagttgttgagtttgaaaatgtaaaaattatatgaatggatctgtcttgaaaaatactttcataaaagtatgcatatatcactttgcaataaatatttttatagaaataagaagtcaaagttgtgttttggagaccgtatcgctgtccaaaacgacttcctttataagtacggagggagtatatggtaagttactgcaattattatgttccattaatatctctcatagtttgtttgatgttttatcagccacaactaaaatttaaaatttaaagttaatcttagttgttttgggtttttttatcgtaatctactttgcagcattggtttttttataccatgaacaatgcaaaaaaaattgtcattgcttattagccatagcttaaccaatcacaacctaagcgaggatagttttgtatgaatttttgtgttggctagattctagagattaggtacaaaattcactactataaaaagttatttttatgcggtcaaaatccattttttccgtgcggtttggtcacccatctacccaaaagtgtctgaaaaattactattttttccatgcggatgcttatattgtccgcacacgaaaataaaaatcacgaaaagaattccaaaaatcccatcgtcgtcgccgccttcactatcgctatcaccgaggccaccatcgcccttccgtccgccggatctgccaccgctgctgtcggtgacatgggaccgggagtatcatgactagaggcttgggcagccgcggtcacccacgtggcctgaccccctcgggggggtcgggcccgagggagacgtggccaccccctcctctgtctccccgaggggtcgggccgctcctgtttcggccccgagggctggggcaccccgaccccctgtggtattggcgccacgtgtgtgggttaggtgggcacagcggtgctcaccaaaccacatttattgcggaatggacaagtgcgccacgccgcatttaatgcagcacggcgtacgcatatccggtccgtgaccggtcgcagtgtgtgaccggtcacagactggtcagatcgcgggttaggtggcagcaggcggcctgtcacacgcctcgccccgtcccgtcggaatgatgagagcctcttggcactcgtccctagctggagccggcgtggtaactcctggagttagcacgtcagtcccggctcgattcatgccaggcttcatcgcaaccattgcaaggaagtcactgtatgaagaagggcagatgtgcggcatgctaaactgaagcgtggtggagaagaatgaccggtctgtgactggactgacgccagtcacgtcatcggcagacagccgtgctcccacgttgcatctgtttccggcggagtggaggaaggtatgacccatcccatcggagggtcattcagacagcggccattgcagatttccgtccattaatgaagaaatgacagggtgatcccctgtgtccgacgagtgacggcgctgggcatcactcaaggacaagcggtgatttagcttccaggcggaggcgcgagtcgagatttggtcaagatagggtgggtccccacccaaaagaagagtaggtagaagtggtgcatgtggtatccccttgagatataaaaggaggaccttgcccacaaagaaagggggacgactctaagaagacttgagcttggggaggagatcgagagaaaaaagaaccagaagagaaggaaaaagaggggttctagagcttgaactctcttgctctccggctctctgtaactctttctcacacatatccaccagaacacaggagtagggtattacgcttctcagcggcccgaacctgtctacatcacccgtgtctcgtgcgtttgctctctcgcgtatattccacagatcgagggtgaagaacctcactcagcgcccccggccgaaccggcaaaggggggcctgcgcggtctcccggtgaggagccccacgctccgtcagctgccgtccctacttactcaaatataataaaccaatggatagtaggaaccaatggatagtagggtagcgtggataaagatttttgtctcaaatataataacttagtaggggtagtattttataaaagattgtttttactgctaaattatacacgctacccctactatccattggtttattatagtcctaattagtccgggtttatacaccacccatccatagaagataactaagtttatttaaccatgtcctgtctaaccatgttgaaggataaagcttggctatattttagaatagagagaataggtaaaatcattatttatatatttatttggctgataaattttgattgaacattaaaaaaactttaaaattaataaatatgatttttaaagcaattttcttataattcgttttttcacaaaacacgttgtttagtggcttcgaaatcttgcacgggaaaaacaatgaaggtaaagttaggatcgttgacttaaggaaacagtctaatgatagaactaagggaaaagtgcaccgaaggtccctcaacttgtcatcgaattacaaaatcgttctctaaccacaaaaccagatatataacatcccttaacttacaaaactgttcgctttacatattttgatggttttgactctacttttgtctgacatggcaggtgagtcagcgtgagacccacgtgggccccaaatgtcagtacgccacgtcgtcgggttctttccttcccctcctctccctttctcacactcatctccctggccggcagcaggccagctgtggggaggaggtcgcgggacgaggaggtccgacggccggccggcgatgcggcggcgggagcacgggggagatcgagcacggcggcgggcagagtggggcgacggcgaggcggagcggcaccgcacgaagccggctcatgtctgccatagcgtcgacgaacgacgccgtcgtcgcgaggaaggaggaggcggggggaagcgggcggcggtggaggagctccggcgtcgctttgaccgcgggcgctacgagctgcgtcggcggcggtcggaggtcgctgcggcaatggaggagctgcgcgcgtcctcctcctcctcgaacctgtcgccgccgtcgtcgtcgtcgtccgcgggcgccccaccccgctccgtgccgcgggtttcgtgcgccaccgccttgccggccctctccgcctgccgccgcctcggtgtcggttcccaaatcatggcgcaactgaggttcgcggtactggctgttccgtcgtcaatagcgagcctaacaaggtggcggcgtggccggttggaggacgaactctggttggagggcgccatcagatgcgggccgcttcggctcgatgaggcgctctggagcagattatctatcttgtcggtaatctagtggctgcatctgattgcatcgactgttcaatctgattacttcgtgtatttcccctaactctctcttaattatttttctttcgtcagagcagatagtagtgccaagccatgaaaattactagatcaacatacaaaattgtgcttcaatagaattttaactaggatgatttcttgattttgttgtagacacagcccttctcatatggatcaataggcaacatgactacatgaatcaaccatccctttaaaaaagtactgcatgagtgaagtcacatatcgctgctttcgagttggagaacaaatctcgccgtcgccgacgcgtacacctcccggctcatgatcacccatgacgtcgacggcggcggaggaggaggaggcgccattcgagctcgctcagacgacgccgtacggctgcttggtgcgtcgccatcgccagcccgcgcaccgccgacttctacggtctctacacctcgcgcacagcctccaggacgagtccggcggcgctgtgccacgacggggcaacgaggatgcggacggcggtgtttcctccgccggccgccgtacctcctcctctccccacggcggcctcctccccacagcgccgcccgtcgccggcctgagtaaagagagagcgcgagaaagatcgaagaggggaaataagagagaggtgatgaggtggcatcttacacgtgggtactacgatcagccgtcatgtcagacaaaaccggggtgaaaaccgagcatgttgtgattgagggacgattttgtaacttgatgataagttgagggaccttcggtgtactttttcctagaactaaaggatagaacctgcatacatgatcgttgtgggccaaaaggcccaatatgttggggttctccatcgtatatatggcccaatgaagagagtgcaatgaatgctgctcgatctggccttccggcctgtcagtagtcagtacctgcactccttaattttcatcaggtttcaatgcactaaagaaaatggtacacgtaattaagatttcttacaaacctttttatcaacagtcactcaaacatgctactcctaactaggagtagttaattagatagatcccaatttattactcccctcgccttcgcagtacatatcacttagtgtatcttattcacctccatcggtagcccacattatgtaataagtccaaacggtttattagagcaagaaaaataatttgcatgtaagatttttatatatactccctccctcgtatagaaaaaaaacgtcgttctagccacaacctcgtttgcgatttaaccgacgttctgaaccgcagcaggctatgtggccggaatgaccctcgtctattcgatacccgctcccgcaattaatccgcagcacgcccgcgctcgcctcatttaattccttaagcgtcgcatgcaggcatgcagcacgccgctcaacctcgccgccgccgcttgcgtcaagctcgccggccctgctctcgtcgctctcgccgccgctgccacttgcgtcgcgctcgccggccgcactctcgtcacgctcgccgccgctgctctcgtcgcactcgccaccaccgccgcttgcatcgtgctcgccggccccgctctcgtcgcggtcgccgccgccgtcgcgccgctcgttgcgcccgctcacctcgtttctattcttaagccacacgacgctcgccgctcacactcacgctcgccgccgccgctctcgtcgcgctcaccgctcacgctcgcaaagccatggaggtggtgccagactcgaagatggaggtagcgctggtcttgtcggaggtgttgccggactcggagatgttgcttccaccggacttcgcctcgtcggagttggcactgccagacgcagagatggcgccggactcggagatggtgccggactctttgccgccggactcggagatggtgccggattccttgccgccgggcgcttttctatgcgctcgctgccatctcgtccatgaggaccgccaagcatggaatcgtgcgcactcgtcactgtggccgtgctctcgctgcggtctcgtccacgcggaatacataatcggtgccatgatttacggcctcgacgagttcgactgcgagcttttcattcccgatctagacaatgttgtgatgcacggcaatagtatcgagttacctacacacgtgctcaagatgctcgacgagaagcgcgaacatgagctcgctgctggaaaggatgatgccaaagcaacggtaagataacacaactaatcgcattacaatgatgtctctattaattgagtgcataagctaactagctagcttcattctaaatgtttgatgcagcaagagtagcctcggcttcatctagcaaagatggttgacaatggatagaagttggtagccgatcttctctttctaatgttccttttttcatgtgaggaatcttgaagttgttgcttcctttcaccttcatagcttccttcaaaacactttgaagtgttagaaacattcggtttgctttgtgtggagaatactccatgaatgcctacaaaacaagtgtgcaagaaatgaatcaatgagaatattgcatgttaaagaagatgaaaaatgtgtgaacatttcgatcaatttacctcttgaaccgttggaattagtgcctctactgtttttgcattcttcttgtattgaattgcttgaatggcttaaaaaaaacccaagtcaagaatgttgaaatccgtagaattgggtggttgacaaattaggcgaatatcaaatccttcttgcttaccagcctcacaaaacaacagatcatccaattttaaatgggaaggtgcattatcctgttgaatgaagattggtttgcccgcatcttctcttggccgtttggctctaatggcaggcaacactttgttgatcatgaaatctctaatcacgtctcttgtgatcgaagttatgggcttcataaccaagtctccacggacacggccggttctctcattacctcttctagccggttcataagtaacaagtggaaaacaaccaatcttaccatcaaaaatgcaattcccatccctaaaccttggccgagcacaaacacacaagaacatgagcctagggatgtaattcttgttcttacaagtccgatggggatcatcttctttgggcaacaaataatatttttcagattttttatggaggtagaaccatttttcatcgatgaacacaaagtcaaaaaaaatccttaaaccttggatcaacaagcaaacccctcctaatcatgtcaacacaccactttaacctagacttcttgttagcttcggtgaaatatggtttgatgctactagagtggcgcctaagcaaaccttttttcaaatacctttgtatcctccatttgctcatgtttaatttactacacacatcttctatggtcattctatccttgataggaatgttacgcaattg

SEQ ID NO: 39055 - DNA, 842 bp, Oryza sativa
aacgccgccgccagccttctcatcgtcagccgtcggccgccgctagcaagcttctccccgcaaggccgcccgcacgcctctccccgcagcctctcacactgggttgagatgggaaaagaggggatataggtggaagaaactgggttactaatatgtgaggtttatgtgggttgcatgctgactcggccaccatgttagctaaaactaggagcagtactacttgggaccacccggttttgtaagattattgcagggattaatttcaaactgtgcgacaaaatgatagaccaacaaaaaacttattccttattaaattgagcgggctccatgcacaccggaatctcatagcagcctgttcaggcccatttcgcatgcaggtgagattccaagtttcggcccattaacacgttggtgcggatttgctatggaataagtccacttgcagtccctcaattttgcgtcaagtttgtttgacatcctatatctccaatacagaaatcttcacccgtaaactatacaaaaccgtgtaatttgggtcccataacagtaagatgtccagtttcactgacattgcatcctagttagcaaaaagaaaataaaaaatgtggggccacgtgtaagtgagcaaaaatgtggggcttgcgcgctctctctttctcccctgctacctgcttccttcccaaacggcgtggcatggcctcggattggccggcggtggccatgtggatgctgacgctcgggaggcgtagcgcggaacctaagcaggtgctcatctatgttgtcgaggatatggaagaagtttgcatggatgctgtcgccgtcagcgtcgtcgtccccgcccc

SEQ ID NO: 39056 - DNA, 18915 bp, Oryza sativa
gtggaactagacatctatactaccatgggacctaaattatatagtttttacaatttagggctgaagatttctactattagagataatggatgttaaacaaaactcaacataaagttcaaggacggcaactggatttattccttttgatattcccgttgctgcccaagctatagactactccatatctttatcatatcttatctcatcttataaaccaatttcagggatggaaatgtggtatatgattgggccacatggctcattgagaatttagggttagctcctccaaatatcagcaacgtgcccatgcaatctctgattccattagagtgtcagtcatgcattgttccttgcaatcgccattgaactttcagataaatctatgagtaaaaccatcgactaaaagaaaatacgaagcagtaaatatagaaaaacaccagtatgcgtagtagattatagaggtttctgaaaaattcttcttccttcgtcatcaaaatcaaggaaaaaaaattaagcaagagattccagaggttgaaaaagaacattggatctgtccctttgctactaaagaaattccttctctcaatcatgaacaaaaaacaataaaggtcaaagtggaaaaatagaaaaaaagccataattaagttacttcgcctacaaaggcacctagcacaatcgccatcttccgcttcctgttggttgttacccccatagccatgtcgacgagccacgtgacattttgagtaccgccggcatcttccaaattatttttatatatgcaattttgtaaaataaaatggcagttgaataaggtgaaaagtattaggccaagtttggttgtttgccaactttatgcccaggtgggcaaactaggttgttgctaacgtcgcccatgttgctttaccgagctgtttaggctgagttcgttcgaaactaatatctcgcgcacattaaaaaaaatagaaaaatagagtaaattattagcgcatgattaattaagtattagttattttttaaaaataaattaatagaattttctaaagcaacttccgtaaaaaaaaataaattgcaaaaagtacatcgtttagcaatttgaaaaatgtgagtgtggaaaccaaagaaagtgagttgggaaagtgaacaaatgaactcaacattaggctccgttttatacagagtctaggatgaagattaaagtgtgcatgtaaaacgagacaagcaattagcttatgattaatgaatttgaattattaaaaacttgatatatatagatttatttgatatttttaaaacaacttttatatggaacgatttcgcacaaaacacaatatttagccgtttgaaaagcgtgctaacaaaaaataaggtaaaatctatatcttaattaattgtttagtttttgacgggcaatttgtgcaaaggaaagcttgttgttaaaggagatccgggatctctactgcgatcgagcttgttctcacccggttgagctagcttgcccccagaagttacaattactttacggtttcaaacggtgggcctcgccaagccaggcctcaagctcaacctgggcgttcggtttaaaccgacaattcggttcggtttattcggttgctataaaattcggtttacaggcttcaccacccgatcggttctccaaaaaactgaaaaccgcaaaattcggtttcggttttttaattttggttttcggttttagccgaattaaccaaaagttactaccaccagccacaacaatacagaattacataaaaatgaacacaagcaacagcatatatgatattatagatatatcaaatccttaagcaagcaataaccagcagcacagctgcatagaattacacaaagtagtcacacagtacacaaatcaacatgtctcaagagtacagttacatagattcaagagttcttcattattcaaatagagaaatataaagtcccaggtagcaccgtagcaggcacccaacaggcaacaacagcattgcatacaccaaaccaagtgtccaagactccaaatgatcactgatcaggactgaattactgagttgcagctggagtatcttccttggaaatagataggtcaccaagttctaaaataatagatgatctcagttagaacagtcaatagtgtatgaatcatgaagcacattagaatttggaaggaaataaaaattttctatgttaccttcctcaagcaaagccatttgttcgctgtcctcttcaacactaacatagtttcctccacgaagccaatcattagcacaaacaagacgctcaaccattcttggggttagtgaggtcctaaagtcatctagagttcgcccaccagcactgaaggctgattcagaggcaactgaggtgataggaattgccaaaagatcacaggccaaatgagataatattgggaatcttgttgaattggccttccaccactttagaatgtcaaattttggtgtgtccggctcattatcttctgatagatacttgtctacctcagatttgatagttccacttccaccctcactgttaagttgctgagtaattactgacatccacctacaactcactcttttgctggtttcagctgtagattcagattcagtaggttgtggtgccttatcttttggggtatacatttccttgtactcttcaaacaaagcacgaaaataggtattcactgtttcccatactttttctcctactgtatccccaaacatcaccttaattcccattctaatgcaatttgatagtttgtatctaggatcaatagcaacacagaagaagacagtgaagttgagtagttgatcccccttatctttctctcctctcttctctctgtccccttgcctctcaccatacttctctccccaatacttgtagtacttcattagcattcttgtacccatttccttgctcaacttgtcttcactatgagaccattctctcaacagaagtaatacatcagcaatctcatggaaataagtgtgagatgttgtacgactttgtacagaaacacggagagtgaggtcataaaagtgttcaagaaaatcagccatcttcctagccttctcccaatctgctcttgttggtacccctggaccattctctccttctaattctaatttgtagtatgggtcttcatcactatatctttcaaatgctttttggtacttctctgcagcatttaacataagataggttgagttccatctagtgcaaatatctaagtttagaaatgctttgctctgtaccttggctaactcagcacatttcttaaattttaccaacctagatgttccacatctgataaacttaacagcagcacggacacgttgaattgatgtaccaatttccttcaagccatcacctactattaggttgataatatgagcagcacagcgcatatgaatgtactctccttcagcaacacaaccttttgactcattcaagacccttctcatatacttaattgcattattgtttgcactagcattgtctactgttattgtaaaaaccttgtcaatgccccactcagccaagcagttctctaatgattttccaatgtcctcccctctatgtcccttaaccaaaaaaaaaccaataattttcttctgtaggttccactcattgtcaatgaaatgggctgtaacacacatgaagttttggctgttcttagcagtccatgtatcagttgtgaggcaaactcttacacaattgtccttaaaaaatttcttaagcttttctttctcatcttcatatactttaacacaagctctagtgattgttcttctagatggcagaacaaatcgtggacatgctaaagtcataaatttcctaagaccagaacgctcagataggacaaatggttgttcatcttcaattatcatctcagcaaaacaccttctaagtttatctggatcaaatttccaagtggtcacagtaccaagagtactattgccatcacatggtgtcagttgcaaagttccttgattatcaactactggtttgttaggattctttttgcaaatctttagatgagctttcaaggatgacgtaccatttgttcttgagccgcaatgaaatagcttggtacaccacttgcacttggccctctcgtccccattagcaagtttgaccttgctgaaactttcccatacatcagatcttagagccattggttttctttttctggattcttcatcagctttctcttcatccttggactgctgctgctcctccttgtccttgcttgcatctaccactccagtagttgacactccggttttagtgtcttgagattgagtgtgattaatctcacaagcaacagtttcatctgtgtcccccatctagatcaaatgtttcaaatcactaaatcagaacttaccaacatagaacagcaatacaacactcattcactcaacatggactcaactagaacaaacgaacaagaagtgaagaacttacataggaggactgctcggtccgcgccgccgttgtcttggtcggagaactccacgagggtgttgccggcccgccgccagcagcccgtttgccggccgccgagttagggtttgggtctttgggcgcagggggcggtgtgctcgcgggcggctcgccggggcctacagctgctgctcaggggaggggagtgtggcgctgcggccgtgcggcgtgccgcctcgagcccgcgacggcgaggtagggcagcggcagcgctgcggcggcaccctgcgcggctggcggccgggctagcggctgcgccgagtgacgagtcgggggcgtgacgactgacgagtcgggggcgtggcgtagggttggccttgcccttgatggcctgatgggctgcgaactggtgggccgtgggctgcgctgccgcgggatatgtcggtttaatcggttgttcggttcggtttctctataaaaccgccgccgcgggatatgtcggtttaatcggttgttcggttcggtttctctataaaaccgaagctgaagccgtacaccgaatagcacaaaaacagaaaccgaactgacaaccgaaaaccgaaaaaaccaacaattcggtttggttcggtgcggttcggtttgcggtttgcggctaaaaaatgcccaggctgacctcaagctaccttagatccaaacgtcttcttactgtttcttttttttttttaccatacaacaattttgcaaactctaaatattcttccctctaaatattcttcccccaccatttcctttatccttgaccgctatctgtttgaaataaaatataaatatcaaaaaatgatgcaccatcaaaatactttgcatggtaaatataacaatacttatcaaaacatcattaaaaattcttactgctcaactagaaaatctcattggattaaaaaaaaagctaacgaataaagcatcagccattttgaatatatatatctttcgtttcaaatacgaactaaataattcctataaaaaacctgataatatttgtatgctatagaggatcgatgaatagtactaatgggatataaaatatccagcgtgccacgcgccattttctaatcataatgttagaacaagctcgaaattgttacaactcacatgcaaattaaatgccatcgactagtgaactttggtttagtgatcgtgctagtctgcaaattaagctgcatttttgttaatatctcgatggaaggatggcagccacgacgacagcaacgccgaacatgaggatggcgagaccggtgaagttgacgacgaacgcttcgctcggatagccgtggaaggggaagatgaagcgtgctaggccggtctcggcggtgcagatggccatgaggaagatgacgatgcccaacaaaatgtgccatggcgcgtagtcagccctcatcgtcatcaccgcccccgggaatacaaagtagacaaaacccaccagccactgcaaataattttagtcaccggatttagtgaaatacaaccgcctcaccatttcgcttaatacttattataagcggaaacagcttatcaacggtcaaaaaaattgtgaatttagtttaaaaaaattgtgaataaatcttttatatacgtgttattagtattttaaaaacagatgctgaaaaaaaaataaaccaatatgaaaaaaaacccttaaaatcaactctgaaaattgagtcataaaattcattgcctcaatcaatttgaaagtcctctggctcacctgaaaggcatagagtgctgcagtggttatcccaagccaagcatggagggagcggatgtcaggggcgcggagatcatggtggaacttgaaggcggcgtacaggccgacggcggcgaaggcgagggcgaccagatgcagcagcaggtgcaccgccttcttcacctcccttgaccccagcatgatcctgtacgccattatcgctgcgagcaaccatcatgaagtacttccatcactgcacagctaatcagtactactaaagctatttcttcacatatctcctctcgatcaatcacagccattttctttcatttactttgtcttctcaacgaatcacacacttcatctaattattctcatctactacctccgtcccaaaataattgcaattctatgttatttagcatatattaaggtttgaaagaaagactacggtgcccctcattaaatggtgtttatgtgagagtgggaagatggttgagggtaaaatagggagaaatttgaatgagatatgattgatggggcaattagtactctagaattacaattattttgggacgaattttgaatcctagaaatacaattattttgggatggaggtagtatttttttaattcccgtgccaacctcaaaaatactccctccttccaaaaggctaagtcctatttcttttttcaccaaaaccaagaagcaattaatttgtttctatgtgacaaaaccaatgagcatgcaatcaataagcactaaaatagcttcttgggtttctatcaacaatttaatttagcacataataactacaaataggacttagacttttggaaaaaatcaaataatgaaataggttttatacttttgacaaggagatagtaatgtatactcctactccctatgcccgtggattactagttcattagctgataataattaatttaccttctcccgtgcagatgacaaggccaatcaccatgaagagaggatgtgcctgaaaaaaagcacagcaacatataacgttggttgcttgtaattgattataattaattaagtaagctcaaggtttggtacaaacacaactacacaggtagattagacaatttgatttgacatcaccgtgtaaacgagctgaggggtagagctcctatgccaggaccaggagacgccaccccggaagtgcagcacccagacgagcgtgagcgtcagcacggcggcggccagcagctgcgcgaccaccaccaccggcagcgcggtgagccggaagctggcgctgctcttcaccggcatgactatgcctctctactcttcttccccgacccgccgcccgccggctgacacccacgtcgagctcgccgccggcaccaccaccaatcaccaccagcaaccacggagagatggcaatggcatacaaatgatacaatgctgcagtacacgggttataagggctttgttctggtgatgcaaccaaggagtgctcaagtaaataagaaccgggtcaatgcaatcgtaaatttatttgatagttttcaatcctgctaagctagctattggaggagatgaattagggtgcgacaaagccaaggaaaggatgataaaaccggaggaaaggtctaagttttggactgtttcggatttgtccggacggcagaggaaacagcttagattgaaatcatcccagctgggacagatttagctggagttactacaaattgcccattcatcagggatgctggagtaaaaaacaagggacgttattatgattttatattcgtatcaacctgcgcgtcgccggcttgcttcaagcacatactaatagcttgtccgttcctgctggtccatatgttgtgttgttgtgttgtcggtccccctcgcaagcttgaaaagtacaccacaccgggaaggcaaatcaatccatcagctcaaatgcggccgtccgtctggactactttgcttgtcattgcaagaatttctgcttgtttgcgccgagcaggttcttctcatctccagccaaactgaaactgaaattggtccacaaccacctcaagccccacttctcttcttgtagtatgtacgtccaagacctgatgattataatccatgcttctggtgagaacagaaaatggataatgtaccaaaaccggttgcatttttttttgtttcaacattcaagtatatacagtataccaaaaggatataaacgcagccaagaatatgtatgaacataccaacatagccgtcctatcttgtcctatgtcctggcatcgaccttggtaaccactgcattcaccaatagacagttagacaccacaggccctgcacataccacatcatcatgtacaggggaagggacagcaacaaacaacaccggcaagcaaaacctaagagcccaggaaaaatgctaaggtgagggctagtacaaaaaatgctgacctgggatctcagatgacaaccatagaaaccagcatccaggctgcttgcaaaatggaagagagaaccagcatcctcccaaacagcaggaattcagatatagaccaagcctgtaacagaatcacgaccgttcatcacagtttcacagcaactacacaagtaacaaacaaaaccagtactatatggctgacatacagcagacagaaacatcatgggcttaactctgcttcactggaaaggatcaaaactataacacagaccatcacacaagcactattaataccaagagaacacaaaatcacgaaaaacaaatacagcttaaaatatgctggggacatcttttgtgagcttacaatatatacacaagacagcattcgggaacccatgggcaacagaaccagaggcaaacatgacagctgaatcaaataatcaacttttctagatgcggattttgtatacagagggagcttatgtcatatgttacaaaagccctgcctatgttagcatactaatcctacaggacatatcaagcatgaatgttcgctgcagcagcaatcttgcaacaaaagcttgaaacctaacctgctctagagccagtgagagttgtttttctcccggcatgttttcaaaatgaaaatgcccatgcatgtatatctatgagatgataggttctgttaaagcatgctaaaaagcaagcattgcaatgtcaggcataatctgtccagctgacaccttgctcaattctggtcactagatatggaaatcctgtgatgtttcgaaacactgacgacatgaagcaactttgttccatgaggcacccatccaacaaaatgccatctctaggtacaggcacctgaggcttacaacccattgtcactagaggcttggtttcataatcaatcgtctggtgttgtgaataccaacaccttcccatcaccatcccatccaccggtagagccaagtgcacatcttctgaatagacgccaccttgtccatccaagactgtccagggctgcacagaccaagcaaatgtacagttacagcagtgcattctttacacttctcttcttgaaccattcgacgaattcggcctcctaggcattccaaaaggcaaattatctctagacctatcaccaggacgtcccagatcatccaaatttctgtaactgccatttctcggaacagagttagaacgttcatcctcatcaggcctcatgctaaccctggaatctggaagcatttccaaatgcctcggtcttggtccaccagtcctcatgttccttatgttatttgaagtgttccttcctggagtgttagagatcttcatggcaaggaagtccttgggaatggtatcaagatccataaaacatttcctggcctttgcatctgctatcagtaaagcccagtcctcagactgcataagagcaccggcattaccaacaacctggaacagcaaagattatcatcagtacccaaatcatagatctaaggtcatacaacatttttttgaacgaattttgaataaggggaagagacgtacccatagagctctcctagctctagtaagagcaacattcatacggcgtatatctgccacgaaacccacaccatgatttgaggcacggacacatgacataataatcacatcacgctcctgtccttgaaaagcatcaactgtgtttatgtaaatgtccttcccatcctcagtactcataacctcctcgaattcccgctgaagacatttcaactgcaacttatatggtgtgattataccaacagaagctttcttgccaccattagctctcaagaacttctgaagattctcatacaaacgcaaaacaaactgtgcttcatgaacattctggtacgaagatgacccacctctatgagattcacgaccatgtgagatgtcatagaatatgtaaggtgccattaatgcatctctataatatgcctcgtcaggcaatttgacaacactttcactatctgtaaggcgcccttgatagaagtgtcttgatggaaattcacggatctggggatgcatccgatactgcaccgataacaaaatggtagggcaaccagacaactggaacctctcaaagagactcctgctgtacattaaagtcccagctgctttgctgataacagttgcagggagctgttgtggatcaccaaccaagacacacctagctgcaccgagcgaaagtggagggaggactgctacttcactagcctgagcagcttcatcaattaccaccatatcaaagccatgactaaggcgggaaaataacttgcgaccactgcttgaaactgttgtaaaaacaatttctgcttcattggcgaaacttgcttctagactagccctagcatcttccatattgaagttgctgccaacacggaacctgctttctaatatcagcaggcgtgacatctccaccaatactttatccctgctttctactgaagcagcaagtttctgaagtagaaaatcacgactacgatctctttgagcgagcacatcagggtctactccaactgaaccctgcgatctgccagccgctgcaaccatagtaagttccctttgtagaagggctatctcctgtgataattgctgctcacggcattttagctgttgcagccacccaatcacttcatcacggcccttcattaaaagctggtcagtccttcgctcaactgaaacagcttgagcagcacgagattgcgaatcaactccaacacgggcaacatcaggacgatagaccttcatttcaccatctataaaaccacgatcaagaacgcgagcaagcagctcatctgtggcggcgtttgatggagcacatacaagcatccgtggtttggggcaaagcttgggaagagtgcggaaaaggttctgatccatactctgtaaaacttcatcaatggaccctgcagcaacagtctccgagctgttgcttgtgttaccgctaacttgcttgtaactttcaggagcaagcttcttgagcagagcagcatagtaatgttgatactgaacaagatggataacatttagcatcccccataccgtatgggtttttcctgtcccaggcggcccttgcactaatgtgaaaggccagggttcttgtttcttcacagctccgttgcttgtgccagcagctgtatgcattgcagcccaatgaatcgctgatagctgaggcccgttgaaagtacgatgcagatgatcagcaaaatttggagtgaaacaatcaggcatagcaggtggctgctcttcatacttggggaagtgctctggacttggctgaagaatagcattttgcatctgatggaaagatttttgttaaaacaactggaaaagaatattaacaaagaaagcaaaatatataaaatgcattacctgaacattgagtctgcggaatgcatgcaaggcaacatattccctttgtgttgttgctagggaaccaagactagtcagataccaggtgctccgaggttggagtttcctcaaaacattggtctcactgcttcacattcaacacaatagagtgataagataattggaagtcaagtattcagaacaaaagcgtagacaatagaaaaaacattataatattatttgtccatcaagcaggaaatcctacaggtcataagcacatgaataataacaggtctttttgctacaggctaacaaatgtagtctagcaaatgtatagttaatctgagcatgttatgcatacatgggcaactgtttaatgcaactgtgagtgtaccagtgtagtgctcaccggctcacaaatgaagagttacttaagtgctggactgaactcactaattatctttacttttgggaatttggaaggaatgcatcatagaacatttcaacatagaaggcaatgacacaagttgtggctatgatcaaggatgacacgcatgcttggaccctggcaggagtctactggatacacaacaagcctcccatcgtttgccctacaacttataagccgcttttggagttgatttttgtggtttctttgttatagtttatattccagcattggctttcaaattgctaagggcacatacataaaagttttaccctcaaatttccttttgttgctgataagccataaagcttataatcagcattagcccaaccaatggcagatctatactcatttaaagaactccgatggtggtggtggatggtgagtctgccaccacacaccaccactgccatataggacccctaaatactgagtaggtggactactctatagacagatgtacaaatacatattaaaaggcaacaacgtagcttgaaataattaatattgattacaatgggaattttttattatgacttttggggctttagagcgcatggtggggttctctagctaaattatgatgcaaagcacaggcatttacctagttttggtagatagacctgcttgtgtaggacttgcttgcttgtagtttgttccatctaatttcctacttcctccattatcaagtataaacatactttcctaagttgtttggcagagactaaaactaagtgttttacggtcgtacataacctagaacctgttgccttcaatcccgcttaaagaaagaaatggcaggccttctgctatcccccccccccaaacccccaaaaaaaaaggactcgacagtgcatgcatgtaagcgttgcttattgtatcaaccaaaacaatctgtatgtcaagcaatgttatatattgagcattgcatgctctaggaatgccatgtctaccagaattgaacaaatcctaatcagcagataccagatatatgagcattcaagggacaacacaactctaaagagtacacattcagaataataaataggtttgcaatgaaaaaaaaggtagtagaattacaattttgccaaatactagcgtacctgctagaatcaaatgaatccccaagatagaagtgaatgattgccccaatgggatcgcgtgtatcaataggcgtatggcgtctgactgtaccaacaagccgtccacactctgactcagtgtcttcatttgaaccaacattccgcctattagatctacttgattgggaagctgacaacaaagaatagataaataacggttattaaaatatttccttttcagataaaaggaccatcagggcttaatacaaatgagaaaaatcaagcatagctacctgaaccaggcctaggaaaggacaaaactgcaacttcaccttctttgaaagtccatttatactcgtgcattggtagaacaacaacatcataccatcctgaaagcattgcacaagcattgacaggtgattgcattgcaaccaagacatgtttgtataatagcttcatggaaaatgacatcaacaaaacatgctggagatcagaacatacctctttcacgcctctccactgttttcacccgcaccataacatgtgcatcccttgatacagactcaagactctcctcataggaactatataactgagctcgacattcctcaaagagcaaaggctcgaaaactctaatgtactcctcagcggattcaaaacttttaggaacacattgaagttctgcctcctctgttcaggtaaaaaattacaaaacatgaaacacgcaattagaacatagacaatgtgattaagaacatatacagcttgttggaattttagaatgaaaacagaaacaggaaagattcatcagtcatgtataagattcgtatgagcccaacaaaaatatcagagaagaaagagttctactttgagcaaacttcgaacagccttaataacaaagcacaagtgctgagcattaccctattatttaaaaatttaaaacatgtatttatagaatttcccagtccttgtggcacatggtggcacttctagttaatagaagtcactaaaaacagggtaaaagcattcatcactagacagttccacaatttcaagcaattgtatgcattttcccatagaacatcttattgtttttcaaattgagaaatggacaacaaagaacaaacctggattgtgccagaacttgtcacttgtcacctcccgtataagtcgttcaacagaagtgtcttggtattgcatgttatttgctggagtttgttttttggaaacaagagacctcttgttgactggtttctgatctacagtattctgtcctgttacaaccgatctctgagaagaaatttgtctgccctttaactgtcttggcattggttgttgataaccatctgcaggggcttcttcagcattcattttctttggccggccttgagatcccgtctcagcatcaccattggattcagaaatttgatcgattggatctgcagaattacttcgttccgaaccaagcatttcagattgcctctgatccctgatggttggctgactttgtctttctgcagctctttcagcaataccaccaccactgcgaaaagcttccttcacagtacgtgtgacaattggtgctggaaaggatgactgtcttctgggtgttgatgtcttcattgtgccagcttgctttgcatcctcaacattaatgaacacagtttgcctggctctctttttacctagcattgcctctttgtgttcatccaacttaggtctctttgaagggttacttgcaaacttcaacgcataattggcttctacacctctaacatcctttgacttgttggacagatctgaatcatccccaagctgatttcctttgttttctaaatttttcgtgctctcaagtcctgtgggaccacgtaccactggatccttaggcacatccatcatttcggtgtcactgggctcagcggcggcctcatctttaatcatgttaccagatttgacagcagtaggttcactttcttgggaatcccttttcacttgtgtagttgcagtaccagccaactcttctttgttgctaacactactccctgcagtgtcagaagcaacatctgcatcagaccactctccttcctctctttccactgcctgagaaacctgattggaggacccaatcattttagcaacaccatcagagctatggttgattaacatagatgtagaggctatgctagcattcaaattatcttctgccttgattggctcctttgtaatttgtgaatctttgctcctcacaaaaggctgaaaacctgaaccggacggtgcgtgcttaaaggcattattgtttaatatcccctgcgactgtgttacttcctgttgcggaaataaagagggccctgctgtgggaacaggaagggtcttctgaggttgtgacacaacaactgcggcttcttcttcttcagcttctgttgggagctcattaaggtcaaataacatccttccacgagaccccatgtcatgggtaaatgcatatagtttgaacctttggaaactattggactcgataacaatcttctggggtaacagaacctactttttgaaagctataattgaccttttgtagaaaatatctgcaaaaacaaccagcacaagataagtaatatacagaacgaacagggttctcaagggatgcttggatgcttcggtccgctagtgagatggctggcccacagaaggccaggagaactgaacaagtgaacaattagagcagagtccacatcgcatgatactgcaggaaaggaacatttcaatcaggtgaagtgacctgaaaatcattcttcgctggattccttttgtgctgtgaccctgcccactccgtcctcttgttgtccacttcctacccatctcaagaatttgggttctagcaatacaggatctcagcatccaggcagacccttttacagataaagtaaataagtatgcagaacatagctaagaacaaaagaatgatgacacattggtggaaatgtttgacatagctacttaagagtgcaagctaggctctagattcttcgttgtttctaaaggaaagcaatgtaaacaatagcaccagtactatagtgtccaacattaaggtttagaaaaggaagaagtaaattaaaataagaatgatgttggactttaacatgagctgcagcaatgtcaggcttgccgatattaacagagtactaaataaaagaaaaacacaattaaagcttgcataaaacagaggctacctaaataacaggaggagaaagagtgctcaactagtctagaaactttcactagcccaacccaatcctagatctaatccggcactagcaatctcctttgcaatcccttagtccaaccgtaactgtgttatgattgtgcatgcgacatttgccgaagaaataccctgccaaaaggactcatgacagaaaattatcaatgccatcaccaccaaactacaaaaccgtaactgtgttatgattgtgcatgcgacatttgccgaagaaataccctgccaaaaggacccatgacagaaaattatcaatgccatcaccaccaaactacaaaagagagtataaacctaaaagaccatcgagatctttgccaaatctaaacaactttgtcccacatgaacaaaaatacacactaaaaccgacaaataatcccttctacggaatttgccaaaacatcaaccgtgagtgacagcctactcccaatcaaaagataaataacccatagctactccaaactatagtcggaactaaaaaagaccacttatctacaaatgctctcccaatcagtgcaaatgctacattctacagctgcatcacaactattgagtttaaaattagaaacaaaagcagatattactgatctacttaactctgattggaagatattgagttctagctaccccaaattaaaagctaattacaacagaagaaacagcttctgctaaacatgccccataaccaaaggctacatctttttcagcagcaatgcaactcttgaaaaagagaaaaacagctacggaatctatgtgacaaataatcccattatgcaacttcacaagatatagcaacaatctacagctgctcccataaagagctacctatgacatgagtaccttcgggtaaacacaaaccaacccctacacgatttcagacactaagacatttactaagtaacaaaaaaaacagggcagccagcatagcggcagataaagcaatagctttaaccttctagtggttgtgacctctccacaaaacctagcatgatgaatactacaacataccaggactattgaaacttggaaaatacaccactgtagtaataacttaaaatgcttgtttgatcaacctaagcagagaaactaagaaactctagacagcaatagcagcagcagctgatgacagcaaaagcaatgcagtgactaactctagtcaattgtcaagcactagaatttattacgaaaatttataacagagcattcaacagacgcgcagaacagcagcacatggaccattcgaactgaatcatcactcggcatttcattccactcgcaaaaacaaaaaggagaaaacgtactaccatccctttattaccacaactccatgacgcaattccccccgttgctctgctcgatctaccaagcacccccgtgtatttaaacccacccccagtcttaaatcagcaatctggtggaaatttttcgtaaagcgagggggatcgttaccaccccgcaaacagttactagattcggcaaccaccccctgagccccctgatccccatttcgtttctagattcggcaaaatctcctcgagagaagtttctcctcaataaaagccccaattcggcagggcaaaaatattaaaaaaaatcccccgccgcgtccagtccaatcaaatcaaaccaccaccacacatcacgcgctatctatctactatcaatcaataatctattagggttctatccgttcgccgttggtcgtcctagggttggttgggagcaggggaggcgtgaggggaagggggggatctccgtaccaggcgatcggcggcggcgcggccagatccggccctgtgcctcgtctcctcctcctcctcctcccgcggcggcgtcggcggctttgactagggtttcccaccgcgcgctcctcctcctcctcgtgtgatgcggtgcggtgcgatgcgatgcgtttgattttttttttctcaagttttttttcttgccccccttttttggtctgggtggtggtgtgtgtctcctcctcgcctcctcccacgagcgagcgagcggtcggtgagcgtgacgactgcttccttcttcgagaaatcgagagaggaggagagggggggtgggggtgggtgtgaggcgaggaaggggggggtggggggc

SEQ ID NO: 39057 - DNA, 727 bp, Oryza sativa
attcctgcagccctatacaataatttatgagttaggatcgacctactccatctcttccagtataataaatttgaacatacatacatttttctgttctagatcacattttatactaggttggttttttttgacgaagggagggactaccctaaggttgaggtcttgacttttgttgaaattaattgctgaacaatttttctcatcttgtctcccacgaaggggaaaaggctgacgtggctgtgacctgtgactggcattcatgtcgggtagtattgtttagttaagcttgttcaggcttcccacaagacctgcgcctgcaagctcatcctcgtcacggttgtccattcggtgtagtttttcctcgttagcttgggataccacccactgcaccatgacctctttgccaacgttacccctcattcggccatcgttgaggcatgcatgtggcagtggtgagcgggagcaactcctcgaccctgtcaagaaatggttctcctatccaggcatagagccatgaccgatcttcgatgcttgctctaataccacttgttatcgccagaacagatgaacacacatgaacatttggtgtgcagacaaagcgagagagatttggcgctgcgaactgcattgcagcttttcagttttctcttcctcttattgggatgaaaataaaaatggaaatcacgggctaccaatatgcccaagactcaagccacgacgtacataa

SEQ ID NO: 39058 - DNA, 831 bp, Oryza sativa
aggctagatagaaatggcggtccatattttgttggatatggcgatccaactttttgtttggttgggtgaatatgatgatacagttttttgtttggttgtagggatgaaggtggatttggtgatccaaatttttgtttggttggagggagtagggtgaatgagtaggtgtggtcacctctcacttagagagggtgagtataccccatcaaatttatatatactacgaatcacaaattccccaacaaatcacaaattatatatatactacaaatccacatagagaaaaaaggaaaaagaaaatgagaaaaaagaaaaaaaagaaaagaaggtctcgcaccccgtcgctgccgagctcgcctctcgctctggttgacctcgccttccaccgccgcgttcgcatctcgcgtcgccgccgacctcgcccctccccaccgccaccgctgacctcaccttccgcttccgctgcagtcgccgccgacctcgccttccgccgccaccgctcttgcctctcaacccatggctgtcgctgacgcacggtgagggggtgaagcgacccgcctcgggcgctcgccctgctcgctcgggtgctcaggcggctacatccgagcaaatcactcgaatccccccatccagcatctgagagatatattcctcttcgggccaccctatcccacttccgcccaccaaccaaacaggcaaaaaaaataggccgccatctcctatccacccaaaacctcccatccaaacacacccttagtatgttgtctcatcccgaatttgtgcactatattacatcaactaaaccggccgacacaaatttgggatgagaca

SEQ ID NO: 39059 - DNA, 723 bp, Oryza sativa
aattcctgcagtcctcatttttccgtgcggtcctcttgaatggaccgcacacgaaaatgagcctattttcacgtgcggacctattaagagaactgcatgcaaaaatacccaccctttctttccctcctacccactttaaattttcccctctttctctcctcttccctcctctcctctttctctcctctcctcttttactcctctcctcattttccatgtcgtcctctcctctccctgagtcctgacggtgcttggcggccgtccccacacggatccggctaccggccgccctctcctcgtagtatcccgctccactcccctccccttccttcctccccagatctggcggaggggagcggcgccggcggcggtgtggccggaggggagcctggaggccgacgggagcacggatccagcggccggccgccctcccctccgctccccccctcgggatccagctcccctcccctccccttccttccctggccagatccggcggaggggaggggcctcagcggcggtgcggctggaggggaccgcggatgccggcgacgggtggcgcggaggccggcggcgacgacgacgagggcgcgggcgggatccccggccgacaatgaccaggaggcggcgggcggcgcggaagccggtggtgacaacgacgagggcgcgggcagcgtcttcggacgacgaccacgacaggaggcggtggcgttgccgggggat

SEQ ID NO: 39060 - DNA, 954 bp, Oryza sativa
cgcataccaatgagaggataattaggcctgagcggccggtttgcatcaagagatttgagcaccgagctatcggatcccctggaggaaacaatggcagcaggggcaaggccaactttcttggtcaaatcggagaaatggtgcggaaacgcgtgcgcctccacagcctgcatcgaggtgagctcctcgctggccccgtcgacgaacaagaacgtgaatgctctgttcctgcaagtctcagaaggattcgatccatgatgcatcggtaaaaaaaaacccgcagagacacattaagctgttcgatgcggatgggcgaacctgaagtcggcgttcttggaggcgaagatggagaggaactggttgacggagatgccgagctgcagatcccaccacgggacgaggaactccagcttgttgtgcttcttcctgcacacctgcgcctgcacgatcctcaggttgctcggcaccgtcctcccacctcctgcgagcaaatacaaaaaaaacaatctcgttagagatcgaaggaatgatgtggaagcggatgttgggatgagttcgttcgatctgcgtttcttacgggcgcaggggaaccagtggtcgatgtcccacgcgagaggcgaggcggagtcggcgtggaggtagagcacgttgccgtaggcgtcgacgcggaacagcgccgggtcgaacccggcgttgccgaggtggtcgagctgcttccacagcaggttcgcgaacccccgcgggttcgccgtcggcgccgcctccgcgtcggccaccgggaacatctcgttcagatccttcgcccgcatcgcctgcaccaccacccaacacaaccaccccaatcagctcaccaccgcaccagcagccgcgaccatcacctcgacgagcacccattacctcgtgcgggtggaggacgtaagggaggaagccgtgcggcgggccgtggccgtacgggag

SEQ ID NO: 39061 - DNA, 10454 bp, Oryza sativa
gttctactactcccaaatcaacatgaggctcgctaatcatacgaatttgaattccaaaacaacaacaaggctgtgtttagattttaaaaaaatttggcaaaaaacatcgcatcaaatatttagacacatgcatggatcattaaatgtggacgaaaaaaaccaactatacagtttgtatgtaaattgcgagacaaatattttgagcctaattgtgtcctgatttgacaatgtggtgctatagtaaacatttactaatggcagattaatcaagcttaataaatttgtatcgcagtttacaggcggaatctataatttgttttgtcattaatctacgtttaatacttcaaatatgtgtcagtatacataaaaaaaattggccaactaactgaacacggcctaaacttgaaagttcaatccatccaacacatcataccgtgtagacagacaaatcagtctgaggaaaaaaacgagacatattatttacgcatgatcaattccagtattatatttttcctttataaaaataccggggaaatgctgctatctgggtgactggacgggggagcaaaatcgggtgctccccccggccccgctccccgcgcgcggccatgcgcctgcatgccgctggcccaccatgtgtctggcccaccacagtgcctgcccctgcaacaaattaaccatatattttggaaactctctattaagaaaatttggtttatttttttccaccaaaaatatttaacctagtgcactcacaatgtttcactatgtatagatctaatgttgcagtaaactgagatattccattgcaacaaaaaaacccacatattttggaaaccccctattaagggaattcgttttattttttgttccatcgaaaaatgtttcacctagtgtacttataatgtttcactatgtatggatcaaatgttgcagtaaactaaaacattctttcgctatttgctgaaacattgtttttatataaggtgaaacaacacccgatttaaacgagtgaaacattttcgatgtacttagtgagacaatttcgatatacctggtggaacatcgtgcaacatttaaaaaaaggctaagttggttatatagcatcgaaagttcacgtttttggttttatagcaccgaaagttaccggttcactttaatagcatccaaagttcaccttgttcccatttttagcacttccatcaatttttccgtccgtcttaatcgttattgatccagccacacacatgatatgatatttctacccctcattgacatgcattatacttgtacttattaggggtagaaacgtcttatcgtgtgtgtgactggatcaaaacggacggaaaacgatcgagaattgacggaagtgttaaaaatgggaacatggtaaactttgggtgctattaaagtgaaccggtaactttcggtgctataaaaccaaaaacgtgaactttcgatgctatataaccaattttgccttaaaagtaattcaataataagctaatttttttcatcggaatatatccatgtgtaatcttgttttgaagatttaattgcaacgaatttaatggtgcaatcggatcatgatttggataagtaatttaaaagaaaaatcagtttaaagtagttttacacgtaaatcggaggcgattttactccgaattgatcgggcgcccgagcctaggctgccccaaaataccgtttaggagtttagcaatttgctaacgaaaaacaagaaaattgtaagtcgtcgttggaggttagaatggggcctaagccgaagtgtcagatttggagcccatctggagaacgccgtgcatgatgggccgcggtctgtcatttatgggcctatctagagcggcccatagccccgataccgggccaggccaaagctgactatgtgggctgcatggcccactcgccgaatttcccccctctctctctctctctctctcacggcccatgtgctcgcaattaccaaaactttgcattgtggcctcgtcctgtaaatgacaagggatcagatcaagcgctgcaacacaggcacatggagtaaaactacttcaatctcaaccaaaatttatgaaaaccggtatttaatatatttttaaaaatataaaaacaggtagtatttgaaatctggagggcaaaaacagagtataaaacctctgatgctttttacttgcaaagtgggaattgatcaagagttatcattgtgaagtggcaactcgtcattcagagatcgatgccaaccaacagctgctgttcccaatggcatccatccactctgcatgcagttgcagtatccctttccaagatttggatcatcaccaagagctcctctgcctatgcctagcttcctcatgtttctactggcccaagaaaagcctttttgcaaatgcagctagagtactttacttgactacctaaagcccctttgaaagcagagtcttcttcttcttcttcttcttcttcttcagttcatcttgtggatggatggatggaatctggattcccatccttgctccaagatgcttctttttcatcttttcccaactccacttttccattgtctttgacatcttcaagcaccttcccttaaaaccctttaaagctcaccacagtccacagcagcagcatagatccccctctaaccttatcccaatgcatgtgttttaattatagtactccctccgtttcaaaatatcaggatttctagtatttagtttttaatactcatataagcattccttctctgatttctacaattcccatcatttcaataattccaaagccaattagatgcttggaaagagaatctatgcaattcaaaatttaaaaattgacaactaaaatgacaaaaaaaattgccctaaacttagtattttctaaacaacctataaatccttaatactccaaactccctttgttttaaacgagacaacaacaacttctgagcctagaagtttattctttctaggacggatggtgtattttggaacagagcgagtagtaagcattttgttttgttttgttttctttagctatacctcttgtttgcagccagccatggcagtatctatctccaaatgattggcttgggtttatgagcccaagcttctgtctcctgcagtccatactctaggttccaagaggcaatgcgacaagtgattggtggcatgaggtaaagagaacagcagtaaggtggtgtttggttggagggactaaagtggggctaaactttaatccctctcacaaaaacaaaaacagtagtaaggatggatggatgcaatgtgtgttcagaaatgacagcagttggactctgaaatttgctgcaaaggtagctagtaggggatactcctatataaagtggtcacagaaagatttgtgccatactactccagtcaatgcagtgcagtactcatcttgtcatggaagttgggacactgcgtagcagctgcaggagtgttcaggtaaaaaggatttgagtcagagttcaggaattgttctcctgctagtagtacagaaactagcaatcctctgaattcgtgtgaagcaataagccaagaaagatctgccaagacaccactgcatatcatgatatttaatctttgcagaaaagaattggagatgaaaacgagcttgcaaaacagaaaagaaaaaagttcttcaatctgaaatgacttgacattgtcacacttcgtcagaattactgtactcacagttccatacttccatggcgatccattggccgatagcccgatatatcttgtgttgcaccgggatgaacaatacattggatggattgttcatggctccttgtggtacggaagaatcgattcgtaaagcctatactcgagaaggctgatctgcagctaggcaaagcatcaaacattgtacagtagaaaacaaatgcagagaaacttgagaacgaatgggttgggttcagaggcagccaagccaaaaacaccttgtagaagcaagagagaatcatgcagtagcatttcaggctttgattaacgtggcttagcatctttgatgtcggggaaaagatgggttgctaatctaatcaatgggattaaaacggtaacgagagtggttgcctggtcaggcaggttctgatttctgaaactttagtttgacaacaggtggcctacttctcgaagatgaccgtggaccagtgtttttttactgctagattactactgtactagattacactaatgtgaatgaggatgaaaaggaaaagttaatctcggaccatatgaggaatgttttactgctaatgcatcattcgttatctttctgaaaaggcagactctgaagaaactcgttctgcatcgaaccaaagtttctgatttgcaagtaatattcagtgttgcaagttgaattttttttagataatgaatgttgcaagttgaatacactaacacagtaatagatgcggataaattatataaaaccgccaaaaaaaatatttgaacctactaaaagagaagacttttaggcagacaaacaagtcagaacaatgcagtgacaagaagactagaaactgttcagagtctcctctgatgcagtttattcacatcggtttttacaaatgcatctgcttatgatgatcagcatctaaaaccgtcatcattatctaaaaaatctaaaaccgtcggagctcaatcgaatctagacctaaaattttcaagtcccagagagagagagagagagagagagagagagagagagagagcaatcatctcctctcttttctttaaccatccatccatttgcaaagcaaacaaagcaaagcaaaggaatgtcaatcgatcatagctaagctaagagctggaggatatgaggaacattcagaacccaaatccgaatcgacccaacaagagatatgatttttttccctaaaggaaattccctctcttttcgatctttccacttgcattttctcagctttgctgctcatcaatcagagaagaagaaacaaagttggatggtgctttactctaagaaccttaaccggtgacaattagcatcccgttggattcctaatgagcaatggccgttccttttctgcatcgctgcccacattgcattattctcctccttagcccccccaagcatatgcatgcaaaaaccgcggaataactaagggagggcccacatgtcagtgcgctctgttgctgtctacactagatacttacacacgcctattatagagacatgtctcgagcacattgtattctcagctgatagtgaatactgtagatctttttttaaaaaataatgggtatttcattgagtgacagaattacgggttgtttggttcgggaccttaggggttgtttggatgagtgccaaattttattgcccttgtagcgcgctttggcgacttaggactagttcggttatcagaagtcgggccatagatgttcaatctctgacaccctcttacaagactaagttattaatctcgctatacctttttaagtcattgatgtttgggatctagctagtttgttatagggtattttgtcgtaactatggctacaaccaaacaaatatttaagttgcttgcttaagctgagacgtggtaaaatatggcaaattatggacacaaaccaaaccgtcctatctttggcctcgtctgtatgcagggatgcacgtatgtaaatataaaagtagtggagtacattgtaaatcctggtgtacatggagttgtaaccatagttctacttttctttcttacttccatgtgatccggaacgattttccaagagaactgacaaaaaacacacacagcaagtagcagtagcactgtcatggatggaaccgaggcaaaattcagaaatccgaatagcaaacaccaccaaaaagtacacactcaacactggagaacaaaaaggaaaaacttgggggtaattaatcaaaacctcggtccatcgatcgatcagatcagaccatggaatttagagcagggcaatgcaggtaattaaattaaattaaccaatcaacaagatccatccatgctgacgatcttgttccagtacactcactgctcattggcccggaggccgaagagaagatgggggcaaagctcgctgggatcatttggtgtggaaaggcgagcgaaaaaaatgggaaaagaaatggcagctctaggactagtatcagctggtggtattgtatgcatgggtcggagagaaatgaaaagaggaggaagacgatgagggaggggaatattcttggcgtcgggccagacaaaagggatattcagaggacgattttggtcagggaaggcaggccaccactgaccaaaccacgcgtgtcacgacgacaaagttgcctcaacggctcaacggttagacccagggtttaacttatcactaatttttcgaagtgaaaacagctccttactgatttgccaaaagctgataaaaaaacaaaaatattcgatcaataccgtacgaaaaccggctaacataaaccgatttttcacaaacgaaaacttagtgcaacatttctatgaatatatacaaaactttctatgagacatctttgaatttccgatcaaatatgagccactatgtatagctttgtcatccttcttgtaaaacatttacagaggcggggctcctattaaaaacgtcagctgtacgaacaaatcattttatcgatggaccgcttaaaaaggtcacatgtatatatcatttccacgcaagattatatccactagcggcttcttgtccacctgtggaaacaaccattttcacatgcctttacttagaggcgggcacaaaacctgcctatagaaatgcattatttagcccgcctaaaaaaacgtttaattccgtatgtgtagggataagtgtacatatcagaacaatttttctaatgctacaaaacatgtaccgcaaattctttaagtgcttgctccgtaacatattataagttgttttggttcttttagtcaaactttttataactttgactaaatttatcgagaaacaagctgacttttgtaataccaaatcagttccattaaatataatattaaatatattttgattgtatgtttggtattgaaaatattgctataatattaaatatgttattgagataccgatgtcatatcttaaactttacaaaattataatggtatggttccaaattaccctatttttaataaatttagtcaagcttacagaagtttgatgaaaaaaataaaactacttagggtgtgtttagttcacgctaaaattgaaagtttgattgaaattggaatgatgtgacggaaaagttagaagtttgtgtgtgtagaaaagttttgatgtgatataaaagttggaagtttgaagaaaaaattgagaactaaaccaggccttataatataaatggagggattacatgcctaaaaacatgtagcgtgagtaagaccaatgaattcatgcatgcatagacaacagatgtgcaagctagtgttcctgtacacacatgcatgtattggtctgtaccttgtacgcgaatattcttgtctctggaccatgcaaatgtatatgcatgcatatatatacttttggggcatgtacatgtacggtgttcaggtacgtagatgatatacgtatatacgtatacatgggctagctatacgttggatatatagcatgcagtacgacgactgcgaccatgccgttcgtacagagagagagagaatccatggaaaaggtagggattggagtcttgtacctcaagattgccccaagaaagcgaccaaccctaattattgcacagggaattcgatgcactaaaacacacacacacacacacacaacacctttctcccacctcttcttgtgtgtatgaactagctagagagagaaatcaagagagagagaatcttcttagcttcctccccaattcctaaaaagccaagagtagtagcagcagggagattctcacattctccttcccttcacccctctcttctctctctctaaaggacaccatgtcttcctttgtggtgtccttttgtgcgtgtgcttcatatccccctccaaagccttaagatattccttgcttgagccatgctgatatattcccttgtgaatgcaaagtgtgccagtcctcctatctatctagctatctctctatctacacacactcactagactaccatatgtgctataacagtgccacaacatgcatatacatgtacataaacacatgcatgtgtgaagaagaagagcacagaagaattttggagcttgtgtgtgaagggatgcagctcaccccttttcaaagcaaagagacctagggcatgcgatcttttttcatatctttggcttgaattatgtgtgatatatgcttttagtactgctttacccatttaattccttcctcctttgattaatcatgtaaagaatcttcacccattagaacatcaaccagtaaagagagagagagagagagagagagagagagagaaaagaaaagttgattaattggcccttgtctgttggatgtgagaatctatgaatatcggtatcgataattcccggttgaaatttaggtactaatatagatttcttttgattttttgtaatgcaagttggggagttgggagagagagggtggtgtgattcccacagctaggtatatctggtgattatccccattgcaatatgctttaaaacccaatattaggtaaaatgtaaatattccccaagacacctagctgggttctcttagactcttgcaaggttctctttggactactttgagctttgagctcatctttaattcgatcccttgaatcagacgcaccccggcgttaagctttagttttcccctttttccctgctgcatttgcccggtagattcttagatttgttgtaaagttaaacttaccacagaaatgaggcaggcagcatcttgatctgtaaaaaaaaaaaaggattaatggcaaagaaagatacattgagatcatagcagctgatcagctaggctaaaacagtgtaatttgaacaggacaagaagacgtggctaacaaaagtttcagtttttcagtcacgcatgcatgctgaaaaacaaaactgcatgcatgcagtgtacaaacactgatcagagatattcagaaagcaggcagtacatatttgaatggagcagagagaaatctatatatatatatatatatatatatatatatatatatatatatatatatatatatatatatatatagagagagagagagagagagagagagatctagagagagaatgcaatgcatggtgcaatatatgcaatatggacccatctggtcgtaatgttaggagatatgttgattcccctgttggtacgtagtacatgaaacctcctgcatgcagaggaggagcagaattaacctttttctttttgtttttgtttgcctttgatctttgcaagaagttaccatgcctttgctttatccccctatctctctctctctctctctctgatctctcactactgttgctagctagctatagctgtttagctaagtgtatatgtgcaagatcatacaaagctagcttttccttttcctctaaatccaactttattctcctcttccttctcccaaaactctcccttaaaaagaagctgattccccatctgatccctcatcaaaacccttctcacattcgatctcgatcactcacacttacactcgcagtttgcacagctacttcatctcaagtagtagtagtaatatactagctagatcggtcggctatttgctgtagctagctagcgtgagctagcttggtttgtagagcttgtatacttggagggaggagatcgatagccatggcttcttcgtcttctgacctaaccctagacgaccaccaccatctgacggcggtggctgcggcgtcggggcaggcgacgcagaagcttcaggagttcttgtcacgtctcgaggaagagaggctcaagatcgacgccttcaagcgtgagctccctctctgcatgcagcttctcaatcatggtgagtaattgtatgtaacctaagctaaatcgatcgccatggctaaccctagcgaggattggtgtgtgtttgcagctatggaggcgtacaggcagcagctggaggcgtaccagatggggagccagcatagcgccgcggcggcggcggcggcgagggcgccgctggtgctcgaggagttcataccggtgaagaacatcgggatcgacgtcgtggcggcggacaaggcggcggcggcggggggcaacagcgtgtcgtcggagaaggcgagctggatggtgtcggcgcagctgtggaacgcgccggcgtcggcgtcggcggcggacacggcggcgaaggggccccagacgcccaaggagcactcggagcaccacccgctcgacacgagccccaagctgatcaccgcgctcgacggcggcggcgg

SEQ ID NO: 39062 - DNA, 3950 bp, Oryza sativa
  unsure (1)..(3950): unsure at all n locations
gccgccgcgctgccggagctcgcgctcgcgcccgcggagaaggcggcggacgcgatcaccatcgccgccggcgaggtcgacaagaagccgtacgcccacgacaacggcgtcgtggcgagatcgagagaagcccagaacggcgggaagccgccgtcgacgccatcggacgggcaggccgtcccgccgccgccacagccccaccggaaggcgcgccgttgctggtcgccggagctgcaccgccgcttcgtcaatgctcttcagatcctcggcggcgcccaaggtacagtacacctacacatgtaactcgatcaagatcgaacaccatgattacatgccgtaccaaagatgaaaagacaacaaacaaattaatcttgagcttgcgtttttgttttgttctttgcaaaataaagtggcgaccccgaagcagattcgcgaagctgatgaagggtgatggattgaccaatgatgaggtgaaaagccatttccaggtagggtaattatcatctcatcatgcaattcatccatctcacgtacggttttaattaaatactgtttaaattgatcattgactacaagacagtatgattaactgattgctagacatgaatgccataatgagcattttgatctgaatttttttttgtttgggcagaagtacaggttgcacacaagacggccgatgccgtcgccggcgccgccgacggcagcgacgccgcagctggtggtgctgggaggcatctgggtgccgccggagtacgcgacgcaggcggcggggccggccatctacggcgcgcacccggcgacgcagccgcactacacggcggcggtggcggcgcaggagtactaccaccaccaccaccaccacctgcagcaccaccccgccgccgccgccctggtgcaccaccgcgccgtagccccgcccccgccgctgccgcctcagcagcagctggcccctccctacagcgccaagtcgtcggcgtcggcgaggctcgggtccccggactccgacggccgtggcagcggcggcggcggcggcgccgccgcctccggagccggaagggacatgtccgagagcatcgaggaggaaggcgagggcgaggagcgggaggacgacgacgacgacgacgagatggcggcgaccaacaacgcccacgccgtcgacggcgacgacgacaacgacgagatcaacaccaccaccaccacgagcgcgggagcgattaactactaattaatcaaccaaaccaaccaatcaaatcaccacgcgtcgtaattaattactcattagtaataatactagctagtagcttaattaatcgcgctaatccgggagattaattagcgtcacctggaaaaagggaaaagtgattttttgttggcgcgcgcgcgcggagaacgggagccgagccgagccgagccgaccagagaaggagcaggagcttgagcttgtctcactcgttgatgtgatgcatatgtatggaactatggatcgatggataatgtgagggctttactttgcttttgcttttgctggtttttttttctccctcttgtttttcttccttttttgggactctcagctgttcctgatttaataatccggtagtactagtagtaaatatcaaaattatgtgatggtggagagattaaatatgagctagatgtaattgtttgggagattatgtttgttgttgttgttaagttgagaattgtgaagagccaccaataatgcataatgcagggtttgcttctgcaattaatgtgattatatgtgaatggttctaattaatagtagttgttatgttttggtatgcacaaatatagcatatgacattaaattttccaatgggataatgatatgcttggtggtaccaaggctgtgttcagaacctttgttccaacttctcttctcgtttttcgcgcccacgtttttctaaactgttaataggtgtattttttcaaaaaatttctatacgaaattgcttaaaaaatcatattaatcatttttttaaaaaaaatagtaaatacttaattaatcatgcgctaatggaccgttccgtttttcgtgtgcacagcttgtgctgggaacatagggttctgaacgcagcctaagtactccatccggcaaagattacttgatatttccgacagctaaaatccattaagcgcaagttattttgtttgtccgaaacgtcatatagtattatcgtccagggaatatattgcagctttaccgctgtagaagcaatcctgacactttgaaaagcaacagccgcatcgattttcaggaatttttgcgatggctattcagattcttgatgttttataaaagtctactggtcaaagttaatttagttctttattaattcttcgcataaataacacccttttcaccatattttgactataggagaatatttttggagacaaacatatcaactcggttgactcttttatttgcaagaactttgattattacacttttaaaaatgaactttgatgattacgcagtattacagcggttttagcctgcaatcaactgcaggcccatgaatacagttttagctatactagtgatggaccattatgggccaggccgtatttaacagccgtctcagaaaaggaataagtttatcatgacttcctcactctcgctcctgattgaattgcttccctcaaccgtaaaaccaggtataatacatctaccatcttcgaaaaccgggttcaaattgacttctttgttggtcttagaaacgggttctactgacgtggtatgttggcagcatcaacaggtagagcccacgtgtcagggctctcctttattcccctccttctctccntacagtgggagactgctttgtccccaccctcttctcttcctgcattgggagactactttgtcgccatggcccaggtcaacgaggcactcgaggaccaggcgcaggtggtggccttgtcggcgtgtacgacggccataatagccccaaggcggtgtagttgatcaacaagaggctctcctcccacatcgaaggaatcatccaagcgactatggtggcgagccaaacctagaaaggtgcagtgatggtgacgaggtaggagatgagaagagggtggcgacgcaagggttccaattgcatcctccaacatgtctcgtctctgctaccgtctatgacgagagagggtaccaccttcctcggctcgtcagtccgacttgccaccaccaaagccctctccggagtccagttcgccaccaccaccgtcctcttgctgttgaaaggtcggagaggaagaaaaggggagaaaggtgggttagcaaatgaggtaagttattgacatgtgggtcccaagcgctcaatcaacgagtcatccgtggtcaacctaccgtgctaggtgaaattgcttcccaaactattaaatgagtcgatttgcactaattttttttaagtcggagaagacattatacccgttgttacaattgagggagacgattcaataagaatcaagaaatgagagagagaatataatttatttcccaagaaaaacacatgcatatactactatttctgggccgaaacgagttgagcatgatgccctcatcccacctgtccgatcaaataacaacgctttatattcggcaccgaaagattgagaggaaaactaacatttttcgcgggtacgtttttcaaatgatttaacagtacgtttttattaaaaaattaaaaaactatattaatatatcttttaaaatttgaatacgctaactactcatcatttacgatcttctcacatcctctcctctcaaacaaactagattcgtcgctgcaacccaacggtctccgtactccggcgagccgccgtcccgctccagacgcggcgcggccgtctcctccggcgccggccaagatcgaggtggatagcaacactgcaacacacataactctagaagtaattaa

SEQ ID NO: 39063 - DNA, 1073 bp, Oryza sativa
attcctgcagccccatctgagttcagattgcgagtttgtgacattgggtttggttttgcgcagcaatggtgtcaagaagtctgcagcttgtcggcgcgttgctgctgccgctgctcgccgtcgtgtcgtcgtttgatccgttccaccgtgatgcgaaccccatgggcggcggcgccgggcagggccccttcatcccccacgagtacgtccgcttcgccgacgtgaagcggcagtgcaagtccgtgctctcctccgcggcggagctcacgttcgacgccaaccgcgccaacggcctcatgccggagctgtccttcgtcaagggtgactggaagcacgacggcgacggcgacggcggcggcggcgcgccgctgctgccattcgacggcaccgacgtggcggaggacgccgccgccggggcggcgcgcgacccgctgccgctcgcgtcgttctcgctcacgcacgtcgacgcggcgcggcgcgggaggacggcgctgaacgtgagcggcgtgctcggcgtcgccatctcccgcaacggcaccgggccggagatggggccgtacgtgtcgccggagttcaaggtgtggcccgggaacaccgagctgaaggtgctgctcgagggggtgtacaccgagaacgacgacggcgagagcgtgctgtgcatggtcggcgacgccgtcctgccggcgcgcggcggcgacgccgccaacccgtggggctgggccaagcactccgaccgcgacaggttccagccgccgatcaccaaggacggcaacatcctcctcgtgctccgctaccccaagacgctgacgctgacgacgcgcgccgtccacggcgagctcacgagcaccaatggcaagacccacgccgcctacttcgacgccgtgcacctgctgtcgcagctcggcgcctactccaactaccagttcggctccgaggagctcgtcggcacggcgtgcaagccccacccgtaccgcgacgacgtcctcgccggcggcggcggggacagggggctgtacaagggcacctccttctgcggcatcctcgacaggttcacgtcggaggacgtgctcgca

SEQ ID NO: 39064 - DNA, 3006 bp, Oryza sativa
ctacccgaggaaatccggcgacgccgccgacgagacgacgagcctctccaacctcgccgaggagctcacgctccacgtcgccgccgtgccggatccgttcccacgcggacgattcgagcggccattccttcagcttgaggtgctctcgctcggatcgctcgtcggccgggcctcgccggcgacgtttccggggacgccagctgcggtagggcaaagcatggcatcatcatcgtcgtcgacgacgacgaagctggatgcgacggctatcctcaacgtgtcggcggagctgacgatctccggcgacgcgtacgtgaacgtgtcgacgctgtccttggaaggcgtgtacaacccggtggatggccggatgtacctcatcggctgccggagaatccaggcgccgtggcgagccttctcggcgatgggcggcgtcgaggaaggcatggactgctcgatcgaggtgagggtggagtacccgccgacgacggcgcggtggctgatcaacccgacggcgaaggtgcacatcgcgagcacgcgcggcggcggcgacgacccgctgcggttcaacgcgacggcgctccagacgctgccgatcctgtaccgggaacagcggcaggacatcctgtcgcggcggagcgtggaggggatcctccgcgtcgtgacgctggcggcggcgatcgccgccgagttcagccagctcatgtacatcaagtcccacaccgacgtgatgccgtacgtgtcggtggtgatgctgggcgtccaggcagtcggctacagcgtgccgctcatcaccggcgcggaggcgctgttcgcgcgcatcgccgcgtcgagcggcgacggcggcgcgacgccgccgccgtcgtacgaggtggacaagagccagctctactggaccatcgactgcgtcgtcaagatcctcatcctcgccgcgttcctcctcacgctccggctggtgcagaaagtgtggcgctcccgcatccgcctcctcacccgctcgccgctggagccagggcgcgtgcccagcgacaagaaggtcctcgtctacacctccggcgcgcacctcgtcggcttcgcggtggtcctcgcggcgcactacgtgagcgtgctggcgcggccggtgaggtcggaggcgtcgtacatggacgcgcgcggcgaggcgcacgcgctccgggagtgggcggtgacgctggaggagtacatcgggctcgcccaggacatgttcctgctgccgcaggtgatcgggaacgtggtgtggcggatcaactgccgcccgctgaagacggggtactacgccggcttgacggcggtgaggctgctgccgcacgtgtacgactacgtgagggcgccggcgatcaacccctacttcgcggaggagtacgagttcgtgaacaccagcctcgacttctactccaggtccggcgacgtcgccatcccgctcgccgccgtcgcgctcgccgcggcggtgtacgtgcagcagcggtggaactacaagatcatcagcaagacggtgaagacgcagcagaagaagctgcagcacctcgggtcgcgggtgtacgagcgactgccgtccatgtcgtcggccaacttcgaggccgagctcgtcgccggcgtcaacgagggcgtcggccatggcctccgccgcgacgccagcttgagctagctagctacactgctacacctcatcgatcaatcgcctctcttaattactcagtagtcttctcttgttgctttcttaggtttttatgatgttcttcttcttcttcttcttcttcttcttcttcttcttcttcttctttatttcttcttaattagatcttcagattcttcttatgatatccaaatgtactctactacaagttcaataaagttttagtttcttatagctctttgttcacatttctgcacttcttgtgtgtgtgttcagcttatgtgacacaaagtgttcgtgctgacaaattactttccgatattgcgtgctcttggtgaacacattccaagtttccaataggtaactagacaatgatattatttgattattatagattgtcaacgatgctaagatgattaattagcagtcttcttgtttgacaattctgtcaagcaagcttgcttgctagttagttaattactacactgatttgtgcttaacttctgccaagtgaataactgaatataatgcacctagttgttggttggtgtttaaacaaattaagcattctacctacatgtaggtgaatgagagtgtcagctcgagtgatatctcttgctcctgctcctgatgctggatagccactgctgcctctgttgctccactgtaggaggacacctgcagctgatcggagctgccgcctccgccggcgccggcgccggctaaacgctgaaaacaatttcaagaagagaaacaaatgaagaaaattacagtgaccagttatgttgcttttttaaaagacaaaaacactttttactatcataactagtactagaacaatgtgatcttgacattttattattattccttttgctgttgctgttgttcagttcgatacagatagcatgcagtacagaccagcacactgtcatgcatagcactgaaaaggaccatagcagaaaacagagtttttcttttcttggcaattaacaacagagttactaaaagcccatctttttgcttatacttacacttatcaaccaaaatttaaattttcaactttatgattttggagtttttttttcatcgaaatttattttttattatttacttttcactaagaacacgtatataaaagttttattcacaaattattttttatttgcaaatataacgtcaaacgatgggggccttaggtcaagagataaaagaaaatgatgaggaaataaaccaaattggtgtgccaaattcaagaactaaacacaaaatatatgttcttgtgtccaaaatgaatgcaaaagagaagacaagagatcgatgaactcaaattaacacacacgctctgacctcgtcgtggcggc

SEQ ID NO: 39065 - DNA, 19382 bp, Oryza sativa
gcaacagagagaggggctatttttgccagaaaaggaggaatcgttttcatcccaagtacttccaatggtttcatgcccccatttggatctcctctctatatctacagcctttctggttaagctagccctcttgtctccatgcatccagatgctgcaggttcagtagtgacagagacacagagtgagtgagtgagtgagtggagcctagagaaaaccagcttacaattgcatgcatgcatgaagggaattgatgctgtgcatgcaacagtccaatgccagtatgccactgtgctagtgtgcatgcatatgtggctctcattgcatatgcatgcaaaaatcataaccaaattgtatctcaggtgttgatctttcagtttcctatagcaatgcgtgatatttgaagtattgttagtcttagaaatttcaggatggctagtgtcatgaggatggattctaatctctcgggtggacatccactcgtttcttgcatgtcacctaaatgattatgaaaaaatttcaaaaaaaaacacaagatagtttaatatgtaatatatcacttcacaaacatgcaagttgagagtcgatttgtacacgtgggaaccgaaataacacatcagactctagctactatacgtatatccacagttaaatttattgtttttgctacaacttgtaacgttcaattctggacatgcttgacagggaagtcctttctcacatattaacctatcatatcaatttttttgaaattttttcataaccatttagatgacatgcaagaaacgggtggacatccacccgagtgtttaaaacagtttcccctagtgtcattgattagttgggtggttaaaaggggagcaagaaccaccagattttgattgctcatgagacatgtgcattagaatctataaaattctcacgcatgcttgcttacattttgggggtcacgggtcaagtgtgccacactcacactggtttggttgaactatgatgtgcaattgtgcatgcctgcctgccaactgagagcaccagccaacaccaggtagatgaaaggatttaaacacgggtaagcaaaattatcaaggaagcctatgactatgcagacaagtatttaatttgagcaaagttcagcatgatccctagctgtatttactgaattatttagcagtttttcaccccacgtatatgtgagaggcaaatgagccatctctgaatttttagattgtttttttggtttgtgaataaggctatatagtacattgcacaatgtacttatgatctgctagtgtgtgttggtagatgagagggttcttcgatgggatttaaccacatatgctgctgtgaagaggtaaagacaaacatagcaggacaaggatataaagtaaaaaaggagattaccacaccatgctgcttcagaagttcagacacgctctggctgctgcatttttcctgggccaatccaaacttcagtttagctcacctagctttcagtgttatacagaattacagtttactgcacgaagaaccttcatgtattcactgcacataggaggtttctaccctgcagtaatagtagtactaagtactgtaactttggttagtcagagtgtcagatgctcatgccaatcgatcttcatcatgttcatggcatgcacattgctctctttgcccacccctgctgaacatgatagagaaattcatcacttaccgtgctgccatttgacagaaaatatctcttcagctgatcagctcgccaggaaaaaaaaatctgagttgatttgctactgaactgcacagcactgtaatgataaattacacggtctctttgcttatagccttaatactgcagtactaggagtaacaacaactatatgcactccagttactacaagatcgaaccagtaatccggtataccgccaaaatcgccacgtttcacttcgggatttcgaaattgctctgaattcctgcgaatgagagaaccatttggcaatttttaacttgtaagcaggagcaaacgaacatatatgcaggaacaaaacatcacgactcaaaaaatgaaagatggtaaaagcctgaaatgtaatcagaaattgttctcttttctacttttctcttcagaagttcagaggaagtctctctctctctctctctctctctctcacacacacacacacacacacacaccaaatcatgtcaggaaaaaaacaaagcacattcccaactgcttgtccctgaactcccgggtgatttgattctcctttcctcctcctgatccacctgcacctaagtttcctgggattacgcaggaatttactctgctcccgggggaagagaagagaattttacagctactccagtctccaggcttgcagcatctgatctgatgactgtctgtgagctgcagttcatccggcgtctcagtccaaatcgatccaatcaatctcattctcgtggctgttcttggtggtgatgattgggcgggaggaaattttcggcgccgcagccttcctcctcctgcttggaacgccgcgaaaggcgtcggcgccatgacgtctgcttcgtcagaatcgcaatggagagagagagagagagagtcgtcggctagctccatggatcgacgccgccacgcggactgcggcaggaaccctcgcttcgccggccggctccccgccgccggcctgaggaaaagttaggttttttttttggaaaaataatggattcttaagccttctacttttattttttttctaatcaaacttctttaaattaaaaaaatgacaacgcatacaacaccaaattaattttactaaacctaatatttaatattttgtgtggaattttttatatttttctataaacttattcaaacttaaaaaatatgaaaaaaaaaaaaacgacttatatgaaacacttaggctgctttcgttgctgggagattgagagagaaaacacatctttttcgcgcagacgctttccgaactactaaatggtatatttttttggaaaacttttctatagaaaagttgttttaaaaaatcatatcaatccatttttaactttaaaataattaatacttaattaatcatataccaataacttacctcgttttacgtatctcttttccattttcctcaaacacagcttagggcttgtttggggagctttagattctgagaagcagttgtttggtagccagcttctgagaatctggaaaagctctgaaaccccgtttctccagcttctggcttcttaattcatttttcagaatatgtaactacagattctcagaagctgtgaactgtttggggcagcttctagcagaagcagcttttgggaaaagctgcagctgggataagctcccccaaacagggccttaggctcctcttgattcaatggtatgcactatgcaggtatattttcagcgcactcgaaacaagaaaactcagtagcacataattaattaagtattaactattataaaattgaaacatagatttatgtgattcttttaaacaatttctacatagaaacttttagtaaaagcacactatttagtagttcgaaaagcgagaaagttaaagtttggagatgagaaaaggtactaaggcctaggtactctataggcttaaatacgctaaataggcttaacatgttagcccagcccaagatgtttcctgcaagaaacggtgggcctgaacagagcggccatgttagtccgagaccatttgcgaattaatgggcttctctgaaactctgaactttttccttccttttttttttttttgcggggactgaaactctgagcttttgatgtgcttcttttcttctcgtatcctatcatcagttcagagaagttcaggtgcgtgtatcaaacgaagaagaacaggatcaccgtccttttctggtcgttccatcacacattcacattgccaagaagacattttcatcgcttgtgaactctgaagcctgaacatttactagtactacacgggcgaggcgatggttttggtttttgtattgttttctgcaggcagaaaacaggtctgaacttttcctgtcacgcactcacacgggaatactcctggatatatactttcagagtcaaagaaatacgagtatttgcaagtttgagccagtagtaaaatgatgaaaactgagacaagacccagcttcagccgataagcagtagaaaaagcaaattacaaacttggctctgattgtttgaaagctcgtgccggaaaacatgcctccgattgtttgatttgagactaataaaccctagaaaatgagtaatccatatgtaaaacttttatatatatatatatatttttaaacggtttaaaatccaacattaaaaggactcaaaatcaactttaaaactaggttctactgtaaacttcaaatttggctatgctgattagataactaactactccctccgtactaaaatataagagatttagggatgagactttttctaatactatgaatttggacatgctctttgtctaaattcgtagtattgtaaagtgtcacatttatctaaaatctcttatattataggacggagggagtatcacaagctaaaaaaaaatcctaaaggccattttggtttgatactaaaaacataccctaccaatttgttggcaaattaaatagtatatatgtattagtttggattgagactaaatgtttgttagtgcccctatcatatttagtcatattctaaaagtttctcaactataccgtgagaatttagctttatattggtagcgatctaaatgctagctaaataattttaccctaccaatattagaatttagctttatattggtagcgatctaaatgctagctaaataattttaccctaccaatattagaatttagctttatattggtagcgatctaaatgctagctaaataattttaccctattaatattttggtagtgccaaagtttaccaataaattggtagagtaaagaaccaaacaaaccctaaaatcaactctaaaattgtcagcactaaaattaagtttgaagattttttttcttttttgataagctgactagtctaggccctattgtttagattccaacttttttcttcaaacttataacttttctgtcacatcgaaattttctacacataaactttcaacttttccgttatatcgttccaatttctttaaacgtctaattttagcgtgtaactaaacacagcccctatgtctgatttggtgggcgttattagctgatgccttgatgagctgattaactagcattgtcacatcaaacctctaagcacagtgaggtcaggccggtcagtggggtgctcaactgcagcagcagcagctgaaccaaaaccaaaacagcccaaaggttcgtcagtattcgtactcttcctctagagagttcagttcacacgcccaagaagtacagtacaccatttgactgcaaaaatctactgctagtaggagtgtggtacttgctagtacttctacggctgtgttcgcatgtggatgatgggaacatagtgtctccgcacggaaaacggagcgatctattagcacgtaattaattaagtattagctaatttcttttttaaaaataaattaatttgatttttaagcaacttttgtatagaaactttttgtaaaaaatacaccgtttagcagtttgaaaaacatgcatgtgaaaaactagtgatttgggttgggaacctggaggtccgaacacacccgtaatgatgatgaattttgggaaatttcagcactcacaaaacactcgaaggctggaaattaggctgcctttggcagtgagctttcccaacttttacccatgttttccccgtgcgagttttttaatcggttaaaaggtgtgtatttttttttgaaaaaatctatagaaaagctacttttaaaatcatattactttattttttttaagttagctttagttaatccttaattaattatatgctaatgagctgtttcgtttttttatgttggagggaaaggttcccaactcagggcaaccctatgtttatgactttggccgtgtttagttccattttaatttttttaaagtacaaggacacacatttgaagaattaaatgtaactaataacaaaacaaattatagattccgcctgtaaactgcgagacgaatctattaagcctaattaattcgtcattagcaaatgtttactgtagcaccacattgtcaaatcatggcgtaattaggctaaaaaattcgtctcgcaatttacatgtaaactgtgcgattggtttttttcatccacaattaatgctccatgcatgtgtccaaacatttaaagtgacggaaaagttagaagtttaaaagtaactaaacacaacatttgttcaggaggatgtcaaaatcaacattattaaattttttattcttaaatgtttggcacattttaacggtaccaaatttcgataatgttggataagtttagttgatagcctgatcaaaatttggtagtattttttataggaaaaagtttttgaaaataccaaaatttactaaggtgtcaatgataataaattatttaatttgttactttaccaaattttgtgacacggagccacggatgcagtgcactactccctccgttccagaaaaagacaaaccctaagtttccatgtccaacgtttggctatccgtcttatatgaattttttttataattagtaattttattattgttagatgataaaacatgattaatactttatgcgtgacttgtctttttaatttttttcatagtttttttaaaataagacggatggtcaacgacacaaaaatgtagggtttgtctttatatatatatatatatatatatatatatatatacacacacacacacactaaggaagtaagtacgagtgctacacttgcctccattgaggatgagagctcgaggtggctagtagtcccagtgaggcgcatttctccaaatcctccaggatcacaagtggaacgctaagggcccctttgttgacgaaaaaaaaatcgaacacaccggtctgggagatctgcttagcttctgtgtaggtccaaagattgatgagatgcgggcgtgccagtcagtttgatcctgcaactgacaagatatgtaaacagcagatcaaaacagccgatcggctgacaagccgatggagtagttccagccggtagccaataatagccgatgccgataccagccgatagcgatagggtttaagcaatcggctatatgtccaatgtagataacgatataaaggcaatcggctgatgatgatgcaataaaataataatataatccagtataaaccaatcggctagcaatgatatgataaataagcatcgatccgaaggttaaagcacacatcggctggaggtccgatgtcatgaaatctacaagattagattaaacagtgaaacctttgttgtcatcggcgaaatccaacttatatgtatgtgtaatccttatgagccgatgcaacgtccagataactcaccggctgaaaccccgatgaaacccttattggcaatcaagaagcaggctagagattatggttctaagcacgacttagtagatcaaacttaaccgatgcagcactaagtatgaaaagaaacataatatctagatttttaggatggtaaatgtctgagctaatctaatctagcaacgcgatttagctgatatcggcagaaaccctaaaacgagaagcagccgatagagctaaattgatatgctaggactagattaatagagacatatgataaataggtaggcaaatatatcatccaaactagagcaatccaagaggtcgaatgtgctgatgcagccttgaatgacgccgatgtagatgagacaattgcctgggccgacggaacattggacttatcccttcgtcggagatcgaagacgatgcagccccgcgtcgggtgccaagttccgccggaacataaaaaacaaaagtagaagtaaaaagggtagcgatgcaccaaattgtattgatcgtagagatagattacatagaccccgggtgtacatatttatacccatgggttgatacaagtccttgtcggataagaaagaaactaacctaaagataaaaggaaaatataaagtccttatcggacactaaacacactttcctaaagataaaaggaaactaacaaactattcttaattaatagataaactgccatgccgcatcctttttaaactcgttcaattagggataagcttcctttagtagattgatttccttaaccgaatatagcaggaatccgactattggcgacttgataactcccatcggctgattccgagatgctgcagccgataatgattctaagccgatgacgtctttgccgattaccaaatttcactgttaacaccctttgaatcacagggtagaaaaaacagaggaataggaaaaacacaggattctgacaggaattaaaatgtaaaacaaaggattgcaaaacacataaaaaaacaggaatggtcgtttgattggagcgcagtaaaaacgcaggaatcggatgagagagatagactcaaaagaatttttccaagaggttggagctcttgctaaatttcctccaaaatccacatgcaatgtgccattccataggaatttcataggatttggaaagcttcaatcctttgaatcaaataaccaaataggaaaattttctatataatttaaatcctataaaattcctatataaattctttgatttaaagcggtcctaagtaagggtggggaggttgctagctccatgtcgaacagaaagaagcaagagtctcgagtctcccactaggcgagggaaggagacacaggtggcacccctggtggccgcggaatgacggttgtgcccctggtggcgaggggtggcgtggggggcaggacggtaaatctgcagtggagggggaggcgactgggcggtgagctgatgagggaggggggcagactggtcgctgacacgtcgtcggcgagcgcattgaccgttcctcccctgccacccgccacgtggcccgtcgcctgtcacgatgtcacatgccccgccctactgtcctctcctgccctgccctaccggtacgtgctccgtctgtcccttaaaaaaattccatgatattttgagacaaatgaatactccctccgtatcaaatgtttgacattgttgactttttagcacatgtttaaccgttcatcttattcaaaagaatctgtgaaatatgtaaaactatgtgtgtacatgaaaatatatttaataatgaatcaaacgatgtgaaaagaataaataattacttaaattttttaaataagacgaatggtcaaacacgtactaaaaagtcaacggtgtcaaacattatgaaatggatggagtagtatttacgcttttaatcttaaaataaaccaagtcttgtatatgaaaataatactgatagatattatcttcgttccaaataggtactccctccgtactcatcaagatagtaacacagtctccaaaacacaactttgacttattgtttctataaaaatatttattgaaaaatgatatatgtatacttttatgaaagtatttttcaagacaaatctattcatatattttttacatttttaaactcaacaacttaagagttattcatgatttatatttctaaggtttgacttaaacattgtcctaaacgacttcctttgcgagtacggagggaatatccttttaggattcaatttttttccaaaatatttgtactctaaaatattacctctgtttcaggttataagaacggaggaactatttatcctatccatcttcttatattaaatttctccttgttataccctccaattgccactccgattctaaccatatcatttacagaaaagagaatattgagaagatacgcaaaacgatgtgagccattagtgcatgattagttgagtattaactattttaaacttcaaaaatggataaatatgactttttaaaacaactttcttatataaatttttttataaaaatacacgtcgtttaatagtttgggtagcgtgcgcgcgaaaaacaagttgttttctctctcgatctcccagcaaggaacgcaaccttagtgaagagtagtatagtattttaacttaaaccttaatttatgctaaactaacaaaaaaaaacaattattttgggatgaagggagtataacctaacggagatcctctgcagggtagtgctactcactgggcacaagggtttatgccttatagatccacgtgtcagtgaacagtactgcagagaatcctctttcaatataaccttattctactaagataagcatattatactgctgatgttggtcatcggagatgatcagcaaacatttactaaagtttcaaagaaggaaaagaataataaagctttaatactactactacacatttggtcctggatgaatggggaaattagggcttatttgaattaaaggatttttatgatgaggaaaaaaatggaggaatccaattcaaaagaaattctcctactatatgagcagtttagtttggatcatacgattgtttcaaagggatttcaagggataggaaaagtctctccacatcttcgaggaattctagcatggggtctaacctcgttgtttcgaattcttttgtgatttttaaggcatgttctctcctcctctctctagcaaattaaacatgtaatctcaattttctctcacccgttcgatatatccaaacacttgtgtttgaatgattcctgtagtttgattgcttggaggatttttcatgtcgtgacatttcaatcctaagttttcctcttcctgtattttgagtcatgttccaaaggaacccttaaagtggacttataactttcatcaatacatatttggtaactcatggtaaggagattggaaatttagagtaataagctaatgaagggattgatcctgtaagtttcatttttaatctctgtcgtttgataggagatatgagaattatgatgaatttgagtgagaaatgaattttaagtgatgatatactaacttatttttttctctcagttacctgcctctacccaaatattgaaaagacgagagttcgctcttaaaactcctcacccctcaaacttccatcatcttcaaacattccccctccctcctaaccaaacactccctcagcgttctgaatgcaacgtgctattcaattaatcacagaatataactttgactgacttacaaacttagtaccagaaggggataagaagtgaaatccgagtagaaatagggagattcaaaatcacatataggaaagtaagaataaccaacaccttcactcttggataaacgttgtcacaaaatacgtaccgtcaaattttaaaaccttaaatggccaattaataaaaacatcaaagttttacacaatgatgaaatatgtctgttatacctattgatagtgagacatctacatgattttctttattaaagatatgttggtgcaatctctgaaggtgctctatgcacaagtgtacatataagtgcatgcatctgtcatgtgttaaaaaaaagctcagagatgatgagatatgttcattacattaccaaaacaaagcataacaatgaattaagtaccagataaatcttggcaattgggctcttgaaaacctggtgcacagtctcatcatctctactgttctacagaatcacctcccttatcttacctgcatgacaaatgcctcgagaaaaaaaatatagccacgatggcagtagcgaaatatcgtgcaaaaggaggggcagtttcgaccgaggagctacagtgagccgcaagtacgcttttttctgcaggctcatcaatccatgcacactcattattagccctagaactgtagcatcatttcacatttattttctttctctctctctcggccttaatcgcatataacgataattgatatggataattggattggattatatgcagctgtatcacaaattcacaatcccacaatctcattttcttttttactcggtgaaccactaaaacagtgtgaaatgggcagctgtttggcgttttcaagaaagaaaatattgttaaactgaccttttttgacagtcatcttcagttttttttttttgtttaagcccttcctctcctcactcacactgccctgttcatctctttcttttttattcgattcctctattccattccacacgcattgccgctggtagtagaagtatagtatctctccgcgaccgaagattttaaaaaggaagcaatttgcctcttttttttttttggcgcacctcgattagtagtagattttagaggcgaatgtgagcggtcaaatccttcttttttagcttgtgcgcgttgtgttttgtgctctccttttgtcagttcctgaggcgctctctcctgtgcctttgtgtttagcgtgcgtgaccgcgagcgaggtcgaggagtgagagggagtgaggcggcggcggcggcggccatggcgcagcagcagcagcagcagagtgcgtgggaagcggagaagatgtgagctttctcctatctctcttctgttcttcgttgcttcatcattccttagtttgttattgcgatcagattggtttgatgttcttcgcacattcttttttcccttttttttatgttggtgaaatgttctccgttttgtcttgagatttttttgtcattccatttggttctcttggtgtccgcatggttatctttccccaagattagtttcttgttttcctctgggaggggtttcggattcgtttcttggcggtttagatcgtctttttttctggtgatttttgcaagaatcttgtccttcatcttcccttgttgttgtatttcagagggctgcagacgcttgagattctgtttgagttccctgaaatttctgcattttccgttctgcattttggtttctccttttgcaaaagccatgcctcttttttttttcttgttcctcttgttccttttatttttctcggatacagtactagtttggtttattgcttgctagcttttcaactgccttttccttttaccttgcattgcaactgccttttcatttctcgaaatttatttgctttttcacactttaatctgcattttacctttttattttttcatgaaaactttcgatcccctcctttcctgttgctgctgtgcttgcatgcaaacccccatgtttccttttttacttattatatatccccgcactgaacttatccatgtctgttcttggaagcaggttggacgtgtacatccatgattatcttttgaagaggaacctgcagagcactgccaaggcattccaagcagaaggcagccgtggtcttcccgaatcctgtgtggggtttcccccaccgggcgctcatttctgaattttgtcatactactgtagtttgcaatctttgctctttctgcattaggaccagatagtttgttcctcagactgccattgttcttgggccaataggatggttacaaattgatcatttgattagcttgattagtactacacttacatttgtgcatgtgcgagacacgagtattattagctactcgtaccgggcagatacaaaggaacaatactacagccacattgttttgtctgatttatgcatgccagtctctgatgtttctgcattgtaatgaatgcgattttaatcttcttgtactgaaagatgtcagcttttgttttgcaaaaaaagcaattgatgccccagggggtttcctcttggagtggtggtctgtcttctgggacatcttcattgcaaggacgaacgagaagcactctgatgttgctgcttcgtacattgaggttcttgtagcacatgcatcttggttattacttgtccttgttgtttgcttgcactcacttggtacagtggtttactgcttatcttacaataaacatgtgtaaatgcttgaattgtgtcagtcatagagatcatgttcactgtaaaaggatttagttttttgcctaaagcaaatggatttaaattccacacaaacattgaaaaccaaattcaagaactttccatgtcactcttgaaaaaaaagaagaaaatgcctaattcatctatgtaggaaaaacttgttatggtggatatttttttttaaaaaaaaaatcaaatgtttccccatatttccaaacaaaacatgctgcatcatatcacacaattatagaagaacatgtgtcttaatcattttagaaggtacagaatgcaaaacactttctcgtagaatacatactatgttgtctccagctattatcatctttaaaattcaagtaaaatttcaaagtcaacattttattatcaatatgattaattactttgaaggcaatggtcccttccctttgtagtaggccgtagctaatacctgttcattttctggtgattactcatttgaaactagccatttcttggtatatgatgcgtcaatcttattgcaaaatgctattttcatgttcctgatgttgttacacataaattttgtaacccagacacagtcaattaaagctcgagagcagcagccatcacagctgcagcagcaagaggctcattcccagcagtcatcacagcagatccaaatgcaacaactcctactacagaggcatgcacagcagcagcagcagcagcagagtcagcaacaaccacagcaacaacgccgccagcagaagcaacaacagcgtagtgaaagcagtcatttgccgacaagtgcacataatggtttggtttctgctgatcctccaacacgacaaagcacttcagctgcaagttctttgtctgcaaagatgtacgaggagagggtgaagaattctgttcaaagggacaccttagatgaagcacctgcaaaggtagtttcttcatggcaatgtgtattgttgctttcatgatctaaactctcataatatgaaatgcatatctttatactgcagcaaaggtttacagaaaatattggacaactgctggaatcaaactcatcatctatgctgaagtccgttgcaataacagctcaggcttcagggtaccaactgctcaataatgcttgctaatcatttacttctcttttttttttttttgggggggggggggagtgtggggtggggatgggaggtttggagcgcaaaataaataccatatcagtcttaaatacagcctataatgtgtgatctaataggatttcctaccatgcttgaattgtgtttaccgcctttgtttttacctaactattttgcggtcttcaaattgcaactttgaccattaattcttattgtacactaaaatgtgctaataaaaactattatattactttcatattattcacaataaatctatccagcatgtagtagctgtttgactaaatttccgtaatcaatgctatcttgatggttcatactgtaatggctgtttaacggcaattatctctagcttctgttttcctgttagcgtgtgtgtattgatttgctttgatcaattgtttttaggcaaattttccatggatcaactggtggcgtgtcaggtactttgcaacaggttcaggcccggaaccaacaactccaggcatcaacacaggtagtcttatttcagatgtataatctcatgcattattgtctataactagacgagtcaaatttgtttcaggaaataaaggtagacacaaatgctgctgtacacatgagagctgcaggggcagatggatcattaattggagtaccaggtttttttgctttgaactctactaatttttgttgtttctggctgctaactggaaattcttagacctgctgtactgtttattcatgtacttagtgccattgtttgataccctgttgtctggcaggcgctaacccagcagggaacaatttgacgttgaaagggtggcctcttactgtgagttcttcacatcattccttaactggcattctaagctataaattaggagcaagtttgaatacagcaccttctttttttttttgtttttatgatgttttaccatttgattataacttttcagggcttagaccagcttagatctgggtttctccaacagaaatcttttatgcagtctccccaaccattgcaccatctacaatttctcactccacaacaacagcagcttctgcttcaagcacaacaaaatatgacatcttcacctggagagatggacagcagaaggcttcggatgcttttgagtagccgaaacattgttcctgggagggatggtcaatcaaatgcctacacggaagttattcctagtgttggcccttcattgcaaaatatgtgctcacctgtgcagcgcatggagacagatatgctgatgaaggtaagtttcacttgtatgttttactatattcatgcatttatttatttgcgaggatacattggatgtaagtaatagtaccttgtaaaccaccgggttatgcataattttgttctcaattgatatcttatatgtacatagattatattgtttaattcttgtcagtgatcagtaatagaatttcatttaaatttatcatgcttgttcttgttatgttatgttgccaagtttgcataacacagtaccatttactttctactatagcatagtgattaaatcatgaaaatatcggtcttggtccttgtgtaatataatcttttgaacagaggaactcatactatttggatttcataatgatctagctgctattaatacatgctcacatgttttctgaagctacctttttcaagataacttctacatctttggttttcgaccttaacacctcgtcattatatgtagtagaagatagcagctatacagcagcaccagcaaagcagcaatcagcaacagctccttcagcattcttttacttagccagcaaccaccaatctctaatcaccttccaggccagcaggaaaaaatgggagctggaagtgttactattgatggaagcctgtctaattcattccgtggaagtgaacaggtttcacttccttctacatatattcaacattaccaccttgatttgttactgtgcctatccttttgttaagacttgtatccatcataaatatattgttttgcaggtttccaagaatcaaaatgggcgaaaacgcaaacagccaatctcatcgtctggtccagccaatagttctggcactggaaacaccgcggtcccctcctcagaaccctcaactccttcatcgcaaagcccaggagacacaatttcaatgccctcgctgcaccacaatgctagcttatcaaaggctttagttgtttacggtaccagtacagcagggacaatgggatcaccatcaaatcaacttgtaagttacaactggttctaaatccaaacagctatggccctattacgtggatatattatgcatgcaacatagtttggaaatgtttcattgcactgatggtctgtttgatgcctgacttctgaacatctgataactcacactgcaggctgacatggatcgttttgtggaggatggctgcttggaagatcatgtggattcgttcctgtcgcatgatgatgcagatcgaagagatggcagtcgtatggaatctactaaaggtgtgataaggctaactgttttgtaacttatggctagttgaagttgaatggttggctttgacatattaacatcattggcagtggttaccctggccagtttagtcttgaatgtaattatggctggtgtaaatagtaccaacaagctgaactcacttaggtgaatttagcttggaaattgagcagttggtgcggttcaggctatggtcctgtgagaggggaaattatctaatatgtcatgtggtaacatatattggttcagtgggttagatttatgatgtattttgtagggaagtctaacatgaatttgtgttctgtagagctttgattctgtttatatgtcttaagcaggattcatcttccgagaggtctcttctgtacaagcaagcacgaacaaggttgtatgctgccacttctcatcagatggaaagctacttgctactgggggtcatgataagaaggtaagtgcacatgcctgggcttgttaagatgctcagcctagttgatactcttggaagtgggcaggcatatctttgacttcatggtgatattgaaatagatacttgcaatgtttcaatgcaggtggtattgtggcatgctgaaactttaaaacagaagtcagtattggaggaacattctcttttgataactgatgtacgattcagtccaagcattccacgccttgctacctcctcatttgataaaactgtcagggtctgggatgctgacaatgtaagtacataactgtttagttcttttttcctaccatctatttgcctcggtgattgcctctgtgttatgttgcaaaaacctgccaactagcactgaaaccatatcaaattgccatttgtatatttagccagatttttttaccttttgaactgccctttatgtagaaacaacatcataaagttaagtaggctataaattctcaaagaatacagtaagcaatgtccatctcaaggtcatatgtcgtgaatgatctacaacatcaattttgagattcataggcatggcatggattcattttgtagaagtggaacttgtttgttctctaggggatataagcatgatacttctgaactttcagattcctgggtaatgtcagtacttgtaatgttaaagctgcaagggcagcaaagtactgttgtgttttactgctcatcatattctaatgctgtcattgtacttttgcagcaaggctattcaattcgaacgttcactgggcactcagcatctgttatgtcactggatttccacccaaacaaggatgacctcatttgttcttgtgatggggataatgaaattcgattctggagtatcaacaatggaaacatcgtccggatatttaaggttactcagtttttcttattcagcattctgtcaatctggaagtgctgctttattgtgaacaatcctaacatttccttgacaaagcactccaacgtatacttgtagacttttctctttatagaaaatgtgcatgatgaatgtcaatctgttgaaaacatcctaaaattacgtaaaagaaaacatcctagatgttttccatacctacttgttaattggtttcaatcactgtcataacccctttgtagttaatgggctgttattaggtgtctccatccataatcaacaactggtctcaaaaggagatgccttgtaggatacactgtttcttgatttatttgtttccaatccctttgtagggaggatcaagccagctgagatttcaaccacgtcatgggggata

SEQ ID NO: 39066 - DNA, 972 bp, Oryza sativa
ttcaaccacgtcatgggggatatcttgcagtactttcggaaaatgctgtctcttatacttgatgtggagactcaagcttgccttaagagatttgaggtttgtagagactttctaccttgcagttggcacgtgcattctgatcttctaaattcactgaggttccagtaacatatataccgaccaacaaatctatgtgcaaggatgtatttacttttcaaatctcgtttttagagtgagttttggatactgcaaatctatctatttattttgtaattagctttgtggtgttcatttcccttgatggttagttgtccttgcttggttgtttacatattttcaaagtcgcatcgtgctagctgtagccagtgttcacttccatgttaatctttagagtttccgagtgatggtaaccaatcactttaatctgtcctctttattgggaactgcagggccacacaaagcatgtcgattcagtatgctgggatcccagtggcgaatatgttgtatctgtcagtgaagacacggtgaaggtgtggtctgtgaatgctgggagcgatgatcgctgcgtgcaagagcttagctgtaccgggagcaagtttcactcgtgtgctttccacccttcatattcatctatgcttatcattggttgttaccaggcaagtactttatattcgtggatctcttttatgctcatgcgtcacgattcattcaaaactaatctgcactgatcatcctaattcctaagtagctggttaaaaatgactttttctagatcaactcatgactactcactcacactgaggatcattccacaacttgaatttcagtacatcattacacatatatcaagttcctcaaatattccttcatgatacacatgcaattattttgaagatttactgcaatgaaatacttttcctatttaagaacaagcattcggccatagagaccacttaaggttttcccgcgggt

SEQ ID NO: 39067 - DNA, 2131 bp, Oryza sativa
cagcaagaaattggaaattttcttactgaattttacaaacgtggtttcgtcacggatgcttggtgtctggggaaagcaatgaatcggcatctctggcctgcaataaacgaatgtatttgccctgtttgcatgttcagtctttgcacggctcttagattccccagcctgtccaaaaatacccatgacacggtttgatcgatcgattgcaacacaaatctgtgaacagatcattggttcctgatcagagatgttcagttacttctctgaacattgatttttcttcttatcagatagggaatgtgcatctttctctctgatcttcagtttggaagaacactgcatcctgtagggctttcacaatgatagctacacctacatgggaatttttgagaagagtcatatgcatcttcatcagaatgatcagaggtaaatacaatgcttagttgttgcaaccatcatcacaggtttaacaggttctcagattctgttttgtttagtttaccacttgactttataggtttataacctggagaaaaatgtatttctcgttcataaagtgaggaggataaaatgccgtccgagtagatggaaaatactggtttagtaatccaaaataatctagaggttctaaccgtttctaaaacaggctgggtggaatgtcatctaatccaactttacaagaactttttatcggttttgagtagcggaaatgcctatccgtataattatcaggaggaaagcggcaaattccactctacattatttaagatcttgaaggtgtttggtacatcgctctagctaataaaatcttggagtagtagtgccaaactgttcttaggcggcattcgggaggaggggttgtgaacccttcatcctcaacaggcaaaacgaaaaatacgtattattgtatgattaattaagtattaacttttttttaaaaatgattaatatgattttttaaaacagctttcttatataattttttttaaaatacactgtttagcagtttgaaaagcgtgcgcgtggagaacgggagaggtgagttgggtatactggggaagaacacagactttgcaaaaaaaaaagtccccggtgtaattgggaaaaaaaatcattagggatagatggatgtatcattttgtttcacatatttatccctggttactattataagccgtgttgatattttatagccaatcctttttgagtttgatcaagtttataaaaaaatatagcaacattttcaaaacaaaacaaatatattatcataatatattaaatattagttttagtgaaactaatttggttttctttataaacttaatcaaacttaatgaaacttgattagaaaaaaacaaaatataatatcaaacaaagaagtactccctccgtcctataatataaggaattttgagtttttgctcgtagtgtttgaccactcgttttattaaaaaaatttatgtaaatataaaaaacgaaaagttgtgcttaaagtactttggataataatgtaaatcaaaaaaataaataatagttctaaaattttttgaataagatgagtggttaaacagtgcaagtaaaatcttaaaatcctttatattatgggacagaggggtagtatttgtgccttttctgaaagaaaatctaaaaacaagacaataaatgcgccggcaaaagccaaactaacccccgtgtttaaatcgcctcccgtacaagtctcctgcccctaccaataccaacttaacccctcttcttccatctctaatctaatcactcctcccctcttccaccctccccccacctcgtcgcctcgccgtctccacccccaaaaccctagccgccgccgcgctcctcctcctccgccgccgcccggcgccgcccgcggccatggatctcctccgctcgcacctccacaaggtccgcatcccggagcccggcagccgcatccacaaggacgagtgctgcgtctccttcgacaccccggtaaaccaaccaaccacccacccacccacccacgccttgtcccccccttcgctctggtttcctagggttagggttttgacgccgatttcgccgtgcagaggtcggagggtgggctgtacgtcgacatgacctcgttcctggggttcgg

SEQ ID NO: 39068 - DNA, 1413 bp, Oryza sativa
  unsure (1)..(1413): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaccatttcaatcaagtgtatttttttagataatggaatgaaatattcaagcaagtgtataccctgtggtcaacaactattctctatttacatgtactattcacatatatggctgacactaggggtctcatacttgccaaacctactgcctgcattgtgctaagtattgcatgagaaagaattgctggttccttagtaatatactttgataaggattctgtttttcttttttaggaaaatgatgaagaagaaagcactgactatggcttcattcagacaaagggcaaaaagaagcgttctacctgataacttctccaatcaagacagcctacttttgctatctatagtccaagatggacacttttgttatcctctcatctactagccaaattacttttggtgtatctagctctgactaagaacctagactgatctactagccagttactctaatacaaagttgacatggagctttattaaaatctttcattatttaagctctagatcaacatctagaggatgatgacgatgacgatgggttgcttggttccggcaaacgattacgaggacgtcggccgggttctcgagaatcctgtcgtcgtctcccgttgttgaagataatatgtcaatactcttcaaatgtctgtcacaaatagccactgtgttttgttcagattatacagtctatatcacactatatgtcacaaaaatcttttaaattttgtagtctactacagcaatcatgattgtgcactgtagtatcatgctataacttgcgcttttttttttagataatacttgcattgttgttaaactgattattctgtctcattagggtcaaatagcatggcccatccagtattgcacgcggctttgccgcgtgtttttttctagtgatgatcctaaagcatttcaatcattaaagagatgagtagataaaagagcaggataatagcttatataagtgccatgaattgaacacctaaactcccatgctctttcccaaaaaaacatcagccaaccttatttagagcatgccaaatggcaattttaggacttaggagtattactcaaaggtcagcggtataat

SEQ ID NO: 39069 - DNA, 20210 bp, Oryza sativa
  unsure (1)..(20210): unsure at all n locations
cccctcccctgtcacgcactgaaacttgtccccttttaccccatctctttgcttgcatacatttgatcccaaatgcagcatatcagagagagaaagaaatcagatccttcaatctaaatagctatcaagaactccataatacccaaataacactacccatgttttggggcaaacaaaatgccaagccattcgagtttagaaacgaatcaaacccttaactagttgcctccaaagtgtagaaaagagactcacattgtcagtgacgactatatatatggccatctcatcgacggtgtcaacctcccgtctcatcgacagtgtcaacctcccgtgggtgtcttggtggattcagaaggaatgcactaggatattatcttttcgcttatacttattagtcaaattttaaaattttaaccttaaatttagagctaattttaagggttttttttatcaaactttattttttagcctttacttttagattgataagaacacatatataaaagttttatttagaaattactttttgtttgtaaatatacagtttcgtttactccgtagagtagagtagctggagcggagagacaaaacagggttcaatctatgcaaaatggcgaccccggataaagcaccaatcttaaacttagatgaacggtcaggaattcggctggtaaacaaaaaaaagacaatcaatcggacagtatcaccccgtatctgtatagggttgcaacgaagaacgagccaactttccccgggccgaaaactgatcgggtggtgcggcctctctcgcctttgatttaccctttcgcgcaccaaacaccaaaccctcgccgccgccggcgccgccatgcggatccccacggagacggagacggagacggggacgggggcacggattcccagccacaggcggcgcaagggatcgtccgacggttcgcgggccgtacaccggcgcaaaccaacgccgaccaaggagacggagattcccggcggccacgggcggccgaagcggtcctcctcagccctgtcgttggacggcgccggcgactccaacccaacctgggtgatcctgaatcgggtcggtgcccggagggattccttccgcggcgaccgcaccacgtcggtggcctcccgcacctccggcggcaaggagatctccgtctcgttcgagctcgcgccgccgccggagacctccctcctcaccctcgactggccgcaagggccccgcccgtcggaggggaccacatcctacccttacgtcatcgcggcgcacggcaacgtcgtgctgctcgagatcatctccaccgccaagtgccctcgccccatcgacatcgactacttcgtctacaaggccaagcccaacggggaaccctccttgacgcggctgcccgtttgctactggaagggggcttcgggcagagacaatcctcggccacgcatcatgagtagggtggccatgggtgtcctgtcctgcagcaaggattcgttcgttgtggccgagatggagagaaggtcataccaaccttctgcagctaacatctacatgtttttctccggctccgacggctggagagtcttcagggatgtgcggattgaccatatcaatggtgccggctggtggtcaactgatgcagtgttatcctaccgccgtcgctacttgatctgggtggactacttgagagggatgattgttgccaaattggcacatccaggaggaggagacccacaggagcctgctctatggtatgtaccgcttccggtcgatccggttatggggaacccttatgacagtgagcgtgggcgaggatgccctgaagcttcccgtaatgtgtgtgccacccaccatggcatcaagttcgtcaatatcatcaaccaatgtggtggcagttttagcataaccctgtggtcgtggtgcgaggacggaacatggagagaagatgcgacactggatgctgcccaactttgggacctcgattgtgaaaaccgccttccaaatgtccaaccagaattccctattgttgacatggaaaacccttacaccgtttgcttcttgttgaacgagggcaactacattgtccctgaagccacaacatggatgatcaaggtccacatgaagaagaagattctactaggttgtactagttattctaaaaatggaagcttgtctcatcagaacaccacctacatgactgccagaaggatgtctgagagactctcctttatctccagtgaaatgccatattacctgtctggacaaaccatgaaaaggtaataatttcatgtctagtttgccaaatgcatgccatactgttcttttggttgcatgttgtacagaattttcctagtttgaagtgaattgttctgcccatttatgtttagacagcattgacgttgtggtagcttgatcagtcaagagcatgattttagatgaatataattgtggctaggatttagctatttagcagcaccaacgtttcttgctccctttaattacttggtcctgaatccctctataactcatcctatagtttatacaaaatcgatgtttgtttgcatgtttttatttcgtcttctcgacactttttctaaaaatatcactgaaccatttctgaatcttaatttcaagcaggaagttgataaactaggaatataactggagatcgaggaattgtcttaccagtttgaagattggatccatcaaacactgtgtttgcaagagcaagttcccaacactcccctctcgttttccacgcgcacgctttttaaactgctaaacaatatgtttttttaaaaaaaagtttctatacgaaagttgttttttaaaaaaatcatattgatctatttttggaaaaaaatagctaaaatacttaattaatcacacgctaatagattactccgttttccgtgcgcactgtgcatgttcccatccttccctaggatgtgagctcctgcgtctgcgtgctacagtaagttataggcaaaattggttcgatgctatataaccaattttgtcaataataaaaaggctaaaagtttatgccatagcaaacgaaacatgaagtgctactccccacatctgatttgccatgcaattttacaatcgaacagaacaatcaaggagcaacatttcacaggctagagaacatcgtaaaatccagttgcttctgtttactccatgcacaatgtgacaactgacaagcatatcatatcatacggccgccgatctcctgctacagtgcgatgtataggaaagtaggaatgtatgaggaagtgctatatatgcctatcgtatacccatccgacagtaagccgaaattctttagcactcggaccagttttctgtatctccacacctgggctgaacggcttttgtatgcgcctgcatgatggagatcaacatttgtcaaactcaaatatataaaaaagataaagggatgccatgaaatgcgcttaacgcaagagaattttgaatttgcacgtgaactctgccatttttcaggcagaaagtacaacaaatcgtgcgtggtatttgatcttccgtaaaaaagaaagagctcgatatttcaacaagcctggctagtagtgacgctgatagaagagttagagagcaaattgtaaggccacgcattgtatcatctcatctctaatcccgtgcacattcggcgcaatattgttcatgccaatagtttacctgcgggtgcctttcttcacggtggttgaaagttctgtgctttagctctccacggttagttgtcagctcatctaatatctcggcatcgtcacggctgccacagctttctgaatcagatgcaccatcctcctgtgtggaacaaaagattcagattaacaacagacgtggggcatcggagaattaaagagtgaaacacaatcatcactgacaagtaaataatccaagaatgggagataaatttataccagcgtgtgatcgtggtggacaccttcaagctcttcatactcagctgcatccaattcccgaaggtcatttggctcaaaaaactttgggaggacatgctgcctgataagaatcataaggaagaatggcaacgggaacaggatccctgctattggtatccatgttatgccgaagcatatcaagaggtaaaccaactggaagatcgtgaagacagtaattgtttttgaaggcactgactccatgaaagacgcatggggaccctccaaaaccctgcaaatgttgaagcatagtgtgagctgttaatcactgttttgacaaaaaatggattatcttttgattaatccaaaggaggcacataggctgcaccgcaagtagtcaagcatgcaatttcattgttcaaatggggtaaacagatgcagatagagatattacttgtagcgtcggcttgatgggatgaatataagtcttattctttcccaaaactggttgccaggtagactgtcaatggccatataagcaaagtaaccccagaggaccgatgtcggtatcatcttgatgactggcatagctccaacacaagcaccaactaataaggattgcagcaagttacttagtctctgctcattcactcgaacaggcaaatgtgcttcaatatgttttatagggtcaaattcttcagccaatgtcccttctttatcaccttcttgcagcatagcatccttcaagctctttaactccttgtcaacagaatcagtctgcaggacaatttttgacctataagttgatttacttgaacattttccatacaagactaacagtggcatctacattttgaatagttactgaaagaaaaccaaaagtatggggactcctcgtaaggtgaaaagtaaggtgttcaggcaattacatgagcttaggactaattttcttgacaactgatgtagtaattttgacaggaactggcattgacaatagaagtaaaatgcaacaaataaatggaagaggaaattatatggtaacatacatcagtaatgaagagtacatactcacatttttttcacagtccatctcaatgaaaaccccttgcatcttgccatagatttccaaactgctagcacgattcatcaggccttcgttggcagtttgaaccatctttttgcgtagcagctaagcaaacagaggaagaagatgggtgagctgatgagcaaatatggatattgtagcaaacaaaacacttcggtctgaagttcaccaacctgccccttaaggacagcaaggcttcttgtatgcatcggggactgaggaagtactccattagatggagggatgccaatcaaaccacaaagcaggacctgcatcatttttatactactatatgagaagaggagcatgtcacagctttggtctattacaccacaaagcagaatcagtgtccaatactcctatcaaccatcaccttgtagattgcagtagtgccaggttataatcacgcaaaaaagaatataagatattatggatgttggattttcaatcatacccattcaattgttgtaacaaataccaactctactttaaaatatatgagaatatttcttattcattttttttgaacggaaatatttcatattcataagactatactaaaagattttggctagttttaggctagaagtgatagagaaatgaaatgttcactgaggaccaaaagatgttaggttcctagttagccgagaaaaaaaaacttaagaagggccgccataagcagataatttttttagacgggtataagcagataaatttatcatagaaccatggcacacaccatgaatccgaggaccaaaatgtcataatggtaagcagagggcttcttcaagttaaactccttttgttgcgccaattgtgaagccacgctatgatcaaagaagtaaagtcctgcaatcatcaaagctggcagaatggcagcaaatatgtatgctgggggaacagaaaacaggtcctggaaataaaaaaaaaacccaaagatattatcaatgatgccatgcaaaataagctataccaaaattctaaacctgaagaccataaatattcacatctccagtatcccaagcaagtttgatttattacctttgctatggtccagtgatgcagtgaacttgactcccagggaagtggactgaacagcctcctaggaactcctgaaggaacatcctttggtaatgcgtacgataatgctgtccaaacaatcaccataagtgggacaccataatcagaaatgaagcctctgagccaccctgcaagtgtcaactcaaacgcacaatgatcagttcatgtacatgtgcttctcaatggttataaaatgtcatcatggagtcatttgcatgctgatgtagcatacatagtagtaatttcttctctttttacttgaaagatggcaaaagctttgcgtatttaatagagaagatagtagtaatttcttgtttttgtttctaaatgttaaaaatttcaaagagggaaaaacactgtgcagaataagaatctgtcgatatgggctactaaacaccatctcaagccaagccatccactcaataaggaaaaaaaaggagtccatatggtttgccccaaagctgacaggctgacacaacacaagcttgcagcccagcccaaccaacgcctgatctaaagtaggcccagtccaaacttcaaaacagcaaaagaaatgtttggcataaatctaacggttggatggatgactaatggaacagctattgctaatttgatgacccagagctcaacttgccccctaaattggacacaatgagataaaagtaagatgaaaacgtgaccaaccttgaccatacacccatgaccttgcccttcttgaccttaatgcagtgtataacagcccaattgaaaagattacaccaagtaggccgttgacatacaaccactggaatcgatatataggtgaactatggtcgacacctccaggtaccttgaattcttctataattccctgcaataagtaggcaccgttctaaatattttcttccaagatacaaagcactgagctcgctagaaatagcatactttaatagcttgttgcaggaacagaacagtgatcaacatcccgaaaagttctcctgcaacccttgtaaacctgctaataacattagaagcattgaacattgccagaagaaacaacatgatcgcagtccagatgcagaccctgtcaacagtaagcaaatcaggagagcattaacttttttttctgaaaagctaacgtgatagtattcagtttcagttgttaccatccagcccatgctaaatacagtcgttcccccagagcttgctggttcttggcaaagttgtagagatacgtgtacatgattatagttggctctgcaactccaactatcaacagaggctgccctccaagaatggaatggatgatgccacatattgcagtagatgccagtgtttctactgtggtgagtataccatctgaaatgaaccactttccctttgttagagatgtaattaaagcctaaggacagcaattccaaaaagagcacaactgtagtatggctcatagtggcaagagggtaggtatttacttgtttctctgctcagttgcgttccgaaggctatgactgggagggcagaggcaaaaaatatatacatagtaggtgccaatatcctgacgatacatccagaggcaacatgaataattaaggaatgaaactgacagcaacaagaggagtgaaaacacacacagtgatctactgcaaaattaattgttcgaaacaaaattaacctgaagccagagtggaatccctcaagccaatcatgcttgtaccaagctgctcggccttcgatatcagcgacgacacccttaaagggaatctttagtagttccatcagctgaattccactcaatactaaccagaagctgcaacagtacttacaattcagaaatggtacatatatattacatacgtagtattttgaagacacacatattggcatacacacatcctagaagcccccatgttacaaaatttacaaactcaggttaaggtgtcaagctacccagatgagtcaaatggagagaaaccacggaccaaacttgcaatcatcacaaaatgcacgcttggtgctaatacgtatgcaaagtttgcagtatacgtaattaatttgcgcttactgcattgcaacatatttggtgtaccataattagcatttgtaatttgtaattcgaacttctgcatgacgaggagacaaatttgcatttctgcatacaatttctaggaagtttatactatacaaattacttggtcacttgctgagctaaacatcatgcataaaagcactaaaataaaaccagcttgctgggttctttcaaaaataaaagcactaaaaaattgtcgtcaggtaccgcggcaagtgtccaacacttcctctcctctcatgccgtcatgcgtggggttcagtcataacagcaaacaacacatacatgttactccaatattattacttagtggtaaaaaaaatcagaaaacagcaaaaagaaaaaaaaatcaagcagtagagacccaaatcacgaaatatttacagataacttgttagatccatatgcaagcattccacatcccgacatctacatgcgcacgcaaccaccgcacttgcgaaacgaacaagcgccgcgtttctccatcacctcgaacaaaaaacccacaaacttttaccaccgaaatcgatcaaaaaaaaaactatgaaaaaacccaagcaaatctccccacaagtaggaagagaaatcagccgcaaacaccagcatgcaacacaagacttcacagtccgaaagggaacgcacgcacaccgtgactgcaaaacctccaaaaacccatcgctcactcaacatcggccgagcaatcgaggcagcggcgagaggacccgtacctccggcgggcaatgctgacggcggaggggaaccctagacgtggaggtggcggaggagacgacgcggccgcggcggggcggcgcggggcggggttggctcctcaaacctcaaggcccccgtgatgtgcggctatttataatcgagggcgaatcgaatggacgctgccgagaagaaggggagaaaagaaaaaaaaaaaagccgccgcggctgcctctggaaggctggaaaacaaaggagacgagaacccgtttacctaggagtattttttttgaaaaataaatcggagttgttagaaatatgacgccatatactacagtcgattttttcagccatttatatagtagttacacctcacttacatatgtaattagtatgtaatttttgaatttacatatgtaattttattacttacatatgtaattttgagatttacactgtaaatacactaaaattacatatatatatatatatatatatttaggaacttacaatgtaaatacatgccgactattttttatgaaaaatattgtgttataaatatagctacacccaaataaattccaaaggattttttttctttttgtctactctctcatcggcgtcactctctgacaagtgggccccaggagctgacaccagtggggctcaccggtgatactaggggctctgccgcatggcagccgtgacgacgactccctgaggttgaagggtcagcgccaaagatactctactcctacatataccctccgttctaaaaaaataacttctacgaatgaatctgactaatacttatctagattcattcacagaagttaattttctgtgggatggagggagtacctacattctaagataaaattcgtttcaaattagatatggttaaaataaataaaattaaatgggacaagtttatgattgattgagaaataaagttatgaaaaaaattaaataatgaaggattatgattggttggaaaagaaatattgatgaagaaaaaaaaataaaagatttaattattatattatatgatagagatagtacggtatggctgtatggccttgtttagttaaaaaaaaacttttcacttatcatcttgtgtatgaagtattaaatgtgaaaaataaatcaattacacagtttgcgtgtaaattacgagacgaatcttttaatcctaattacgctatgatatgataatgtggtgctacagtaaacacttgctaatgatggattaattagacttaataaattcgtctagcagtttcctagcggaacatatattttattttatattatattacgtttaatactttaaatatgtgcttgtatatattcgatgtgataaccaaacctaaaaattaattttaaggccggggtgatggtgacgtgtaccgatcgttgcgtcatcgtcagcttccccctgccacccaggcatccactgctgcagggcaccgccacgtacgccgcgcggccgaaggcacggccatcaccaccaccagcagcagcagcaggcacggccgatgtgggtttctcgtccaaccaacaagctaagcgcaacgaacagctgctactaacgagcctacgatgccaaaatgaaaagaagttgtggaggagtaaattgcaggagctttttgttgaagatgctgacacttttttgccacgctgtattgatgagaaacagtaagttgtgatttagttttatagcgaaaggtgtaatttagttttgagacgtttacattaatgtaaaagatgtcgtactctaacagatgatcggttaaaatgaaacttattaaagggggacaatagtgggtcagtagattccctgtatctataaatattatgtatgtgtgagtccgtttttaataaaaatttacgggtattcagagtcagggctatgctgaaaataactatatgtatgataaaattgataaaatcttgttatgatcctgccttgcatgattaacgattgggccattaaaacattatattggagctcatgtttgttgcatgcactagtttcatagaagcaacattagcaagaaattttatcatatgtatagtagggcttgggctatgcggcggtttttatctcttcaaaacgtgtgttttggagcaaactggcaggtgagtgagtgagtggtatgtgtgcacatacgtgttgtgtgtaataaaaaaatatataatttatttatggttatttagatgaggttctacttctaatggccaaaatattttagttttattccgtttccgtaagttgtatagctctatggtgaaatggtgacatcatatatttttatgtattggagtattactgtattctttgtgtagtcgtacgtgtaagactcctccatcgtgtttaaatcatgtgtaattcctaatacacataaataaccatgagttagcgtaaattaagggtgagaaatacccctttctttcaaaactggaaagtattttccctacacctggccaggcgtcactgaaactactcacggatgtgttgttgcattcaatggaaaaaaacacccaagaaatgctcgcagctgctaggaacgtaacgtgaacctgacggcaacctcatcaccacaacctcttcttttgtctctaccaaataaggagaatgtaggacctctcaagccaagaaagagaaaaaaacgaatctctaaaatttaaattttatgagacaaggacttctcatatgttccctgataaaaacttaaaagagacaaggacttttcatgctcttgagtgtacttcaaagttttttgtgtggccggtgagttcttggagtcttagatcttatttatacctattagccaaagtttaaatttttaaccttaaatatagagtagattttaagtttttttttcatcgttgtttatttttcttagatcgttaagaatacatgtataaaagttttatttatagatttttttttgaaaatatatcgtttcactttttactctaatatacctaacgattgggctgttaataataaggcgcaacgtagcaactgcatgctgccttctttgggggttttcagtttggatcctgcagattgcagctgcagcgacgtctcgaattgttatgatctgaacagaaaaacggaatggtagcctcttggtcaggaagcaacaagcgtggctgcgtgggtgtggctaacaatttgtttgccgctccttaggccgtgtttatttccttgttaattttttttatgtatacggacaaacatttgaaacatttgaagtattgaacgtaaactatttacaaaacaaattacagattccgcatgtaaactatgagacgaatctattaaacctaattaatccatcattagcaaatgtttactatatttttttttacaaaaaacattgtatatatgaattcatgaaaaaaaacaattaaaatatatttcttaactttatagtatttaatacattcgtttgtgctatcaaataattgtaaaaaaaaaagaatcattcagtcattgagccttaaaaagcagaccctagtagctaaaatatctgcattttgtgtatagcagtacttacattgtactcccttttacctatgcgtaacaaaatcgtactactaagtacagttataatgttcaaaaaaaatacagttattgtgtacaagaaaaatcgtagccttcacaagatatttgttggtactttgcttggtataaatcttaaacaggacgtgctaatactttactgtctcgtacaattaattcggagagcgctacgtgtcggacgtacggcgcgagacgaaaaatcagacgcctccgcaaccgtccgatccatgcacagatgcaccatccatccatcatgcatgtatcaaacgaattttaaactattttttctctcaaaatatttatccaaatcatgatccgattgcaccattaaattcgttgcaattaaatctttaaaacaagaccacacatgaatataatccgatgaaaaaaaattttagcttattattgaattatttttaaatgttgcacgcagttgcaccaagtatatcggacttgttccactaggtagatcgaaaatgttttattggacgccgtttcgccttatatgaaaataatgttttagcgaatagcgaaatgatgtttcaactcactgcaatagttgattcatacatagtgaaacattatgagtacattaggtgaaacatttttaaattaaaaaaacggatggtcaaatgttgcagttgaccaacaagtaaaacatcatgttatatatatggtgaaacaaaaaagtcagcaactggaacatttaaatattttatgaaacatagtgaagatacatgttgaaacatgttgctgttacacatgaaacaacaagtattaactgattgaaacacatgtttttcttttatgaaaatataatcaagcgatatcttgttgtaaagatttaattacaacgaatataatggtgtgatcggttcttagattgaataggtaatttaagagaaaaattattttgaagcttgctaaaatacatgtatgtatgcatgcatgaggtggagagagagtagtagtaggtagtttcaggaattttgtgaaacacacttaaaacacatattgaaacatatcactatcacgtatgaaacattttgttttaacggtttgaaacatacgtttttcttttgacataatataatcatgtgatatcttgttgtaaagatttaattgcaacgaatacaacggtgtgatcggtttatagatcagataagtaatttagaagaaaaaatatttaaagagatgagaaaagaatgaaaagaaacaactatgtatatgcatgtatgttacagtacgacagtaccaggctgctgatctacaacattttgttgacgtcaataaagagaaagaagaaattagcaagcaaggactgagctgaccgtaggcgttcgatgtttttcatctgatcggacgttcgaagagaagcattttcgaattaattctgctgtaaaatacacacaaaaaaagatatgataatcgtgatctaagcgatgacggcgcctatagagtccagattcgctcatcaaggcagtgaaggcactggctatatgaagatgacaacgagactgactgtatgagaatatgagaggccatgttgaattatcgatgcaaaaatattgattaagaaaaatgagttttggagggagagacgtccctccaaatatttttttatcgaacatgagattttatggttaaaatcacacgctacttaccactgcactatcaagtacatctcgtaaaaatgttgattagtctcaataaagtttgatgctgccaggaatgtttcaaagggatgtctgtatttttttaaacgaagttctattgatagagtagaaaaaaattacaatttaggatcataactagaaaaaaggaatgcctgtaaattaaatttgatgagtcactgggtcaagatcacttttattttttacatttaccatttagcatgcggccatgcaaagcaatacaaataatgccccctacacccctccgtcattctctttccgttccactaaataagacatgatgaaatttaacacaatctttaaaactaatttttaactttaaatttctcatatacacaatgtttgtagcaagaaaataaaaaagaacaagtttcaatatcagtcaattgaatcgattgattattcttatcaaataaataattaatcctgaagattttaaacgatatgtacacacactaaatccattacattaaattaatctacactagctcctccttctgtttataagttgctttaactattctaaagtcaacattttaagtttatagaaatgtacaacaatattaatatttatagtaccaaattaattttattaaatataacattaaatatattttgatagtttattttatattaaaaatgttactatattttcttataaatttgatcaaaactaaaagaaaagtttaacttgaaaaaaatcaaaagcggaggtgtagctccaaagtccaaatgcaattctcagaccaggcaggcagctgacggatgaaacaaaaggataaaatgcgaatcatctgaaacatggctcaggtttaacctccagaatgttctcgctgattaaaaagtctgggcgaattaaccagctgacacgtacacgcacgtttctgattatattatcagctggtttattatactaatctcgatcggatcatgcagcataaatgtccaattgtctggtcgcctaatatgcagaggagggttgataattacttcctttgttttatactccgacttgatatgtttgaccattcatagtgttaaaacatcaatactataaatttgcagaaatactactcatgcataaaaagcttttttaatgataaacccaaccccacggaaaataattaataattagtacatactcatcgaaaatatcattattttaatatgacgaaggtcaaatccaatattaatcgaaaaccaccattttaanaacagaggaagtaatgtttaaaaaaaacagaggaagtattacgcagtcactttcactagctcaggtagcgtttagttagtcgtacggatcaggtggtcggcaagatcaagattgtgattagaacatagtacagtatataagttggccatgtgttcgctgttcaggggtacaaagcagaataggcagctgccgttgcttgtgaggagttagcactaattatttgtactttgtcacgagtaagcatcgtcgaatgcactccctccgttcttaaaaacaacactgaggacaacaacaatatatatgacaaaagtagtccataaaactagaacccacatatataaactttaactattataaatttcacaatgtatatggatagcaaatagtattagtagaagagaagagatagagacaaataatatattttattctctataggcaggccatatgtttatgagtagcttttgttatttctttcctatgggctagtttcacaatgttgctaggtggctgaatcaaatattatattgcttatggaccatttttggagtacattgtggatgcccttaatcgaagtaaagatgtaatttcttctagcacaatgaatctgactcactctctatccagattcattgtactagacagactgtttaaatttattataaaaaaagattacatcttcttgtaggttttttttaatggagggaggagcacgtactccagttaattggtcggtgggaagtttcttttctctggatcgataagggaaattttcaatggcaatagaacgtactaatccgtagttaagtacgaactcgagacatgtacagggatatgtatgagtatgacgttgggatcaatatcacagtgtcatatagatgatcggtaggagagtatagctagtaccgacatagggaaaagtattatttcttgaccgatgatatacatagcattggttgtaaacgaaaatttaactatttgccacttctagaataaacaattatctagatgtcattcttatatttgcacttatttttttgcaaatatttttacccctctaaggtgatgacttctttaactatttaccatttttatccatgtgacataccaatgtgacaactcggggtgaaaaacggtgtggaacccactagtcaaactctccacttcccttatctctctctcagctagttgaccaggccgcgacagcatgcggagaggcccaggcggcactggagtggaggttgacggccgtgacggccctctccccggcacgcacccatcgaccttcatggcatcgatcaaattccacgatgacgaccattgatgcggggcaacgtaccaatcgggatgctcaggctgcctttccagtccgatctctctaccagcggtgactcgcgtgagcgctcttcggttcgttgtctccaccatctcctcctctagcccactgccccagcctcccattctccatctccgtccgcgtcaatgtcgggcccctcggctcccatgcctgcgccgcacgcccttctctctcaccgccgagttcaacctcgtcttcggcaaccccgtcttccccgtcttcttcctcttcctcaagctacggctcggtgttaatttagtgggaaaaagacatatatgccttgcatatttgcctttgttttgagggtgttgtgtttttgccatatttgtgccagcgtatcttgcatatggcgatggatattgcgcgcgcgcgcgcatatatatatatatatatatatatatatatatatatatatatatatatatatatacacacacacacacactcagcctcatcggttgtccatattttcgaatatgttaaaacagtttattaggaaacaaaaattaatttacagtaaaacttttgtatatatatttctggcaacttaagccaatataaaaaaaactatgttaaaaatattttaaatttaacatcaaaattaagtttgaaaattcaaatttgataaatcaaaccgatagaaccctcaaaatgttaactaaaagacaaatcttcacacgattgtatgtgaaggtgaggagaaaagaggtgcgacgggcgaggttggcggcgaggcaagcagaagcgggggaggcgacaattagagcaggtacaatagcagaatattagccagctacaaatatattttaatgagataaaagatgagagagaagagcagcgggatacagatctgtagctagctgcagcacggactccaagatgcaatgtatgtatgacagtgggaccatatactattagtatagtaaacaactattgtataaattggctattagattagctatagatgaattagagctagtagttggctatactattaaccttgctcttatagcgtgcacgatggctgcgacgacattgggcgcgttaggcggcgacgacgttggctgggtgctagggtgggcggcgatggcagagcggtggcgatgaagtgccgacgcatgcggttgctgggagcctgcctgcctggagactcggggaggagatgcggtttccgagaggaatcagggagggagaagcgtgataggcagagccgagtggggaggtcagggatgggacgttagatcgaaagatccaacggtcacaaaatatacgtgcggagtcatgggtctatgcggggtctggtgttacggaattttgttggatcctaggattgcacaactgcactactcgatttaatatcaaccctctgcaaagtggaacaactttttgtccatatgtcagtttatcgtttcgtggtgcaaaattattatattatattcgttccaaaataagtgtagccataagtacctttgaccgtttatcttatttaaaaaacttattaaaaagttgaaaaagtgcatcaacttagctaatcatatgctaggtgagttttttttttcacgatgtcaatatgccattacatagaaatcctaaggatattatctttaaaaattatactacacatccaattacctttaagaatttttgttttcttcaccttcccaaatctcaaccgaaatataataatttctacatccagcttaattgactttcagttattagttattaggataaaaatataaatatgcttatatacaaatccacactagtatattgccaaaataagtacttaaaaattgaatatgtataaaaaaaagtgctccaaataattaagttgtcgcataacttcttaacttattatatcaaaattgtacgtatcttgcaagttcttatgcgatcacttataaagttcttgtactaaattacacttacctaccaagttgttgcactagaacgctcatttcacaagtttttacaccaatttacacccacctgccaagttgatacattgggggtgcaatttacttaaatattaatctaaaaaaaattaaatcagacaaatggccaaacttggacatgaccatcttgggagtccatccacttactttttgcacgagtgttttctatataaataaaacgctaaaagcttatgccagatcaaacgaaacatcaagtgctactgcattgaaagcccaaactccacatctatattccatattgattgccatgcaattttacaatcaaacagaacaatctaggagcaacaattcacaggctagagaacattgaaatctacatgtcacacagccttacagaccttcagtaaaatccagttgcttctgtttactgcatgcacaatgtgacaagttgacaacgtacaagcatgtcatatcgtacggccgatctccagctacagtacgatgtatatgaaagtatgaatgtattatgtatataatacaacggaccgctgcttgaggaagtgctatatacgcctataatatactcatccgacagaataagcagaaattcattagcactcggacaagttttcagtatctccacacctgggttgaatggcgtttgaatgcacctgcacgatggagacgaaacatttgtgaaactcaaataggtaaaataaaaaaaaggatgccatgaaatgcgcttaactgaagagaatttactctatgccattttaggtccaaagtacaatagatcgtgagtggtatttcaacagactggctagtagcctagtagttgaccacagcagaaggttagagagcaaattgttaattaagcccacaccctctatcatctcatctctaatcctgtgcacattcgctgcaatattgttcatttgcaaataatttaattacctgcaggtgcctttcttcacggtggctggaagttctgtgctttagctctccacggttagttgtcagctcatcaaatatctcagcgtcgtcacggctgccacagcttcctgaatcagattcaccatcctcctgtgaggaaccaaacttcagattaacaacagatgtggggcatcggagcattgaagaatgaaacacaaaatcgtcactacaagcaaataatccaagaaggtgaggtaaatgtataccagcgtgtgatcgtggtggacaccttcaagctcttcatactcagctgcgtccaattcccgaaggtcatttggctcaaaaaactttgggaggacatgctgcctgataagaatcataaggaagaatggcagcgggaacaggatccctgctattggtatccacgtaatgccgaagcatatcaagaggtaaaccaactggaagatcgtgaagacagtaattgtttttgaaggcactgattccatgaaagaggcatggggaccctcaagaaccctgcaaatgatgaagcatagtgtaagctgttaatcacttttctaacaaaaaaaatggattatcttttgattaatccaaaggaggcacataggctg

SEQ ID NO: 39070 - DNA, 18233 bp, Oryza sativa
tactccattagatggagggatgccgatcaaaccacaaagcaggacctgtatcatttatgtactactatgagaaaaggagcatgccacaattttggactgataatgaagtcagaacacaggatagatgcagggtgtacattagaccagaaagcagaatctgtatcctatctgccattgccttgtagattgcagtagtgccataatcacgcaaaaaaaattcagatattacggatgttggaatttaattttctaagaaatgcaggtgtattttcaatcatacccattcaattggtgtaacaaatacaaactctactttaaaatatataagaacatttcttattcaaaagactatactaagagaaacttaagaagggtcgccataagcagataaattgtatcataaaaacatgccacacaccatgaatccgaggaccaaaatgtcataatggtaggcagagggtttcttcaagttaaactctttttgttgcgccaattgtgaagccacgctatgatcaaagaagtaaagtcctgcaaccatcaaagccggcagaatggcagcaaatatgtatgctggaggaactgaaaacagatcctgaaaataaaaaaagagaagatattattaatgatgccatgcaaaataagctgtgcgaaacttctaaaattgaagaccataaatattcacatctccagtatcacaagcaagtttgactaattacttttgctaccgtccaatgttgcagtgaactcgactcccagggaagtggactgaacagcctcctaggaactcctgaaggaacatcctttggtaacgtgtacgagaatgctgtccaaacaatcaccataagtgggacaccataatcagcaatgaagcctctgagccaccctgcaagtgtcaactcaaacgcacaatgatcagtgcacatacatgtgcttctcaatggttacaaattataatcatggagccatttacatactgatgtagcatacatagtagtttttttttttttttgaaataaagcaaaagctttgccatgtatatattagtagagaagatagtagtaatttcttgtttttgtttctaaatgttaaaactttcaaagagaaaaaaaactgtgcagcaactatccacataatataaaggaataagaatctgtcaatataagttcattaaaaaaaagaatctgtcaatataaaggctacaaaacaccatctcaagccaagccgtctactcaagaaggaaaaaaggagcccatatggtctggtccaaagctgagaggctcacaacacaagcttgtagcccagcacaacctaagcctgatctaaagcaggcccagtccaaacttcaacacagctaaagaaatgtttggcataaatctaacggttggatggatgattaatggaacagttgttgctaatttgattacccagagttcggtttgctctcaaaattggattcatgagataaaaataagatgaaaaagtgaccaaccttgaccatacacccatgaccttgcccttcttgaccttaatgcagtgtataacagcccaattgaaaagataacaccaagcaggccgttgacatacagccactggaattgatatataggtgaactatggtctgcatctctaggcaccttgaattcctctataattccctgcaatagataggccctggtctaaatattttcttccaagatagaaagaactgagcttattagatatagcatactttaatggcttgttgcaggaacagaacagtaatcaacatcccaaaaagttctcctgcaacccttgtaaacctgctaataacattagaagcattgaacattgccagaagaaacaacatgagcgcagtccagatgcagaccctgtcaacagtaggcaaatcaggagagcattaactttttttctgaaaagctaacgtgatagtattcagattcagttgttaccatccagcccatgctaaatacagtcgttcccccagagcttgctggttcttggcaaagttgtagagatacgtgtacatgattatagttggctctgcaactccaactatcaacagaggctgccctccaagaatggaatggatgatgccacatattgcagtagatgccagtgtttctactgtggtgagtataccatctgaaatgaaccacttttcttttgttagagatgtaattaaatactaagaacaataactcaagaaatagcacgactgtagcatagactcatagtggtaagaaggtaagcatttacttgtttctctgctcagttgcgctccgaaggcgatgactgggagggcagaggcaaagaagatatacatggtaggtgccaatatcctaacaatgcatcaacataagcaattcagaaatgaaattaacaagcaacaaaagcagggaatacacactcaatgaattaactgtttgaaacaaaaatcaacctgaagccagagcggaatccagcaacccagtcatgcttgtaccaagctactcggccttcgatatcagcgacgactcccttaaagggagtccttagtagatccatcagctgtacttagctcgagactaaacagaagctgcaatagtaattaaaattcagaaacagtacataaatattacatggattttcaagacacatatttttttgactgaattcaagacacacatattggcatataaaaacatcagaagccccatgtcgtctacaaaatttgcaaactcgggtcaaggcgtcaagctacctcaagacgagtcaaatcgagagaaacctcgaaacaaacttatagccatcaaaatatcagacgtgtgcttaattgcttggtgtgttacttatataacatgcacggtttgaagtataaatatttattttgcgtgtactacgtacaccgcaacataattttccgaacttttgtattcggaggagacgaatatagattttcaacatacactttctacgaagattttaccaaggtgcaaactagttcgacacttgcagcacaactttttagcgtcagtgccacaaaccacttcaaaattgtcgtcaggtaaggtaaccgcggctagctagcttacaaacatgtccgagtacaaccgtacgatccaacacctcctctcatccctcatgcgtggtggggctcggtttaagccagatacatggaaaaccaatggcacgcagtaaaaaaaaaaaaaagcgcaacgctacacctactaattttttcttactaaaattttgatcatttgatttaggtagatagaagttaaaaaaaattaaatgcacacatagcatgacacaaccgtgttactaagagtttagtaagaaaaagttagtgaatatagcctttttcgaaaagaaaattcgaaacacaagttactcatcaattaataggcgataaaaaaattcagaaaacagaaaaaaaaactcgagaagcagacatccaaactgcaaactcgcaaagttttgacagaacaacttgtagtagatccatttgcaagcaaccccacaaaccacatcccggcagccgccgcaccttgcgaacaaacaaacgtagcgttcctcgaagaaatttgccaccgaaatcgatcaaaaaaaaaaacagccatggaaaaaacccaaacaaatcccccccaaacccagcgcaaacaccggcaggcatgcaacgcacagccaccaccaccagtccaccaccaccaccaacgcgaccaaaacccaaacccaaacccaaacctcgcagttcagttcagttcgaaatagagcggacacagtgcgaaactccaaacaccatcactcacatcagtcgtcgagcaaatcgatggcgcgcgtggcggcggcggcggcaatgctggccgctcgacggcgcgggagcgaaaccctagagttggagggtggtggcggagacgcgggtttctgcgccgccgcggcgggggagggggtatttataatcgagggcgaatcgaatggacgccgcggagaagaagagaggaggagaagccgcggcggccaggaaaacgaacacgtttacctagaataaaaataataaataaataaataaattcctccattattttctagtactacgtcgtcactctctgacatgtgggcccatgtctgacatgtggaggaccacaaagagatacgcgtggggcccactagcgatgacgtggcggggatgggaggctctgccgcgcatggtagcagtagccgtgacaaggttgaagggtcagcggcttgtggcccgggggtgtatgtgtggctgcaggtggggccggatggtggtgacgcgtcatcgtccacccaggcatccactgttgcagggcgccgccacgtacgccgcggcccaagggacacaccaccgccagccaccgcgcatgtggttctcggtttctcgtcaaattaactgatgacaagctaaattggaagttttcaaaaacatgcaaagttttttcttgagtaaagtgtatagccggtccctaaacttatacgactgtgttatttgagtccccaaactctcaaaatgtatattcaaatcccaaaacttgttaaattgtgtcaatccgatcccaaactaccatgacacctccaggatcctacatggcatgccacccggacaatgatgtggcagcatcacaaattctacaccaactgacaagtgggccccaataaaaaactttttttaatatccttttttgttcattcccatcatgtcctttcttcgtttctcctcttttcttcctactgcattgaccgtagccatggcctctggtcgagctgtctttttgatggcatgaacagaggtgcgtccgtgggcaagaaggcaccggcgcagcagccgcgtcgacggaggcgctgcaacgtgtgggtagcggcgccagcgcagtgatggacgcggttatgtcctgggcatcgaggagactctggccgggagcggcgcgactgcgtgtggctcggcacgtttaccggtgaggccgaggcggggcatgcctacgatgttgcggcacagtagttccgcagccgtgacgcagtcgccaacttccgcccctcgtcaagtctgacccgaaggctgccgtcgagctctgtttcttcgcctcccggtcaaaggccgaggtcatcgacatgctccgcaagcacacctacctcaaggagctcgttgttgaaacaagtgtgccttcacctccatctctcatcacctgttcgacaagacaatgatcccgaagcaaccaaaccccgaagaggccgcgtcgccgcctgccgccgccgtcggtactggtgttgcgcatggtacacggcctgctcaagaacggcggcagtggcgttgtcatcgccgcgagggtggcgaggttggtttgccgttgcgctcgtcggcagcggagccgttctggccgaagcttagggttattgccgctgacttagacttcggaattcgtcgccatcgtcgatccttgtccaaaattgaggtcttcctcatcttctctatgccaaactccccccttcccctctcctccccgagccgtcctgctatcggagctcaccagcaaggtacccgtgtgctgcggtgccgcctacctgtttggccgccattgtgtcagcacggtgcaccgccgctgggcgtccctgcccaagccgagaacacctccggctccaagtcgacgccctgatgctcctaggcagccgtgcccagtcggaagctcaccggagcgccgctacttcgcatgcccccgccgcttgtacaacaaaaaaaaaagagaagagaaaggacaaaaaagtgaaaggagaaagagaaaagggaggaaaaaagagtttttaagtgggtcctatttgtcagtcaatgtagaggtattgatgaggccacatcagtgtccgtgtggcatgccacatcagcgccgtgtaggatgctggaatggtggtggctatgttggaccgaaatgacatactttagcaagttttatgacttgaatctgtattttttgagttcggggacccagatgggacgacgtcacaagtttagagaccgggagtgtagtttactctttttttatttagaaaaaatattggaaaataaaatttatttgaactttttaaagaatatttctatataattttttttttattaaaaaacttatcctaaactaatttaggaagcgtgcttatgacaaagcagcttagcgaagattatgtttaaaacacatcctaatcaaacaactggtacgataaattctgacactggtggagaaaccatctttcgtcggtcggccgaattccacaatagtcccggatgcaataaaaatcggggctaaagatgatctttagtcccggttcaaaagggtaacgggcatatttgatcttaacaccaaccgggactaaagatgatctttagtcccggttcaaatgctgtcagggcctgtcaggccccccgggatctttagtcccggttggtagatcgtaactttagtcccggttggtaataccaaccgggactaaagtctcacccctatatatatgtcttcttcctcctccagctgcctgagcaagcttcaaaatttcttcaaaaaagaggggaggtcatgctaaaatttctagtgaatttattttggtgattacatacaaatcggaggtgcctaaaaggtttgcaacttcatcctccaatatttttttgtcatattacatttgcagctatgttttgcatacttttttgtctccaaaaattagttgtaagttgatgagggagaaaatttgtgtggggaagaaagaatatatagaaatttagttgatttgctaaagaaagttttataaaatagttgagaaggaaaactatagtgaaaattaatcttgaatactagaaaacaaactaaaatgaaaattaaaagaagtaaaacacattaaaattagtttaaaactttagaaatagtaaataagaattatttggtgtaatattttatgatttttgtatgaataaagatatgtcattattgtatgactgttgaaacagtttgtaattatcttataattattgtatgactgttattattgtaagaataattatttttgtatgattttttttcgactcatgtagatggatcggcaatggatgtacgctgaccggcggtccaaagagtttattgatggcgtgcactattttttgagagtggccgaagctaacaggcaaaggggttttatttgttgtccatgcaataagtgtaagaatcagaaggagtattctgcatccaggactattcatttccacttgtttgagtcgggggttcatgccaagctataactgttggacatcccacggagagcaaggtgttgaaatggaagaagatgaagtggaagacgacaatattccgaactttgctcagtacgttggatttgaaggaaatcaaacgggcgaggaggaaagggatgctgatggtaacgacgttgcggatgattttggtcagatgttgcaggacgccaaggaggactgcgaaagtgaaaagggggcccataaattggacaagatgttagaggaccacagaacttcgttgtacccaggttgcgagcaggggcacaaaaagttggataccactctggagttcttgcaatggaaggcaaaaaatggggttagtgacaaggcattttgcgatttattgaaactcgtcaagaacattcttccgaagggaaacaaattgcccgagacaacgtacgaggctaagaagatagtctgcccgctaggactggaagttcagaagattcacgcatgtccgaatgattgtatcctatatcgtggtgaggagtatgagaacctagaagcatgccctgtttgcaaagcactacgatacaagattagacgagacgatccaggagaagttgacgggcagctaacaaagaagacaattcctgctaaggtgatgtggtatttccctataataccacggctaaggcgtttgttcaggaacaaggggaatgctagaatgatgcgatggcacgctgaagagcgtcaacaggacgggatgctgagacaccccgccgatggttcgcaatggcgaaacatcgacagaaaatttaaagaatttggaaaggacgcacgaaacatacggtttggtttgagtacggatggcatgaatccttttggagagatgagcagcggccatagcacttggcccgttacgatgtgtatctccaatctcccccctggctatgcatgaagaggaagtacataatgatgccgattattattcaaggccccaagcaacctggtaacgacatcgatgtgtacctaagaccactggtcgaagatcttaagctgttgtggaagaaggaaggtgtccccgtatgggacgaggacaaacaggaggagtttaacatacgagcgctgctgttcgtaaccatcaatgattggcctgcacttagcaacctatccggacagtccaacaaggggtacaaggcttgcacacactgtatggatgaaacagaaagtacgtatcttaagcactgtaggaaggttgtatacatgggtcatcgtcgattcctcgcagcaaaccacccggtacggaagaaaggcaagcacttcgaacataaggctaaccaccgtatgaagcctaaacattgcagcgggaaaacaatgtttgctatggttaaagatcttaaagtagtgttcggaaaggggcctagaagccagcctatagagagcgaagatggtcacgcggcgatgtggaaaaagaactctatattttgggagttaccctattaggaattcttggacgtacgccacgcacatcggtcccatgatccccagccgaccattcctcctgcaatggtgagcccgtcaggaaaccgtagcagctgcgcctcaacggggcaggtaggatcacagagcatggacgccatacaaacccaggacgaatccacctgccctgttgatgacatcactcagcggacaccatgtgagctgcatattcctttcaagaacttatcaataaaggtaagctcgtagtttatatattttagatttggccattccgctagttgctgcttatatatgttgattactaataaataacctctcaccacatgatggtggcatcgggcatggccatcccaacggacccttcaggtacttaccactgcaggccgattccagcaggatactccaaggtcgaagttgagttggtcgaaggcgcgtacgaggacctcgagctggattaccctggaggagacagtgatacgcatctatgagacacaagccatgccattattctatggcgcaggcggtacatcatcctccctgggcgacaagcggcgtctcgtgcaccatctcctccggctccgccatctcctcctcaggatcctgcaccgtctcctcctcatgctccaacaccgtctccacctcagactcctgcaccgactcctcctcaggctcctgcaccgactcctcctcgggctcctacaccgactcctccgcaagctcctcttccggcaccttcaaagtcaagggccccccaagctccaccgcctgcccacacaagggcaacgaagaaggcgaaagttgacgccgccaagaacaaggacccagggtacgattgcacgcaagaggagcttgacgcttacgtggcatcagaagtcaagagacaattcaagcctcgaagtccagaaaagaagattcctatagacccgagtgtcaggaagttctttaggggtatgtctgcacctgccaaggaggccattaagctatcggactatgagcgaacgctgaagaaagcatcttctggaaagtccaaaccagtccctcagcttggagagcaaccaaaccaggagatcgagccgttggtgaccggtgaagaaatgacgatagaagaatttattactgacaccagtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaagggaatctacgaactataccagctggacgctctcgacgtctctattatgagttgctggattttgtaagtatatcgttcagttagatttcttactacgtctcctttaattaattaggtccttgtatataagtagactatagaaaataatatattctcttttatcgttgtagaatggagattcaaagggcccgacggcggggggttttcgatactggattcatcgaccctcggaaagtaaacatcgcaatgctcgaccaatatccgcaagccacagaggacaatctcgtccatctcctgaaggcgcagcattacaagacgttcatactgttgccgtacaacacagagttagtttaattttactgtcttcctataccaaatttcattcccgtacgaacttgctaagtgtttcatatgtaatgcatcccacgcacattgcagattccactgggtgcttttactcttcgacctgtcggcctacaccgtcaacgtatatgactcaatggataaaaaaagagtctacgtttgacaaggttttcgaacttatggacaggtattgtcataagttcctctgttaattaagaaaatcttgttatgttaattgctactacgaatcatagctttaaactccatgtagggcttggtatcggttccgtcatttggtccgcggcaaatggagagaaagacttaggcggaagtttaaatttcctgtgagtacacatgctctacatttatattgctccgattcaaatatatacaagtgtatattaattagatctctcgtcgtttgtcatttatttgtagtgcggaaagcaaaagcagggaactaacttgtgctgctattacgtgtgtgagtattgccactgccttgcagaccaaatcatcaccacaagagagctcgatgtacgtacaaataaattcaaaatttcattacgtatcgatttcttgtttaattactaatcaatttcatacattcatatagtttattcgtatgagggataacctgaccacacacaaggaatttatcgtggcggttcaagaacaacttatgggattcatcaacgaacaagtccttgatcccaagggtgaattctactacgacggaaacacaattcataggtccttagcttctgagctagcgactactacgtcgaaatcgtagctagctaggacatataatggattgtaattaatacatgactacatatgtttctatatgcatgtgtacacattttctataatgtaaatatattttggtcacacacacacatatatatatatatatgtatacatatatatatatatatatatatatatatatatatatatatatgtatatatatatatatatatatgtatatatatatatatatatatgcatatatatatataaaccctacagcaacagagccatgaaaaaaaaggtcagctcgatttttagtcccggttggtatatctttagtcccagttatttcatccgggactaaagatagcgatctttagtcccggattggtagtcccggtttgaaaaccgggactacaaagggtttctccaccagtgtgaagtccaaccaatatccactttcggtcttgctatgagcttgacgaataaaattttaatatatacttttatttttaacgttttgcttttatatacatgcatagaaaagagttgtgaaaatatatctctaccctagaatggagatgcgggatcaaggcagtgcttcccgcgcagcgtccgcgtggcaccgttgctcccgcggaacgtccgtgcggaaccgtcgttcccgcacgcaattcctcgctcccgcgcgaccggcgcggtccagcgcgctcatgacgcgcggccggtgcggcaaacaagcacatatgcatggatgtgcatatgttgcatacatgcatgcattcacgttgcatgcagcgatgacggcgcggcggttccgcgtttccaggctgcgggatcgataggttccgcactgctgttttgcgcgaccgctggttccacaacccttatgcggtagagatatatttgtgcaaaatttcatcgcattggtatataaacacaaaataacgaagaaaaagatatattgtgaaattttttcctgggcttgaccaccatagacaaacggtgaatctatgccgaatgcgcttacttagctgcttccacgaaagttgccacatgatgccaatttttagcaacccagccaaagactaagaacttgtttggagtgaagctaattattttccaaccaaaattttagcggcctaaatagtattgcattgatgtttagtttgcttttttttccctcactaatataaatttatggtaccaaattttgtagtcgcagaaattatcaagattttagcaccatcaaaaaaatattaacaggggaaaatttagctccaaatcaaacaagtgaaaaaaaaaactttgtgccacactaccacacccctacagtgagagtgtgttcttagttcagcatcacctctacaacgtattctctccgtccataaataatcaatctaatttcaaatatgatatatcatattactacgaatctggataaaaatatactccctccttccctaaatatttgacgccgttgatttttttaaatatgtttgaccgttcgtcttattcaaaaacttttgtaaaatgtgtaaaactatatgtatacataaaagtatatttaacaataaataaaatgatagaaaaagaattaacaattacttaaattttttgaataagacgaacggtcaaatatttttaaaaaagtcaacggcgtcaaatattttaggatggaggtagtatgatactagcttgattttttttatgagtcaagtcaaaggaagtacttgtatttggaataaccccgagcggtagctgatttgaacacggaaagctgtgaaggtcaattagaagaaggccctatgtgcttgtctcggcagaataagattcacttgtccccatctccagatgacctgatcttcgcttggttgttccaaccgaaatccttgcagccaatcaaatgcccagaaaaaaactgggatattattaccgggaccgtcaaaacttcccagaagatagtattgtattcttaacccaagaacgatcggagtggccggcacaaattactgtagtggaattccggaagcttatgttgacacattgtcaatttgttgataacaaacaattactaggttttaatatattttttggaagatgtaaaacggctgtggattgatgcagaggtccaaaaatatcattctcgtttttcaaaaccggaaagtatttttctacccatcgagacgtcactgaaaataactactcaaatgtatggttgcaatcaaccaaaaaaacacccaagaaatgctaacttcggctatagggacttgatatcccacggtatccacaccctatagaggatcttagctatagcaactagctcatcatcttaagaccacaaccttttttttcctctgctattatctaaaattctaaaatttttgtttttgaaggatcacattttgatactttctggtagaagtgaacgaaggacttcaagccaagaaaaatgaagtgacctctaaaattgaagggacaagacttgctcctgaattgtactttatgtttttttttctttctgtggccggtaatcacttgtaattcaagcctgtaataaggcacaagagagcaactgcgtgctggccttttgtgaggttttcagttcgaattttgcatatttcagcgacagctagctggagttgtcagttaccattcgccagtaactattgtcagtcaccattcgccagtaacggctcaaattgcaaactatactctgattaattgtatatctaatgactgattaattgtgtaccttctctggactttctggtccctcgatgaatattcagtgggtacgaaagctctccccgcccggttatcctttcaggaaaagaatgtcatcgggtggacaaatcaaaacctaacctcttcgatcggatgaaaccttagccaaatgttttgttggccacaccttagctgattagctgagatcgaaaaaaaatctattacctatacctatactaatcaaacttcctgagagctcccggttaaaagaatatatgatcgttaatttgatgggtcgtataggttggcgactagttataacaatacatgaaaagtatggcataatataaccttgacaataaaacaaatctttcggaggtaattttttttgagtcacaagaccgcgggtagattattcaatttcagctaatttttatcctgttaattaatatatcagtcaataattagataatcagtatgtatagaaccccgtaatttttggaatatgtccgccgtttcatgagggtgagttcgtgcgtgttacaagcgtatgcatttataccgtgtttctaaaaagtttcttttaaaagtttgataatattttggcaaacgataataatggaccagacaaatcttacaaaatcagatgagaaacaaaatactcttccgcgatactcctatacgactatctcgtcagtttggtggaggtatgaaaacatgaaatgtgcatcagtttcttttatttttctttttaatttttaggaactgtgtaccagttgttgatgcgctataggtaaaatatctggttgttgtggatactcctatatggctatatagcagtactttacatagtgcggagtattacgcagacataacaaaagcgtacaaagtacaccgtctgtgacttaaattaggctctgttcggcaggagggattgggaacccctctcggcacgtaaaacgatgtttgtattaacgcgtaattaattaattaatagctatttttttaaaaaatagattaatatgatttttttaaacaactttcgtatagaaactttttgaaaaaaaaacacaccgtttagtagtttgaaaaacgtgcgcgtggaaaacgggggtgaagagctaggaacctggggatcgaacagagccttagtagagcgagtacaataaaatcaaagatcctttcccttaagaaaagtcgtgtgttctgctttgatcttcaatacggatatttggtcatagatacgtgacatggatgttgttttttctttttctaagtataacctttcagaactgtagacttatattttatttctactctatcaatacaaaacgtcacactatcttgtgcgtattatttaaaaaataaaattacatgagcgtgctatacaagttatcacatcaccagtgacgtatatagaaattttatatgggtgatccaacttatataaacttttttaaacaccctaaatgtaaccaagttagaaatataaattggtcaaatatgcataataatatatcataaaaaaaactttttaaaagttttttttcacatgtgtatatatatatgcattggattaggattttttttccaagtgagcactaggatcacccctagattcgcacacgcacatcacatttgtgattacatggagaagagatgagagagaagaaaaacgtgctacagattcgtaaccagctacaacacattctgtaataaactatctgagatcgaatgaattaggtattaatgatgcagtatatatatatatatagctaataattatatgaatggattattaaataagttgcagatgatattttaattttgagtaaagtccatcaccagtccctaaacttgtacccctgtgtcatcccggtccctaaactcgcaaatcgaccgttcagatcctcaaacttgttcgactgtatcatcccgctccctaaacttgcagatcactcgtttaaatcctccaacttgttcagctgtatcacccagtccctaaacttggatttgaatatcatctgtgtcaaataggacggtgtaaagactttatatttaaaaataattcataacttttatgtgaactctaataaagacaaactttatatcaaacttgtagccctcgacacgatctacaactttgtagttgaattttttttattttaagtcatttttgttccaaaatgtaattttaaaattaaaatttcaaaatctataaatatgcaacaatattttgggaccctaaacagttttaattcaaaaaattttcaactacaaagttgtaggtcgcgtcgagggctacaattttgatataaagtttgtcttcattagagttcacatgaaaaagttatgaattattttttgatataaagtttttagaccgtcctgtttagggactggggtgatacaactgaacaagttggaggacctaaacgagtgatctgtaaggaccgggatgacacagtcgaataagtttgaggacctgaacgatcgatttgcgagtttagggaccgggatgatacaacggtacaagtttagggaccggtgatggactttactctttagttttttataaagttagtagttgattatattattaaaattgctcgtggtatactaagaaaagtaggagccttttacacgatatttgcgtggtactttgctgcgataatattttactgtcccgtgcaattaattattctgtgaacaattaaacaggaagtatatatgcatgagctaagcggtgacgtacggtacatccatctgttgaagttataagcacatgatgattcgagtactcgctaggcaaggcataaacagattgatcgtcctgagaattatcacaggccatatgcttgaattattgatgcaaaaagattgatcagtctgtggctctgtgcaatgagtgcggcacatgacattttctatgctgtcagtcaagaatctttcgaagagatacatgtagatctcattagtcaagatcacaatgttttacgtttttccgtttagcatgcaggagtagtagatatttgtaatgcaatacaaaattaatggccaaacgaatgagtggtcggctgtatgatctcacaaatcatgggtttttttgttctttttgcccctcaagagtaggccctgctcgtagtgctgcggattataatccggaatcattttgaatttttatggattggttttatggtttctttttatcaactttcattactgtcccgctctgcttttatgattgccgaaaagattgttattaaaaactaagaatttagaatcattatatactataaacactatataaacaaactaaacgtaaattaatcatcttcaccagccggcttgcatgtataaattcatcatgtacttcaaaacatatttaagaagtttaagattataagaaatagctgattcgtgtagtagtaagtttctgagaatttttttaaaaaaatgtgtttcttagattttgatttctagtttattttatggattctataattatagtttttttaatctaaactgtttggagagcttctgattatagaagttgtagtagtctggaaatcaagccggcactgtcttttattgagctgtgattgaaaataattttattacaatttattacatttttttaaagccaaattttaataacgagctagcgagtccaaatgaagcaaacacaactttcatgcaaaattttatcattttagttttatataagaaaaaaacatatcacttgacaaaattttgacttgtgcaccaatctcactaactgggccgatcgacagaaaagctatctcatcctctttttacggcccaatctcactaactgggccgctccacgcatacacgtcccagcccaaaaccctccctgcgtaaataggccgggcctaatcactttaagtgggccgggcctccctctcctgccgcttcgtcctcgccacctccgccacttggcgcgagattcctatcgcgcgcagacgcgccggctagctaagtcgcgagcgttttcggcccatatcctcgcgcacggcccactagctacatccttctttttctattttttcgcaacgaagtgcgcaggacttttagaaaaaatcgtatacgtaattagttatcgataattatggtatattaagctaaccattctttttttctcagcaaaaaaaattgaaaattttgaaaacttttaagtcgaattttgaacttttaagttaaaatttaaaacttttatctcaaatttaaaaaaatttaacccgaatttaaaaactttcgacctaaattttaaaaacttt

SEQ ID NO: 39071 - DNA, 2810 bp, Oryza sativa
aggcggtcgcagacgggcgccgtccacgggttgcagtagtcggcgacgaggcagtccgggcggcgaggcagcgcccggacgagccgctcgagccgcgccgccatggcccagatggccctctgcagggacaggtacatgccggggtcggcgtccgccagctggtccatgttctccagcccctccggcacgccgaactccgggccggggaaggcgacctcggcgaggtcgacggcgaggccgtcgcggcgggcggcctccacggcggccccgttgcgcgcggcgttgacgggcgtggtgacgacggtggcgcgcgcgccgcgggcggcgaggaggcgcgccacctccaccatggggatgatgtggccctgcgctatcagcggcaccaccaagaaatggagctccgccgccatcccgccgccgatgagtgtgaggaagcaagcaagttgcagtgtgcgtatacaagtcgacgcgacgaggacgacgcctgtgtcgaggcgccgcgccgcggcggcagaagcctcctggaaaagtcgggagggaggggtgatgacgtatgcgcctagcgaagcttcgtcgtcgcccgcctcgtagtcttcacagctgcctctgtcacgtggactcgtggctcccaagtccaatttcaacaagaaagttttttttaaatgcaacaaacaagaaggtaattaattgagttttaattatttcaaatttaaacaaggatttctttgatattttagagcagtttttatacagaaagttttcacacgaaacgtactgtttagttgtttgaaaagtgtgttaacaaaaacaaggtgtgtttagttcacgctaaaattgaaattttgattgaaattggaacgatgtgacggaaaagttggaagtttgtgtgtaagaaagttttgatgtgttggaaaagttggaagtttgaagaaaaaaattgggaactaaaccaggccaaagataagattctgcgtactggcctgaaggcatatatattgccctctttgtttaggcttataagccaacttataagttgaaaagtctaagccaaaacaaacaagtagctttttcatttggcttttttgaagccataagctattctaacactattaagccaaaagctaggttggagaagcttttttggcttaaatgagatagatgtatgactccactactaaacttaggacattaaatccactggcttataaatcatataagccaataagctgacttaaaagtctaggccaataagcctaagcctaaacaaagagggcaatagccatctgcttggctttcttatataggccgtgtttagattcaaacctccaacttttccgtcacatcaaatgtttagacatatgcatggagcattaaatgtggacgaaaaaaaaccaattacacagtttgcatgtaaatcgcaagacgaatcttttgagcctaattacaccatgatttgacaatgtggtgctacagtaaacatttactctactagtgacggattaattaggtttaatagattcatctcgcagtttacaggcagaatctgtaatttgttttgttattagtctacgtttaatacttcaaatgtgtatccatataattaaaaaaaatttagcacacgaattaaacacagccataatgagtttaaatgttagcacttcaaatcacatgaaaccaaggttacccttatcgatgggtttattgcacagttgccatgcggcaattgcggtaaccacaacaaaccatagaagccatacaaaatttatcaaaatttcagactattttttgaatctatttaattttatttttggtaccctagcaataagcacagttaccgtcagttttataaatcctgcttggaagtattttcaagctgttcattgagagagacaatagaggaatatctcatactcctaccttcttttggaatttcctctgaccaatttcgaatggatagtatccatagttcttctagaacttccattactacacactacactcccattcacgaggtcaggagtccatagatgacgagtgaacatgcgtcactccaagttgaaagttattttgctattttcttctccggcatgatcgctccatccggcaagttgatacaagcaaaccggccctccgattgtttaatcgtccacacgtcactctcctttgatccgaagctcattgactcaaacgccataaaacaacttcgccacaattcactagcaacaaaccacagccatggacgacgacaccgccggccacgcctccggcggctacacgacgacggcggcggcgcacttcgtgctggtcccgatgatggcgcagggccacgccatccccatgaccgacatggcgcgcctgctggccgagcacggcgcggcgcgggtcagcctcgtcgtcacgccggtcaacgccgccaggatggccgggttcgccgccggcgtggaggaggccggcctgccggtgcagctggtggagctccccttcccggccgccgagttcggcctgccggacggctgcgagaacgtcgacatgctcccgtccaaagacctcttcagcaacttcctcttggcctgcggcgcgctccgggagccgttcgcggcgaggctccggcagcaacggccgccggcgagctgcatcatctccgacatgatacactcgtgggccggtgacatcgccagggagctcggcgtcccatggctcacgttcaacggctcctgcaccttctcctcctttgccaggtaaaaatcgtagcaaaagccactggcatatttctctgcatatgaataagggtatcccgtcatttttacatg

SEQ ID NO: 39072 - DNA, 6071 bp, Oryza sativa
tttttgtttcgaattgtataagttgaattttaactcgcatgtttgcgaaaagatatatttatatattgatctatcttgataaatttttttataactttttaaacgacatgtaaaaaacgaggggatatctcctcgagggacaaaaatctactttccatatgaacagagaatacttactccctccgtcgtgtccagatttatagctaaaaatgcttatattctgggatagagatagtagaaggagatacttatcaggtatgtgatctaagaactcacagtttggatgtgacctaaggttgtgtttagatccaaagtttggatccaaactttagttcttttccattacatcaacctgtcatacacacacaacttttcagtcacatcaccttcaatttcaaccaaaatacaaactttgcgctgaactaaacacatcctaagaacttggtccaagtttccaactatctcgcagggacatcatttatcgcaaaaatctattggagaacctcacggatgatgagatcgtcaaagtctcagggttccctacgccgctagagttgccaaaagctagatgccctggaacactgtgcgttccaggtctgaagcaaataagtgacaagatttacgaggctgagacgcgaagcgatggcaggatcatgaatagcttccaggagatggaatctctgtacatcgagtcgtttgagcgaaccataggtaagaagatctggacgatcggcccaatgtgcctttgtcacagagacagcaacgccatggctgctagaggaaacaaggcgtcaatggatgatgcgaaatgtttgcaatggcttgattcaaagaagcctggttcagtgatctttgtcagctttggcagcctctccagcaccgaccctcagcagcttgttgagctggggctgggacttgaagcttccaagaaaccattcatctgggtgatcaaagcaggaaaaaagtttccagaagtcgaggaatggcttgcagatgggttcgaggagcgcgtcaaagacagaggcatgatcataaggggctgggcgccacagatgatgatcctgtggcaccaggccattggagggttcatgacgcactgcgggtggaactcgacactagagggcatctccgcgggtgtgccgatgatcacatggccacactgttcagagcagtttgtgaatgagaaattggtggtggatcacctgaaaattggggtggaggttggagtgaaaggagtgacacagtggggaactgaacaaaaagaggttaaggtgacaaggactgctgtggagacagcggtatccatgttgatggatgaaggggaagttgcacaggagattaggatgagagcaaaagattttggcatgaaggcaagaagggctttggaagagggaggttcttcctataacaacataaaactattaattcaagaaatgggaaacaagcaaaatgcatctggttgatacatatggaaataagctttattttttcttaattgtaaatctgtaagcaagaactggaggatcctattgtgcttaccctgattttcatccctcaaactataaagaactgtactctccctctgattccaaatataaatctttttatacttgtgcaatttgtataagaattaataaaaacaactctaatgaatttgttgcccttcatctacagtatactatatcaagaaagataaattatttatttttaagagggatatagcatttatttagcaaccacaaacattgaacaatagtaaaaaaaaattgctaagaagctctgaaacgatatatatttgggtaagaattgagaaagactcaaatgacttacatttggagcccaacagtcccaccagcttctgcagtggacgaggttcccaggaccccttgcggatgagaagagtattctacaaatgatcagtgtatagagtggattagacctggtcttacatcactttcgtaattgctgcttcgattcctctgaatatatgaatgcaaattttgtggtcaaagtcaggcatagacttataaagatcacaaaaggaatttccttgtaccagataatgcagaggccagggagtatctttcgattttaagtacgtactgtattgatagcaactgtggcctctgtggttgcataaagaatggaagaagcttcatgtacgagggatctagccacgagtccatgactagcatgcgtcactgaaactgaagttgccaaagtctagcaatactgttctttttcagcacgagctcgaactggccgagttgatagtagtacaaactgttggcgctgcaatactttcaacccgtcactttcctctgatccgaagtggcaggcaccacatatgcactcctcggttgctgtcaagtgtcaagcttctcatcaactcgagcaggcaagcagcacacgacttctcggttaatgcatacctccaaggctccaactgttcttgtcacactctcactgtccacgcttgtcttggccgcttgactagatacaaccacacagccatgtcttttgccagccacgccggcgccggcgccggcgaccagcagcacaggtgctgctccaggacggtgcacttcgtgctggtcccgatgatggcgcaggggcacaccatccccatgaccgacatggcccgcctgctggccgagcacggcgctcagatcagcctcgtcaccactccggtcaacgccggcaggatggcggggttcgtcgccgccgtggaggaggctggcctgccagtgcagctgctggagctccccttcccggctgctgatttcggcctgccagacgggtgcgagaacattgacatgctccagtgcaaagacgacatgaggaaattcctcgaggcctgtggcgcgctccgggagccactcatggcgaggctccggcagcacgacctgccgccgagctgcatcgtatccgacatgatgcactggtggaccagtgacatcgccagggagctcggtatcccctggcttacctttagtggcttctgtacctttgcctccctcgccaggtaaaaatcacaggccactggcatatttatctctacaagaacaacaaatagttagaattgatcaatagacgaggcaagacatgagaatgatattggttaaaggattttaatcaaaaccacacattaagccttttatctaaaaaatacttcaggtcaggttggcaattggttggcagcactactaactcatttcagaaaatagaaaaacttttcatggtatcttaagaactgccggttggatgtgttttaagagctaagactgctatcttgaagggacattgtttaccgtaacaatctattgcgggacctcactgatgaggaggaggtcgttaagctctcagggttccctacgccgctagagttgccaaaagctagattgcctggaagcttgtgcgttccaggtctggaggaaatccgtgagaagatctatgatgaggagatgcgaagcgacggcaaggtcatgaacagcttcgacgagctggagactttgtacatggagtcctataagcaggtgacagataaggtctggacgatcggcccaatgtgcctgtgtcacagagacagaaacacaatggctgctagaggaaacaaggcgtcattggatgaagtaaaatgtttgcaatggctcgattcaaagaagccaggttccgtgatctttgtcagttttggcacccttgtcagcaccgcgcctcagcagcttgttgagctgggactggggcttgaagcttccaacaaaccgttcatatgggtgatcaaagcaggaaataagtttccagtagtcgagaaatggcttgcagatggattcgaggaacgtgtcatagacagagggatgatcataagaggttgggcaccacagatgatgatcctgtggcaccaggccattggagggttcatgacacattgtgggtggaactcgacaatagagggcatctgcgcgggtgtgcctatgatcacatggccacactttgcagagcaattcttgaatgaaaaactggtagtggatcacctgaaaattgggatggaggttggagtgaaaggagtgacacagtggggaagtgaacaaaaagaggctcaggtgacaaggaattctgtggagacagcagtgtccacattgatgaatgagggggaggctgcacaggggatgagaatgagagcaaaagattttggcataaaggcaaggagggctttggaagagggaggttcttcatataacaacataaggttattgattcaagaaatgggaaacgagcaaaatgcatctggttgatacatatatatgggaataagctttttttattaaaattctagatctgaaagaatgaattggaggatactatcgtacctatatacttgtaaggatgggaggagtccatatttggccctttaactatggtcttgcccggattttcatccctaagaattgtgctcccttcaattccaaatacaagccgtgtaaagacttgtgcataaatatgatttatttattagaaggataacatttatttagtatggaaaatctggaagaatagtaaaaacttctgtattctaaaatgacttgatattgagaaagaatcgtgaagcataaaatggcttacatttgcagcctggcagtccaccagctcctgtagtggaggggatttccaggatccctgcagatgcaaagagggagtattttacaaatgatcagtattattgtatgaggctcgtttgtggcatgattgtttacagtctggattattaaattatatcactttctgtttctgacactcttgcccaagtttcctagttacttctgaatatatgaagataaaaattaggaatagtggtcaagttatgccgtagacttcgaaagaaaaaaaatactgaatagtgagactgcagaggacagggagtatgagtatgtatagcaaccgtggttaacctgaccaaccgcgttgtccggacggctcaaagaatggaataaactcgaggactttggctatgagtccataactataacatgcacaccaaagttgccaaagttcagcgatgctgttatccttttcagcatgagctcaaactggctgatttgataggaggacaagctgctctgcaattatttaattctttttttgaaagaagctgcaattatttgattaatgggcaacattccactttcctcgaactccaagatccgaagcatcaggcactactcggtaggcacctcaaaccaagtactatgagcatccaagcacagcccccaaaaggtcacatagaactaaattgttaagtggaggaaagaagaaggattagagagaaaaggtcacctctcatgcaaggggcagcccctacacaaactttaataaacatgtgagagtgttagaaatattagggattgtgtggtagagatgacctattatacatatcacctcttaatttaattatctatgttatgtataaaattagatgcgatagtcacctccaatataaaacttgccctcagactgcttgcagtcatcaactcaaacagcatacgacttctccagagttattgcatacctccgcttgactagatacaaccacagccatgtcctccgccggccacgccgtcgaccagcagcgcaaatccaccacgatgaaggcgcacttcgtgctggtcccgatgatggcgcagggacacatgatccccatgaccggcatggcccgcctgctggccgagcatggcgcgcaggtcagctttgtcaccactccggtgaacgccgccaggatggcaggattcgtcaccgctgtggaggcggctggcctggcagtgcagctggtgaagctccccttcccggccaccgagtttgggttgccggacgggtgcgaaaacctggatatgatccagtccagggatctcagccgaaacttcatggaggctgcggagcgctccgggagccgctcacggcgaggctccgtcagctatgcccacctccaagctgcatcatatctgacatggtgcagtggtggaccggtgaaattgcaaggcagctcggtatcccaaggctaacatttgatggcttctgta

SEQ ID NO: 39073 - DNA, 2958 bp, Oryza sativa
atttgtcagagaattaagaagctgtaatttgtgcacatatccaaaataaaacaagaaagcagtctactcgaagattgaaccattactgaaacaaacaaaattgctaaggtaagtaggtaactaccaacaacacaaagcgtaacaacaggcaaatatacaaacaaattcttacctcctgatttggcacagagtatttgccagagagcattccatgagccaactttgtcctgaaaatgtcaagtgatgagtataagagcggaaatattttttactaaaacttcttccataaaaatagattctttctagatttcttttatcataccacagtagcactgaattgaggaaaacgttcacttagaaacaaaatgcaaagccttcaatggacacttggacagcatgatatatgtttgattacagcatttgctatgagtctaacacactggaccactacagcacccaggatgaattccctccagcagctaccaagcgcgagcaaagaaacaagaaagtgctgattcaccaaaaaaaaaaagatcctagaaagaatcactttgtttgtgattgcaagtgtttaaaaaagtaattgtacccgaattacggtttcttcacatacaaccatacaggataaatggccaaaaaactgctttatgtattatccttacatttagcattagaagaaggtaacactgcatctcacaccaactacctcagaatagtgactaatccaataccaatacacgcaaaaacacagatcagctggtgtacacttacatttgcatgttcaagtccaatgttggatcagctggggcaattgcaaatgcagctttcaagctctgcttctcaaagtagctgaaatgatgcaagaaataaatgcaagagcatgtgctactaaaaaggaaaaaatgcaactctagacaagaagtgctgaagtatcaattgagaaagtagaaccaaccgtgatataaaaggatgagttgaaaacataacttgcattactgaggccatatagcaactgcaaagaaggaaacgcatgcattacataagagaaattattacaaaagaaaattcatgacgtcaaccaatgaaccaaagctacctatttccaagatttacaaggccagtataaccagggccggtataaaagttcggcatctttgccactttcttgtattctattccagtcataatttgtgttgtgatcaagctttctttcagcagtagtcatctcggtctgcacaacaaagggtcacatcaaatagcttttaacttagacagatagacaagcataaaaaggggaaaacccagtatgagcatgagatgctacagaatatattattcccatgaaaaagtactattctgttactatcccaataaaaaaagcaagtcatattgagcagagctaaattatcgctcataaatgtcatcgaaaatgatactactcaccttttggagtgaagaaaaatcaataccaaaatgtgacaaatgctgcgctaatagtggatcttcaacgctatcatcttctgggtatgagaaaacgtctgagctgtcacagaaaagcttgtatgaataggtatatttaaatataaaacaacagtaacttcagcagcacatgcccttgataggaaggttgctttaggactttaagaatattctttgttaaaactaaaataagacgaaagcaaaatatttcaatggaaggttaaaatatcagtgtaaattacttttatagtagctaattgggctgtgtgttataaattatgaagtacgagcagtatgtatccagggaacaactctggaatttaagaacgagtcttactgattaaagtgaatattcaataataattgcaatatactccctccaatcacaaaatcattaacattttccaactttttgtgcctctgaataaagacaagtatttataacaaacatatctctaaaagctatttaagtattacctctggttttaaatatatgacaccatccacttcttttctcaaacgttgaccaacaatgtttattcaattacttagttaagtaaagtggtcatcaaatgtactttaagagtgccttatatgtttgtttatttgcacaaatatttctagagaagacaaatagtcaaacgaatttaaaaggtccaccgttttgtatatttaaaactagagggagtatagtattctaaaagtgcattccaagttgagcatcatatatatgacacttttaatttagatattacaaaggatacagtttgtgagaggttaaaaggggtttagttcaatttttcacaggcgacaacccaatgtcaccgtaagttgtattcgataatagaagaggaagcctaaatatgtaaaaggtccacgagtagcattacctgctgcttctaaatcagcagtaattgttccaagctttaccgcaagaggatatttagtctgttcgtagtgttcaatagcatgattattccccccacttccatcccaaagccgcctcccacataggatcatgccatcagttaaatttaaccagagattctcagttttatcacacttgctgcacttccatcctgtaggtggcacaatgacaccattgtctagctgcttcagatccatagcatgtgcactgacttttttcttgtcagcaacccaagaagccaattgttgttttcgatcagcactttcggcaagtataactttgtcaactgcaatcctaacctgtggagttgtagagtagtaagtaactactatgtagtaagtaagtacaatctcttatgtcaagcacagttaccttctctggcaagtcaattgatggaaaagggagagaagtaaattcaggcaagataacaatttcaaaagcctcatcgtattcgggttcttgatcagtgaaacctccctccactcctataaattgtagaaaacccggattagtaaagatggtcaacgcattcatctatttgccatcatggg

SEQ ID NO: 39074 - DNA, 1590 bp, Oryza sativa
gggtgacaaggaatgctgtggagacagcagggtccgcattgatgaatgatggacaagctgcacaggagatgaggatgagagcaaaagacttgggtgtaaaggcaaggagggctttggaagagggaggttcttcctatgataacataagcctattgattcaagaaatgggaaacaagcaaaatgcatctggttgatacagatgggaataagcattttttttaatcatgatgagcatgaagtggaggacctatcatacttatatcttcataaagtatggagaatgtccacatttggttattcaactatggatttggcctgaatttcatccctctaactataaaggattgtgttttacaaatgaccagtatgttgtgtggtatgattctatggtttaaaataaacctggtctaaattgcatcagttgctcagtttctcagcagagttgatacattttagagaaggagtaaaaattaaataaaatagcgtttgtgcaacaccctaggccaaaatgctctcaaagtctaatctccaagtaatttgggtgtacgactggtacatcttacgagcatagaggactggtgtaaatttatgaaaacaatactttgccaattatatacttctttaacttttctgaaaatattgtatattatctagcaactgtggctgcttcataagatcatgcatcccttacaaacctccatatgttaaagcagataaacagaaatagactgtttttaagttctttaaagctttaccaagcaagtcaaatgcatgttttgggtcattacaatttcaaatagcagcctagcaaatggaatcaaatatatgaaagctgcagactggagaaaataaagcatacctggtttttctatgaatgaaacagtaaggctccatcagacatcctcctttgcttaatagcataacggcgcaccagattagctccagaccacaagataaatttaacattactgcaagaaattcttacatgaaaatctctgcaaagctggaaaagctccaagtgtaagatatcttggcaagtcgcatagtgaatcatgtacagcatgttagtaaaaggatttgtgttaaaaataaataaattccatacatatcatatttcgatttttagctcataagaatctgaatgagaaaacctccttaacagaatagtctaaattaaggaacaacttattgagaaatcaggaaaaacttaatactctctaaccagaaaaaggaaaacagatttcagcatgacataaaagagaacatgtaaggttaccttcctttcaataagaactttgccagtacaaccatcagcgacagagaggtttacaccaagatattatagtgccttaaggagagcacaacatgtataggctaagctggattaagaatattctctcattattaacttcattccctggactaaaaatttgcagtcactgccacatttcaactgaaatgcttgttggtcatttgggttttcacttgcttacagatgttcagttgtccgtatgattcatatataatgtattaatgtgctaccacttaccaatagtctttgcatgaacaggatccatgtctaaaatgatg

SEQ ID NO: 39075 - DNA, 6178 bp, Oryza sativa
acaggtccctggcacgatcaacctggcctgacctcacaaggccagaaattaccgacgtccaggacgccatgctcctcatctgcatgccctcgaacaacacccaggccgcgtccatgtcgccgcactcggcgtacatatcaaccagagcgttctccaccctctgatcaggcaacaccccgctctcgaggacgcgcttgtgcacctgcatccccagcagcaggtccttccctttcccgcaagccgagagcaccgagacgtaggtgaccgcggtggccatggcgctggctctgaccatgtccacgaaggagcagcaggacagctcgaaccgcccgctcctgttatggccagagatgagcgcgttccacatgaccggcgctccccctcccgtggcgaggcacgccgcctccagcaccgcgcgcgccgcggcgccgtctcccctggccgcgtacatgacgatcagggagctcgccgcgtgagcgttcgactccatcccgaacttaaccacgtgcgcgtggatggcaccgccaactgatgccgccgccacggccgcgccccgcgccgccgccgccgccttgagcaaggacgggaacgtgtacgcgtcgggcctggccccgccagccagcatgcggacgtatcccgcaacagcctcctccgcgccatggccggacacggacgaactcgcagcacgcccccgccggtggggaattccgtcgagcaggctgcgggcacgtgacagggcgcggaccatccgcctcacctcctctcctcaggcctcccccacgcggtccccgccattctattgacggaataaccgccggcggttaccgcgccgcctccccgcggaatcccggggaagacgaaatttccgcggcgagacagcgggccggcggcgagtgcttcgccttctcttagtcgctcggtgtttttttttctttttttttctgaagccaaaggcacggtaaagcatcaggtaaaataatgaaaaatatttttattattatacggttattattcaatttgtactagtatacgacgggtatacgtacatgtacagatgtacaggtataatgaaggatttttgttgtatctagcaacgtcgatgtcaccgtacatatgtacgcacatgtattattgtacgtatacgcacgaataggacccggaggtgcagagagatttttcttttcagataatagagagaattttgtttgtcacctttacgccatgtttgtttggagtcctcgttaattgctctggaatgtaaacaatatatggtacacggatattaattgcattctgttttgagttctcataaaagaacaaaggtcttctgtttttttttctctttgttaatctctttgccgttttgcaggcaaagttggttgttttcatccctttttccatcttcgtctaattcaggtagagcccttgcttattttcttagaaaacatggtaatatggtgcttcggattgtatcttcacatctttagaataaaagccagcgtttgtttcttgcgataattgaatccatgtcattacaactttacctaattaaaaaatatcaccactgttcatgatatcgattgggtgccatcaatattttttgaaatttgaatcatgtcatcatcgtcacgttttccgtccttttttatacatataaatgaattaaatatactaataaaattgaaaatatatgcttctagaaaaagtatgtttaggagcttgaaaaacgtgcctattcattctattgatcgagatcgagtgcaaaggaagaggatatgatgttgtactcatatttatatccatgaaaaatggtaagagtctcgggcagtgtttagtttccttcaaactttcgaaaattccgtcacatcaaatatttagacacatatatggagcattaaatgtggataaaaagaaaaaccaattgcatagtttgcatgtaaattgtaagacgaatcttttgggtctaattacgctattatttaacaatgtagtgctacagtaaatatttgttaatgatagattaattaggcttaacaaatttgtctcgcggtttacaggcagtctttgtaatttgttttattattagtctacgtttaatactttaaatgtgtgtctgtatattttaaaaaaattggcacacgaactaaacctgggctcaatttaaggaaaaaatgtgcacttgaaataatgatgaggctaactttgggttcgttgaagacatgacatgacagcaatttttgtaacctcttcacgtgagctataaactgaattacaatgactaacctagatgctactactagtacatctcagcaaaaaggactaataataacctattgatggctagagaaacttttaacaacgttcgtgctacataggcaagcttaacttgcgttgcacttgtacggatataatgcgcacacatgtatataggtatagttctaaaaagaaaaaagtaaagttggtatgcaatgcactgtatatggccaacgatgctcgtggtccattcgaccatatgggctttggtcccataaaaacgtagtactacattttattgaattcattatcaaatacattttgatagtatatttgtttagtgtcggaaataatgcttagattttttgtaaatttaatcatactttaaaaagctgacttaggaaaaacttatttaaaaaccttattatatgaaactgatgtagtaatggtcaaagtcacctattcttagtcgaaaggatatttccgctcacttggtttatcaattaagcttttgcaaagtcaaggtaaatacacatacaacatatatgcatgacaccatgtacaaccatatatagatgaacaggagtatacatacctacgttgcttaggtagcaccttgatttaatcaaatgctagctagttgatgccaggtggcacactgcggacggatttgtttgtcagtttccctgcattacacattgtacaggagtgtactacatccacatacaatgaacagtagtagtagcagcagctatatactccagttgcctagtcgtacacaaagtataattaatcacaaaattttcattttatcatggaaaataagtaggcattcataatgcacgtacactccgcacccatacaatgaacagtagtagtagctactagatagttgcctagttgtacacgcagcataattaatcacaagattttcatttttcctaaaaaaaaacaagcagacgtataatgcgcgcacactcatcctacctttaatgagtatcttcagaagattgagcctgttgtcgtcgagaggtacagggtatgtcatctatcactcaaagaataactagtcgtaaatacgagtaccgggttgctgtcaaggggtataggttacgttggctatctcttaaagaataatttgccgtaaatgcgaataccatcaagcctaagacttgcatccatataggctagttacaccacaaaacctaacgtgttaagctacgctccctccacacaaaattttcatttttacccagcaaaaataaatgaatactgaagcatgcagcgctgtacacgagcttcttgtttatcattgcgtatttgtcatcatctaaaaaaaattgcgtatttgtacgcgtacatgcacgtttccatccacaatttcacatccatacgcgggtgacatatattatgcagctctcgtgggcatagctcgccagccaagaacgagctgaagctctcgtgcgcggcgcggccatgaaggcgtcgtcgtcgtcgcaggggcagagcccgaggacgccgtcgccgcgcgccacctccgccaccgccgagcacacgcggtcctcctcggagccgtggctcgtggcggcggcggtggcgagcacctgcgacgactcgtgcgtcaacgacgtcgagaacttcgcgcgcaccgtcgccgccgccaagtctaggcagctggtgggctcgtcggcggcgtcgcgccccgacatgctcgcgtccgtgctgtcccactacgccgccaagtggctccccgacgtggtggccgcgtcgtcgtcgtcctcgtcgccggcgacgtcggcgtcggggcggttcctgcccccggagagccccaccgccacgtggctcaagaagcggctcctcctggagtccctcgtcgccgcgctcccgcctgacccgccggctcccgccggcggcggaggagcggccgacgacggcatcacgtgcgacttcctgctcaagctgctccgggcggggagcatggtgggcgccgacgcggcgctgctgcaggagctggagtccagggcggcgcggcggctggaccaggcgacgctgggcgccgtgatgataccggcgttcgggcacgggtacgcgtgcgggacgctgctcgacgtgccgctggtgctgcgcctggtgcgcggcttcctcaaggacgccggcgccggcgggggcggcgccgccaaggcaggcggtggcggaggcgccgccgccgcgagggtggcgaggctggtcgacgcctacctcgccgaggcggcgctcgaggccgggctgcggccggccgagttcgaggagctcgcgcgcgccgtgcccgcgcacgcgcgccccgccgacgacgcgctctaccgcgccgtcgatacctacctcaaggtcacccacacgtactcctccttccatctccactaattttacgtttccgtttactactaaaaaaaaaagctaccaatgtagctttgcatattgtgtctcgatataccgataaggtcttttttacaccttatggacaaatttgatgtcgcaatcttttcggtttcaaaaaattgatatcaccatcttctacatatcgtcaaaacaattgtgaattattttgggaccagctagctacattttaatattcatggcgttacaatttaagaaaaaattgtcaaaattttattacactgtaaattacatatacttacattataacatttttaaaacctacactgtaatttaaatttgcagtacacgtacaatataataataataataataataataataataataataataataataataataataataataataataataataataataataataataataataataataataacaacaacaacaacaacaacaacaacaataacaataacctacctagaactaaaatgggataggagagagaaacatattgaaagtagccgtaaaaaatatggtgtcataattttagcaaacacgaattatttcattcagaatattttataactatgtaactaatatgcacaacatttagtaaaaagaaggttttgaatttttttactcgcaaaatagaatattttgatttgactgttatggtgaaattcttgtttttctttcacaagaaattaaattccagctgacatggtagctagtggtgtgttgggtttgcactagtagcagctagcatatgcaaagtatgcaaccatgcaaatgtgttggccgatgtgccaacgttggatgcatcatgcatgttcaatataaatgtactgaaccaaatggggagttttgttctttggtcaatcgccacgagacagcctgaaaatttgtgaggcgtctactgcatctgtttttgtgtttgaccactgaaattgcatcggacaatgcactaacagcatagcatattctacatactccgtttggtagtacgggtgctcacttttctctgtcgaagagaatcttgtgtgtcatctactcactaaacatccttttggttttttgcaagtataagtataaagtttagtgtagggtgcacaatcaaaataaaccaattagatataggcttggaactttggaagaaacaaaatttgtgtaatattgtatatcaacaggaggagaatcaggacaactgataagacctgttattttctcccttgggtttgttttgtcttgttagcttgtgaactgaatgattgatatcagtagttgcttctcccacttcactaatatataaaactaaaatagctcattaaggccattaagatccttctttgtgtttgttctgttggtgtttactgtagtgtccaaactataaagttactaatatctgaagattgttcagccaaatcacttgtagtttttttttctgaaaaaaaaataaatcgtaactcggagtacttctatgaagtagggtaagaacaaagcgtagggaagagatcacgtgagctccaaa

SEQ ID NO: 39076 - DNA, 952 bp, Oryza sativa
caaacgagtgtccaaagagtactaagagagaagatcatactcctaggcctggtttagattcaaagtttgaacccaaatatgtcacatcgaacttttctacacacacaaactttcaactttttttcgtcacatcgtttcaatttcaatgaaacttccgattttgacgtgtaactaaacacaccttagtactctaaaaacgtgtggatgattgaaattgccagataaacatgcaagtatcagagatcttgcaggcatgaacagtcatgcaggtggtacttattaacagtctttaacaaccatcgtaccagactactgtataacagagccaggagattcatctttcaatttcatggctctacatgtcaggacttgacagtgctgagagtttcagatccaaatgacaccaaacaaaaatcatgtggaattctgtttctgctgttctctgcgcttttacagatcccctgttcatcagaaatgccagcaactcagcattgttgctgctgtctgcaaatgaaagattctcaatgtcaaaaccaatcatatgttaggcagttaggccatgcaagttcatgccaatggcactatgccaaatatcaagatgccatcttttgttcagttctgttcttcaaaattttttgtctagaataaatttacactttgttgagcaaaaagtgctgtgaaatcatgggagaaatgatttttcaagtgcaaaaaatattttttaaaaagaaaaaaaggccgtttgtggttcgctgttggcgccacttgttttgggggccttttgggagtataggattttaaacccctcaacctccctagcgataggagtttttccctcttagtagctagtactccctccgtattttaatgtataacgctgttgactttttgaccaacgtttgaccactcgtcttattcaaaatttttatgcaaatataaaaatacttatgtc

SEQ ID NO: 39077 - DNA, 4384 bp, Oryza sativa
aaaaataaaataaaatccgaaattagaaaataaaataaaagttcaagtaggaatacaatttaaaattactgaaattcggaattaaaaataaggaacattgagagaagagtacatataagaacccaatacgagattagttaatattcggaataaaaataaaaataaaatccgaaattagcaaaaagaaaataagagttcaagtaggaatacaatttaaaattaactgaaattcggaattaaaaataagcaatattaaaagaaggatccatataataacccaatacgagattaattaaaattcagaataaagaaataaaataatatccaaaattagaaaaactaaaagagagttcaagtaagaatacaattttgaaacaactaaaattcaaaaataaaaaataaaaatattaaaagaatgctatatggtattaaataatttttttaaaaaataaattctaaaataagaaaaataaaaaatatttcaattaggaatacaatttataaataactaaaattggtgataaaaataaagactattgaaaaaaaagaccatataaaacatacgatgagataaattaagtaacaagcctataaaagagtagagtggtggcggttgatacgacatataaaaactattagtaaaacaccaaatagaatcttaataatgattaaaaggagggatgataggcaggccatgaagcaaacgtgtaagatggttgccggacttctagaaagtgaaaaaaaaaccccattgataatcatattcgattttcaaaatctcaatgacaataaaaaagagaagcagcgggcatgatgtataggattatagttccagagccaccgatggttggcgggacttctagaaaataaaaaatgaattgaaacgatagttatgttcgaatttcagaatcccaataacaataaagagtaggcggcgaatgggtcgtagaggagtatagtggcatcatttgacgtcacttctaaaaattataattaaaaaatgaaacccaacaagacaataaattgtaaaaactacaaggtccaatttttaaaggttcggaacttctaaaaagtaaaaaaaaaaacccaatgataatcatgtataattttaaaatctcaatgagaataaagaagggagacaccgggtgagccataaaggagtacaatggcaaagccactgacggtttggcgggacttatagaaagtaaaaaaataaacttgaacgataattatgttcgatttgtaaaattctaatgacaataaagagaaaagacagtggatgggccgtaaaggagtataatggcagcgtttgatgggacttccagaaattataaaaacgaaacccaacgagataataaactcaaaaaactataagatctaatttttaaaggtttcaagaagaataaatagaaatagtggtagaccgagcaagcaaataaaaaaggatatgacagaagtaacgggtagcagctggtataacttttaaaagctacgtaattagaaatatggggatgatacgtggatagctatttaataaattttaagtgaaatcatactgaaaaatatatgattttgtttgggtgctagccgcgcaattatgcgggccacccaactagttttaagaaagagctaattttttttggctgtttcatggtgagcaggcacacgcgagcacgagcatagaggagaggaagtcgctgtgccggctgatcgacgcgccgaagctgaccgcggaggcggcggcgcacgccgtccagaacgaccgccttcccgtgcgctccgtgctgcaagtgctcttcttcgagcacggcaagcttaaccgcctcgccgagctcagcggcggtgcctcctccttcggcgcgcccagcccggcgtttgacctccccggcgcccgctgcccctccaagcgcgaggtgctcgcccagcaccacgagctccgccgcctccgcgaggacttcgcccgcctccaggtacggccatctccgccgccgctcgccgccgttcatcgattcgattcaaagctttttgaggtgttcgtcctcgtcttcgtcgcgacgtgcaggtccagtgcagcgcgctgcaggctcaggtggacaggctgagcacggagaggaggcggcgcggcggaggcggcagcggtggcggcggcgggttcttcaagtggagcacgttctggttcggcggcatgagcgccgacgtcgcgcgggtggaggactccgagagcggcatcgagcggcggacgccggcgagcgggaagaagggcaggggcggcgccgccggcgccgccgccgcgacgccgacgccgaaatggcgcaagtcgatgtcatgagaggatctgaaattctgaagccaaagctgatggctaagtgggtcgttaatctgttttactacctttaattacagtcagttacctttctgtctgaactattgtttgtggtgaaaccattcagataaatctgctcacttgagtgcataaataaatctgtgatgttctaaaaagagagggaagcatataagatttctggtttggtcgaggacgaaatggacttaagaatttagtttctcttcataaataaatcaacaaatagttgtacaacgccagtatgatcacataatagtgaccatgaacagtaaatgtctgtctcactagttgcagaaggaactctgcaaagctatgtatgcctcacttgagtactaacttattcagctacagaaaacaaaactagcaatttgacacgaatttaaacacacagatttgaagaataaacaggttgaaatgtgctgcatcatggtgcaaagaattgtttatttgttcactgctttcttgatggcttgcttgcacctggtgaggaacttgctgctgcttgtggacactgaatcttcatagccgtatctgccattgtcgtcgccgaccaccttgggcttcctgctcatgcactccacaccccttctcattccaaggatcttggaaggtgaggaaggcagagacctgaaacccctggagctgtcagaccttgggaaccagatcttcttctcctctcccctctccttgatctcaaagctgttcctgcacctgtcctgctgctcagtagcaccatcgccaccgacctcgacgatctcatcggagcattcggtgatctcattcctgcagctctcatcatcaattctgctttgcatttggtgctcgtctgaagcgatttcatcagcagtgttgtgatcttcagaagaatgatatgctgctgcaggatcttcttgctgctgctgatcctccatgagcatttgaagccacttatccacagttcctttgccggtgtggttcatgtttgcgtcgccttcggatcgaccgacgccttgccgatgaatcacattattctttttcaatagcaccgatttctctgcaggatatctaggtgttccatacatgccagttactctgtaaggaggacttggaggaactgaggatgtccttggcactgaaactgtctgagatctttcagtctcagactcacattgcaccatggctgctttgcccttgccattgccatctcttgacctcacaggagtgctagttgcccttgatccccttgatgacatggtcctttctctccttctgccgcgctgccgttctttgatcgccagatgctccagcttctccctcactgatgctcttcctctctcagtgtcaactgtgttgtcttccatggacctccttgggaagtttatcaccttgaaaggtgaattcctgaaatttcccattgttgaagtttcacctgcaatttcctcttcctctagggagatgtatgcatctgaagccctctggtcctcctccaggaaaaccctcagctcctgcttgagagggtttctgctcctcagtcttattcctggaaaatacttcaccctttcactgtgcctttcttctaagctgtgcctttcctctagcaatccatcatcgtcaacacgataccgcttccttgcttgatcggtgaaaggcttgatctgcttctccagttcatccttctgctggtacttcctccggagctcggtttcggatgagtcacacattgctctctgggcctcgagtctcgccatgagagtgctcgttgcagcttggttcatcctaagctgctccttgtacacaacagacctgcacattttgcaccacaatcaacaattagcacaaacaatcgacattgaaatcaactgcatgagagttcttggctcttgctgcatagattcatccttactggtgcatggcgtctctgatcatcttctccagcacagccttgtaattcgactgagcctccgccaagcggcggcacttctcgacgcgccgccgcctcttgatgaggagggcctccatgtcctggatggccacccggtcctt

SEQ ID NO: 39078 - DNA, 2267 bp, Oryza sativa
cccctaccccctaatagatcattagagcccccattaagaccccccctaaaatttaaatccatatatctattaaagggggctaaaatagactttatctgagattgttagaaggcccaaaagtctgaggagcccccactataattttatcctggctccgccactgcatcagtgtacatcagctaataagctaactatctaagtggaaagcaaaacaaatatctatctatccaaactagcagtgagaaaaaggaagaggaaataagaaatagtggcaactacatacatctgccttgtgatccaacaaaatcttcagtgtcttatccttgccattgttagcagcatgaaagagtggtgttccaaggccacagtctatgtcaacaggtatcccttttgaaagcaagaactctgttaccttacagcatcctgcagtgaatgagatgggccataaatcatggggaaacaaatactatataaattgagttatttgaataaacagttagtaccagtataatggacaaatcacaatagattacatgtgagatgtgaccgagtataaacagagcaaacctatacaactttgagtggtgatatataaactaaaagtatctagattagcaacacaataaaagataactgtgacgacatggttgaattaaatgtaatctattaatagtaatgcagtatcgtagaatcttgtacaacaatataattggtaatataacaaggaattggatagtgttcatatcaagggagacctgtgccagcagcatggtggagaactgtgcatcctctaacatctgcttttgttacatcaccaccatgatcaagaaaatactgcaccgtaggaacatcaccagactcagcagcggccataaacggtgttatatctgtaataaacagcacatcagtacacttggcacattatactgccaaaacatagacatggcagccgccaatttcatgaaaggatggtagagttagataataaccttcttttccagcaatattcacgtcaccccccaattcctccaccaagaacttgcaaacattcagatggccctggcatgccacggcgtgcagcatcccaatcccatgcttgttaagagctaagactgcatactgggtctttcctttctcgatcccaaggctctttaaaataccttctcgcaaataagaacaaaaagaagtcatcacagtgaggaagataatctgcgaatgaacagattaactaggtagaactcgaaaaagcgacgaatacgtgcaacgagcaagaacctcactgagtcatgtgaacctatacttcatacttgcgacttgaaaaacatttttgtagagtactacctgctactcatcacacattagcacttggagaggtaactgtaatagaaagatgatcacaacgttgtcgcatttatccaacgcaaggacttgctacgataaaagcctcagatcttgcaatttctagataagatggcatgcatctccagtaatccatagacctggctgttaattccttcacgcagggtcaaaaatccatgcaacatataaacattaccgaaaataaattgtgggaaattcccaaaggcaacgagtgctagatacagaatttgcattccaaaattccatggccaaatcaattaacagtacagccatcgccaagcgctccacacaaggacacacatgcatcacccaaacctaagggaggaaaagcacgcaacacaggcgcatgcaaagggggggcaatgcatacacgcatcgatcgggggggatcgacgcggcggagaagaaggagaggaggaggaggaggaggaggagaggaagcaaacctacctttgaggcgtccgaggttcccgtcgaaggccgccctcaggagagcgctctcacctgcgaacaaaccgagaaatcgccattagaccacatggccgaggagctagcaagccgatcgagctaggaggagatgcggagaggtggggggaggctggacgaactggtgccgtcgtcggtggggcggcagtagacgaacggcgccgccatggccgcgaggagggaggaagcttgcaggaggaggaggacgaggagcggagtgggtgggggtggggggttttggtttggttttggtgcactggacccggtgcactcgtgggactcgtggacaaggtgcacggagccgttttgctacactacctctcgctgtctcgcagatcagatggtctatgagtatgacatgggtggcccattgcaggggtctaggccctgtttagtttctg

SEQ ID NO: 39079 - DNA, 1110 bp, Oryza sativa
ttcaatagcatatcattcagatcaggtgtttgcacattgtatgtatgccaattaggaagactgtttcctactagaccatctgcacttaacggatttagtttgttgtgactggaaggtccatcctccatgttgtatccttcagcgctttcatctttattttggttatcatcaacttccatatcggtaggatgaactgctgatcgaccttgaataataatgctgaagagaggcacaaaccaatgtaaataaagtaaaaatacagaaaaaggcaaatgcaagatgctgccactttcaaatgtcatggaaaaaaatcacaacacgtgtagcaaatatatcagtgtcacaccccagtatggccatctggactcaaatcaggagaaagtagtaactagaccctgggttgattcagactcagtccaagtgtacaatataaggtcagaagttataggaaaacataaaattgcctagagaaacttaacctcatctgtgaaaacccacaaaggctcctttagataggatcaaagaccctttatatgggagcagagacgtgtagataaaatttccaagggacttgaatagctattttttataaaaaaaagtggaagaggtgattttacccatcatcagcctcaagttgaattgactggtccttgttcagcattaattcctgagggggaaacaaataaaatttagctgctgaagatatacaaagttttgttttggaattgcagtttatcaagtgataggacacaataacacaacaaccagaaatagagagcttccattaatcagtcatctattagccatgtgttaccctatactcaaaagaaatattgattactaacaggtaatgaaccaaagctgccaaatatacaaccagaagacaaggcatagacaatggccgcaaggaattggtacatggtaaaatcattgttatgttcaatgttcatgctctaaacattcttgtacaactcaaaatgagttttcatctgcataatctgcattccctatcattatgacctaaaaacaaaccaatatgtgaagaactgccatgttatggagcatgacagtaaatatttactctggaagtacatctatgataatgcggag

SEQ ID NO: 39080 - DNA, 23141 bp, Oryza sativa
  unsure (1)..(23141): unsure at all n locations
gttatagaatgataaggagcagttgattcttcagggggaagatcaacggcagtagacctaaaggcttgttttattttcagcaacgcttcactgcaatcatggaataggtagttcaccttgcgagaatagatcctgaccacaccaagcataagatggcttgataatcgaagtgcaatcggaacttcagggaatataattgaatctgcaggaaaaaaatgattattaatactaagctcaaaatgaaaaaaaaaaagacatatggcagatatatgaccactgttaggaaaacataacatttccatcacaaaattctgtgaattgcactagtgagtgttttagtgatgcacatggtggtttgccctgtatcatgggcagagttaatgccatgcttcagctgctctaagattttaagtccatgtgttgatgttataataaacttataatggaaaccttttcctgtatttatactactaaatagtggagtactatttagaatcataacagacacatgtggcatctaagtacttctatttttatctttggagaaaggaatggagttgaatgtttttcaccaattaactgctataagctggtttgcttgcccaatgatggcgtgacagcgctttctatcatcaatgctatccttttagaagaaattaacatattagatgtaaggacatgtggtggccaggggtggatctactgagcaatgtgggactgcagctgcagctacaggatgatgtaggacagctggaaggatatgtagtgcctggacaaggccaaaggcattcacgcgtacaccgcaccactagatttccgatgtagtggaatatttacattcataaaaaagtaaattgatcacatttttccattggagaaaattaaaggctaccaaagatagctggcaaccaattggcatagcatgcattgacacaggcattactaaaacccatgcaagcaatacggaaaaaaaaaggctaggaacataaaagtaactacacagtaattgcacgaaagaaaacaaatatatcccaaaatggtaagaacgaaatgagaagacaacgacagcttgcatttttctcatatgcgaacaaaacatgatttcttttccttcttcaatatataactcatgcatatatggcatggaaccttacattgctcgatggctcttacatgctacatacacttatgtaggtttgagtgatcttctaagtaagaagtgggttaacatgcacgtatttattttattttacaaattacatggttcaagtcgtatactagtcacccttcaatatgcatgcaatgaaacagacacgtattaaatttggtataaggagatggaaataatgttgttatcagccttgatctccatcaaaccattgccactctagcctgcttttacctttaaataaatgggaaaataaccaaagaagcttctggtttactcattttgctgcacatgcatacaggacacagctactggaggttttcttgagtcctctctctctatatctttattgtcgggttcgcatcctctatattgaccgtatatggtatgctttaaaaaataatgagacggatcagttggtacctttggaacattattttaatctgtatttggaatcctcatatctttctaaatttggcaggaaagtgatgtacatggtgaaagtgaattggagtattgtttagttgggcgcacctctttgcatatttcaataaaattcccatatacaccccaatccagttgtgaatggaatctatggatagctcatggcattccccatatacactccaatattacttgaaatttgtccgaatgatgcttgtgtagtttttttttttggtcaaaacaacatttaactagctttacacttttctaaattccataactttctgttcgctgggcttcatttacaaattatcacattcctattcctaacacaagcttcactgtgtagagacacgacttgacagctaatatcacggagccttaaccaacttcacaatattgcatgatcatggcactaaaaaaaagatgttctttctcatgtttgctacacttcaactagaattccgtaaccaagtccttacataccacatgcatcacagataccaatccttaacacaagcttcactgtgtacaaatgcattatcagctatcatgcaatcaaatcctatgctacaattttgcttccttctctacagaccctgtgcacttatgttgtctgagaccttcacagaagtattgaattctggtcatcgtaaacccagattttgaactggattgacttgcatataatagcattagcaacagagcaacatcagaggaaaaaaagagatctcatctctaccactatatccgtgataaaaccagtccagtagtagttctgcttgaaggcaagctaccagcattctcaatctaataagctgtacttaactattacgattaaatctataaaacaactagcgacgacgatggatactgtaaaagcacataataaaataaaatattgtgtcatattagtgaacaagtggcttgtaactagtgagggagttagtgttttctttgtccccgagaaagaacaaaaacactatatccgcaatttgtcagacatctaaaagcatatagcttttacaactctagtgatggcatacaaaatccacatgaagcattaatactaacaaccaaatgaccagtgcaactcaaggttgaaactttttaccaatctatcagttgtaagaagctaatcagcgactgcattgatacaggtggtttcttttcctattactgtagtacaacagtgataatccagcagacgagcacgtataagcaaaaatgaagagacagctcattagcatagttgtaaaaatatggttgctctgccagcaacaactaggtcaactaggaactaacactatcccaaaaaagctaacatcttttactaattaatcgcaacatatgagcagtaagaatacatataaccataaataagcgagaaaaaaaatgttttccccctcctacagcacaaacgagcattagcaaagacaatgctttagcagtctacgtgtgaggccctaacatgctcgaacagaaacaaaaaaaaatggtagtagatccgaaaagaaaaaagcttgtgaaacagcaaaatcacccacctacggagacgccgatatccgtatccgcgacctgattcttccgcagcttccgctccaaatgcgccgcgatccatatggtcccgaggggccccttcttggccaagatgaactgcgagtagaacattttccaccccccacctcccttcctcagcacctcaccaccaaaccctagctcagctcagcaccacccaaacacacacacaccccaagcaaagctcccaccctcccaacaccctccttatcccatctctccacgccccccaaattccaaaccctaggcggaacaaggaacaacaccccccgaagctcccccgaaaccctaaattcgtgccgggaaaccctagaaccgccttcgaattgggccgcgcgagctggggaggaggtgggatctggggaatccgcggcggcgcgagcaactggggcgttcgaattggaggccgcgaggaggaggaaggcacgaagatttcgaacccaagggcgaaaaaattttggatctttttttttttctcgagaggggggagttcacagtgttgtgtggactcgcactcgcagcgacttgaggagaggcagctagcgaagcaaaagtgctgcacgcttcgcaatttagcccctggagaattgacaaattacgcgcggggctctccgcgtgcgtaccgttggtacgagggcgagggtgtggatgtgtttttcacttttttaggatgggtggagggggtttaatgtaaaattagcggatttttgaagaggggcttccgctcgcgagaaaaccgggagaatatcaggatatcgtgttgggggtggggggaggagcgccgttggatgggggatgggtaatgggtttgaggcggtgtggtgtgtggttaccgttggatcgtctcgcgagatgttggcgccgtctcccaactgctgcggttggcttcgtgctcgcttgactagctgagacctgtcacgtgtgcgtgactcttctttccccgtagtatatacgtggagtacgtgtagtattttgaattttgagagaggggcggaacattccgggctcggccatgcaagttaattacgtacccctccgttaaaaaaaaaaaactcaatcataactacgaatctggacataaatatgattagcttcgtggctaaggttgtatcttttttaacggagtaatacaagttaacgattattagagactaaaagaataatttattgataataatttttagaataaatttcacataactacgcgtatttgatctgtctatcgtaaaactatatattcaagtggtttatcttagcgtgctagccgctgcttcatttcgtatagcgataacgcttttctctttcttagcgctccaccccgcggagaactctggttgtgctttggttggctttctctttttttctattttctctgacttgactcagcttgaccaacttgactcaactgttagagtataaatatttgtatttatgggtctgtctaaaagtctttagcatgttttttgagtaaaaaactttcgaaccatgttttttgagtaaaaaactttcgaacctaactacattgtattatagttacaacgtaactactatacatcgggcatgactaaacaaaaagatgtctttggctcaacggcatgcgccatgctcgtcgggggagaggtccttggttcaacccccgccttgctcgtgcgaaggtttttattccaccacatgtacatagcatgactcttgaagcgcatcaagcggaactacttgatatgatccagcgataagaatatggacagacaaaacattaaaattaagttttaaaattaaattttgattgcaaccaaaaagttgaagagcatacattattcgagtcacaaacagaagacattcaatttgggactggtttgatttgatggtgtattaacgaaatttgagtcgaagaaattttggaggaaaaatggacgaatttaatccaaaggaattgtctttatgcgtgccatttgctttatatgattgcttcaaaggaaatacataggataaaaaagttgcctctatttcgtaggaatgctagcatgaggtctaatcttgtgttttcaattttctttgaaactccattctctccctttctatccttatccttgttctaacaaatcaacacgtaaattttaagggctcctttggattgaagaatttttaaaataaaggattggaatccttagatgaacttccctatgggggctcttcggatcaaatgaatagagatgccaacacttatatagattggcatcctcccccgttgtataggaaaatgaacatgagctcatacgaacaattttcttttaaattcccatgtttgtttcctaccatccaaaatgcaccaaaattagtatttcggtggcttggaaccttgcaggattgtgtagaacattatatcataatcttgcatatttgtagccccattttttggcttatgattatacttataagctaaaatttgaatttttgagttgattttagggtttttcatcgcggtttatttttcagtctttgcttttagatcgttaagaacacgtatataaaggttttatttacaaatcatttttcgtttgtaaatatgatgtttcgctggagtccttaatgttactgcgttttcaaaatcctgtgttccaaatgagctctaaatttcttggtttttcatgtgatacatcaaaacatgtgttcggagcatttcccgtgtgattcaacatggtacatgaatcagttagccagcggtcaaatcgtggtcaccacatacggagtacgtggcagtggcataaaacaacctggactccttcgattcgtgtcctcccgaaaccgagctcgttatcgggtccaatattccaatccgacacgagcgcgaccacgtacgcgatcatcacatcacatatacacataccgctgctggtttttgctctgccccgcgttaggcgatcgatctcatctctccttctcctgttgctgctcggcccgccgcgttcgtcgtcgtcgaccccggccggccatccgctcgccgccggcgtgcgcctagctagccatccatccatccatccatggccgttgcaatgatgcactacttctttttccggcgacaccgccgggacgacgacggcggcggcgagcaggacatgctgctgcgcgagagcttcctgcgccggatggaagaaggcgccgccgccgccgccgccggcgaccaaaggcggtcgcctccgactctgactccgactccgaggcgttgctactcacgggaagctggctaccgctccgtccgggtaaaccaacttaaccgatgtatacagctagtaattatttcattaaggctgttcttttcttgctccacatgaagatcgaaaaaatctcccgagtccataattacagataaacaaatccggctagcaaatgtcacaaaaggttcccgtgcatactaactagcaaatatcactgaaatttttagaaaaaaaaatgtacaaatacttataatagtattacacctaccgaactacgcgtgaaatattatcttcaaattcattatattttagccataataaaaagaataaaattatgatagatttttaccctcaaaactgtcattttttttcacttttttgttacgactaaaatataagggagaatcccttatatgccactctaaattaaccgactcccttatatgccactttaaattggcttctcacttttatgccaccggttcaagtttctcctcccttttatgccattgccgtcagtccatcgtcagttgatcgttaacttcattgaaaaagacgcatttgcccttgagaattagtatacaaccaataataggtattttagtactaatataactattggatacaacatatgaaaattgattttttctacatcacatgcaattttagccattaccatcacaaataaattttaaatgtaagcatgaaacatgcagttttccaacaatatttttaatataaagagcatttttcactagttctgacaaaattttgttcactcaaaaaggatttaaaataaattagttatgattttttgaagtttacacatttttttagttgagagggcatattggtcatttacgaaaaaaactaacctttgactaacagtcaactaacactatagtggtgggagtggcataaaagggtgaaaaaacttaaactattggcatataagggagaagccaattttgagtggcatataagggaactggtcaaattctagtggcatataagggattctctcaaaatataataagtttgaatatgagactttgcatatatgtgtagtagtactagaagtaaatgcccaattttttctagaatttttcatgacatttgctagttggtgtatatgggaagcttgcatgcataggatatgttcgccaattatatgtatcccaagtctcgttagttctcttctctcactgcaagtgctcgtaattagcaatatgctcgtacatttgcagatatgcttagttaattacaactcgtaattaatactccctccgttttattgtattataagtcgcaacttttttcctaatcaactttttaaagcttgattaaatttgtaaaaaaaaatagtagcatctccaacaccaaattaattttgttgaaattaatattcaataccaagttttatgaaaaagatactaccattgaatatctaccatactaaattagttttaataaatgtaacattgaatatatgttgatattatgtttgatttgtgttgaaaatgttaatatattttttataagtttgatcaaacttaaaaatgtttgactatgaaaaaaacaaaacaacttgtaatatgaaacagagggaatatattttaataatatgtttattttgttatatttatctataaacttgataagtttgataaaaaaagataaaaatgacttatataatatgaaacgaaaggagtatgatacaacaaattttcttttgcagggttttggggtcatggggagcttagtgctgttgtcttttggtatcatcgggtatcgtacaaaccctgcatcctgcccaccactgccgtttctaatcgtcctccctcttcttcccgcagcatttgttttgatgctaacgcaataaaagccggttttcatatgaacaccatccagcatttgttttcattttttgcgttcagcatttgtaaaaagactacttgttcccttgtttctcattgtgagagcaaacatatttatgttacctttggaaattaaaacttctgtagaaaatttgaaggttcaatttctgaacaagtaactccaatagaatgcttcagggattgtttatatactcttgattgtggtttgggctgtgtacatctttctaaggtgtagaagccgggttaatataatccattatcttaaaaaaaaaagatgcttcagggattgttccgctgcattccaatcggcgatatgtttcagggattgatggtgcaaaatgttttcccattgcactgcaactttgaaatcttttactactatatggttattactggttggcgttcctagtaggctcaatgaccagaacatgagctgggatttctgcacaccacgctttgttcagggttttctaatttggtatcagctaaaaagcaatgcatcgttactgtggggaaaaaaaactacggaagacgattccttgtatacctaccacgatattacaggcttacaatgaatgctaagaaacctttaagtgttagtaagctgctcccattggctttcaaggcgtgttcagaagaataaggttggaaatactagggagaagtgttttcagactttctgggacaacatccatttttggacaatgactggaacagctagccagataagtagtttaaggcattataaaaactgactcaaaacttgctgaaccttgaccttctacttgcatgctctgacctagagttccctactttccaaaccattgccaaatgagacactttagcaatattctataaattctgaagcagctgtaaatgaacatcagtttgacatgtatcatgtatggcaatctgtaactccatccgacaatcaacaactatatccattaacttgctgttctttaaaaaagggacagcaatagtaccaacaattcattgactgcagtcaattatcctaacaaacaattcatcgactgcagcaataagaggaagtaagagtaaggtcaattatcctaacaattcattaactgcacaagacaatccattgactgtagtagtagtaggagggagcaagatcaattgtcctaacaattcattgctacttatcatttggatgagaagtgattctatcgatatgtaatatcttcaagtctccttgttcatgtgatcctgcaaaagggataaaaacttttctttgttaatactttgtaacataaactgcaacttgcaaataagaaacaattaatgagactaacaataacccaaagagctaaatgcagaaaggtagctatcccccaaaggatatacaatccgatggcctcagttggagctagctccagatagttatagagtataaccatcaaagtgatgccaagcatggcaagtcgagaagcaacttctaaatatacggataagatcaagccccatatatctctctctacacattgctctccctgagctgctgcaaatcacaccgacaacaatgcaaatccaccacgacgagaagatgtagtggaagacagacgggctgcagggtgacactgttttcctcagtccagagcctagatagggtaggagggcaggacctccaagaaaaccataattgaggagttctttgcattttccaaaaagggacgactccttaatctgcaaaggaccaaataggcacaatcatttcagaacaggtgtttcataatgcaatttttttagaagaaagagacaatcgtttcagaatgcaaaaagtgtcagaatgcagagactccttgaacagtcttgaatgcataatcaagaactcaagataccgacccgacgaatgcacaactaagaactcaagagaaagaagttgaatgcacaatcaagaactcaagaaaacattgttgaatacctccgattgctgaagtggatcagagtccgctgcactattcctcatctcgctgaagtccttgccctcgccggtcatcttctcgttcttgtcctgacatgacccaagaaggggctcggttaggaggtcgccggcgtccctcccgctcgtgctggactccggcaaggacccccatcccgaggcggctaccgagaacgcgtaggtcgcgcaggtcagattttgggccgcatctgagagacccgacgctcctgacgcgtcggcctccttggccaccatggacgccgcatcgaaaatccgctcggcggcgcgccgcctcggctccgcgtcggtgtcggacctggacagcgcttccgcagcctccagcagcttcttgccggagactccgcaggcgtcggcggcgttggccacctccttcgccacccggaccatctccgcggcggtgatgggggaggaggcctcggccgcgtccctggccgaggagatggagcggcccaggagcgcggcggagctccaactcgtcaccggaacggggaaaccccgcatcttcttccggtggattcttgatcgcctccggtcgtcgaggatttcttgatttcaatcggacttttggttatggggggcaagggaagaagaagaagaggctaaggaggaggggctagatggcaatggcgtggccgtgtgcggagaaggagctccggatggggagaggcgagccgaggcgaggggtttgggaatggcggagaggcgcgattttgcggttttggatgacgcggctcgaggtggaagacgaggggtcgtttggtaaataagggataagtagggtggcaaatggaaattatttgcaatcttcacgtttccagcgtattgctggattgcggtgatggtgaaagttattactaaactgcccccgttagctccattttgaatcgtttgccatttattgcaaggagggatattttggtcattagtaaaaaaagcattcccttccatatccatcaagttcgttagtgcatcattattatattgcagtcgataataatgcaatatgtatttttcagtgcttattttttcctaatagaagcatgttttctctgatatactccgtagttagaacatcaagttaatggatatagttgattgttggctgttaatttgaccggtgagtgtgtgaccaatatgcaagttacaagccgggatgcttcatcctcagcgttttaaaactgataacttgcaaggtttgtattttttttacttgccccccttaatacaagttcggccgcccagcgaaaaacaaaaaaaaaagtttcaggcttacttctgattgagcgtgcgcattcaccttgttctttttcatcgtttcctccaccgcaatcctgaaccgataggctattcattgcacaccagtaaatctcacgtatcgtctacagagtagagacactgaagaaggcatcggcgtctctgtcgattgcgtgcgtccgccttcgagatgggaagacagagaacagcctaacgactgacacaccctttcacttgcgaccagggttacattaacgtcggtaaccgtccgtgcggttatctcctttaccacggggtacggtaaaagaaataccgcggtaatctccttaaattcaaataaatttaaaaagtaatttaaatttttgataaattttgcacggtttcgtacggtttttcatggtttccgcagttaccgcgtggtaaccgtgcttaccgccagggcgcggtaaccccgaccccgacggtttgggaaaccttgcttgcgacgcgacacgattcgattagaagagcagcatacaccagcatgaaacgagggaggattttgtatggatgagatatatatgtttcatttgtttaaaatcccttatatttatcgattagaagatcagcgcacacatgcatcgtattaatttgttttggaaaaagtatgaattgacctcctaaactatcgccgtcgatcaaattaccccatgaacttgaaaagcagacattttacaccctcaactatgcaaatcgaacaaattatcccctaactcaatccggtgtggttttaatcctacatggcagtctagtcagcaatttttttttgaaaaatcggtgggactcacatgtcatacccttcctctctcccctttatcccataccttctcaatccccatcctatctttctcttctncctccccttcccttcttttccctccatctctctctacaatcaagccgagcagggagagaggaagagtatgacatgtggggcccaccgactttggaaaaaaatgctgattgaactgtcacgtaggaccgaaaccactctggattgagttagggggtaatttgttcggtttgcatagttgagtgtgtaaaatatctggtttttgagttagggggtaatttgatcgaccacgatttatgggggtaattcattttttttcattaattttttatttttggctgacacttaattaatcaattaattatttattattatatcgttccgttttcgatacgtagggattagttcggtagttctacgggtccgcatcctctgccttcgagaccaacggcaaactttgccgttgcttttatccatgcgtgacatagtagaatcaacggtgtatggcttgagcccatgacagtgattaattaacagctaaataattgataaaattagatgtttctcaagcaaaatctctactacttaaaaataaagacgtgcttccattgtccgtaaaaaaaaccgggaaaaaaacaggcgaaaaaaagtccgataaaaaaatggagaaaaaaatgtccgatcaaaaaaacggagggaaaaaaaacaactgtccgacccaaaaattacgaaccggacgaaaaaaacaggcgaaaaacaacgagtgaaaaaaagtccgatcaaaaaaatcggagcgaaaaaacaggagaaaaaaatatcagctccaagaaaatatggggaaaaaaacgaaatgagtcagtaaaaaaagggcgaaaaaacccggtgaaaaaaagtccgaccaaaaaaaatcggagcgaaaaaaaaggggagaaaaaaatgtccgctccaaaaaatacggcacaaaaaaacgaaacgagttagtaaaaaaagggcgaaaaaattatccgattcctgattgcatgtgacgcggtaaaaaaaaatcgaccagggaaaaaaccgagtgaaaaaaaccgggctaaaaaataaaaaaaattccgataaaaaaaggggcgaaaaaaaaacaaatatgtccgatccaaaaaaaggcaaaaaaaaggaagaaaaatcgaaacgaatccaacttcgtcgacgcagtaaaaaaagggcgaaaaaaataaataaaatgtctgattctaaagaaaaaggaattatatgtgacgcggtaaaaaacaaatcgaatcatattatatctagaaaggtccgacactataataaagtggtgaaaaaaccgttcgtaaaaaaatgcacgagaaaaaaaaggcgaaaaaaagcgcggcggaaaaagtctaattcgtcgttttatatctcttctttatctctaatctaatctaatgtaactatgtttctaccgtatattaataaagaaaaaaatgcacgagaaaataaaaacggtttaaaaaaacacgtgagaaaaaagtgtcagaaaaaagcgcaaaagaaaacacgctagaaaaaaaagttcaatagtccaaaaaaacacatgagaaaaaagcaaaaaaaaaaaagcatacgaggaaaagaaccgttagaaaaaaatgctaaatttatggacagctggttggataggttgcaaccactttttttccatctccaggactcgtcatctattcttctatagtggagaccctgcacatctttgtagataattatcatactattttttgaagtataactattattattcttgataacatgttatatggaaataatcttagaaaataaacatattctaattgttatttagagaagagtgcatagtgactctattttgtgtagacttgaccatacgaggcagtgtaggatttgattggttgtaagaatgagattaaaagaatattttagattatatgcatgttgttatatgaataattcaattattttaggtaaagcaaacatcgtaaggttgccataaccatcatcgaggttgggctattacatttaacatgtttcaattttctgattttctgattgtcatcgacatggttatgcatgaaaaatatatcattacgatttttcacccgttgcaacgcatgggcatgtttgctagtaaatcaagaaacaaaatctgtgatgacagagcacgaggaatacacaatacattccctctcgcattttgacgccaacaatatgaatgaacatccaatctccattcatttagaaataacatgaaaagaaaaaaaaatccttcgttgatggagcagccaattaatcttaattaccaccttatgatgcaagaatattctctttatttgatatgtcaccatattgtacctttcgttgttatcctttttaaatctatattttatgtttttactagcttctttcatactataaaaagtgatttaccaaagctcttgttcatattattcagttaaaagaacccatgttcacttaaagcaattcgatctcttttgttatgcgcaccctgccaccgcttattttgtttgttgattctttttccgcagagaaacgcatggttttattgattaagtaggtgctaattagtaactggtgaggccaagctgttgcagctgttgatctcaagatgggtggcctacaggaaagcaacggtaaagtttgccgttgatctcaaaggcagaggataattaatcaattaatcatttattattatatcgttccgttttcgatatgtagggattataatttggtagctcccaatggcctctcgggcacgcgtgcgctcgtacctctactcccgtggcattgattatcccgtggacggtcagatagtgctcgacgtgcacgtggcatagatcgaacgggggtggggtacgtcttttggttcgaactcgagtaacaaaatcttcacgaaaaacacaaaagtttagggctggtttggtttgataccaatttattaccctactaaaattttggtaacttcaatagtagcaattgcatgtttgatttcaatagtagcaattgcatgtttggtttgctaccaaattttatttgcaatagttcaaactaaacaccacccaatttggtagtgtcaaaatttaccaatgttttggcagtaacaaaattttggtaggacaaaaattggctccaaaccaaataaacccttaatttgaatccgacccgacacgggagacgcactactacgcgatcggtcatatataacttgtttggtttgcttcctacgcgcgctttaggcgatcgatctcacatcgctcacgtacgcacgcgccgcgccgcgccgcgccgcgttcatcgtcgtcgtcgtcgtcaacgacgaccagaccgaccggcgccgtccggccatccgccgcagcgcgcgccgctcaacggcgccccttcccggccggcggccaaccatgcccgttctgatgctcccccggcaatacgatgccgccgccgctcctcgacggacgacggtgacgatcgacgacagcgaggcggcgctgctcgagagactcctccgccggatggaagaaggcgacgacgccgccgccgccggcggcgaccaaacgcgagccaacgaccggcgttgcttctcggtcaaggctggctgccgcttcgtccgggtaacttaattagcttaaccgatacgagcagctagtatattaattacgccctctgctgagtttttagttggtcaaattttttaagtttgtttaagtttgtagcaaaaaaaaaggtaatattttaattttaaaatatattcaatgttaaaattaatgaaactaatttcatgtcacaaatgttgctattttttctattaacttgatcaaatctaattcaaacgatgtataatataataaggagggagtaattattagtgccaaattctgggtcatatgaggattgaaaatcactaccctaaatataaatccagttatctcaattaccttcatacatattcggacatacttacaccttctaatttatttaaatatttttttctgcagggttttggggctatggcgagcttaatactggtgtcttttagtctgatgggtgatagttcctactcactggcgcttcgaataatcatctctctttctcccgcagcatttgctttctttctaacccaagaaaatccgtttttcgcacgagaaccattcgttcgtttttttcttcaatgaattttatcattcagtatttgttaaaaggagtaaatcccttcgggaaaaaaaaatcaacgctataattctaaacacaacggtttttcttcctgtatcccagacagatgtttctgagattgttgatgcaaaattatttgtaatctttttctattagtatatggttactggttgatgttcctagtgagctcacccagatttctgcacggtgcaaacacactatgactgtgtttagtttctgaaattagggagaaatttagaaaaagttcagagtttatgtgtgtagaaaagttttggatgtgatggaaagttgggagttggaggaagtttgatgtgaactaaacaggacgtatattcaagatacttgtagtttggtgtcaggttaaaaaaaacagatcaatacgtcagtactgtcgaagcaagagagagatagcgcgaaggaagatgagataaagaggatcccttgtttgctaaccacaacatggttggctaaccataacattgtaggaaaccttactctttttttttttttttgggggggggggggggttggagaagtatcattttttaggcaatgaccggataacaagtgaacaactaacaagatctgtaggttaaggcattatgtaaattgattagttcctcctaaagttactgagaacgccccaaaatactgtcaaaagttgcttgtttttggagaaattaagaccataatacccatcactaataaggtatggttagatgtgcgctgggtttagatataagatggaaatgttttgaattagagatgattaatgggacggttagcaccggagaaaaaagtttgaatccctcaaacatatcactgtgaggtactccctctatttcatattataagttgtttgacttttttttaagtcaaacttctttaaatttgatcaagtctataaaaaaaatataatgatattttcaatacaaaacaaacatattattaatatatattcaatgttagatttaatgaaactattttgatattttatatgttgttaagtttttttttataaacttagttaaaattaacaaagtttgacttagaaaaaaaaatcaaacggcttataatatgaaacggagggagtagtatctataaaagacatagaagtaatcctaacaattcattgactgcacaagggtccactgcataaataagaggggggcaaagaatatatcgaaagaaatggcactgacaggctgctaggctcacaaggtcctccaagtgcaatgctaaaatcagctcagaagtcacaagataactaaactaccaccgaatcagacataaatttttgctgtatttacatactaacaccccacccaaaacaaacaaacaaacccagcaatggcgccctttgtctgggtgtgtaatctgtaacaggctaatgtaataaacaattgaatgcacatatccaacagaaaacctaataaaatgttatcacagaatagagagaataatatatgaactgctgaatttcaccagaagcaatgcagttttacaccatgcaaaggttctacttctaacttgtaacactcgataatcacaattgtaggatcaacactgaattgggactgttatgccatcaatgtacatcgagcatcagtatgttcgcaactcatttgcagaaggttgaagagtgagataacatcgagcaactctacatttgccatgtatcagtatttgtgccactgtactagaacactaagatggtaaagggcaagatccctacatttgccatgtatcagtaattgtgccaccgtactagaccctaagaagtaggtaaagcaaaagatcccaatgaaagaatgaatcaaattatcaacaatcagccactcctaatttttggtcctgacaaaaactgtccaaatactcctctcttttcgcataccaattggattgggatcaatcagcagcatctccgggggccctgctcatgtaatcctgtgagaacaaaagaatttgtaactacaaaacaacaaaacctgcaatatggaaataagaaacaaggcctgaggaactaaccatagcccaaacgagtaaatgcatacatgtagcggcccccaaaaggatgtacagtgtgtagatttcattgggagctagctctaagtgactgtaaaggatcactagcagtgagacgcccaagattgcaagtctagcagatgctcgagcatagaaagccaagatgaaggcaaggatgttcttcatcatggctctccctctattgccacaaagtacatcgaggcccacacatatccaccatgtacagaaaataatatggaatgtgcttgggctcaagggggagtatgcgctcttgagtccgcctgtcctcgtcaaataagggaagatggcaagggcaccaaacattccatagttgataaagtctctctcactctcagacaattcaataatctgcaaaacgaaaatcaaataaaattaagaactaaatactactatacaattggcatatcaaggaaggaacaagaagcaagctcctctacatttggcaaatcaagaaagggaaaagaagcaatcacctatacaattggcaaatcaaggaatgaaaaggaagcaatctgcaagtagaaactcccaatttaagctcactgttccaaacagaaagtcatgtgcatcaataacgctaatatagtttgaatctgtatgagatatggttctttatgagatttaatatacatggttataatctgtgatcaccaattcaccatacaatcatctgttcatatttttattatttttctcagactaatgtgcaacttagcatgggctaaaagctgtcttttctataaaaaaaaacctatttggttgagccaaacataataaggcattgatcatagtatctttcagtgagttagttatcacaaaaccagagagttctatggcaaagacatgtttttacattgtcccacggtaaatgccacgaatctaccttatcctatggcaaattttgcctaaaagctatacagtgttatgatgtaaatgcgttagatttagcttgtgactttggtttcactgcaacatgcatcagattctgcatcccacaaagctctgagcaaacttgttcttacctccgatagagaagccccgatcggcgaggaggaggaggatggcctctcgtggggatggagtagaggtgcctccaaatcagcctctcccgccgcgttcttgttgtggcggttcttgcggcgccatagacgaagcaggcatctaggtctctccgccgcagggcccgactcgaccagggcgcggacgcagtcatgcgcggcgtgcgccaggtcgccggcgaccttcgtgacgccgggcgaccccgcctcctgcgccgcccggaacaccatggcggccgcgcggacgacctcggcggtggcgcggggcctcgcctcgggggcggaagaccgggccagcgcgagggcggcctggcgcagggcgccgctgggaaagccgcggtcgccggcggcgctcgccaccacctccgccaggtgctcgccggtgacggcgcggccggtggaggtcgcggcggcccgcgccaggcgcgcggcgcgggcgaggagcgccgcggagcgcagtagcctgctctccattggaggaggaggaggaggaggaggaggagggttcttggaattcttggagggcgcgaaggtttcttggaatgggaggggatcgcctcgccgcggagacgacgaggaccttttacggacttagctcgggacggagagacgacgagaggaggcggaggcccaaaaatatgggccgcatacgtgagccctcctttcccttttttgagcccaattacattttgctttaggcccaggcccgtttcctgttttcctatcctctcttttgcttattcctctcctcgccaaacctagctcatagtttattttcactttatggaaaagtaaaaacaatatattaatattggaaatttcttggatcccctagtacatgccctatggggcctatttataggttcatgtgccctagggttattaaatacatcaaaatttacatggttactcgtatgatatgagatatttatgatggtaattatgaacaaattagccttagggctcttcttgagctgctaagtgggccttcattgagtggttggccctttaaggctttgagtccttcggcttgggacaaaggtctttggctccacctggtgacttcgcccataacctctatctttgtgacagtcagcgctttaccgccgtgcttcgccctggcaattgtagacctgtttctgtaggctcggtcaaaggccctcgtgacatgtctccaacaatatattttctggacatttaaatatttaatacaacttcatccatcagattgcaccaatgcctatacttttatttattctgggtctctacaacagtaacagaaatttgtacaccttctcgagaaatttacactcagaagaataaaaaatacaaggcgacaatgaaaagaaacagctttagaagacttgtatctgtaaaaacatttctgtatacaggcttgaaaactagtatcagatccttggcgccatcgcattgcattgcaccagcctatcgcccagcagctctcatgaacttgtcatatgggcttgccggtggcagcctgaacgaccggtcagattcgcttgatgccgagtcgctgcgtcgcattcgctccttcctcgtcgactgcgtctcaggctcagaccgagcagatgactgcaacaagatgttgatgagtttttcaggacattttcaaagatttcagtagtgatggatagattttttttttcctgtcaagatgaacatgcctcgtttgtttccagtccattttctgcagtcgagccacgggaatcggtcctcgagtgtttgaagctcaggagaacagacatcttctgttgcttctccatgactagggcttcgcattggctcttcatttgatcgtagggtacaaggttggcagaaactggagcattagcaacctgccttgctgtctcatgaacctgaagaaaaaaaaaagtcgtttgattacaaacggatgaggggactgtaagagatctagaaaatagcgagtgatcttcatgtgccattgttgtagacagaaatggcgcataccgattctattagttgattgacgtttagaacatctgatgaagccatagatccagaggttttcctgtcagattgcgatccactgtgttcaaaaacgatgtcatcgtcatcatccatctcacaaggaatgacttcctggaagcacaagggacgcagatgcaaccaaaaaagttaatacaacagcaattcataaataacaaaaaatcacctaactatagagaatcagtacggacctcatcaaaacaatggtcatccttttcagcgtacatcgaacaagagtgtggtgtttccatgaatagtggagcactgagagggaatgaatcatccagggaaaactcctgaagaagctgctcttctataccattaaacttctgcaatttgcagtgaagacacttaatcgtcaaataacttcttgattgtgaacagagaaatcaagaaaacacgctctcataatgtaaatctgaatgtatacctctgatagattttcaaacttctccttgaagtgggatatcacaatttcttttaactgtgtatcatttttatttacacaagaaagaaaattgcgtgcatcactttcatcttcctcagaaccataaactatcccactgttagatgactgtggtgaactaataacgagtctgcaatcatcaatcaggcaaagatgagggtcgacctacaaaaacatcaataagcgaattcagagtaaattgaaaaatgtcacattagagatatatatagagcaagcatattcaaaatcaggaatcaactaaccattttctctggaactgctgctttcacaagaggaattgtctgaggaatatcagcaacttttgctgaaaaaatcagcattgctgatgccattgtatacaaacacctcctacgtgatggctgcaaaccatctttatttacagtagaaaatgtaagaataaatcaagcaggtatcaaatgactagattgataggaaatataataaacttgaagttggacgcaatggctaaaatatactggtattagaaaaaatgatattcctatttggaaaaaatccctagctagttgtcactttttttttgcatcatcattttgatatacaaaagcaaaaactttaaagagcaggcaaatgaggataaacttactttcttggttaagggacatcctcctgagagagaaggccaactggaaacatcgaactaatgctgcgtgactagagctctgcaacgaaaattcaatggtcaatctcacaaatatagcacacaatttcaagtccaaaggagaagttgacatcactagtcaaactcacactagcagggaaatcttaaaaaaagtgttaatccatgcctattacatcaataaaatattctaaagaatctatcttgtgtaaaaatagagtataaaaaaatattatataatatgaaataactccatgccaaaagggaaaa

SEQ ID NO: 39081 - DNA, 10542 bp, Oryza sativa
caagtgctttattaagtcgcttgttgcacttgctattgtcaccgacgccttcaactttgcatgttttgcaagaagcgaagcaacttttaaaatgcttgtttgcttggcaggcttcttggcaacactcttatgatctatgtgttttatggtgaaagataacagcaaatggccattttgccctgttaagaaacaagatttagaagagcactaaatctttctgctgttaaacactaacaaaaccaaaaaaaatggcacaaaaagagaaacaaatagcatgggtgaaaaattttgcacctgatttgtccatcagtgcctgcatttcttgtagaatagaaaatgcaatcccattttcaggagaccaatagttgtggctatcaaaaaggcggaaaagaggatcaagaacacgccacactgttgttgcctccttggcgatactggccatattacgtaagcaaacccttgcccaatgtgctggattttcagatgcagacctgtcaacacactaagtcattaagatgacaagggcacaaatcgagtgtggaaatgggccgttacattagcagaaattctcacattgtatcagatgccactttggcactattttgcccagatactggcaacccagtcagacttccattgattaccaaatcatcatcatcttgaagcctgacaacctcttttattgagagagtttgattaacctcataacaacttacgatcacggacacaacctgggttcaagaatgaattcagagactaatcagaacccttactgaattactgtttctggcgcacttcaaatgaaactatcatgctactttttttttctattcatagactaatcaaatatcttccacttattcaacaagtctatctgtagtattaatggcatcaacttgtctatgctccaaagatgaatcttatgcaattccaacaagagaacaaatattcaccaggaggcatctatcaaccatgaatgagaattaagtcttaactcttaacattctagcccaacacagagtgataaggacttacttcatcaagttccatggaaatgtgtgagtggtcacccatgtattggacctgattacaaagtggtaaatgagtatattaggattaaaaagttaaatttaatcaatagactgatttaatggcatcagttggcaagaaccagtaatgcaagtataggattatctgttgggaattctcaagcaatatcaatataaccaacattaaaaaaatgttatatttgcaaaacaaattgtataatagttgaatgtagttccttattttgttctacattattatttctggtccaacaaatctactgtaaattagccctaaatggctagctcgcaacatataagactaccttatccatttcatcagagaatcaagtaaaaacttttcttaccatagaagcaagagcctgaagtgcagcacatcggaggcggaaccctttgtcatcttcccttagttcttgactaatttggcaaagttttggtatgaggccttccagattaaacatatgcgtgctatcaacctacatgaactcaaattaaaccaaacagatggcagatttctagcaaaccaagtaggtgcaatttgttacagtcgtcaataacctggccgttgagaaagtcaacaagcattagacaacccaggacccgcaaatcatcattcattctctgatcgagaagagtacgaataatgctcaatgtgcttgtggccagcaatggtctgaatcaagaataatatggtcagtacagcagcaaacatttgctatgggtgcttgactggcagaatagagcctttacacttacgtatgatccttgcatgaacacagaagcttcctgtatatacatggtacaactttggccaaggtgaaattctcatgtctcagatctttatagcacctctcctcaaggtactctgtgatctgcagacataaaatcagttccgagttccacaaattcattcatctcggtaagtcctacttaaacagcctaaaatcattccagctagtgatcggtgctagcgaaagttgatcggttgtactctggcaaaaggaatcaccatcacactaaagcaatgcagtgtaaatcagccattatgtggtaactactcggtacctataaagactgctttcagaaatactggaaattcagtctaaactattcaagctaacagattgcgcgacaattctagtaaaaacagagaggagatcaaaatgtgttaccttgggtatccgcgtcggatttctcgagacataatcacagagcttcccaatcctcctatcattcggttcaccatcctacagcaacaacatcacaccctcaatcaacaaactccctccacacatttgaccacagactccaattcgcagaaactagaactatttgaccacagacccaaatcgcagagactacaactaagcatcagaaatggctgaaatgccaagacaggattcagtaatcgccataccggtggaagctggtagatctccgcgatgatcttcttgtacctcttgacgggctgacgcgagcgcgcccgcagcgaggggcagaagtagcagaggctgctgcaggcaggcagcacccgccgcgacatcacccccatcttcttcctcctcctcctcaaagcctcccaaaaaagagcctttttgggatcgaattcggctcaagcaacacaattctcagaactccaagaactaaaactctcttcgatccaaggctccaagcagcaagatgcttgagcaaacagcagagaattttcgcagcagagggggtagaggattagatagcaggtcgccttcttcctcctcccccttcccacgcagccaaccgagacccttcggatcgaaaccaagatcaaacctcgcgttcgtactacgacttcttgaccaaatctaatccgcgtagaattatcttttcaaaaaaataaaaaagcagcgattccccggggtcaaatcggccgcgaacaccccaacaacaacagcaagaaatccgaattggaatcaagcgacagacagaacccagaaagccgaatccaactccttcccaaaagatcaaaaccttcgctgctccccactcctcctcctcagatcgcctccgaatgctagcgaaggcagcaactagagtagactagactagactctagagtactactactagagtagagcaccgatcctcgccgcaggtgagggtgaggccgcggcggaggtgggggcggtggaaggcaacggtcacctcacggtaaatttggcagcaagctgcggctgcagcggaagctggagcggcggcggaatattcattcatttcatatgggcacccgatgcgtcgcggttttctttctccatcgatgcgtgggcatgttgcggaaaaaggggatttacgagggggcttttcggaaaaaaaggcgggcgccttgtttgttccttcctcctcctctgaacttttctgacaggtaggcacggtacacgatgcggctggctggccggccggcctgccgctgccggcagcgaggcgaccctgaaattacgcgcgtgccctcgtgaagttttcctttttttttcttagacaaaattggctgtaggacattaaaaaaaggtaaatttcacgaaactatattttttaagttacagaaaatcacacacattttgacacttaacacttaagtacatatatcttggtagtttaatttcacaaaaacacactatcgatgaatggattcacccgcgagatgatgtggtcgctccatctaggataaagacatggcatcctattaatttcgtgcgatggctggtaatagtcacatcatctcgcggtgaatccattcattgatagtgtgttttgtgaaactacactactaaaatatatttacttaagtgccaagtgttaaagtgtgtgtggttttctacaacttggacttacacgtgtagttttgtgaaatttactctaatttctttgtatagagtaaaagtatttacaaaaggacttcgatgttactactaccatactactccctcaagtacttatactactctctccgtcttaaaatatagacacattcagctactctgttgagtgctaccacagccagcacctatagtagcaacatactgtagctatggttgttgtagcattgactgtcaaataggatctacaacaacttcaaatataatcttttttatctacattatttgtcaattgatcacgatattttcttatttaattttacttttctttaatacccgtatccaactaaaaaaataattataatttagggtggagataaggtggtgtttggatcagggactaaattttagtctctgtcacattagatgtttgaacactaattataagtattaaacgtagactaataaaaaactaattgcataaatgatagctaatttacgagacaattttttaagcctaattaatccataattagcacatgtttactgtagtatcatataggctaatcatagattaattagtctcaataaatttgtctcgcgaattagtccaggttatggaatgagttttattattagtctacatttaatacctataattagtgtccaaacatccgatctgatagggactaaaattttagtccctaatccaaacagcccctatgttcttaatactccttctactttcccaactcaccttcctcgttttttttgtgcgcacgcttttcaaactactaaacggtgtgttttttttaaaaaaaaaatctatatgaaagttacttaaaaaatcatactaaacgttggagtacttcgtttcgcgtgctaggcgcctaggcctcccgaacacagcgggatggcgtgggtaagggaggggtagaatggtcaatcgcgtcgtcctctccgtccgtccgtccctggactgcagggattgcagatggatggttctcacgtcgtccggagttgttgttgcgtgagatccgaggctcttcactgtcagttattacttcgcccgagaggctgtcaccaattcaaagaaaggaacgtgtcctgcgtttccgagcggtgtggtggggcccgcttgctgtcacgtctgtcctcctgtgcgtccttctcccatctcccagggccttcaattccctgcattgttgggggttggttagccggtagtacacaccctcggtaaaaaaaaaaaaagcccaaccactgctaacacaacgaattttgatgaagggattactccaaactaggatgttctaggcattaaaaaaaactcaaacctcgtggcttaatttgctcatatcagtatcaaacttaggtcaaattgacttacaaactcgaagtcataacaagacaagttaaattgggattttatctcatcagctcgcacgtttcctaaactgccaaatggtacttgtttgagaatttttttattggaaagttgttttaaaaattatattagtttttttaaagttttttactaatatttaattaatcatacgctaatatatgcttcattttgtgtgctagagaaacccctcctaaacacagaagaaaaaaaaagatcaccaatttaccatgtgttcatacagttgcgttaatttgctcgtttttcgtgagcatatgctttatgaaataataagcaatactccctccttttcacaatgtaagtaattctagcatatctatattcatattgatgttaatgtctagattcattaacattaatatgaatgtgagaaatgctagaatgacttacattgtgaaacggaggaaatatgttttgtgcacaagttttaattgtatataagtttattataaaatataaaagaaactattggcccaaaagtctacctgcactgcgtaagagagaagacacgggctcaaaaggaaaaaaaaaacaaaacaaaaatgttgctacctgtggccatacaaagtcagcgacgtgacaggactacaaaacatgccggaaggaggagtacctgtcctggaaacgtggcaagctgttggttgtttcttcagcatacgtgctgtatttttatctagaaaatgagcatcaggacagcacagcctgtgtacctgtagggaagaagaagaagaagaattattcagcagcaaagcggatgctcctcctgctcctaccaggcaggcgcacaacctgccagcgctgctaatcaatctccatgtgccggcaaccagcaccaaccgggagtgccaatacacctaacaggtttgtttttactccacttttaggggccggcaaccagcaccaaccgggagtgccaatacacctaacaggtttgtttttactccacttttagggcccgtttagttccccaaaatttttttttccaaaaacaacacatcaaatctttagacacatacatgaagcattaaatatagataaaaagaaaaactaattgcacagttatagaggaaatcacgagacgaatcttgcctaattagtccgtgattagccataagtgctacagtaacccacatgtgctaatgacggcttaattagtctcaaaagattcgtctcgcggtttccaggcgagttctgaaattagttttttcattcgtgtccgaaaaccccttccgacatccggtcaaacgttcgatgtaacacccaaaaattttcttttttcccaaataaacacacccttaggtactcctactaatctacgtgttcaattcattccctaacacacggatttacattatgggctggtttggtttgagacctaaattaggcttatcaatatttggcaattttaatagtgtttagtgtctatttggtttgaagccaaattttggcatgcctaagaaaataggccttttcaatagtgaacttaggctattttggcttcaatccaaacacaactttgccttaccaaaattagtcatgccaaaatttggcactgataaaatttagtaatacctatttaaaccacaaaccaaaccaaccctatgtctcacgagccatgatccaactctgcctgctggtacacagctgccttgtcctggattttttttaaaatatacccttctttttacaaatatgtttacaaagaattggcaaaaatataatatcgttacaaagcaaggaatatacacgtttaaaaagaattagcaaaaatatactatcgttacaaagcaagaatgcgaactcgcggcggacgtgtgagttcgcatattgggatgcgaagtcgtgaccttgtttgtatatccacatacgcgagttcacatctccgctttgcgacaatgatatacttctaccagtcccttcaaaacgtgtatattttaaaaccggtgataaaaagggtatatttcccaatttgttctcgatgtcctaagcttttatatcagtgttgtgtgcttaccctaagcctgggctgcctgccaaagaaacatcaccatatacgttggcttctaaagtgttgggctgagtgggcatatgggctactccctcttgggcccaacaaagcacgcaaagcccactccagttggcacgggctgcatgggccgcatttcctataggccctgcgataataaaaaattggagagagagaaacacgtaatctagttttacgctttcctactaggcttacgtaacatgttgatctactacacacaatacgcttcaccactcctctgatatcttccagggccattcactttaatgatattttcaaccttatcaaattttagtaaagttgctaaaaaagtggctatatttagttaactatataagaaatcttgttaaaattttgataatgctaaattttagtaagatttttttttttcgcatcaaagtgaacatgtcccggttccatctcccgcagcaaaaccccactccctccactccggcggtttcatcctcctgtcctcctggtaagcctcgaaaaaattcccaactttgcactagcatttcgcgcaacgcgcaccgaatcggtgcgatttcttgaatcctgacggtttctgtcgaatttacggtggtcactatccatcaccgaggctgtttcaccaaaaatgctccaagaaatgctgaaacttctcggtttgttttgctggtaggtttcacaggatggcttcgcgggctccaatcgccatccaaaacgagaacctgccgatctttcgcggtgattatcccaccaccgtctccgaaaatccgcggcgagcgttttttcttgctctttgatttctttgctctttgatgcgaagggatcgatggcaagaaggccggggcggcggcgagggtggggcggcaggagcgcagagccctaggtgatctcagcaaggcccggagagctcggccggcgagctccacgggagggaaagctactgcagcagccagtgttgggggatctggtaagaatctggtgaagcctagctacctgagcgatgaggattggatgaaatgctgcgagtgggcgaaggatggggttgaaactgccagttttactgggaacgatatgcagaaactgctcagtgataagctggaagagcgtatgtttctgtttttttattttacttttatggatgcctttgtgccagtattcgcgtatgataagatgtagtacttactactgcctttttttatgtgtattattgggggtatgtaattaggcatacagaagaaggtggagaaggcaatggggacgatgcaactctccatggacagtctttaccgcatcgatgcgcattcaaaggtatagtgtggttcaagagtggcaaaacgtaatcacggcgatgtgccagaatggagaggagggatttcataagtaccctaagtattagtggcaatgaattaatatcattgagaagttttgaattgttgccaacaatgattttaagcatttctctctagttagcgggtatcttagcacggcactctcgaattacattagggttaggctgccttgatatttctatcctcacctaccattttgtgaatcttataagatggattattagcgtgtaggaatggtgataagtacaagctgatcttgttctgttaatgccatgagcacatgataatgtatagtaatatagtatgcatttgtgtactttcagttgataattgcactatttttgtatttcaggcatgcatggtggatcctgaagataaaacagaactggatcttgatacagaatttcttcctccaatgtcatacttaagctcaagactaggttctcttcttctgcacctcttacatgcactggcacatgtatatctgtggctggcaatttacaaaattgaatgattttctagtaaccttctacaaatgaattgagccactgtattcggctttcatcaatccagagccttgtttcttctccaaagagaacaagccattgctagaaactttatgcatgccgctctcctttcttctagcagaccttgtaactagttaaatgtacttctgtatagaaagttgcttgggatgttcgacgtgtgctggtgcatgaaaaatctttattttttttgggtaacttctgaaacaaacctattggtttttttttacaggtgaacacaacgccaatcatgttctttctgacttggaattcgaacatgaaacatttgctaattgcaatttagacttgaagctcaaggaagaatatggaacataatttcctgaggtctcatactcttgtagtacagtgtactgggatcatgttcaactcttagtacatctagttgtattgcaatttttttttgtttgtgttgtatctgttctcttaaccaatccaactattctgggcagccaaattgactcagatattttgttgtgttgctagttttccttcttgtagtgtaatgctatctctgtagactgtagttattcccattcacattttctggggacaccagttgttgaaatgagtttaacttggcttagtctcatgttatgtttcccatgtcattttaattgcaaatgcttttatatgttgtttctttccaccccaaacagccataaaatggtaaccaggtttactcccaagcaaatgtgcatcacctcatgatgcatgaagggtgtgaatgttcaaatttcaatctttcttccttttcccctactaaatacaaaattaaatagaaaaaagttaaaagatgcaacaatgtgacaagtctagagcattaaaggtcagggtgagggagcaggtgacagaatgtgtgaatgtttacttgcattgtcagtttccatttggtgttaacatgacttgcagggcataaaagtgtgtactcatatggggtgtcaactagagccaaaattagaacataaaagtggtgttttaaaggtggcaaaacacgtagatggtcgaagatatgagactttcatatcttactggaccattggaagaagatacatacaacgcatgaacaagcttggataagcttgccagcagtttggcagatgctgaatgcttgagtgtaaaatacgtgcaaacattgcttgtggttcaaagttaacattttacttttttttcatcctgagttatcttttccctcatcacctataaatagctctcctttgttgagaaagaccaccagagagagaaatttgcaa

SEQ ID NO: 39082 - DNA, 1820 bp, Oryza sativa
taagagtcattcttctctttgggtaacattctttctctgcgcatgtctggcagtaacttacttgttgaattgctttgctcttctaggagcttgatgggaaggatgctcggattgcaaactactttgatgccattgctggcacaagcacaggtggtcttattgcaggcatgctagcagctccatcactgggcaatgccaatcaaccatgctatgccaaggatattgtcccattttacctcaagcattccccccacatctttccgcacaggtaaagtatgtattacaggcttcagttaatactaataacaatctttgcaattatgtagttgtatgtttctgtctgaggtcagtagagaagctatgaccatatctaagtgtttatggtcaaccaatttctgagttgaactgttctcttgttaattgattttttaactagctatgaaaatataaatggtattttgtcaactggattttgcaaccaggactggattttttggttggttcttcaacatcctgggcatcataaagatggccattgggccaaagtatgatggaaaataccttcacagactaatcaatgatcttcttggcgagacgaggatgaaagaaacattgacaaatgttgtgattcccacttttgatgtgaagtgtgtgaagccaataatattcagcacattcaaggtcccttctctaaactgagttagcgtgtggatttcacatgacaattttttggagtggtgtgaactaatgtatatgctacaatgcaggcgagacgtaagcccttgaagaatgcttgtcttgctgatgtatgtattggtacatctgcagcaccaacctttctccctgcacactattttgaaaccgtggatcacacgggtgcatcgcaaagcttcaacattattgatggtggcatggcagcaaacaatccagtatgttttttcttcatcatttttctgaaattgtcaacttttgttgggtttaaattcctgtgtaaaaactctatacttttgtctttcaacaataatgtttacccagtaacgcaatatgccttttttcattatgtgttttgtatagacttcacatcaacctttgttgccaaactggacatggtaatatttaagatgctaacttatcttgatgtctctaatttggcagactttggtgactatgggtgagataacaaagcagatcaagcggaagagcgaggagttcccgaaagccgagcccttggattaccgcaagtatctggtgatatctttgggcacgggtctgcctgagcacgatatcatgtttgatgcaagaaatgttgccaaatggggcatttttcgatggctagttgataaggatacaatgccgttgctcaacatgttctttcatgccagctcagatatggccgatactctcgttgcagacctctttcaagcaatcggatgttcacaccaactattgcgcattcaggtacgcgacccatgctttacaatctattgtcatgggtgccatccaagttagttatttatttgttgacatgttctaaaaaatattgtataaaaaacatttataccttgttcaccattacaggatcacaacatcccaataggggcaatatccaatgacctctcgacgaaggatcatcttcaactgttggttaagataggcgaaaaccttctcaagaagccactaagcaaggaagagtgtgagaagaacaacattgagccagagccaaaccttcatggtgaccatgtgacgacctatgcagatatgctcacacggtttgcaaagctactttcagacgagaggaagctaaggctccacaacatgaa

SEQ ID NO: 39083 - DNA, 16453 bp, Oryza sativa
gttttgtgtagttgatggttggttgttaacagtctcttatgacacgtgtcagaaaattattgtgccatttggtcaaatcaaccggtgaaattatcgctagcttttttctaataagatcaaaataatcaaacgtgtatgtaaaagttaacggtattatctagtattaattagtattaaagaaaaggaaagagtatatatcaacacaatgaagttttccttctaggaccatgcacactatgacactgtgttccacttttgctaggactcatcaatctagtagtctctgtagctcagtttctgaagtagagcagaagccgaatgccgccaaactaagagagagaacaattaaaaatgacagctttgcggggtcatgaagctctgaatcgtcggtcgtatatctcgcatagattagccaggcaaccattactaagctgacaatagtcgtaaatccctgtaaacaacaattgcattaggatatgtgaccaagattcatctaatctaaggatatactacctccgtttcaggttataaaactttctaacattgcccatattcatataaatgttaataagtcttgtaatatgaaacggaggaaatagtatgttggcaaattttactacaggacacctgaaatttatgtaatttatcggtggacatcataaaaacgtgtcaaagctaaaagacactatataatttactagagaacacttttggctcaattaaaaagataaactcttaagaaagacaagaatgcccttagggccacaagcttcaaacataatgttagcgtaaaaatttagaaattatgcaactctaaatttgccatcactccaagtacatcactagcatacatcatatttaattttcactctaacctaagctcaagagcttttgaccatagggttattcttgtctttttaagaatttctctccgaaagtgttctctagcaaattaccaatttttttatagtggccgtcatacgtttttacgatgtctactagtaaattatacaaattttgaagatcctctagtaaattttgcctagtatgtatttctaagtacactaatttgatttccattaaccatctaattaaaagatatgttaaggattactctgtccaactgtaaataaatatttaacaaaggataaagagttggtcagcctcttgaaattctagctatcaataatttgtcaaacgtttgagtttttcttttaaaaaaagaaatatgcgtgcatttaattgaagagtaatataagaataatataattttttagagacctgctatggtgcttgggaatgatgacatccgttgataggatgcaatccaactatctataggagaaggtatgtgtgggtgggtacttaaaaatgtttttttaaaccccaggtacttaaaaatgtgggctagatattaacttaattaaaagattaggtgaaagattaaatatgtaattttgtgtcaaatattacaatagataaaaaacgcaaaccagcaacgagcgcaaggagaacataattacgaggattagctcgatggtagttgtggcggagaaagggttagagcagctattaagcctaggcctgccttcaaaatcttgttaaattgtgttaaatcatcatgtaaattttgtgaaaaactgacacttcatttgtgaaaagccttaacttagtagttagtcatagtctaaaaggctgtgctcggtcccgacacgaaaaacaaagcacacgactatagtgagattaattaagtattagcctacaaattgattaatacgattttttaaaacaactttcatataaattgttttttaaaaaaaatgtatcgtttagtagtttgaaaagcgtatgtgtgtaaaacaagggaaagtgagttaggaaagaggggaaaagaacaaagccttaaagtttccggcttagtcattgatagttgtaaaaaaaaagtatatacaagatgagttagagatggtatgactataaaaagtaggagtaccaaactacacctgtttacattgtttccctttctaaattatccctcaaaaaatgaaccgcgaatgtacggtacatggggaacagtaaaagatctcgatttttaaatttaaaaatgatggttaaattttttttaaaaaaatggctgaatctaccctaagtaggagtatttatgatgaaagagactactcccatcgtcccatgatataagaaattttgactttttgtttgcacaaaaatttatgcaaatataaaaaacaaaaagttgtgtctaaagaactttggataataaagcaagtcacaaacaaagtaaataataattctaaatattttttaaattagacgagtggtcaaaccgtgcaaaaaaaatcaaaatcccttatattataggacggagagagtataataaattagaagtgaattcaagttgttgaagagctgtttaaatgttaattacccggatgaagtagcgcaaggcgtggtcgctgcagctcgtcggaggtggatgcccgccggcgctgctgccttcttccatcaggcggatcgagagctcctcgagcagcagcgccgccgccgcctccgcatcgtcgacccggcgggcacgcggcggggggactatgaacgtcatggccgccgccgccggagttacgagacgaaacggtgggagatcgccggaattaagcctctggattggcttctgttagatatatcggggtattatattatcaagattcaagaggctttcagtgtccgtgtagaattaatacaaatttggcatgaagcttttgtatttttttcttttcttttcggattgcgtcgcaagtgaaaacgtattgcagaaattacgttacccggatgcagaagcggaaaggcgtgccagttgggttgctctccgtcttcccatctcggaggcggacgcacgcagtagacagggcgtgagatttacttggggggcgcaattagtattgaattgtttcgggattgcgggggaggaaatctcttctctatctctatctctatctctatctctatctcttcatcgcaattcaattctcagcatttacatttaaatcgttaagaacacatatacaaaaggttttactaacaattttttttcattttttttattgatgaaccattatgacttataacctgcataagcgaaacgatgagcatatgcatgtgtgtgatttcaacaatcctcctctgcgagtggtttgttggtattaccagcattttggttagtattaaatgtctgcaaacttaggtgtggtattcatatggtgctccatactactactatatcattttctctgaaatcttaaatggccgtttcagtgatgctataaccagacagtttccttccaatgatctacattattttgttgctgcaggcctaggtctcctccagctcaaccaatcattgcttcatgcttcctttctaattaaacatacaagaaaagacctttcattctttctttattagtgtggtacttagtaccgttaattagaagcttccacatcaatgtggctacctcctgggtacatccaccacactacaccttttcataacaccctgtcttggccatggcttgcataattaagtataccactctaaacaggctgagctaaactaaccctgatgtgattgctactactgaaaggtggaccaaatacatatctagatatcaaattaaatatcatatgaggaggtttgcttggcacaacatatagagagatactaccactgtatcactgcagtttcaggctttcagtttcagaccactcttgccttcttgggctcaactagacccatgaaaatctttgcacagcttcactgcacattaaaccattacatgaatgcattaattattatactgcaaaatcagacagttcatgcagcatgtagcacaaatctttcaatggatgattaaaaaaacacgaatattagggaatgaactaatatcaaataattagaagagatgaggcttcgaacccagatcgtctagtccaccatcttgtgaagctagcaagaagacctctgttcgtttctcaatcaatggatgattcaggtaagttcccagcaagatagataggtggagtctggttgagttgagccagttttgtgccggcccatcgctataattcttgtcgttgcagatatatatcttggcttgcacgtcagagatgatcgatatcctcctgcatgtgcaccggcctcatatatagttgtacagtatgatatattgatatatatcccccatccaacagttaatagctgaacttgacctgtaccgaccttgttttttcagactttcagagaacatgtaccaactgttagctctaactgtataagctctgagatttcagtgaacagaaagagttgtttcttcttaaaatttatacagcttcttgttatgcaataaaatttatatgatgctcagaaatatcatagttaatcctttgaagtcgttatctactcccctctgtttatctagttatgtgtgcccatgcaatccatattcagactttcttctcttgtgtttctcttctgtatctaacggaaagtcggcagaataatgatgatagtttttaagttcatgggaccaaactaaaacagatttatttagggatttagggtggctggttttggatttggagacaagcagattaaatactgaaactgaaactggccaacggcttgcaccatttgctgcttaaattacaatctcgagacccacttcaacagctagaaccatatagaacaggcgcaaccaaaaaaaaaaaaactgcagcactagctagttcatgcatgattgactgactgattgattattagtgctattgagtagtatcaatccctaattatcttcaggattagtactactagttgcctagaataatgtgcagggatcaactgctctgcatatgcatggatgcgccgcatgcggctatctcagtgattagcagctcaggattaagaaatcagaggtgtcatgagtgtgaaatgaagtttaaaatgtggttcaagctgataggttgatagcaaattagatttgggagtatagataatattggcacaagtaaaacatttgcattattcagatcaactgctaactgaaacttgctgggacctgataaaacttgaaatattatgatactagataaaatactcataacttctgctgggattaatcttcagtaagatacgaatatgtgattaattcaaaattctatgatgatactagataacaaaggattaatcttcttgctaggacctgatgaaaagttcagtaagttatgaatagtgaaacttgaaatattcatgaaacttactgaactttttggaactaaataaaatctaaaactttctcattgttggcactacatgatagtacatactagtagcaccgctatatggtggctgttgaccatatagggccatattgatcagccacctgccgatcatcgatgaacttaaactaattaattagtgcccctaaagcagggaaaataatgcatggcatctttatggaagtaatgatgattagtgccgatctgtgataatgatcatcaccagtttatgccatctttcagccttcaaatggcacacttctctctcaagtgaggttcagaagctatagctagcttagctagcacctcaattcttcagttgaaggctaatacatgaccatgcaaaactgtacacgacgaaagctacaagagccacacaagtgatccatccatcagtgcaattaattaaccccaattaagaaacggatcaatcgtaattgagaattattcctctgtatatccctgaacctgacagtgacttcatagtacacatacatatacaggctacatgactgcatcaattgatcgatcgatcgatcgatctctcactctctgcatgatttctctcagcctcacacttactgaagcacacatacgtgtgtgatcaacagcgacagtttaattaatacaaatactgaagaagatatgcattcgagttcttcagatttgtgaagcacacacatctctgaagaacagctgcatgcatagcaaatatccatcacgcatttgatctcgtgcagtaaaaaggctagtggtcaaggaaattcaggtgccattttttgccgacaaatcttccaagtttgaaattggtagctagctagcttgatagcgtttgcaactttttatttggtcttgtggttaaattgctataaatttattgtgaacaccaagacatgcacaagtcgacgtcacattatatatattgtaatgtagttcgtcgaatcaaaaacaaaaggttgaattcaccgaacaaactttatttgactatatagctagtgatatagtggtggtccagtggagaatcttttggagatagaaaaaaagagggtagtgacccgtttggcttaaagttttttggtttaaaattgggattaacttttggccacaagaaaaggggttttgtggggccgaatcctcacttgccggtttatgcgtggctgaaattaatcgatttctggattattattattacaagattaattgcagctggttttttgatatcgatggtgacttcccactttaccagtatgcatggcactatcgatggatggatggatcatatcgttttatttcgtcatgaaaagtgaaaaaaaactacgggtgaatcatatcgttttacttcgtcatgaaaagtgaacaaaaaaactacggctatgtttcttatgtagcaagttctatgcaagtggatggtaagtttgtcagtagaaaatggatttatctttgggaaacatcagcgatatggtggtatatggtggtggtgtcgtaggcacgtgactctacccaagagaatttaaatcctgatattcacaaatattacgtacatacaggttggttttcaacgtatttttaattttagtaaggtcaaagttgtaccgttgattttcatcacttagagtgtgtgttagggtattcacgggagtatgaatgtggtgttacgtgtgcagtgatgtgacgcaatgagtctttgttgtgaactaattaaaaaaaacagatttatgtttatgagtttatccatgcgattgattcatgtatttatcctgcttggcagctgatcaactaaattgtccaatagcagcgaggttgacgtggatctaagagagttggctacggattggtcgaacccacgcagggcggcacgtcagaggaagattctgccgttcgagtggggcccacacgcgccacgtggatgcatgcattgctgtgtcgtcgtcgtcgccgccgacgccgacacccgccgtgtgcgaggggtcgccggcgttcgccgctcctccgccacaaacttccccggcgagcttatccatccacgtagcgcgggcgggcccacttttcctctcccgtgggccccacctaagtacacgtagcagagtcagccacacgcgatcgatcgagtcctcgtatattacggagtaattaagcttatagctttaagtgtgattaaatattagattttctttttgagaaattaaatattggaatcgaaactcgaaagtagggttaaccagcaagagtatcaattagttaattattttctactgtatatcagtttgtcaaaaataaatttgccaaaatattaatatttatttttttagggtaaaaaatattaatacttaaaacccaaaacatctactagtatattgtaaagcagagagtaagtacatattagagaaaattccctatctagcataaaaaaaagttgctcttccctctatagcacccaaacttaaaaagttccctatctagacacttctaaaattttccttccctatgtagcacttccgtttgtttttacacttgacgatgttaactagcagaagaaaagatggttttgcccttctttatttttcagacttgcctatacatcatgttggttattaattgcttaagttaattaatgacaagtgaaaccacaagaggataattattatttttttcaaaagagtggatcgacatgttatatttgcagtgttacgttaaatcaagagaaaacacgtctaaaataccaacgaccatgtacgggcaagtctgaaaactaaataagggcagaaccgtcttttctcttgctagttaacaccgtcaagtgtaaaaactaacggaagtgctatatagggaagggaaattttataagtggctagataggtaactttttaagtttgggtgctatagagggaagagcaacatttttttatgctagatagggaattttctctatatattaagtactagtatatataccaattccaagtgatctgaacaaaaacatttacaagttcaatgctgtataatgtacatgtaaaatatgtgatttttacatgtgtaagtatattatctactgtagctaagagtaccacgtaagatcgatgagaaagtgcatgcatgcgtcgatagtgtcatcacagtggactactagatgtaattaatggcagggggaaaacagtgccacgtcaccagagaacagacggagtaattatgcctctcagcatgcggccactagtagttaatgatgcccggctccctgccaggtgggcccgtcccccacgacaagcgcagtcaaggtgcgcgtaattttcagtccacgtcaccttcctccggtcgagtgctccgacataatttctggcacgtacgcatgggcaagtggtgtgtatacatatatctacgtgcactgaatgcatatagatttagtactaggattattatcttttcttaatatcccaaaatgcacatatcaactgatatatatatatatatatatatatatatatatatatatatatatatatatatatatatatatatatatatatatatatatatatatatatacagttctcaaattaaaaacaataatttagagggagaaaattttctaaatttttaaaagaagaaattatgagcatgttgagtatcaaacataagatctcaggttaaaaccacacatcctcaccactacactatcaagtgatctctacttcacaaatacaaatattgggcattttatgatttaaaaattatctacgaaaattaggattataaattccactattattgctcactggtagttgcatcgctacttcgctagacatcataattttacaatcaagtaaaatcttaattagtgacatcaaagcaatttcaacttaagcttaaattgtgttgaacaatccaaaaatccgttatatttgtgcacggtgggagcatccaggtaccaggtaatatgcttataccgaagtttttttttcctttataactaagcagttaaagtaaaatgatacaattatttataccaacatgagaaaaataaaacaacttctgctctttactgtagagacagataactgcaattagggatgcatgactaaaatagagccagcttaaataaaacacaacaaacacactccaaaaaagaaatccttgctaaattagcactcacctaaaactaatccaaaaaaaaaatgtcacctaattaaagcaatttttttaaccaggaaatattttttttacctctttataaatagccccccctgatcaggcagagcatcggagcaaaaaatggcggccatctccaccaccaccgccgcctacttctcctcgcagccgcagctccccgccacggctgccgccaagtccggcgggcggcagcagcagcggcggcggagcagcttcgtgatgctcgaggcggcggcggcgtccgggagcggcggcggagggggaggggcggtggggaggacaaggagcctgacggaggaggacctggaggagctcaagggctgcctcgacctcgggttcgggttcgcctaccacgagatccccgagctgtgcgggacgctcccggcgctggagctctgctactccatgacgcggaggttcctcgacgagcagagggcgcccgggcaggagccggagtcgcccgccacgccgccgctccccaactggagaatctctggccccggtaaagctttcccctccccccgtgcagattttgattctgataatgttctaggtttgggattgtgtgaatatatacttgattacttcttggttgtgaaggtgtgtgatcgattttttctgttgttttgttggagctgtatgatttgagaggtttagaggtgaatttttgggatgtcagatgcagggtttggatttttgggtccaaaaaagaaaaacgagatttgaagggagagacgtccctccaaacattttttaagaacaaattgtcagcgtgtcgagaattgaacacgggaacttgggttgaaaccacacacccgttgccaatgcactatcaagtgcatctcttggattttttggtccatttgaagtgtgagatgtttgatattgagatatgtgtagcgaagtagtatagacttagttgatcgtgaaagaattgattatcctatgttctacccaggtaggatgagagtatgtttgcaatattatatcaggtgggtttctccattagattgctcgttgaatcctgtgtagattacaccactgttttttttaacaagtggctttgctataggatggcactaacaatgaataaacatcctgaaatctgatgctcgcaatgaataaaagatatgagatattcataacggaatggagtaggcttcaagcaacatgcttgcagacaatcgatgcccagtttacaggctatattgaacaccctggattttgttggagattactggatgcctaatttcgattttgattgccctgtgcatatgaattgatggtttgctctattcaactgatgcacagttgtaataattataacaaacttataacagcaattccagctggatatatgttttggataccagcttgttgtagctctttaaggaaatccgctgaaaatttgccaactttctcgtgcacagttaataccaattgttgtatcctgtattcaacccttattcttaggatattgattcaatcattctctctctctctctctctctctctctctctctctctctctctctctctctggtgggggagagtggagttaggatttctgttgtcttgatgacgcttgcatcttgtaccacatacagcacaagttgtttaggcggagagaatcagattcgcttgcttttgctttgtttcataaagaaatgaggatgttagacactcaagactgcaaattgtgccaaccttttggttgttgtaaattcaatggttctctaaaattttttttagaaagttacggttctctgaattgatacacatacaggaaagggataatggaagttttagcataggaaatgaaggaaaaaatgcttacattctcaggtagagcactcaagataaaagacagatttgctttgttcatgatgtctcttttcttagtaagtgcgaactgtcttctgcaaaacagtcttcacaagcaagcaaagcaagagtagccccacaggaaattatgcttctctcctttccaacacatgtttcttctctcaaaaacaaatttgaagaaattctattcttcctatcaagaatgtaaaattttatttctaaaataaacagtacctaagcatgttctctgtagctattagatgtactgtccgtttaatcgagatgtttgatattgagatgtgtgtggcaaactataatagtatctactctatgaaagccatactgttctttgctgatcaataggttctgaattcttataggtgatgacccaaaggaagtgaaggctagactgaagtattgggctcaggcagtggcatgcactgtgaaactctgcagttagtggtggactggtggttggctgtctgctggttcatctcataatgtctatcctactgacgggaggaaatgaaggtggttgaagttgaagaatttcacttatatggttttgaggtcaggtgagcaaatacactgatgaggtgcttatgcctcgtgttatcgaggcaacacgatcgatcagttatttcgcaaaacttcaaaggggagactggtcaccccacggaacagcaagaaaactcaaggtgatccgtggtccgagcttttctgaaggcatcagaagcttgtcattcctcatggaggtctctgcatggtgcagggtttgcaactgcgagacctgctagtttttgctcttgtcatgatctttaggagcaccaattgctgtactgtaccgggtggggcgggggtttggctgatccatgggtggatcagtttcagtatggctttgttctgatattctgtttaattttcatttgctttgaagtagaagattctgctatactgcaaagtttgcagatagtatgctccgaaaaatgatttatccatgcagtctaacaataaactgtagctgctgatattgtgtagtactaccatgtgatgctactgaacttgtatgcctgtatccccattctcaatgctttcagtttgagactggtaaaagatttgattggattatgctgctgggataacactgttgcatgaacttgttggatccacaaattatccaattcagatcctactattagcaattcagagcttatatccagtttattgtcagattcacggtgtgttcactttattgtcatttttaacattataaaaatttggcaagacaacaaaccaaacacatatcagtacgaacacaatcttattaaaattttggtaatttcagaactaccctcaaaactctagcaaaaattgggtaagccacaaactataatgggaaatgtggggtgggattgagattgggaaatgagggttaggattaaatggaagatggagaatgaatggttaagatttaaagatgtcttttagtgggtggaaaatgatttccctatcccatgagccaaacaggacctaagggcttgttttgcagaattccaacttccacctctccaaacagtttcagctaaaaaaaaagaactgtaatatgctgaagtgttatcacaaattgaactaaaaaggtgacggtagattctggttgctctatggctgtgtttgggtccaccttttctcaacccgtctccctcgttttccgcgcgcacgtttttcaaactgctaaacggtgtgtttttttacaaaaaaattctatacgaaagttgcttaaaaaaatcaaattaatccatttttgaaaaaataacaaatacttaattagtcacgcgttaatagaccgctccgttttccgtgcggaggagattagttcccaacctgttctaccgaactcaggctaagttggcttcgtactcaactcttaagattaaatttaggaattaaaatatctgcccaaacagaccaagcaaccaaccaacattaatctactactaagttttatttttataaaaaagaacaacaaagttccaatgtaagatctcctttttgctgtagttgtaagattcaatagcatttcctgtgcagttttacagaaaaccactgtattcacaactgtacagagggggaagaggctctcgtttttttgtcggtgaggagtcgccagtgctggtagcagggacacgtggcgcgcgcatgggtcccgatgatttccgaagcttccatgtggagccttgactctggattacgcatccccaagcgtcgtgtatactctatactcccctatcctattcagttgtgaatttctgtctaacatttaactatctattttatttatttttttatatttaatatttttatatttattaaatgataaaacataaataatattttatgagtaatttattatttttaaacttttcataaattttttaaataagacagatgatcaaacgttagatataaaaactcacaactgcatgaaacgggttgagtttaatcctgcctacctgttcggtatgactgcacctgtgcagtggcgaaataccggtagtaccccccgttttctgtgaattgattgaggaggataggtggcagtttcggaatgttaggtctccatgtctgggaggtctccactttgtcgtctctatcggcgattctctcagcaagtctcgtccatggtggtgaccggtgaacaagcagaaagggccgtggcaattgtcagtttagacctttgcattcctgcttatttgatttttttatgctggatgggtcgaacaaactctccttccgaaaaaggatcgcattaatattttttttaaaaaaaatcaatttacagatttgtatttcgacccagctaatgaattttatgctgtaatgcatatatggtaatgcactatagtataacacattcgtacaatattgtctgtttggtaattgcttggtgcccacattagaaaaacgtaaattatatatttccaacattccatgaggatatactaattatccaccttatagaaagatgatatgcctaatggtgtaatcatggcgaatatggtgtagcatcaaaatcctcttcaccacttagtgctttttaaatttcatccttttcagcttaagatatttttttttattatcatggctacttcctaagctcctacgggtatatttggacaatgggaaataaggggtgagattgagatagggaaatgaatgaaatgttaggattaaatggaagagtaagaataaatggttaggatttaaagatgctttttggtgggtgaaaaaacatttccctaacccattattcaaacaaggcctaaaagtttattatctctttgacaactttcttcataaccatttcttcaaaactttacaaaacaaactcttaactctctaacatctaattcattcatttataacatccaacaattgacataaactgaatttcatccatcatccaccagcactcgacaaaacaagaccttacaacagctaatactcatctattagcactagccattaaacattccctctaaaccgaaagtctctactgacacttggatatcacacatatcctgggttttgattccatcccaaatcagcaaaaacctcacccaaaaaaaaggagaaaaaaaaatgctacgaggaccattttgaaaatcagtaaaattcaagggtccattttagaaacacacgaacctcacataaaagtcccttcccctttcgttctcgtgggatattcctccgaataattatttattttatatttacataattttttttcccactcctctccctctccgggcctccgctccccgtgtctccccccacctcgccgactcgcgccttctagaatcttcgaatcgcgatcgcctcctcccacctcggcccagcaacgagctccctcccatggtggcctccagaggataggttctctcgcctcgcctccctttccccccaccctagttcgtcccggccagggcgggttctgattttattttattttgttttgttttttttctcgatttttttggtgaattttgctgatgtttttgggtgatttgtagcgggagagatcggaatcgtagggttttgggggaggcggcggtgggggagatgagcggggaggtggaatgcagagtgtgccacgcgaaggtgcaggtgccgatggcggcggcggcggtgtcgaaggcgtacgacatccaccggagctccgtgtcgtcgaggcagcgcgcgctcaacgtcctcctcgtctccggcgactgcgtcctcgccggcctacaggtggataatgcttcacccccccccccttcctgcactgggttttggtggtctgatcagcgtgcctggtcccgaatcgccgccaggtgttgcgcgcggactgaattggttttggtggattgcgtgagataatgaattgagaggatttagatttaggattagtagcttgctgctcagtgaaactgtaatggtaccaaagtttgtgcctctgttgcatttgtttagctacagttcatgctaaacaaaaacttactaattagccatgagtctgtgactactttttctatgaatgtgttaatgttattaaactgtgctgatgtctggtaaaatgagcgtcatgtaaatgtctagtgttatgtattatcacatcacaccatgatcggtttcattgatctgtgtacgtgaacaagcagtagttatttggggttttgatgacttgtattctttcctgagctaatgttaatgtctagatacacatactagctgctaggaaaagaatgaatgtctagttactactgtcattatcattccatcattttcattgcttattagatatctctagagatcttaaactttggaacattctgttgaaacacaacttgttgctgagttatttagccatctgagcacatccatagaaatgtttgctaagtcattactctgttgccactttatgaactcttatgttgcctgacgcatctctacctctttttctgcagcctatattggtgtacatgtgtaaagtggatgggaagttcaaatttagcccagttagtgtaaacttcttgacagagattacaaaaattatatttgccat

SEQ ID NO: 39084 - DNA, 2625 bp, Oryza sativa
tacatagaaagctatcttttaatcatgtgttacttcatactggccatatgctcccatttgttgcaagaagttagtgatttttttctgccatcataattatttttcttcacttgccaggctgctcgcaacaatgttcttcatgcagttcctgctcttttctatgctatcaacaattacatgaagtttgtaatgcaggtataggatcataaagacctcttaattacagaccgtgtgggaacttgactttctttgaaccaatctgtgagatctttcttttgcctaccttcaatctgatgcagctcttctaaccattgatcctgtcttgtgcagctatattttaatcctgcaacagtgaaaatgttgggtaatctcaaggtatgttataccctctttttttttttcaaagattatcttactgtcgtagtagctacatagcatcaacgttggtgcattcacccacctcccacacatgtatgtacgtgcacacgcacacacttgtccatgttgttttcagaaaagctattaagctcctaatagtcccaactcccaaccttgtgatttttctagttgattttcatcatttctttggagtttggcaacatgtgaattacgttttgattgtattggtcatcacacatttgttctgtaggttctggtgattgctgtgctcctaaaggtgataatgaggaggcgtttctccacaattcaggtaggtttggtttttaattatcatttgtcatgttaatcagttttgagcttttttttcaggatttaaaagtagaggtggtccaaatgtggttttttatttaagccgattggcttcctgtttttctttacatctatctattaatatctaactcttaataaatatttttgcaacaccacaaactttatgtaattgacatcatactatggcgtgttgacagtgggaagcccttgctcttttgttgattggtatatcggttaatcagctcaaatcactgcctgaaggttctagtacacttggtcttcctgttgctgctggtgcctacctatacacattatttttcgtaagttctgtctattggttcatttgttcattcgtttttcttgtacctcttttcatcctcttatatctgattagtgcatggtgtgctactctatttaacatgtaggtttagactagactaatgtatcttctgtgtaatttgggaaggtaggttaacttttagttttcagagttcattttcatgcccagctcaagcaaggctttctggtagtccgtagattacgatacaatgatgctatatctggcctgctctttatctgcatatagttatagacgagcagacatttgggttattgatacaatgcttgaactcttatatgttgtgctttgaaccagtgttttgcattttattgattcacatatagttaaaaatatgtagcatggtaggattaagaacttgtggtaaactgacagagtaaaatagctacagtagttctcagcacatgggattacattattgcttttgaatacttcacattggaaacaagcttaatttcatttgattgctcaatttttttcctatataacagaaatagccaacacaatctaatgttccatgctaacattttctgcaatcaggtaacagttcctgcattggcttcagtttacaatgaaaaggctctgaaaagccagtttgataccagtatatatcttcaggtatgaccatatgcatacttatcctgcagtcaccatgtgctactcaatgataatgtactaaactatcagcctgtatctcctaaagctattgtttttcaagggtcatgactgtcatatcatgtttacagaacttatttctgtatggatatggtgcaatatttaatttcctagggcttgtgatcactgccatcatccaaggtaattgttgagaatttatatctcatgataagaaatgcattttttttgcatattatagtttccaaattatgtgttgtgatctgctgtcaataactttacttttaattactagccctatgcctgcttggattttgatagggtacttatttggttaattcagtcattttgtgatatatatctttagttctttacacctcggtatggctacaatttaatagatcataataaagtgcttcaatagtttaattaatggaatctctttcttcttgctttccattttgtcacaattattcaatcaactatgcttttaggatgacaatatgcgcaacgaaatcttgtaccttaactgtgttttctctgaaatgtcctcttgtacatatgtatcaaccatttgacttctacgatgccactatagctatgcacttttcttttgtgtcatgcattactcggtgctataaagatcacttattatgtaatttcgtccaggtcctagtagctttaatattctggaagggcattcaaaggccacaatgtttcttatttgcaacaatgccgctcagggcatattatcgtcatttttcttcaaatatgcaggtacgttttccctttgactcttaaaatggtactttttaatatccttgaagtctgtttttgtacatgttctggatgcagttgaccagttttttttggtaaagttagtatgcaaagctgtgattatgtct

SEQ ID NO: 39085 - DNA, 5133 bp, Oryza sativa
gacctgcaggcatgcaagctttcaaactattattactatgagatattattactatgaaggataaccaaagatcaaaacgctgattcaaaattctattgcatcatccgcccacgaggaattgccgcttcaggctcgcgattcgactttgatcgttatggattggtaccaaaccaagatcaagtcctaggcaagcgggaaacctgaaaaccaaaatcatgcgatcattccttcaagagcataaatgggtaacaactagaaatacatgaagaatcacttctttcgagaatgtgcctgagcacgtgtttcattaagaagatacatgaagaatcacataccagcaaaaatgtcttcacttaaatttataccacaggaagccttgctaatgcctcctcttgtaatgttaaaaatcctgtcgaacacatcaggatgtccatagtgaaatcgtaccctgcacagagaatgaagtatgtcagatacacagcatttagactacaagtctgatgccttctgccctctcagacagtactgccagacttgtgcgcgctacaattgctttagagggagctgctgtcggtattggaaacgtcctcagttcttcgattcattccgtggcgcgaaatccttcattggctaaacaattatttggttatgccatttttggcgtagtaccggtattagagatcaggaaagtagttgggagagctcatgagactctttttgtgaaattcataagtctcaattccccaaaaactcgagttccttttggatttccttcttgattaatgacaaccgtcatcatatcgtattatcataccgttgtcacgtttgagttctttacatgagtttttgagctccattatgtggacttcatcaattttttaattatggacttggtggtagtggtcaatactaactgcaccgtctaaatgctccctgaccaagttagcgtactcgccagggttgagttgagggggcagcccgtgcgctaattgggctctgaggttggctatacgcgaaaaaagctcactttctactgagctgtcctaaactgttccagaatgttatttgtttcataggaagattccaaaagcacattgtgatgccgaaagaatcttcggaaccggtggggttctgattgaaggctagacaaataacatgactgaaatatgtaaatcaaaccagtgaaatagctttataatattatatagatatagaataccaaaagcctgataatgggttaaaaaaatccaaaataagctttttgctttctttttattttgtgtgcgctttcctcctgccttcccgaccacggataggctatggggctttgcacttcttccgcgatataggacgattcgctcgctatctgaggcgttaatttacctactaaaatatcgcctgtttctacccaggaccccaacttcacaactccatttctttccaaattgcggagtaaatgttcttctagatgtggtatttctttagtgattttttcagcggagccttggcttgtcgtatccgtctgaatttcatattttcggatgtgaaaagaagtataaatatcctcatataccaaacgttcgctaatctcattcccaccccgtcgtcgagagcagccagcccgacgtttttatgcgagtgccccatgaagagattttcaatctcgaatctccgtctggttcccaggtggggtattcatccattgatcgaccaactgataaaataagcaattcttccactttctctctgttgcctatcggattgtcgcctgttgatggtaggtttgttctagaggtagacgaggcattactttggctaggtggagtgtttgcgagtactgaagtcaatcttttccaaaaaaggtttagtaaatgcacatcctcgccgctcggctcctccctcattgcccatagtccctaaagtctgtatgtctcttgtctctttgagaccggggatttcccaactgttccttcccttacaccctaatcttaatacccctgttacccgcctgtaggcggatcctaccaaccaaaataaagtgaccgaaagacacaattgcatcggtccaatgagacatggaagcaccagtagatattgaaagaaaaactattgttcggtattattgttgtagttctttgttcctttcgtcgatgaaagtacaaccacccattttccacactttttcatattgacttaagtcagcgaattacccgcggcgaggaggagagattagaactcctggattgaaaaactttttcttctccttgctaattgccgttcctgcccttcgcttcaggccatagtgcttctgaattatttctatacccctttgatgatgcagcctctgactttcgtgggtaaactcaagtctacctcgtaagccacttaaagatctttgagcagctcgagagagaaatccgtcttcattggtacaaaataaccttcgacatttggtactggtcaataacttacggcgagacgagcatccctataccacgtgtatccacactcgtttgtccttttctacttagttgtacagatcacttcagaaaatcgtataaaaatcaagcaagaaaacgtatgcgctttagcaacaaagcgctcatcccttcttctttcgcttggaatcccctcgcttcttctttcgcttctacgctcgtgctttcagcaagttcgtaccagtcgtcaggagctccaacctccgcgcctagccgcaaggaacctaaatgctggttctatcccggccaagcaagcaaggtgaaccccggtgggaaagaaagaccagggggaagaagctgtcaacacttctacaatccagtctcttaacactagctttacttgggaaagtagtgaaagtcctgctgctggataaagatactggaaaaagtctcaagttccactaggcgagatgaaaaagttcagaactgggatgccaaaaagagccgatttacaagcaaaatgaaaaaactaccactttcccactatgtcggaactagttttttcggctaaccctatctatctccttaccctgtaagaaaagcaaggcgccctccagtctcgttcgctgggtggtcagagtacagcttcgccttctcctcaggcggcaacttgaaaaactccattccaatccccaacaaagcgggattcaaaatgattgacaggtaccaaagcaaacatcccttttccccttgcccccatgaggaatcctttgtctacctggatcttcaaagagcctcatagccaaaaattctcaagcagagaagccatttctttctctctttgatacaaattcccatctcatgaaatttctattcaattttattttaaaaaatagggctaaacttctatctgagcctttacgagcaggatccggagtgggttgcgttcattcagcagatcaccggcatacctagcgtaaaagaagagttgctgcccatctgcatgttccattactttttcaagagctaggtctaatggaaaaattcattaataaacttgttttcatctggcagataagcttttgagaagagaccactttgataacgagctttcgggttgccgtattgataccgcccttcgggggaacaggatgacctcgaaaaagaatacaattaaagatgttgattctagaaggaccttagagtattgtcactgttccactggaataaaaatatttgtcagtggtcagtttagttcgaacaacaaagtgagtggctggacttctagttttgaactctggctagagtaaccaaccatcgaaccatctccaggtcacagtcacccaccaggaaggcatagaggcaagacagaaagtcaagacagcaggaatcgaacctagtcatagtaaaatgatcattcaaagtagacttttgtcatagggcaaaggagcttagaagggtgatgtagggaagtagtaagggatgaaatcacttagatgttgtatgacggaacggccgggatgaatcaaaggcatggaaagggaagagatagccctacccttcagtgaaccactcaaggtcaacctacgcctgatatcggcggttattatacgatgcagttcgtggattggcaaaacctggggcgccccggcaggaattctgtaagcttgacttgcgcgcagcgtttgggaatcaaagataaaaaataactctatgggacttacggaactggaaagaaggtagcacctaggcgtaagaaagaaagtaaatagagacagcacctactacgctatctattgaagcttactatataatatataaaagaaaaaaaaaggccatataagtgagatcctagccagagaagagcaacaggagctataaaaaaggaacttatggacttgaatcagagattgggttgacatccgaaacagagaggaaaagaggaagcaaacatagctagctcacgaaagaaagcttgcaactacgcgttatatattttattttcaactgcgctaataagggcacatccgctttctctgtatgtagattaaaaaaatacataccatattttttcccttgctttgctatttgaatgcttacctcagtgcaagagcagggaagaggtttgattgctaataaaatgagtggaagaaggccgtcatggaagagtttggggtccaaagccacaccttctttctcccataggaacagaggtcaggagctgccggcagggtgctgcttttaatctgactgatggctcaagataagttggagacgtacttgagatagataatttatgtatttcgctatttcgaatacctaaactcaagcggtgctaatttgctaatccaagccggtattcttaaaaaaagaggggaagcagaaccaagtcaagatgatatgggtcgccccttcttcttgcgccaaagatcttaccatttccgaaggaactggggctacatttcttttcaatttccattcaagagtttctatctgtttccacgccttctaatctagatcccacttccctccacttcttgcctcacgcccgtcaaacctgactccacattaacgactgtccttccacccaattccctgcatccttgcatcacatctccaacccctgccccaagtagcaatcagaaaaccaatcaatcttccttacactacgacaattcacttgaactaccaacat

SEQ ID NO: 39086 - DNA, 6373 bp, Oryza sativa
agtaaccaaccatcgaccattttcaaggtcacagtcacccaccaggaaggcatagaggcaagacagaaagtcaagacagcaggaatcgaacctagtcatagtaaaatgatcattcaaagtagacttttgtcatagggcaaagaagcttagaagggtgatgtagggaagtagtaagggatgaaatcacttatatgttgtatgacgcaacgaccgggatgaatcaaaggcatgcaaagggaatggatagctcaacctgtcagtagttcaagtgaattgtcgtagtgtaaggaagattgattggttttctgattgctacttggctggcataagaaagaaggcgccccggcaggaattctataagcttgacttgcgtgcagcgtttgggaatcaaagataaaaaataactctatgggacttacggaactagaaagaaggtagcacctaggcgtaagaaagaaagtaaatagagacagcacctactacgctatctattgaagcttactatataatatataaaagaaaaaaaaggccatataggcctattgggtgccgatccactcgatcctatgctatgcatttgtgaccaaggcgaggtaagatcatgaatacaagatggcgatgagtcatgccaagtttggggagtgttgctcataccctcattgcatgttttaaaatagggcatactgcctgtgatttactattgatttccaagtcgacacgagattctatttctttccctctacactatgtacttacttttccggctatgcgagagagactttatccttggtctataggcacaaatccagtagaaaataccaatccaacttcctcctaaaatcacttctaacaggcgagcgtgacttgtgcgtgctacaattgctttagcgggagctgctgtcggtattggaaacgtcctcagttcttcgattcattccgtggcgcgaaatccttcattggctaaacaattatttggttatgccattttgggcgtagtaccggtattagagatcaggaaagtagttgggagagctcatgagactctttttgtgaaattcataagtctcaattccccaaaaactcgagttccttttggatttccttcttgattaatgacaaccgtcatcatatcgtattatcataccgttgtcacgtttgagttcttgttcttcccccgaagaatcgccaccaaagacattcttccatggttttttttacatggggggggctcggttttgtaaaagattatgggtttgtgtcgaattattttattcttcttacccagtccttcggtggaatgatgaacatacaaagctcatgaataggattgacttccctaggcgagattagggttagaggagatagcaaacatggagattaatgcttcttcaggttctaattgcttttctgttgcactattgcttaactcctcctgtggatcttcctttcacaagttgacaatcacaatcgcagtacctaaacgtcttgcagtgatatggagttaccaaccacctcgacctagccaaagggccaaatcaagatgggtttttgtagaaaacggctaaaccggctagcggagctgatttagagagacccgacgaaaacagattcgggttcggaccctgacggtcagaccggccgcatacctgcggtaagaccggagttcaggccacggtcagaccgcccacatacctgtggtctgacctgtcctgtgaaggaaacccgacactttctaaactttggtaattttcctctatttcatccatatgtgccaaatttggatgtaaacatcaacttaaatgtttaaccagaaagattaaactggtgaaaaaagacaaaacagtttacttatcttctaacaaattcgagatctgaatacgataaagtcgtcgtagcttctggcaccaataatacgcctgattctcatgctcacaagagcacaaagtagccaggccagccttgttgccttcgttgcatggagaagaaagatacacatcaccagagtgtgggatcatacaggagaagaaaaggatagaacgaaataccaccttcgtcttttaatatatgacgatattgatgtttacacatactgttcaccattcatccaaattgaaatactaaacaaatatcatttgtaacttgtttttgttattaaagattttttaaatcatgacgtattttttttatttttgcaataagcttttaaataagacaaatcatcaaacgacacgtccaaaaaaatttaaaagcaaagagcatttttcagctcgaagaactaagaaacatagggagtactctcttcgttacgaaataagtttagttttatccatcacacataccaatataaaattaaaaaaaaagactacaatacccgaactttattaaatcctaatgcaattattcctatctttatctactcccaaatcccaatgcaattttttacaaactctgatacaattgctaaagataaatttgtcttgagattaacaattgagacataaataaagtcgtttgggatagtgacacggtctccaaaacacaattttgacttcctgtttttataaaaaatatttattgaattttatgaaagtatttttcaagacaaatctatgtatatagtttttatattttcaaactcaacagcttaagagttattcatgatttatattcctaagatttgacttaaacattattctaaatgacttactttatgagtacggagggagtacgagctattagctccgtccaagaatgtactccctccgtttctaaatatttgacgctgttgactttttaaaacatgcttgaccattcgtattattaaaaaaattaagtaattattaattcttttcctatcatttgattcattgttaaatatactttcacgtatacatatagttttacatattttacagaaaaaattgtaaataagacgaacaattaaatatgtttatgtgctaaaaagtcaacggtgtcaaacatttacaaacggaaagagtactagcaagcacacatgtgcgttatcgtcttctcccggcgcgaccgcatgcggaggagagggacgcgacggccggtggcccgggcgttatcatcaaaaccatcaaatcagccgtgttgtcgatgcggcagccagccgatcggctcgccggacggccgcctgcgtttgtcccatcgtcctcgcgagtcctcccctcctaacctgcagtgctatatatgccacgacgagcaggaggcgaccagacggagagagagatcgatcgaacgaggcgtcgccgtcgatcgccgtcgtgccggatcgtttggttagcttgcaagacatgcttatatactccttccgttacatattatattataaatcgttttaactttgttttaattttttttcgttttcaaagtttgattaaatttataaaaaaaataacgatccttttaacataaaataaatatcctattaaaatatatccaatgttatatttaataaaactaatataatattatatataaatgatgctaaattaaattaaatcaaaacgagttataatagaaaatagaaaacagatgaagtatatatatactctatactgcgcgggcgtatggatcgccggagtcgccgttggaaaactacatgcgtgaatgcgtgattaaaagtcggcatgatccaccaccgcctgcagaaagaacaaagcacgacagatggtgacttgtggtaaagagattctgtgaaggggaaggtttaattttatgctgtcaattaagtaagtctctcatcggatgggctaaacagtcaaagaataaaccaaaatttaaattttcaaacttaattttgagattgattttgagatattttcaacgtagtttctttttcagcattgacttttaagtcaccaagaacatatatataaaagttttatctaaaaattcatttttattctctaataagccgttttggcttattagggaaaaagccaaacgatgagagcctaacctttcaagactaaaagaaaaatattattttagcagtatatagtttatttttctcttccatgatgttaaacccaagtgtataacagataatatgatcgatctgatggcgtctagaaggctcatggacaattattatatgctgctttttaccatacagtatattgggatcacggtgacctaattttaaggacttttttgaaactcaagaattttataagattttcatagagatccgttcgaagcaagtaaatgtttttttcctatagaagcaccgctatgatcttataagaagcagctagtatgtaagtcagttgaaggaatatgagaatctgaaaaaaaaagttttttcacttatatttctagtttgttatttcctccatcccaaaatatattcgtagtgctagtatgtggcacttcttataccaaaatctcttatatcataaaatgtggaaaatagttagattctataactactgattcctagaatcttttgaggacctgaagatttggaataaattacaggcgtaagaatctgcaataactgattgtttagcattatgaaaaacaactgattggtcagcttctgtaatctgcaaaaaatggctttttatcttctctcttctagttcatgaatctcacaaccacatattctcaatgtttaggtataactttatttcttcgagagagctaaacattttgagagaggcaatacttcttgagaatgctacatgctgggtccccttgtcccctgcctatccaaggacgagtgagctgagcaacaaggaggagggtgcccaccggcgaggacattcgacgtgggccgggggagaggacctgtttagcgagaggacgtgaccaccagcgacgagcactagcatgggggcgtggacgacagtaggctgtgtggttggcgacggtagcggtggctacttcttccctgggtcgccatggccgcgcgcgaaggtggccaccaccgttgtcgtcagcggatccagcagagggaggataggaagcgccatcgtcaccgccgctgcgccaagtgaggacggccagatccttctccactgatctcgattccccacggcagcaacgatgacaaaggctgatggaacgtgtagctggtactgatggataccttgtcagtattgtttgatacctatagggatcgaccggtgtcagtggatacctataggtatcatctgataccttgtcagtattgtttgatacttggtaggtatcagatccaggattccgtgtttcgcaagccccatgtacgcaagaagctttccaaatgcaattcgtgcattcgttagggcatgagcaacgtatcttgtcggactcggtagtaacgtgggcccaagatacatgtgatagtagtatatgaacttacccataatatttattcgtgtgagtgagaagtaaggtagggtccacttaaaagttgattcctatgaatggtgagaaacaataatttcatggttccttatactaatattttacttgcatgtgtcagatttactgtacaaataatgatatttatttcttatgttgctacttggtagcaagagtgcattcaatgcttaatacctagtttttcatcacattgtggatgtccttagagcaagtttaatagtatagccaactattagctccaatttatctatagccaatctaataactcattcatacaatagttacatactacactatcaataactggtcccacctgtcatacacacagtgtcttggagttcgtattacagctaactacaaatgtgtagcccgctgctcttctctccttatttatcttcttaaaatatgtttggagctgcctcctgctatttaatctgctcttaggcatgctgaaaattgaaatgcaatgaccggggcccacgcgtcagtaacggattcccacgccctcgcgcctcctcaaataccaccacccactccactccgctttccttcaacattcgcgacgagaagttcaaaaaaaaaaaaacattcgcgacgagcatccgatactcgccgccgccgcagcgcgcgccatgccgctctccgcaacggatgcggcggccgccgccgtcaagccgctgccgcgtgcgctctcgcttgcgggggcggccgtggcggcggccaccacgtcgctgatcctcatctccgtcgtcgtctcccgcgcccaccactccgccttctcctccttctcctcgccgccgccctccagcagcgcctccaccgcggcgccgatgcccgcgccacccaccccgttgcccgtcccggagcaccttcaccaccacccgccgtcgccgtcccccgttccgccgtgcccgcccaacgccacccacgttgtcccctgccacgaggacgacgagctcttcggggagcgccactg

SEQ ID NO: 39087 - DNA, 8271 bp, Oryza sativa
gccgccgccgccgcccccgcacccgcccgaggacccgccgcctcacccgccgcaccccccggaccacccgccgccgccgccaccttgccgcgtcccgccgcctcccgggtaccgccagcccatggcgtggcccgcccggcgtgaccgcgcgtggtacgcgaacgtggagctcccgccgctggccccggccaagctggccggcccccctgaccccgtgcgcgcccgcggcgactggctggtgttccccaagggggtggggacttacgtcgagcagctggccggcatggttcctctccgcggcggcgaggtccggaccgcgctcgacgtaggatgtggggtaaggctaatccaatcatttctacgagctttccgtttcatatccgagacgttgagatttcaatttgtaggggactgaactgaactactgatagtgaatggtacaaagtacaaacagttaattactgtcacctctgaagttaaccactgaatcaagtagtactgaaaatttcagtgtcaaagatgactctatcaagttaaaatttgactaccgaatagtgaatttgaatgtgatgtctgtctctgtgctacaggttgcgagctttggagactacctgttgaactatgggatactgaccatgtcaattgataggagaaataggcataaagcacaagtgcagctcgccttggagcgtggtctgccagcgatgatcggagcactcggtgttcgcaggctgccttatccgacgaggtcgttcgacatggtgcactgcgcaggctgccttgttccggggaattctcatggtaggacatgaaagatacatactctgtgataattcttgatatcttgttgatcatgaaactcgtctccatgtatagcttttgattggttgcatatatcaatagctttgaaagttggcagatgttgtcatcagtgagaagaattattgtgtggtgaagtgctttagtttgttctcattcacctatagctgatttcagatgaactctacatgctggaaattgaccgtcttctccgacctggtggatattgggtattggctatgccaccaatcagctggaaaacacagtatgatgatttgaaccgtacagccaagggtatgccaggtgaacaattagctttggaagagatagtgaaaaaactttgctggtcgaaggtttcagagaacggtacaatcgcggtttggagaaagcctataaatcatattcaatgcgagcaagatgctaagctcttgaggtcaccaccgttctgtacaggagatgatgcagacagtgcttggtaaagttttcctttccaccttgtagctctgcacaattttattttctgttatctgatttgtgttaccatgacgtctgtctatttcctagtcatctattgctttcaggagaattgtccttgtaaatgttaattctgaaaatcagtatatagtatctggggtattttaggagagttaaaaatttgaccagatcaaagtttatcttaagttgcaccatgagtacgacgtccaagtaagagtattagcacagtaccagtgcacttcacaaggagcttactgctaaatttatgaaaataagaagagagaaattggttactgtagtagtatataactctatcgactatagattatattggagaattgcccattcaattcgtcagttatgtaaaactcattcataacaaatgcattttgattatattgcaggtatgtaaatacttcaatgtgcctaactcgtcttccaagagatattgctggtggtgctgtggagaagtggcctgaaaggctcactgccataccaccaaggatagccagtggagaaacaaaggggatgcccatacagacatacaaacttgacagtttggattggaataaaagagttgatttctacagaacatatttgaatttatctgatgggagttacaggaatgtcatggacatgaatgccggctttggtggctttgctgcggctatgtctgaatatcctgtttgggtcatgaatgtagttcctgcaaatctgacggacaatacacttggtatcatctatgagcgtggcttgataggaacatacatggactggtaagttacagatcagattttgaagcgttatttctacttttacactaaacataacagatagctcaccatcctgaatcaattttcttcttttcattgtcaggtgcgagtctttctctacttatccacgtacatatgatgtgctacatgccaatggagtattcagcctgtatatggacacgtaagtgacgactcctatcaagtagtaactcaaattgttctcgttctgagagaagatatcattcagaaaagagacatgacatgcattgctactctggcatgcaactcctctggctcgcttagcttgatagtgccaaaactaatctcaatgttaagacgtaccgattcctttacaccaatctttgtgttgttcaggtgtggcatcccttacatcatgctcgagatggatcgcattctccggccaggaggtgctgcgataatccgggacgcgcctgatgtggttcacaaggtgaaggatgctgcagacaggctacactggcacagcgaaatcgttgacactgagaatgggggcctggatcctgagaagcttctcatcgtggacaattctcttccattcccagatcaccctgcatgatgttgataatttccacatcttctctgatcatcatcttcagaatcagaaaagattgttcttggatgcttgtatacatgcacagatgaagagtataagaggactctacacgcaatagttacatatccagatgaccacatagccgaataatccaatgtatttgagctgtttactccactagacactgtcagattccaataaaccagtataggtaacttaatctcctgagctctgtgttgttcccagcatggtgttggatgtgcagagatgcaaccatgctcgattctgtagagatgtagtatctaattgctctgcatttgtatattgtatactagctgtgtattatcggtgagatttctgtgaaattccttcagagtttgccttgctttgcttgctaagcaatggcatgattcatgtatgatgatggaatctgtagcctctacagttttgctcaggtacttccaaatttttcaggctaaaggatgttcaaaagatgcctatgcttgtttgggatattgtacaagtaaagtgaagctgcagctgatcgaatatggacatgatattttcgcctctttattgaacattgaactgaaaagtttgagcttactacgatggcctctgctactactgccgaagtagtagcaacttggaatgactgaatagattaattaatagcaattagtactagcatgcaacatttttgcatgagaatctggaaaatgtattaatcttgtggaacacataatcccctttgctaatatgatgctggaaacatgtatatttatttggctatctatattcacaacacacaaggtaggttaccagtacagccaactgctactccagggccttgatccaagttaagcagctgaaatgtgtatacagtcagcagtcagcaccaggtgcttcccataattcatggctataatttatatacaatgaactggggtatttccttccaatatagtagtataacataaacttattattacatataaacgatacatatataatcaaaaggcaccactggttcaacgaaccacttacacttatatctctacgggtttctaaccagaaagcacactagttgctgttgttatttttcatagttgcacactagttggctataataataataataaatatagtggttggttttttacatagttgcaaacaagttgcctataatagtaatatagccaacacgcccctataataataatataccgagctaacactgcctgcttcttttgccacaaaacttgttcgagacttcctccacagtgagatccgcaaatttgtttgtacctagtgtgcatttgcagcaaccatattttttcacctgttcagcattgaacttttcgacatactggacagtagacttgaatacctcaaagcgataagccttctctgcctcgtctttgtaattacggttgaacttgttcatccactcttggaatctcaccttcagggcctgctcctcgtcttcagacaccttcttggagccctccatcctctcatcactgtcgcttgtcttcagatacttgaaagcttctgtaattatgaggtatagtagacatttcttgttaattatgaggaaacaaaaagagatttcacttcaggcaaagctgtccgtacctggttcccctgcagtgtttgtggttgccatatacacttccattgtgttaccaggccttaataatttgagttcacgttcccctaaaggcaccctgcaaaaggtaacgaaaatggaacatagttaaaacatgtagggtaatgagtgatgaaatgctagatttttttcttttgctctaacttttctgttcgtaaagttgattgcacagatcagaaaataatagacagagatatagtaacttcttttttcatatttttgctctagcttactgaatccttaatcgcttgggtctttaacgacgtgttggcttgttaagggcgttcgtaatggtaccggtagcaaataagggacagtttttgggtccgcttggcacaacttttcttaaaagctgcaattgatatttaaatttagaatttggttttaaaaattatttcttgaggttttcctttgccacttccattgcctagctctcttttcatgattgatatacatatgagtaaaacctacctaaaattagtcttaaaaaacacatcaaaatttgtcttttttaagaaaatgtgcttctaaaagttttccctccacaatatatatcttttgcctatataattaagttactctcctggttcagtgaagatctaaccatcatggcaataacttgtgggttgaagatggcgtgtgtgtatcacatcataacttagttgataatcattatatgacaataataggaacgccgaccaatgcttttagactcatggttattgcagggtcctcgaaagaaagaaagaaacatggtgtaatgaatggcagaagcacgtcggaagctattctccatggtttagcttatatgttctcaatattgcttacaaacagaaacatctcaataaataaaaataagtactatgctatgagaataatcaattctattgctaaatgcattctggaaaacatcaatcagatttattttagtaagtcatgcgcacaatctctctttctctgtggacattgtatatttgtttacattcgaccaagatactatctttcagttagcaggacatgaacattaaagggaaaaaaaaatcaatgcaatggaaagaatggaaccctgtgcttctgtacttgctgtttataataagtttaagattataaaaaaatcctgtcataaatagccacaatatcgtaattataatcacctaatcgcacagaccaatccaaatcatgacacatcaatacaagccatgacgaccggtggacaagtcaagtggcaggctattgtaccatcgttgattggtggactcataagcatcaattactactccctccgtccctaaatgtttgacgcctttgatttttttaaacaaatttgaccgttcatcttattcaaaaaatttaagtaattattaattcttttcctatcatttgatttattgttaaatatacttttatgtatacatataattttatatatttcacaaaagtttttgaataagacgaacggtcaaacatgtttaaaaaagttaacggcgtcaaacatttagggacggagggagtattatggctgtgtttagttcagcgcaaagtttggattttggttgaaattggagatgatgtgactgaaaagttacgtgtgcatgacaggttgatgtgatggaaaaagactgaagtttggatccaaactttagatctaaacacagcctatgtaaccataacattacataggaagagttgagatatcataacattttttactgaaaagactaggaaccaactgatcaatggtttaatagaacatgattgagcaaaatcatataggtttcacatcaatatttacttaatttgtgtaaattgtagttaagaaatatagcttcttttatttttaacagagtcagcaagaagggtaagtagtaccttagaaaagagccctgcagccttgtggttcttcctgcgttgtaagcacggccctgaaaatcatactctcagtaaagtaaaatcagtcaattgaacatttggagcgggtttgtgagagtaaataaataaaagaaggcatacatggaggagaagacttgctgctctgcgcagaatcctcatggagaaggataaggatggatgctagatgacctaacaagaagacgaattcaaagattcagggcctattcagactgtagtcaaaataaatattactaaatattgtcaaaattttagtaggattttttatatatttatcaattttaacaacaaactaaacgtagccaaaattttaacaactttataaaaaatagtatgattaaaaatagcatcaaagtgaacaggtctcaaataggaagggaaatcagattcgacttgacaaatgaacaaaataaacacgccctaccagcagcggagcggatttggttttcgagggaactctgaaaggcggcggcggcgatggaacacggaagacaggacgagtatatggatgagatatgggccttttagcaaagtgggcctttcctttaagagttataaaaggttcactttggatccctcaatttgtcaccgagttcgaaattcatccctggaccacaaaaccagatatagcgtattccccaacttagaaaaccaatgcaatgacaggtaagctcacacagaaaagtgacgtgtatatctttggagttacagtattctcttggaacttctgacagggagaaacccagtggaccatacaatgcctagagagggcagcagagtttggttagatgggtaatgttcacatctatttatttttcttgttagatttgcttgatcacatctgaatatctgatttaattaacaatgtcaacaactaaggggggtgttcagatcccggggtgtaaagttttggcgtgtcacatcggatatacgcacacacatttgaagtattaaacgtagactaataacaaaacaaattacatatttcatctgtaaactgcgagatgaatttattaagcctaattaatccgtcattagaaaatgtttactgtagcaacacattgtcaaatcatggagtaattaggtttaaaagatttgtctcgcaatttacaccaaactatgtaattagttatttttattgtctgtttaatactctatacatgtgtccaagtctctatctctctctatatatacacatgagtttgacgagtcatggcacaatccgagacgcacctgacctgatgtggttcttcacaaggtgaaggatgctgcagacaggctacattggcacagcgaaatcgttgataatgcttctcatcgtggacaattctcttccattcccagatcaccctgcatgatgttgatgatttccccgtcttctctgatcatcttcagagatattgttcttggatgcttgtacatgtacagatgaaggaagagtataagaggactctacacgcagtagttacatatccagatgaccacatagccgaataatccaatgtatttgagctgcttactccactagacactgtgtcaaattccaataaaccagtacaggtaacttaatctcctgtgctctgtgttgttggatgtgcagacatgcaaccaggctcgattctgtagagatgtatctaattgcgctgcatttgtatattgtatactagtagctgtgtattatctgtgagatttctgtgaaattcctgtcgggttcgccttgctttgctcgctaagcaatggcaatgattcatcattcatgtgtgatgatggaaaccggtgaaatgggttgcatgtacttgtcttctcttaatctcttcatctaccaatcgttggacgatgtgattgggtgatgttcttgcttgtcctttcgtcctctcaaaattccaatttttccccctttgcttcgtgcaaaggacatcataactggttttgttagacgcacacagtgctatacatctccattctccagttctctgctttgcttattctattacactccctccgtccctaaa

SEQ ID NO: 39088 - DNA, 7245 bp, Oryza sativa
tttcacaaaccccatgtagctttcatatatttttaggtaaaaatgtgtaaagattcaacccaccgttgttctagctgagctgttaggttgtgttttgaataacctgacgattcgttatcctgatcgacatgttattgatttaaaaggatctcacatactacaaaatatgcccgcccgcacataagtccattaaattacacgctcacacgtaacgaaatacatacaacctgtttggtttgggggaatttttgggagggattgagagtttagagatatgaggcaatttactgttttatttagttgggaaatgagaattttagtgggatagggattggaatggggaatttgggaaggaatttcctctttttcattttctgtgtaggaggtggtaattgggagggaatttctcatttactttacctaaacaaatcttaatcatccgtttttgttaataacctaatctctaactaaacccctatcaatttccaccacctctaccaaaaaaaattttaggattaaaattcaaattcctatcttaatctaaccatcaattttctaactcccaatccccttccatcaagttgccaaacgagccaatagtctattatagccacaacccaaccttttcttcttctttttccccctattttgatgaactaggtgaaaccccgcgcattgctgcgggaatttagtatgataacaataaaaataataacgtgtaaaataggtagataacatcagattaagtaaattaatatggtttataataatttaaatttaaatagtatgtagaatggtgattcaaatgtaaaaagtaaggtggtatgactttatggaagaagaaaagtagggagatagtttgaaccgtagattaatcatctaaaggctaaaaacaattgatgtgatataacttaattagaggaaaaaaggagaaagataatttggaccattaatcatttaagcactaactaagtgaggatgaactatataagtatataggatatcataaaacataataaaaatatacattgaaatattatgtgaattatgttggatgataatttaacatgtttgtatttgaaaagctcttaaattataaaaatacaaagatatagcatgtttgcatgatgtttaaatgtgatgattgttagtggatgatgatgtggcatatttgcatgttaagcttaaagagttagtggaggataactttatactaagataggataggtgacaaacaccatcaaacctcattcagttaatccttatcagggagagattggaggggatttattctacttctattgtggtgtagaattattcccccacaatcccctcgaaaccgaagaatgcctcgacgatattagtaatagcagggtttctagttgacagttgactcgttagtagctgacagcgggcccaccccgtgtgggacccaccgggcaggcacatctgatccaatcctaccagcttcttcggctcttcccataaactgcagagtactacgccgcgtcaaaacgcttagaaataggcagcagaaaaaaaaaaagaaaagaggaaaccgaactccgctataaaaccgcgcctccgccgcgacgaagccgaccaagtgaagcagcgccgccgccgccgacgacgacgacgacgacgacgaaaccgccggaggcagagaggagcagaggttacgcacacggtttcaggttcccccccctccctccctcccatgaaatccaacaccgttttcgagcttgatcgtctccgatttcgtttctgggcggcggcggagtactagtggagacgacgcggtttgtgtgggggatgggattcgtcggctcggcgctgcgctggggtgagtggatgtgggtgtaggctagtggggtgcgcgtgcgtgctagtttgattggtgttaggtgacgatttttttttttttttggatgcggcggtttgttaggcgcgtgggtttgtgttgtgcgaccatggtttggatctcggagctacgcatgcgtactgtttttgtgtttaggtttattggcaattatggctgcctcgtgagtactggctgtgttcgtgatgagataagttgattgaccagtttttcatgttgaatgaatgaaattgttttgagactttgtctttgagggtttatttgtttattgactatgtggtttatgttaccgacaccgtaaattctgtgtacagaaatctcatgtatgtgatgtatggaggtcaccatttttagccgagagagcaatttcatttttagacgatctggaattctctccttctgaatagcatcagcatcatagacgcccattgtggcagtacatatcctgaattcctgacgctgtatgtctctgctgacaatgtcttaataaggagcgaacggagaggattgcccactgaaatttattaagaatggggaacaatttaggctggaacattttacaaccggtctaaggacattgtctctgctgacaatctgatatatttcttggtaaaatttatgtgctgtacagactacaaggggtaaagtagtgagaagagatggtaaggtggcgccgctggatctgctgcaattgtcaagtgaacgagtctgatcagcttgaaaatggacatgccaaggtcctgactagtaatgcagatggtatgcttctttgaccttgcttgtgttctctatttatatttcttagtcctgcagtgtcacttcattgattgaaaacttaaaactccgtttctgattgttcacctttctacatttttttctccttttccaggagtgacaaagggtttgaaagattctgctactgaaaaagctcagccacaaaattcggctctcactatcaatattcctgttctatccttggacgaactagtagaaaagacagatgattttggctcaagtgctttgataggcgaaggttcttatggtagagtgtactacgctgttcttgacagtggaacaaaaattgcagtgaagaaacttgattctaatgaaaatgagcccacttcagaattcttgacccaggttgacttgcttttagagatatgaattattattatttggttatagcattaatgcatttctacagatggaggatcctaaacaacactgcttattttctgatgctaggtcgctttggtttcaagattgaaacatgaaaactttgtagatatgttgggatactgcacggagggtaaccttcgcctagtagcatatgaatttgccactatgggttcactgcatgatgttctacatggtatggttcggcatatccatcatgttctccagtttgactaactttactactgtttttgggtagctgggaacgggtgctgtatagctgcagcagaagcagatcaattgttgatatatcttttttaactttgtgtaacaggaagaaaaggggtgcaaggtgcacaacctggtccagcacttgattggatgcaacgagtaagaatagctgttgatgctgccaaaggacttgaatatctacatgagaaggttcagccctccattgttcatagggatattagatcaagtaacatactcttatttgaagacttcaaggcaaaagttgcagacttcaatctctcaaatcaggctccagatatggctgctcgtctgcattctactcgtgtactgggaacctttggttatcatgctccagagtaaaaattcttaccatattctgtgatgaactttattttactgttcaattgtagtttctttatagcattacttcttcaattaactttggaaaggaccagtatacaatgtgattattatagtttgttgaaaaggatccaataagttctatttattcataggcacatttaggactcctgcagtgaaagaaactggtcttactctacgatatttcttactttgtggcactttctacatataggtttttatgcctgggttgctgtagagcccattattgcctctatatgacattttctgatgaataatcaagatatatatgtaacactgtttttatgcttgaaatgatatcattatctgacccaatatgtgaactttgcaggtatgcaatgaccggtcagctgacacagaaaagtgatgtgtatagcttcggagttgttctcttggaacttctgacaggaagaaaaccagtagatcatacaatgcctagagggcagcagagcttggttacatgggtaatgttcaccatatagtttactcatttatcttgtcgttaagttcagatcacatctgaatatctgatttagcagcttatagtgtctacagttaacaccttgattagtacaatgtagcaatacgcagcccaatcctttagtggctactttttacctagttctctgagcatgtctcagttctgttttgcaggctacaccaagattaactgaagataaggtgaagcagtgtatagatccacggttgaatggtgaatacccaccaaaaggagttgccaaggtctcgatctctatacatgcacacaatatttatacacatgagtcatgatagtcatcctttccttctcttttcccccacatttctcactactgcactttctcgatgcagcttgcagcggttgcagcattgtgcgtacaatacgaagctgagtttcgcccaaacatgagcattgtggtgaaggctttatctccactgctcacaagtaagccgactccacccgcgcctccaccagctctggacggttgatgtacagaatcatcagagaagaaataacaactaagaccatataagcttctaagggtcagggactattgtttttcctgcttggtcattttgcatggcataccacagaatggagctacttgcttattgcttctcggaattcaggctaactgcatggagaatgtgttttgccttttgaaggaacacgatccgagcacaataacatacttaatttttgcagacggtgtctaacaatcgggattgcattgcatatactgtcattctgggccaaccataggatttgcaagtatttaggtgcctgtttacagaagattagacgatggcttgtgttctagtagtcgtttattcagtgaactagagatgatgtactgctgaatactgatgatgttctttgattcaaatagtatcgctgttacttgtgttgctttaccgttcgttcaagtcttgggagataaatcaaattagtcaccacatgttgctactgctaagttgagggatactttcagagaaaactcattagcgcatgtttaattattaattattataaaattaaaaatagatttatttgattttttaaacaattctacatagaaactgtgtaaaaatatatcatttaacaatttgaaaaacttgctaacggaaaatgaggaactcaaagcttagagttgagaaaaaaaactggccctagctgctagcccatggaatatggttaagaaacgtgcacgattctgtacgattgtgtgcatcttgtaagcagtcacgttaaaaagaatattttgtatatatgagacttgacttaaaagacacattccaagttaaatgcagagcttaaggtttgttaagccaaaaacgaccttaacaaagtacttactgagttactgtagagctgattaaacattagcacgaagcagaccaccccagatgcacatatattcttgctacaagatcattaatacctaacttatgaaaaaaaaaactctattctatgccactagtatataccaagttctagctcaacgatttatcgacttcattaatcatttctataacatatctaaagtttacacatacaatttagatttaaattcaaatcacccggcaaaaagatttaaattcaaatctaaatatttttaagttaaatgttttaatattaaaaatttgtacgtataaacttttctggtccgcgctcgaacgcttgccctttacacccaggcaggatgctcgaaaaacacatttaatccatccataaaggacgagcctttctcagcaaatcagtcggctcttgtcatgcaacaactgtacagtaagtacagcacggaacagcatctgtttaaattactatgcaagacttgcaagggaacatattgctgctgctatctacaaaaccaacacaaacgaatggaatggatgaatgctgcttcgattcaagctttgtaagtgtgatctcatcacacgcaacaacgctgaaggtatccttcatccccccgctactctatatcagtaaactcacacgattcggttgcgccactgaattagatatgcagaggtgttcttgccacagttaactcaaaatggcgaacattaggtcaaaaagaaggctatgaacaccattataagctttcaactctctacttctctaatgaggactgtgttggtaagatgtatgctgcttctccttggtgtggaaccaagctgaattgtatcagttggcagctctgtcagaaatgtgagctagttaggagagacgtaactaaatcaaaggatagaatgagattaagattatactggactttcttcgcaaaaaaaaaaagagattatactggaattacactgtgccaagaagaaaacctcaggaatagaggatcaaacaggaagaagtggctgcctctcatcagtaccgtgcctgtgtttagcctgcattgtatagatccaatgatttgtatccaaagaaaaacaggggcagttttgaatttgatgtgaatagttacctcagtagcaatagaatcagacacgttgacgactacagattccttcgatctgaggaacaaggcatccatcaaaccaaatatattactagacaatcatggaaatagcaaatggatttctactgatgatagaccacggcatggaaaagtgacaaactacaatgttctatagtgttaagaatccaaacctgtgctcatgagcatcacccatctcaattttactgctcggaacttcatccttaatttggttcgagagatactgaaacaaaaacaccagaaacatgtaaaatcactgaaagagtcagtactaattgactagacaggaaaaaagaaaggttacctgatgcatagatataattactattgatattgcaagaacaaaatttatggtcagagtatgaccaaacaacacagcagatgctactccagtaaagattgtggcgattgttgatgagtacttcttcaatattgtatctgcagtcagcattaatgtgttttaaatgaactgcagtacaattaccaaaactggcatattaaaacaaaaactcataaaagcagaattag

SEQ ID NO: 39089 - DNA, 856 bp, Oryza sativa
gaaaaccaaaagcgttttgagtaaattccagtacggtaatctcagaagtcggcatatccttattgtcaaatgcattgacattgtcatggacaatggcactcaactcccctttcatatcatccactgcttgtgcagaaactggatcagagctatccagaaccacatctggaccaggcatgtcatctagcacaaacagaggtgtatttgtatttgtgctcctctgcagatcagctggaacatcttgaagatattccttatcaagtgaatcaacttgagcactgtcacccatattagtggttgctttctcaacaactgcagtttctttctcattatcagttaattgttcagttactccttcaacattgttaacctgtttgtcagatggcatgtgtgaatcaaaatcagttctagtatctgctgcatcagttgcttcaggatgcatcgcatctgactcagctccatctggtagcactacatgatcttggtgatttccactgtcctttgcgccagaggtgccaacatcattgctgccatctgccatagtttgggacatgtctagccgtacatgtatttccatattatgaatggtgggatgagcaacaatctcataggtccgatattgcaaatcgtttagctccttgcacatgcctagttgggaacacaaacatgcatcagtagaatttcagagcataaaactaaccactaattatcctcatatatcaaaactaatttcacttctgtttcagttctttcctaattgaattgaacatacagtaaatgtgtaaagaggaagcagagaataaaaaccaatttaagtagcttacaggaaaagatgggctcatggaatatatcatct

SEQ ID NO: 39090 - DNA, 12341 bp, Oryza sativa
  unsure (1)..(12341): unsure at all n locations
catggcataattggtatgctgttcacattgcaggattttggcagtgcgattcaaggtgttgacacaggtattgccttttgttctgatacataagtgtaaactagtgtagtagtgttctaatataatgtggattatgtgtacaatgctttgtaggtgcagcagaaaactagctaaatacccatgcacagattttctaataaatatatcatcagttcgaaactcaaaaagtgagcatatttatcctgagaatcatatgtaatttgcaagacgcatattacaatgtcaaaataaaaacaatcttattacaagacgcatgctcagatattctaattattcacagaagggtcaggctgactcaagaagtggcggtgggatttcagactcaccataaccaccattcctaggttcttttgtattagtagaaataaacatgacattaaccttcatgactagtgcaatatccgttcttaattgtattttatatgcaaattttgtgatgggaacttccacacgcccgtatgtgacactggtggatcttactgttctagtgttgcatcgcgagaggtttataagttttatgacttgtgtcatatttgtactctacactttcagattttctgatgtatgatgatgaggtggactgtgatgaggctaatgatgatgagcctaatcctgaggaattccagtctcttgataacagtggatggtcttcacgtactaggtacgattggatttcgtgataatattctcagggtttaatgctcaatatttttttgagttctataatgagttgttacaattgctcttcaggggtgttgcaagatatctcaaaactttatttgatgaggaatctggtctgggaagaaagagtgtggccattgatcatctgttaagtggaaagactaggaaagaagcatcaaggatgttttttgagacattggtaagacggttatgcttttctgtttctccactcaagaaatggaatacctaccttcagctccagtgtgattggaggcacctagaattgcatgatcaagaatacgccattcattttatattgcatgtttcgattagccatcttctcattagacaatcttactggcatcaaccaatttctgtagtcattgtcaaactagacctgcaatggtagcttaaattgttttctcgaatcatttctgttgacattatccttggtacttattgtgttctgttccattcacaggttctgacaacaaaggacttcataagtgtggatcaaccaaactcctttgattttgtcagcgttaagccagggccaaagctcctgaagtcagatttctagatcaaaaaccagctagcgtggcgcgatacatacaatcttaccatatctgtcacattaccaacaacatacagatctcgcatcgccgtgaccgtcatttttgttttgttctttttaatttatcctccctctgtagtatccccgcactaatctgtgtttactaggcttcttgggtaggattctgttgtacccccctccgtgttggctattcagtgtatatatgattagctcttgtaaagttgcttgtgtaatgtgatagcatcagctcctaagtccccgtctattgttgctttgaataaaccttcaaacctgtatacttctctgactttgagcaacctgtcgattaatttcaaatttattcagattcgtaggtcaatcgtgagaaaagagataacctttttttgtttgttttgcctgaagtggaggggaaaggttgctcaaaattctgtattggtattatatcattacaaccactctgctggtgatccgagtcaccagcatgaacgtctgagtgaccattgagcaatgtggggcgtgtgattaaagcagctttgatccctttctagcacatacgtaaagtgacacgctgctgtgtgctctcgctattcgcagaaaatgtaaaagcatcagcaaatgcaagacagaattggcagagaataaggtgtttggaaaatggaaattcttggaaggatgacaagtattaatcgacggccaaaaggacaggggaaagccgaccagaaatgaagaacggagcagcgaatgtcggtgccgaaattgtttttatctgcacggttagcacagggttttcgtgtcgcgcgtctcactagctcactgctcatgaaagactgaagtgaagcctagcaagcattgccacctgacgagtgacgaccatactttgatcgatggatggatgtatgggcgccgcaaggcagtttgtcccattgtccggcattgctgccgattcctttgcctcgtgcgcgcggcatcctccaccaacaacgtccgcacgaattccacgcccaaacaccggcaattcccgtgcaaaatcacgcgacacatctccgcgaactcaacgccacgcacgcgcgcggacgcaaagccgcgcgcgcgagccacgccgttgccttgccaccacggcgattttcatggcgtcgtgcgcgcgagatgccgagatccgcctcgcgtgcccagcgccatcctgtcggctacagtacgccgatcagtggagttcccatgggttgatcagacggacggcgagcccgtgcgtgaacagtagggtgacaagccacacccagccagtcagccacacgaagtggcatatatctcgagctatagcctgacctgacctgctgtttagcttgttactacctgtagcgcctcggctctcaccaagcaagtgtcggtgcattgtttttttttcccttcttcctctctcaaaatataagagtttttatccagatgtgacatatcatagcacaacgaatctagacagagattatatcccgatttattgtattaggatatgtcacatctaataaaaaaatcttatatttatagacggaaggagtacctgttattcattaccattagtagtacaactcgattggttattatttcttccatgagaaatgtcctatatatatagctagtttggaaaatgtttgcttaaattggaaatatgagattagcttaattatgtgatcaaaatcgatgccctttgatctagaggtgtatatatatgtacatatgtgtaagcatgattaggcgaagaaagttcaagtgtgaggtgtaacctgttatcttattcggcggatgcatgaggcgcacatggcatgtgacgccgtacgccgatgttggttgatgcacactagcatggatgatgtgtgcattgtcctcattcctcctccattatatggctagctcttcacaatgattaacaaataattaagctataagcacgtccctcgtctctcaattccttccgatctgagcattttgtcaccacttccctgttccgtctaatttaatgacctaatccaagaccgtatctgggttagaaaccaacaatctcaacgtttcctctcaccttaaaagggtactagtacaacgatgtaaaattgtggtactactacctcttttcctgtcgtcaaaagggagatttttacattaattcccttctcctgtcgatcatccaactcatcaactacttttgacctaatattttccctttttttctctctttttttttccaatgtgcttgcattacatgattacatccatgaaggttgggctgtctgtacggcactcattcattcgttcctctcacaaacactgaagcctgaaaacgattgagaagcaacacaagctactcctagctaggaaggcatgcagacctaacataatccagcatcacttagtgggtctaataaaaaagaaacaaatccaacaagcaaacaaccatgcataacaaaatgctcattgccaccacaactgctctaatctcactgtctctctctttctctcctttctgcactctgtttgcttacaacacaagaagaggaggagggtttcggttcagcagtcggcatcaggctccatgcagagacatggatggatccatccactgtgaaaagggtagtatcgctttgtgattaaagagagcaggaacaaaagggcctgcgaaagctggcccagaaagtgccgatcgaatagattctgtcattaccagcagcggagtatcttcctgcagacatctcacatttgcatgccttctctggaaaagggcacgcgagtttgcatcgtcactgaacagctcgaggtttaccaaaccgttttgagtagggttatcgtcacctacggttttacggttatcgtggtaaccacgtggttatcgcggtaaccacgcggttatcacgatactttggttttaaaaattgaaaaggtggttttgtaaactctgcacagctcataacattgctggcttctccagcctctagtgtcgttgtcaacaagaacaacgaggttgattctgatttctgaaatgtgaagttgggtagtaacagcgaatcagcgatctgacatgcttgctcacttccatggtgattttctgagccaaaaaagagtgaactggaagacagagcgcccaatgcaaatagttgcagttttccgcgtagttaagagggtgtttgggaactagggactaaactttatccccactttagtccctccaaccagacaccacctaaattctgttgtgggggaacctagaggagcaagcaggagtgactcgtgagcaccgaaggttccaatgtaccagagttgcatgcatcggccggcgtccagaagcaaagacgatcgatcggctagaaaaattgaagttcaccgaaaccgatggccgttccatccaccacccggagcgccagaatttttcgtggttagcaccgtgaagaaaaaaaggagaagaaaacagtcacacggcgcagagcgacatgcgtccactcccccggcccgcggtgctctgcacctctgctcggcttcggcgaaggaagtcgcggtcggtcggttgccgccccacgtcgatcgcgcggagaaagaggcggaatcgcacggagaaattgcctccggatcacggtgttctcctcctgccccatcccgcacgcgcgcgtcgcgtcgcccagttggttcggttgatcacctgttggatgcggtgcggtttggtgagttggcctcgcgcgcatgagttgcatcgcacgcgcgttggctgacctagtgacctgacctgctgcgcgcgtgccatcgacttggtagcagttagctactactccgtgcgccgtgcatgcacgccaaggaataatgcatagggaagggaagggaagggaaggctgcaggctgtttgcggtgtattccctctgtccctataaaatatgaatctaggatcaaatatatttagatttatagtttaaaatatgtaatgtaggttagttttttttaaaacggaggaaatatgttttagacctaacgaagtataatagactgtaccggccggccggccctgcagctcacgaattgtactagtacgtgacatacgtgacaggaaagagatctacactccgtatatcgatatcataccaatcgtacacaggtaaaaattctgtatagtagattagtactactaccgagtagtctagtacatggtgccgtcctgcggatcgagcacggcactcgtcaacgtttatctcgagtccacatcgatatttctgacacaccaagcatagagcttactaatttaattactggtctctaggtgcagagacacagatcgatggagattaatccgtctgacctccgcggatcgatcggccttcgcgtacgacgcagcgaggagagaatcacacgggaaacttctgcggatgacggcatttcttccgtgagctaggctccggcaacagcaagtcggcaacagtgttaaactactcgttatacagtacacaacgggagtgagccaagtgaaggctgtgcctatccaccgccttgcagatcgatcgatcgatcgatcgaacgcggttaatttgtactcaagcctccaggtttacctgcagtctactactacgagaccgcatctgacaaagactagtactgtacgagcttactttactcatctcgaggctgcaaacttaacctctgagggacagaaagatagcagcgattagtttagtactagtactactccatagcaaagctaatactgcaacagtaatagtataatcaactagtgctaataatgcaccgtgctgatgatgtcacccagattagcctagctgaataattttccgtcatattatctgaacgccacgcaacgtgtcccgtcgacgcctgcgtagtacacacacaagacaagacagctctctcaggtcgccatggcgatcaccggccatggccatcatcggtctcttgactctcgagcagccgacatggctatgcacagcacagcacacagtgtcactgatctgtttgaaatttgtacgtacgtgcagtgccattgggtgtgtacgttgctgcaattaacggtcgggagtcaaaggcgagaagaagaagaagaagaagaagaagcgagaaaagccatctgacaaagacgatgatactgctgctttaggtgagtaaacccacatcattaagcagcttaatgaatgctctatctaacatgattattatctcatctcgtggcctgataaagtgagagacgaaagtcacatatactactagcagtattatgtgtgcgtgtcagtgtcaagagttatcatgctttagccggtaagagtggctatcttcgctagctacatgtatgcaagtatcatcaagctaatagagtttatatatattgctctagctagctggtccgtcaggtaggtcaagtgtcccaagcgtacgtacgccatagatgtgctcgtgcggcgaggtcgacgcacggccgtgtcgcgctccatcgttattatagatgcaccatcatatctctcgtctatttctccggcgatatgatgcgaccaccatcatcgagccccatatttccatcagattaagcagaccaaggcagcctgatgaacttgattagaggcaattacaaatttatcactgctttgaatcgttattgtaagactgccactagaaaattataaaagtactactagaactgtcattcaaatgacatccttacaaaattaaaaataaatgatagtaaatttgcaaatgtcccgattgattaggagtactaagtaacatcagaatttctgtacgtgctactgtgcatagctacactactgccttggtcattcactcattcacaatgcaattaaaagagtacttttccatattaaaataaattaacttcatatcagacatgataattctactactacgaatctaactaataaacacgactcgtcctagggttgtgttcgcttgaggaggatagaaatgcgcacggaaaatggagtagtccattagcgcgcgattaaataagtactagctattttttttttctaaaagtggatcaatatgaatttttaaacaactttcgtatagaaactttaaaaaaacgtaccgtttaacggtttgaaaaacgtgcgcgtggaaaacgagacgggagtcttgcaaacacagcctaggtttatttaacggcgccccgacctgcctcctccggtcctgcacggtagcctggtatgcacgggcacggcaattcaatgcacgcatccataatagatcgatcgccggcgcgggccacgcacgcacggcggcggcgtttacgccatatactacctcgagtgaaggtggaagaatcgcgtacatggggatcggatcgcctggatggtttgtgaaatccacgggagagtacgtactctatctactgtacagaccgcgacgccgacgcgtccgggctttttggcattggcaggcggacgcacgcagacgcagggcatgggttgatggagtacgtgagattcacacgcagacgcacgcggctccggcctttttttctcacgcgtcccacgttggggggctctgggacgttggactgccaacggatcccttctgtgccgcttgtgatggctgactgccgaggttttcattgccagtaacatctcactcacacactgcagtcgctgattaaatttacccaaaatttactacgagtactacagtaccacgacgactaataacaagtggaccagcaaggaccgtacaatgtaaatggagggggtaaaatcttgagtaattagatgaagaggagtggctatagctcgtggagtagtgtatgtgactggaccattgtatcatatcatccagtaacaaaaaaaaggaccatccggtttgtttgagtgtttcctcacgaactcgatggatccagccacagtcaaagctttcggctttcgtttgcatgcatgcatgcttgctcgatcgatcagctcgctacttactggataccaacacgtctcatgtgtctgccctgatttctagccggctgtttcttcgtaccctagctggaaatcagatgagctcatcatcctcaccgactaattatactcgcttccatcgcacatcaatttgcggcgacgatctgaaactgaaagtaccaattaattaacaacctatacatcatttatatgagtatattcctacgtgtgattgcatatttgtatatatattcagttgctaactcagaacgcaagcacgcttctagccaacaaaccgaaagaacacctaacatttggagacatctgaaccaaaaacgagctcaattttttacactccttaatatatataccactgatcattcagtccccactctaaattatatatataaaaaaacagttcttttcagagtacaaaatacagttgagttactagtagcattctgctcgtgcttgtgcttctccttccacactttgcctatgctctctcacttgtcttgcactcttctccaactaccctcttcatctccacattattaaacagcccaaaaaacggacaaagaatgagaacaaaaccaagcaagccatcaaccaccacctctctccctctccctaattaatatcttcacccttcactaatcacctaccctcatagtgacccttacttagctaattgcctaatcacaattagaaaaagaaacaaaaaaagcaaaaaaaaaatcatcaaaaagcagccaaaatactcctcctccatgtaagctgtatccaccacgacgacgtccactcctcttcttcctcctctcctcctctctctctcttctttctctctcctcgcgagatctgtggcgtcactgacctagcttgttcttgctagctgctgctgctgcttcggcggtggcggtgtgtgtggcaatgccgtctctccggcgattcttggagttggtggtggttgggattgttgtgtgtggtgtcaatggcgggagtgatggtttggaggttgcggtggcgaggaggcagctgcaccagccgttcttcccggatcagtcgtcgtcgccgccgacgccggcgccggccggccccgctccgccgttcttcccggcgctgccggtgccgccgccgccgccggcgacggcggggcaggagcagccgacgtaccccgccctcgtgctgcccaacaccggcgccggtggcgcggcggcgacggccgctccggatggaggtggtggtggtggtggtggtgcgagtaagtccaagagcagcgcgtcgaagcttgtccctgcgattgtgctgccgctgctcacggtggccgtgctcgggctgtccatcgcgttcttcttcacgcaccggcgtgggaatgcggcgcacgtttgaggaggaggcggcgggtgcgtcggtggcgggtacgccaagttcttgcacccggagagggcgagcctcttcgcgcgcgacgagttcggcgggagcggcggcgccgccgagccgccggccgcggcgatggattaccgctacgtggggaacgccggcatcgggcggatggacgagaagagcagcgagacgacgtcgtcgggcgacgaggcgtcccggagcaccggcggatcgccggagctccgcccgctgccgccgctgctggcgcggcaatgcgggccgatgggcgcgaggagccccggcagcggcgtcggcgggttcgcgtcgccgtcgtccggcgacgaggaattctactcgccgcaaggatcatccaagatgtcgacctcgcacagaacgctcgccgccgcggtcgaagccgctgtggccgcgcgcgaccgctccaagagcccctcgcccggctcgatcgtgagcacgccgtcgtacccgtcctcgcccggcgcgacgatgtccccggcgcccgcctcgccgcctctcttctccagccccggccagtcgggccgccgctccgtcaagtcaagatccgatagcgtgcgcaccttcggccaaccaccggcgcctccaccaccacctcccttcgcgccgacgctgccaccgcagcctccgcctcgccggaaaccgccgtcgccatcaccgccctcctccccactcatcgagaacacgtcggcgctcagatccaccaccaccaccgacaccaccatcccaagaaacccattcgtacaaccaccacccccaccgacacacacccacggaccaccaccgccgccgccgccgccgcctccgccgccggtgggctactgggagagccgcgtgcggaagcctggcaccggaacgtccaaagaaacccggtccccggcgctgtcgccgccgccgcaggccgccagcttcaagagcggtctacccaccgacgcgttccccggccgcctcgcggacaatgcggaccacgccgccgccgccgcggccggcggcggcggcgacaagtcggaggagacgacgccgcggccgaagctgaagccgctgcactgggacaaggtccgggcaagctccgaccgcgtcatggtgtgggatcagctcaaatccagctcgttccagtgagaactccacccaaattcacaaccttattcagttcttgatctgtttttctttttgtctaaatcattttgtggtgaattctttgcagggtgaatgaggagatgatcgagacattgttcatctgcaatccggcgaactcggcgccaccgaaggagccagcaacgaggaggccggtgctgccgacgcccaagacggacaacaaggtgcttgatccaaagaagtcgcagaacatcgccatcttgctgcgagctctgaatgtatccaaggagcaggtctgcgacgcgctctgcgaaggtgaagaacatgatctttctcttaacttactcatcacaattttgccagtttctgatgaactgcatactgcattgagttggggatttttttgagatgtttgcagcagtatctgaattgatgataccttctaactaattggattcatttttctcgtggttcttggttgaacacacatggagcttgtgaatcgagatgtttgtccgtagaatttggttgggctttaaatacattgtctgaagaagtgaatgccagcatacacccgttggtggtcgttgctgaatttagccgtttttaagctgaaactgactagtaattgcttctggatgactgaattaggtgcatagagttatacctgcggtgaagatggttagagataccattgttctgatgtgaaaaccagtctttcgatctactagtattactaccgtagttgcttgatatagtattactacttctctgcacatagtcttgacttgggtgcaaataattgcaagatagttgcattattgcaccaagtttctagtcaagtcaatgagattgatccttcctatagtattatccttactaacgtggtaccaattcactgagcaggtaacacagagaactttggagcagaattgttggagaccttgctaaagatggctcctaccaaggaagaggagatcaaattgagagaattcaaagaggagacatctcctattaagcttggtcctgctgagaaattccttaaggcagtccttgatatcccatttgctttcaaaagagtagacgcaatgctttacattgctaactttgaatcagaggttaattacctgaagaagtcctttgagacccttgaggtgagaattatcgtttccgagtttcctttcatacttattattatattgacatcttacctataactaagtacatgaaacttttcttaacagactgcttgtgacgagcttagaaacagcaggctgtttctgaagctacttgaagctgtcctgaagactggcaacaggatgaatgttggaacaaatcgcggcgatgcacacgcgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 39091 - DNA, 1129 bp, Oryza sativa; identical to SEQ ID NO: 22896

SEQ ID NO: 39092 - DNA, 746 bp, Oryza sativa
ctttcatctaactgcccttcaagctcccaaatgggtaatcagcagaatagatcgttaccgcagatccttcttatggaagggagaagacccagacaaaacaaatccgggaagtagcttggttaattggggtacagtctgtagacctaaatttttaggaggccttggaattccagaccttgagaaattttctcgcgctctaagactacggtggctctggttcaaatggaaagaggacaacaagccttgggttggaatggatttaccttgtgatgactgcgacaaaagactcttttaggctgccactacgataactgtgggtaatgaagaaaaaacaaattttggcatgataaatggctgcaaaatacatgtccaaaagacattgcacccttgtgtttcaacctagctaagcgcaaacagagatcggttaaaccggaattgacaaacaattcttggctcctttcctttcggcaaataactacaattgaagaaattagcgatcttgtccagcttgggggaatgctgcaaaatgttcagcttctaccgcaaaccaatgacgacatcacttggaacctgaatgaatcgggatcctactttgcaaacagtgcttatttatttcagttccaagggtccttctctccgattgattttcattccatttggaggtgcccagctgaaccaaagatgcgcttctttggatggctaatccttcactaaaaaactctcacggcccaaaatcttttgcaccg

SEQ ID NO: 39093 - DNA, 734 bp, Oryza sativa
tcgatgattggcttactaacgagaattcactttgaacagaatgagttgtggtagtgactagagagaatagtcaattttgtccctctaagtttcacttaagggctattttgacagttggttataagactttctagcattatccatatttatataaatgttaatgaatctaggcacatatatatctagattcattaacatttatatgaatatggacaatgatagaaagtcttataatatgaaatggagtaagtaacgctttattttgtacagttcagtgcttaaagcttgcattttgggtcaacgtggtaattggatgaacctaatatgctacaatacgaacataactcaagaaaagtttagccttgtgtatcgtgtgtcttgccggcgagcatctttccacatacagagagagcttgagatcgcaccctaagcccccggccgaaccggcaaaggggggcctgcgcggtctcccggtgaggagccacgagctccgtcaatatgtaataaacactagcccaagatgcaattcactctttaaatagtttcataaaaaaaatcaaaacatcgttatataatataatatgaaaagagaaatatatgtattaacaaggtaaatctttcgtctacttcctttcataaaaagagtcgatctacgtagtgatggcaactcacctagaacaacgagtcttaacaatgaagtagatctttagactccaagagaggaagcaaactta

SEQ ID NO: 39094 - DNA, 17013 bp, Oryza sativa
aaatacatttttgagtccccgaactggttatgagtgtcatgtaggtctaacggactccaacccgctccgtgagatgacgtggcatgccacggtgacacgtgttaatgggatccacatgtcattcgcataaaaaaataaaatttaaaaagaaaggagagagagatgagaaaaggatgtttttaattttgaaaaaataaatgaaaaaagagaggaaaaaattgttcttaattttttctatatatgattgacatataggttctactgacacatgtgccaccatggcatgccacatcagcacacggtgtgagttggagcccatttagacctatatgacaccctaaacaagttaaggggcccaaaaatgcattttgagagttcagggatctaggtgacacatctgcacaaatttagagaccgctcgtgcactttattaaaaaaaaaggtctttgtctacatgtatattgctttctataagatgcatgtatataagtatattgatgctgttatcatggcaatgttatcatggcaaatagacagtttatactacctcctcaaaaagacagtttatactacctcctcaaaatataagaaatttttactatgcatttgtgttgataaatttgcttatattttaagacggaagtgattttgactatcatttgtattgttaagattgcttactctttccgattttataattcttgatattttggacaataacagtctccagaatatatatttgactgtattttttctattataatatatacaataaataaatatatatttacttttattatagcactccctctatcccaatttgaatatcacctaagcaaacacacagagaccaaggacaacaaaaacttcactattatgaaattaatcatcatcagtcaaggtgctatgttgtttcgtgtctcatagattgcatcacgttttatatattgaatggagtttcaccaatcctatcttctatatagttggtacccattaaagggcatttactcctataaagtaagacatgcaagaagccacatcatcaacaattttaagccatcacatcatattagtataaagataacaaccgttggatcaagaagctacttattcttccaattcaatcatttattatttatccattcacctcattttgctctacttcatagtcacacatagcactgttacatattttatgcataacaccatgttttcctaatacaattcaaattattgtttaatatgtgtgttttgttttattatgcatgacaagatagcatataattattaggtatcgttacctgaatctatttttagaaaaaaaaaacttgagtgaagtagagagatgcaaattgtctaactacaacgatacccatatattacgcatgaaattcatatattataacaatgcacaatgacgcatggaaaaataaagcatgaattatattgtaataacataaggcatatataaatccacattatcatatagtttgtatgtatatagagttgtaccttaactatttaaaactatgattttgtttgatgataaactacaaaacccgcggcaaagatgtgggatgccaactagtataaattaatattggttgattgcatgtagcacattcaataatgctcatttactatttgcacaaataaacgaaaagacactttgttagaggatggtcatttaggaagaccttaaaaatcttatatgatgatcaataggggcggaactaggcctcgggcagctcgggccatggcctgaggcctatgatgcaatcccactatgaagtttgtttttccacggaataagtcaactttgactatctacatggaataagttaactttgactatctaaaaagtgaccctaatctaatccatgaccctaaaccgcaaaaccggatatctcgacccccgaacttttgaaactggtacaatttgactcccttaacggttttgctgacgtggcgcctacgtggcggtattgaccgggtcttttttacacgtgacattgacatggcgcttaagtggcattagaattaaaaaaataattcatttatcattcacacaaaggatggcatgcggaacccactgacatgtggggctcacatgtcatcctctctcctccctctctctctcccttccctcattcagcaagtctgccacaatcctcttcctggtggtaaccacgatcttactcccagctcgaccaaatctgaggggagctaacacatcagtccacatatccctgtacgaattctcattctcatctttattccagacattctcaagaatcagcaagaaccggcgcgacgagacattctcaaaaaaatgatagccgcgacggggatggtgtcagaagcggcgctccgatcctcgccttcggtcgtgctaccgactagccaagacaccaattattgctcatgccccttgtcacgcccaaacacctcagcatcctccagaatcgagccggtgatcaccggaccatccgaggttaggagggtgctgctcgactcgccggaccctggcttggtcagccccgccgcctgcatcagccgcccggagctcgcgcggatgtccttcagtttctggacgacggccttaagcctattgaccgactcgtccttgccaacgagctgcatgcttgccgatcttgccaatggatgaagatcctagtaggctgaccttgccgtcgttgcgggagaccgcagaagggcagcggcgggcaagcggagacggcggcgagcgggggagatgcgggcatggcggggagtgaagacggcggcatccggcggtggccgccatggaaagggcgaggtcggggatctccccgacaacgtccgccgccgccgccgccctcctacagctggatcaacggccgctgccaccgccgtcgccatggcgtgcaggccggcaattcggatcctttgcattagaggtactaatgcagaggatgaacagtaccgcacattaggggtactgtagaccgtccaatcgagaatggaaggatatcctgtagctatagtaaatagccactgtttatgtccttagatcgctgttcccctcacatggacagtgcttccctgcagtactgtaggcgatccggatccgcaggtcggccgtgtgctccgcctccgccctcgcgccgctgcctcctcccattgggagagaaagagaaagaagggagagagagaggaggaaaaatgaaggacacagggaggactgccatgtgggcaccacatgtcggtgggcccacatttctctttttgagtgactaatgaatcctatgcatattttttaattctaatgccacttaagcatcacgtcatcgccacgtgtaaagaagacccggtcaataccgccacgtaagtgccacatcagcaaaaccgccctccaaaaccgcctagagagttaaattgcaccggtttcaatagttcggggtcgagttatccggttttgcggtttagggttatggattagattcgggtcacttttaaagggtcaaagtgaacttattccgttttccaccatgtaattgatattggaaaaagtccatttagactcccttaattgttcaccgaatttaattcgtgacccttaactggaaaaccagataggatgactcctcgaattattggaaccagtgcaatttgactccttcagtggttttgaagggcggttttgcggacgtggcgctgacgtggcgataccaacccggtcttcattctacgtggcgctgacgtggcgatactaacccggtcttcattccgcgtggcgcctacatggcactagaattaaaatatatccgtggaacccatctatcattcacacataaaatatatcatgggacccaccgacatatggggccacatatcatcctttctccttcccttcttcctcctcgctccctccttctctctcttttctctccccttttctcttccccctcttcccccttgggacgcatcggcggcagcggcggccgggtggagtggcgatggatctgggcagcatggccgcggcccctcttctgggcgtcgatttcctcgccttgagtgataattaatactcccactagctgctactactacatcgctagcttagctaatgacgtcaccgagcaaccaagaacactaaattaaccaactaaacacaagctaattaagctagtgtcgtcgtcatgttgcctagctagctagctagctagctaattactacttcggtgagtggatggcgccatgccgccatggcggcgtggcagcagcacgtgtccatgtcagcgtcgtcgtcgctggtgacgagcgtgagcaactcgcgcaaggggagtcccgaccgtggtggtggccttccagagggtgtcggcgacggcgatgtcggcggcggagtgcaccggggcgatggcggcgccgtcgttgctggaagggagattcgggctgggcgggagctcgcggcggcggtcgagcctgaacgcgtttgacatcatctccttttctccggcaactccaacgccggcggcggaggtggagctttaccgccgcggcagccgcacccgacacccgaacttcccaccgccgccgtctcctcgctacaggatacgcgacagcagcgaccgcggcgactggcagctctcgatgccgccgcagcgctgctccgccctaccttcatgccggccttctccacccaccgccgcccacggcttcgcacactcccttgccactctccgctccgccatccgttgcctcggcaagctctccgcgctgctcgccgacgggaagagaaagagagagataagggagagagagggggaggaagaaaggttgggaagagaatgacatgtggactccacatattagtggatcctattataatttttgtgaataataaatgggtcccacatatatatttttaattataatcttacatcagcgtcacgtgggacgaagaccaagttaacactgccacatcagcgccacgtcagcaaaaccgcccttcaaaaccattgagggagtgaatttgtaccggttttagtaattgggggagtcgttctaaccggttttctggttgaggggtacgaattagattcgttgtacatttaagggagtcaaagtggactttttccattgatattcatagctcaagctataatgggctggcccaggtcgtggcccaattttgggtccgcccttgatgaatgatgatcaaggccggctccaattatggatccgccccctatgaaaactagaatagagaactttgtaaaataaatctatatttgttattctaatggctttaaactaaatatttttaaagttattgatagttgaagttataaaagtttgacaacaataatatccaaaacaccaagaattatgaaaccagggcggaggtagtaatcagcaacagcatcataatcacctaaataccgagctcatgtgcaactacttaacacggtggcacgatagtatcaagggagtatattttgccacaatataattgataaagtgtggcatgccacatattgtatggttatgaatgtgttagccacaattgtggtaaaaaaaatcattcaatgacaagaggactagtcttagttgatcaaacttttttgccacaagtttggctaaggttgacactaaaccaaacaggccaattcagtcattcagtgcacatctatgttggaaacactgtaaattcatcagccaagcttttgcattcataatgtccaaaactggttataaaccgtaactgttttattagcaattagaaaataatttatctaaaacttctatatgtgttcttaacaacttagaaatcaatgtaaaatgctatgttaaaaatatcttaaaaatcaacttcaaaattaggttttaaattttaaaatttggctttgctttagctttttagtgtaaccaatggggctggcgactcatttcaaactaaattcgcaacaaataatccatggctgatgtgagacaatatgtgaatagcctaacctttttgacaaagtacattacagcacaatttctagtgcaaatatggtaaaatttatctcgcaaaccattagcttctaaatatttacacaaacgcaggcgctgaaaaaagctaatgatgtgctccaggaacacaagcatgccttgttctgcagctatgccaggtgatatttacacaacaaaagaactgcggcaaaatgatttgtatttatttgtttatgtacgatgagaccaaacagtttcagtaaatcatttggggtagttgttgtcagaggggtaggagggtttcatgaatggacatgaacaatgagattctccgaagagaaatacaacattgttaggctaacaatacaacctatggctaaagattgatgcattgacagcctctattcctacaatacattgatctgccttccgcttctgcaatcctactatgctaagatacatatttacaaggaggaaggcaggtacttatctccctcctttttggtgggtcttcatgtgaaggaaccaaaccgatgaatcagaaagcatcaacgaaagcatctcgaagtgcccagctgacaaaagcatcgaccctgaaaagcagcatgtcagatgaatcagagaagaagataattgtggcatatggtggtaacaagaggaacggaacaaatggcgtaccattcacggatagcaaaaatgttatcttggtctccagctaccatgtgctgcgataaaagatgatgaattagtatcctgtaatctgatgcgacctgaagttactttctttggaacagcttgtgttattcttacacgtattatgccaagcatttcgtacagtacaaccaaaatatgtcatgaacttggacgaaatattgattaggactagtgtaggtaatattagaaaggaaacaaaatggtcccaagactttggtcacaacattaacaatgttattcctctctttcaagcttcccctcatgactttacagtttacactctagttctacagttaaggttgaaaagtttctaccatataaatgctccttacaggacaaatgcttatgaaactggattctttggacaaaccaatatctagtggtaagaggcaaatcaatgcaagttacattatgaagcaggacgaaagagcatgtaacatacctcctacatgtggaactggaggctccatagaatgtctggagggagaataattcgatgaccgaggaggcatagaccacccagagcaaggacctggtggaggatctgatggtcgtccgtagtgcactggtgctgctgacgatgcttcaaaatggtctggaccaggaggccctggacaataatcaagaacaaagaacatttagtctgctgtttttgagggtcctacagcatgggatagattaacttaattgggtaatcatatatctataaagttcatccccactaagtgtaattaatgctaattctctcttctctcatgaagccacatcacctcaattgtttttagcttttggatgattcatcaagggtttaaattgcatctcttccccccaaaaggcacactatacaacccaatcatttataacctatggataattgataaaggtaaaaaatacataaacatataaaaaaaatcgtatagtaggtactccctctgtccaaaaaaagacaaacctagggtttccgtgtccaacgtttgactgtccgtcttatatgaattttttttataattagtcttttcgttgttgttagatgataaaacatgattaatactttatgcgtgacttgtctttttaatttttttcatatttttttcaaataagacagacggtcaaacgttggatacagaaacccagggtttgtctttttttgggacggagggagtaagaatgaaaattttagaactcatatctactatattatcacacaattctcccgcagcaacgcgtggagtacccatctagttgtacaataacaattcatggctggtgtttctagggtgaccttacaggatgaaaactgtgccaggaaaaaagcgacaatgattcacgaaaaaagtacctggaggaaaaggaaatctgcccctgtcagcaacttcgtggtgcattggtcccctaatagctctctcatcaaaggaacgtcctctgtcatcaaaatggtgtcctctatcatcaaaataatgtcctctatcatcatagtgatatcctctatcatcatagtggtatcctctatcatcaaagtgatgtcgtctatcatgcccatgatgtcttctatcatgcctgtgatgatctcgatcatgtccatcataccgatatctctcaggataggatgaactattattactccaaggccgtggtctttgctgaggttctggtggtcgataggggcattggtttataggaggtggagggggtggtggttgcatatgatatccttcgttaggtaccgatgccattgggggttgatgatagttattcccatgatatggtgcaggaggtgcaggaaaattgccatggggtccaggcggattaagtggtgcaattgggggcggcggtggcatctgatttggatgccccccatatcctgaattacagaatggtggaggctgcaattgcgctacagaaggattcatactgcctgggcgttccacaacagaatttggctgttgcgtctgaatattctgcaaagaaaatgaatcattagtttctaaaataaaaatgcataaattccttcttgcacagaaagcaaatatgagcatacattggtagctcttgtaggatgcggaccaactggatcagatgccattggtaatgttcgctgcaactgtccagtctgagtaattggagcaggtggtggtggcggaacaggtggaggagatgatggcaatggcgggggcgatggaggcctatcatcagggaggggaggacctaaagtatgtcgatcagatgttctgcatttggtatcaatttgttctggccgacatctggtgctagcttcaacttcagatggtggagctacatcctccatctcaagctcgccatcaacttcttcaaggatgcgatgatgcttttctgcgggcatttgtgattcttccttctcatcagtgcaaggagcatcatgttcaggtgtaacagcttcaaaacttctatcttcagaggagcttccgtcctcatcttcaagtacttttgtggaaattaagtttggtagttgaaaaccagcattgctgcggaaaacaatggaacatacaaacatagggaaagaactggatgagatacatctatataattgaatatgtagaacatggagctatgaagtaatgaggacatattcatgcactgcatgcattaatgcatatcttgttttatttaaaatagctttgtctcacagataatatgaaaaaggacgcccactaaaattcacccccaatatttcaggaatgactcctttttctagttatttattcatggtgagttttatccaatattagctaattggatgttagcatcattcatatatcatagaacactgcttaactgaccaacaagactacctgaagaatacccatgctctaagaaaattactcaaaattgcagtgttccatcaaatctaccgtggctttgcctgcttctctacacttcgacacgtgatcccattttgtctgcacaattcatctagctatcgtttatgaacattacaatattatatgcatgccacactacttttcatacatcagtttgacaagcatacctgccatactcatcaacaagcattccttcgttgtcacgcaacgggtcatttaaagctctttctgtccttgaaggacggcgagaacttccaaaagatgcctcattgataacctcaagttctctaatatggtggcgaatgatgtactctgggagtgttttcctctcaaaccaaagcttcaaaacctgaagataaaatcacaaagtttttaagaggagaaaaggagaattgcacatgacaccagttctatcaaactgctgaaggtgcctgcctttagacattgccttcgattctcccatgccgaatttccaggaggtgcagcagcataaagtaatcgaggtagaactgcctggataagagacgggtaaacatctccagctccacctgcaaatttcttacagaatttaaaaaaatagagtgcaagcgaaatagacagaaaaagatcatgaaagctatatgttacctttctggttacgagagtattgagttattgaatccacaagaaagaaaaggtccactctcttatataaattcgactccttctccaagcgttcaacgataatatcaatcgcctaaataagaaaaaaaaatcaggaaaattgatatttggcaattggttgcatagaaaggtatgtaccctctttttattggtaatctaaaagcaccatgcatgtgtctgtagatgagatttcataatctaaaagaacatagaagtggtaaacaaagcaacatctaccagaattatcacaggttatttcgaagtccataagttgctgagatatgttgtcatatcacatcaaaagcatgtagcaactacgtattataagagatggtacacttcaatggtaaataagattgatccttgagaagcaacaataagttccagatgcctgatgatccatcacaaaaaagatggtagttggcacttggcacagagaacatagcactgtaattactaattagcctaggcaaatcaagaatctaacttccccgtccaccaacaaaacaaagaaagcaacaatgtttgctacatctataagcaagtaaatgatgatactacttaagaaagacacagtaaatgcatgataaatgaggatcacgtgccaaatagaaaactaggagtgacatgcatggacgcatggtctaacctctccagcaacgccatgtttggcacactcaattgcaagacgtgttgcacgcgctatattttcttttgttcttgtcagtgtaccaagaaaagatccaaaagcctttcgtgctgcattagcctcatcatgtcctgttaatttgctcaagttcttctgttgctgactatcaaaaggactcctagaatgaatattatcatttgtagatgtggatctgattatccggttcaaaggtgacaattgcttctgtgatccttccttgaaagcaggtgtatcaactacagtttcaggaatatacttggcattcagaaagttatctggaaaagaagttgatcgagagaaccttctagcttgtgcaacagcaataagttctttcataggcattgaatctggagaagtgctcttatcctttaggtttctatggttcagttcttttaatgccaaagctgagaaggtgtgcctgcaatacaacaataagtattgtcatgccttttcagaagaccatcttaaatcaactaatcaagtatcaaatttataaagtactaatccagagttgttataggagtaattcaaaggtacaatataaaccaaaaaagttgctattccaggcattctacatgaataggtcataagttcatcagactgtacgttgcaaaataagcattcctgctaagaaggttcaaaaggtgtagagctcaatgtatagatttcagacatgaaccataagaatgatgtttccattgggacctaaatattgctctccagtctccactggctagtaatgtcaggctccaaaaataggctctatagttaaagccaaaatagagcagacaaataaattagggacgtatggaggtagaaaacagtcccgattaattctccttaataaaggattgtgaaggaactgaaatatcccacaaaacatatattaggatccacaagcccataacatggaaagatttagaatctatatgatataactaaagacgttataatcagaatatttgaaaacccaagtatccagctcataaagcaacaaatctacacaagacaggagcattagaataataagatccttgttgatgagtaaaacaagataaccattcatgccatttatccagattccagagtgaatcaatttgcccaccttttttgttcagtcaactagattatgaagtgttacctatgtttaagacatacattgacccattattgagtctccaaagaaatgcattttgatggatgaaaacatcaggttgacattacaaggaaaagaatttcgtaggaaaagaaaaatcaaattgcatggatgcttcttcttcacaactttctgaagtttcaatcagaaaatgccagcataaatttggaaaagaagcatgcatgtcctaaatttgtcacaaaaaggttatgaacaagaagatatggagcatataatgataaacaaatatctcatgcagacataatggaagatacaatttggcatgaaagcttacacttcaaatgtccgggtgtctgcatcagattgtatactggaagatttagtggccagcgaagaggtgcttgctgtatcagccacattgactactgtttcagctacaacagtttcattatgcagtacagaatcactgatcgcattattgttagaagaaagcaactttggtcggtaaattggctcatcacatctttgaacacttctgtcagtatcatatgcaggacggtcaactggttttgggccttcattgaagttgattggtttggcaacctcgctaacactagctgtccccaaagatgaagataaacgatcaggtacagctacagtctgtgtaccaccaagagcagactcattcagcttcattgaaagagccaagcctttcccgcagtcgtcattgccaacttcactagagaccaacaagcaatcagtagttttgctatcaacgtgagtttcttcacaaatattgccttctgtaacatgactgtcatcttttgcttctgaaggaactgaagcagaagcaggaacactgttattttgcagaattgattctgaggagtgtgttttgcactttgggctatgcatggattctgtgcacaaagatggcctagggctttctgctattgcagatccgttagtggctgtgactactgcatctgcagatttattagagtggctgttttctgaagccacaaaaccatttggaatcaattgctttgaccctgtcacttcaggcagattattagtttcagcaacattagcggacatagcttctaaggcacgatgaagacgttttgatggaggcaaagcagcttcaacatccaatgttaaaacctttggttgatattctttgttcttccaagcagactgaccttcacctgaggggccaggcatgtataacttggatgattgatttgaaacagtatttgcaactcttcctgtcaaggaaacactatttaccactgctgactgatcgactgaacaatcatcaccaggtagtgcaactgtgttatgcatattacataggtctgcaagcatagcaagctctggtctgttattagtaacatcaatcccatcaactggtgagtcttccaactgaggccttcccattcgaacccttgcccttttgaccaatggcaagtgctcatctccatctgacttatttacttcagtctttggatttggagaatctgccgttttttcacttaactcagcctgaaattcatcatccttatccgtagaatgagaaaaaatatttctacttggctttctctttctcttgaaaataactgattttttcatgggaatgcttgatgcatcatgcgatttaaattgtgtctctaaagccccattttgagatgtttcactgtcgcaggtactatctaccttagtggtataattcagctttttattgttgttactggtgccaggtgtgccaggttgattgtcgatgcccgcacttgaatgcaaccaaacatcatcctgtgttgaaggggaacctgagttaccttttacatcctcaacatacacatgatgactggaaccttccttagtaccatcagcagccaaatcaactgaagccaaacaggttccacctgaaagcttgccagaatcctgagcttttcttgtgtcagtgttcagtgaacttcttgacctccgcagtgatgaaaccctactccgtgtgtagcaattttgaggctgtgcatcccttagcttctttgaaattgaactcgtagacaaagggatgtttctcatttcatcaaggatagacacattttcagtagggtcatcaggagcagaatttacaacacatcgctcacttccaactgcggtaacagaaggctcatcagaatcggccgtattatgaccacttgcaactatggaatggtcttcttgctttttatcactacccatattagagctactcactagaccctccgtatccaagctgctgttattattagcaagtttttctacacctggtttcacttcattggcaaccaaaccgagcttattattaccttccttcaaagaatcataaacatcgattatctcatcaactgccctcaaaaaatcagatccttttccctgtcgcttagcaagtagagacctccgtttctcttcagtgaatgcttcaagatctgcatagttgcagaaagcactacaataaaaagaacaggaagtcagatgtaagtgcgtagggttataggtaagaaaatcagtataacacattgaaattcatgcacagctaatggtggaccagggaaaaaacacagatgcttccatgtcttctctagaagttcctaattgtagcttttaactattagaccataaacaaattaaaaataaaaactgaaatttcacactttttattggaacaacacacaggccaccaatagtgattagtgagttttagttagtccatagcccatacattgagaaatacatcgcgcaaacccaaaaggaacacaaccacaatgggtcatcgaggatcaaagcgagatagtgatacattcacagatcaagtgtcaaaaagcaaatctttacatgtctaagatgttttcatttcctagtcctaaacagcaccacgatatcatggttcattccttcaaaactcattataaacaaagtagcagatttcatagattatttcatagttcatcgaccctgaggagcatttatgcccttggcatatacataatacattgacaacagtgtactactagtccaaatgacagctttaaccaaacctatcgatggttcaactttcttaactatcagagaaatatttaaagccaactaatcaaaattttctcaacgcttgatagtacaactaatttggggggaaatggttatatgtccccacaaatgatatgtgcaatctttgcgggatgtcagaatttcaatggttactctcattgagaagaggatggcacaaaggatggggcaattttccggttttcttcattcacaaactcaaagccatacctatccgagggaggttggatacatatatatagccatagctggctgcaagcctattgctgcaccctcctagtctaaaattcgaaatttgaatgggatgatgtcctagagggcatccaaactgaataaagcataaaggaggcataaagaagatgctaactgctgctgtcctgctaaccgcagctgtcctagcaactgaaaatatgctaaaggagcagatgctgtcctgaaaaggtgaaactacctaaaagaaaaggaagaaccacgaccaaggaccacaaagacttatccatcattctcccctaagtcttgtgcgtcgtcttgtggggaagttgggccatcccgatcctggagcagagctcgaggaacttgatcctcccaagaggcttggtgagcaagtccgcaagctggtccttggtgttgatgtagctcgcgttgatgctcccttcctccaagtagcctcggatgaagtggtacctcacccggatgtgcttgctccgttcgtgaaaaacagggttctttgccatggccagggcggacttgctatccaacctgagctccaccgctccagtgtctctgccgaggagatcactaagcagtcgagcaagccagagcgcctgggtcaaagcggcggaggccgccatgtactcggcctcgcggctggatagggccaccacctgctgcttgaccgactgccagctaacgaggcactcgccgtggaagaagagaatcccgcttgtgctcttgctggtgtcgatgtcgccagcgtggtcgctgtacccaacgaagtgtgccttgctaggacacctcgggtagtagagaccgtggtcgagagtccccgcaacatagcgaatgatcctcttcacagcctgctggtgctccgtcgtcggtcgctgcatgaaccgattgacgtagccgacggagaaggccaagtccagccgtgtgtgggtgaggtagcaggctccccacaagacgccagtattgtgtagcatccacttcctccgtcgtgctatcgcggctcagcttcagtctctcctccatcggagtgagagctgggttgcaatcggtgagcccagccagctcaacgacgcgcttggcgtaggcggtctgtcgaagcgtgatcccggagtcgtcctggtgcaccacaatccccaggtagaaagagaggccatagatcactcatctggaaggtggccttcatctcctccttgaacgccgcgacctccgcatccttggtgccggtgatcacaaagtcgtcgacgtagacacctaccagcaaggcattttctccattgccccgccggtagatggccgcctcgtgcgggctttgctcgaagcccatccacttgagcgtggaatccaacttggcattccacgccctcggtgatggataagtctttgtggtccttggtcgtggttctccacgagcgggattatcttcttcctcggcgagtgcctcgttagctggcagtcggtcaagcagcaggtggtggccctgtccagctgcgaggccgagtacatggcggcctccgccgcttcgacccaggcgctctggcttgctcgactgcttagtgatctcctcggcagagacactggagcggtggagcttagggtagatagcaagtccgccctggccatggcaaagaacatcgtttttcacgaacggagcaaccacatccggg

SEQ ID NO: 39095 - DNA, 21870 bp, Oryza sativa
gagcatcaaggcgagctacatcaacaccaaggaccagcttgcggacttgctcaccaagcctcttgggaggatcaagttcctcgagctctactccaggatcgggatggcccaacttccccacaagacgacgcacaagacttagggggagaatgatggataagtctttgtggtccttggtcgtggttcttccttttcttttgagtagtttcaccttttcaggacagcatctacttctttagcatattttcagttgctaggacagctgcggttagtaggacagcagcagttagcatcttctttatacctcctttatgctttattcaatttggatgccctctaggacagcatcccattcaaatttcgaattttagactaggagagtgcagcgataggcttgcagccagctatggctatatatatatgtatccaacctctctcgggtaggtatggctttgagtttgtgaatgaagaaaactggaaaattgccccatcctgagtgccatcctcttctcaatgagagtaaccattgaaattctaacactcggtgcctgccgcaagctgtagagagccttgtgcaagcgtagcaccttgcattccttgccggggatcacaaatcccggcggctggtgcacgtagacctcctcaagtcgccgttcagaaacaccgacttgacgtccatgtgatggacgccccagccttcctgagcagccagcgcaaggagtcgcacggactccatccgtgccacgggagcgaaggcatcgtcatagtcgatcccctcctgctgcacgaaaccgcgtgccaccaagcgagccttttgcttgacgatggctccggcttcatcctcttcagcttgaacacccacttaagggtgatcgcacggtgaccacgagggaggtcagcaagctcccaggtgcggttctcctgaaccgcgtccatctccgacggcatcgcggcacgccatgccgcgtgtttctcggcctctgcgaaagaccgaggctcaccgtcgtcgcacgcaaggtgcaactgcgcctccaggtcgcgaggcaccagtcccggcaccggctggtcgccgagaagatcctccatcgtacggcaccgtagctgctcgccgtcgtggtacgcatcgatgcactccccgtcgtgggagagcggagtagcgaactccaccgggctgcactcaacacgagctggcgtcggagtagacgtgcccggaggagtggctgttggtgctggagcgcgtggtgtcgccggctgtggtggtgtcggcgaagagctcgtcgtagtcgaagtcgtggcccgagggtgtgttagtgtcggagttcggtggaggctcgggaactggggtagacacgctcggtgaagaagagctgcctgctcccctagctccctcgaagtggacgtactcgacggtgaagtcgtcgtacgtcggagtcgaaccatcgtccactgccttgtcccatacccaccctcgcccttcgtagaacactacgtcgcgcgctgtgcgcacacgctatctccgggtcgaggatgcggtaggccttcgagccctccgcgtagccgatgaacacccctggggtgctcctgtcgtcgagcttgccgatgtggccaagctccttgacgaacacgaggcagccgaagatccgtaggtgggagactgccagcttgcgcccatgccaagcctcgtatagtgtcctgccatcaagggccttagtaggcaagcggttgaggatgtagacggccgtcaccaccgcctctccccagaagatggccggcatccctctctgcttgagagcccgagccatccccacaaccatctggttgcgccactcgacgacgccgttctgctgcgggctgtacagcacagtgtagtggcgctgaatgccctcatcagcgcagtacaacgcgaattcagcggccgtgaattcgccgccgttgtcggtgcgtagcacgcgcagcttgcagccgcactccacctctgcagcagcctgtgcgcgcctgatggcgtctgcagcctctcccttgctgccgaggaccatcacccacatgtagcgggagaggtcgtcgacaagcagcaggaagtaacgtcgtcctcctggtgtggccggtgtcactgggccacacaagtccccgtgcacgagctcgagccgctccttggctcggaaactcgtctgctggggaaaggggagccgcctctgcttcgttaggacgcagacgtcgcagagctgctccacgtggtcaaggcacggcaggcctcgcaccatctccttggcgctgagccgcttcagggcctcaaagtggaggtgcccgaaacgctcgtgcctctgccacgcctcgtcccgacgagcggcgaggcaaactggttgtgcgacctgcgcactgaggatgtagagtcgattagtgcctctggttaccaagaaggtgacggcggcgatcccaaatcctcatgactccgtgctcgaccaacacgcgtgagccgttctcatccagctgccccacgctgatgatagagttcctcaacacggggatgtagtagactccggtgagcagcctgtgctcaccggacttggcggtgaaggtgacggagccgacgcccttgatctccacgcgggaggcgtccctaaacttgacggagcctcggacgctagggtcaagctcggtgaagaactcccgtcggccggtcatgtgatgggtggagccggtgtcgaggtaccacccatcacccttgtcgttgctggagccgttgcagagggagacgagtaccttcggctcatcaaggtggaggaaagcctctgcggccggtgccgctggaggtagctcgatgcttgcgtgtgccaggagcagagccggctcttcctccacctgtgcgacgtggacctggccacgtcgtggctgtcaagagtctttggcccaatggccaagcttgccacagttgcggcaggtgtcgtctcgtgtcggcttgtggttgccggcggcggcgccctgggcacctctgcgagcaccaccctcggcgcgtcttcgcggccaccgcagctggacacctccacgcgccttgcgcggcttgcggccgcctgtcgagggagaagactcccccttcctcccgtcactctgagaggcatcccactgctcccgagtgagatggagcttcccgccgatggtgataggccccaagagaggttgtggctcatcaccatcgacgaccttgaggcgacctaacgcctccttgatcgacatcgtggagaggtccagcagactcgatcgagcgagcgatctgcctatacttctctgggacgcaacggaagagcttctcgacagttctctcctcatcgtaggagtcgtcgtcgtactgcaccatcttctgcaaaagagtgttgagacggagggcaaagtcatcaacatcctcacctggcttgaagaccaggttctcccactccttgcggagtgcctgcagtgtggacttgcgggcgcgggcgctgccgatgcgtgccgcatcgatggcgtcctaggcctccttggcagtccgcttctaggaaagcgagaaccgcatctcgggagggactgcggtgatgagggcatccagtgcccgccgatcttcgtcgtagtcgacgtcgccgtaccggactgcctcccacatgtgccgcacctggagcctcaccctcatcaccgcggcccactcgatgtagttggttttggtgagggtaggccacccaccgccgggaccaaagtccctgaccaccgtttggacaccgtggtagccatagcgccggtcaggggagggagagtcgcactgcctgcgatggccgcgctctccgtcgaaccagccacctccaccgggagcgccgccgccacgcgcgcgctccgggctgccgccggcactcccgcgcccatctgggttcccgtcgacaggcgcgcggtcccttgggccgccgccgccgccgtgggggtgggctgctgcccaccgctctgcccgctcccgcgcccttcctcttgccagctcctcaagctccctgtcggcggtgatgtcgctggcgatggagccgttgatgctgctgcgcaaggtctcaacctctacctccgccgcacgtgccacatcttccgccgcctctgcttccgcctccaccctggctgctgccaactccgctaccgccagtctggccgccctccctgctgctgctacggtctgagccgttgctcgcctgcgcttttctgttgcggcgagctcggcgtcttgctgacgccgagtgctcgatgcgaccgaacgccgagaccgaacgtccgacatggcgcgcctccggggggctgctgcgtggagagggggaagggaaaggggaaggagtagccggtgctgctcctgctggctgagagctcaaccgagcttgggaaggggtggaacaagagatgtttagcctacaggaaagtgtggctctgataccagatgttagaatttcaatgattactctcattgagaagaggatggcactcaggatgggggcaattttccggttttcttcattcacaaactcaaagccatacctacccgagggaggttggatacatatatatagccatagctggctgcaagcctattgttgcaccctcctcgtctaaaattcgaaatttgaatgggatgttgtcctagagggcatccaaactgaataaagcataaaggaggcataaaggagatgctaactgctgttgtcctactaaccgcagctgtcctagcaactgaaaatatgctaaaggagtagatgctgtcctgaaaaggtgaaactacccaaaagaaaaggaagaaccacgaccaaggaccacaaagacttatccatcacgggaagcatatagctgaatccccatttttaagagataaacagcaattttcagaactcaatcagttcaactagattaacagttttacatgtaagaattcagcattcacaaagttttgctagcccatgattattgtttttcagataataaaatacatgcataagaatttctgacacaaaatgctatggatttgacataggatagggaagactgggggatagggcaccccgctctctacgagggccagaagagcttctccccatcatgatagaggctatgaggaatactgaattaaactttgtagattcattgcttatttcataatggattgcatgggcccttttatagggaggatgtcagtgctacataaaccataaattgtcactcgggaatgcttcctagtaaaccatatatttaacttccctaactaacagtgaggatatgtcataggtaggggccgaggggtcgaggcccatgggcccaacccctggcgagtgaacagtacccgcggtactgtagcagtaggttgggtgataggataggattaagaaatagataaatctagattagatcaagttagttacctaggggttaagtttctccatctatataaggatgggactatatcgttattctaattaagcaatgaatcaagattagtctcccctaacctaagtccccctctcatccctagcagccgtcaccgcccggctatcctcccagtggtgtttatcacctatgaaccataacccataataggataacaataaactaattcatatgcactaatcccaatgtaacacaaactaacaagattgatggccttaaagtaacgaagtatttaagcaagttacagtactgaaataaaaagcaataagcaatgctactaggtggacataactatcatcctgtatatatgtgagcaagtgtccaacctaaggaatattccaattagactacaaagatttgagtcagtgatatcaaacttcaaacctcccttaattattacatttctcatgttcctagaatgcaaatgagagaaccaaaaaaaagcttgcatgcaaattacagcaaagagagagatagagagagagacagacacacacacacacacatagagacagagagagagagagagagagagtcaggtgttaatccatgccaactgttccaaacgaaaagagtcagcagcagaggctcaaagggcggtggtggctggcactatggtttgagagataagcgtgcagtgatgtgcagtagccctggcggtgggaagtggtggacagctggatattgggctgcctcttttcctttatttttttctctcttgcatttataaatagcaccataatttattcaacgaccaaggctcattggcacggatttatttgggttgcctccggtatcccaggctatcatcacaaagaatactactctagtttgacccaaagttttagccacccataacccaaatccctcaaacccattcctcaacccaggttcctggtgctggtggctttgatctatctgctctgcgaactgtagttgcgcaataatctatttaactcacgagatatgcaaagagaagtgcaatattgatagtcccccaaaaacacgaaagttacaaatacaaacatcatgtctagtcccatttcacaatcatgcatataaaatgtaaataacccgataaaacaggaactttcttataaaaagaagtatactgacctactaataataacaaagtaggatatctctacacagatgtagggtagatagcacatataaagtcacatggttctatcaaattagaacttacatctgtttagttccatagaagtacaccagtatcttctttttaacagacgtctggccccactgctctggctcacttatctgcaacattatacaaattcatgggatattaagatgatttcttagtatgtaatctccatgtcattcaaactgatgtgcaagacttaaaataggcactaccaagcctataatagagcagttcccactttccacaggagttattctttaaccaaaagtaaaccattgtgtggtgacacagcaaaagatcagatcaatacaataaatactatatgcaaagacttgcacggatgttgatgtgattgtcctaagttacatctaattcagaacttagcagcaaagaatgccagatatgatgtgaaacgcaatgttccttgctaatccttgtcctttttttaaaaatgaatccttgttcttttgttgtaatgaaaggacaaatacatcactaaacactgcactgctattcaatacatgtatgtagcctagcccttcataggcctaaacctaataacaaatttagaatttgcaccatgtatatatcgcgcttaaccctaccaatcctggaagaattaattaagcaaaacctacaacaaaagaatcttttaaaaaatagccaaatgttgaaaaggatcgtggctcaaaataaaatcaatcagtgatagatcaaacgaggagaataggagagtaaaggtctactaaatcaaatgctatctgcacatttacgcatcttacaaagtgtatagaatattgctcccattttgcatattagaaaggtcagccttaagtcctcaagcatactaaaccacctcccaatatgagaaaagggtagtctgttcatgccagcctacctgtgtatggtccaaactaaaatcaaattcaacatgcaaggaaatatgtagtgttgtttccctttgctgatgtgcacacaaactaagaaaagcaaacagatagcctatcattttggtttctggtgttcaggcactatgtaagaaaagttagataacaattttaagagaagaaagagtacgattatgattaagtagtgcttttcctaaatagtaaaaggaaacatctcttcattcccaatgaaataatcagaaaatcctcattgaaacttaccgaaggtaactaactattaactcgatgacaaataattaagaataaaagatagaatcacatctgtaaccaacgaatagagtgcaggtaacatgatatcaccctgttcatcctaatcccaagaccatccatgccctaaatcgccggcaacgtcaaatctcagcaataaagcagcagctaaacctagaaattaacaggaaccggggcgaactagatcatatttacagtacaaattatcagttaatctgaagagctcagcaggaagtggcacgaagaaggcttgtttcggtcgaagatccaatctttcttaagtacatgtacctgaaacccccacatacaccaaatcgcagtgacaagcatccgcaaaaccacgaagctagcacggattaacagctaaaatagccgaatcggggtagggagaccatccaagaacctaagatttatcaagaatggacatgccgcgtcccaaaacctggcctcgcacgcccccaaacgaaaccctaacctgctactccccagaatcccctaaccccaaggcaccccccctaagcaaagtatacggccatagatcagagagaagaagagcaagcagccgcgaagcatgctagcctaagaactcaccatggccggccacgccgggaagcccttcatcttagcgagcacgaggtcccccaccttccactgcgccgcggccgccgccgccgccgccgccgccgccgcagcagcagcagcagcagccgcgcgcttcttcctcgccggcgccatatccgccaccacccaaccgtctccaccacaccccccgccgcccaaaccaccggcgatcagcaacccacggggggaggaggaggcgcgcccccaccaccaacgacgacggctaagctaccgccctacgccgccccgcgaggcggccgcgccacaagaggcagcggcgggggcacccggctgccgtcctcctcctcctcctcctctcctcgggctccgcggcggcgatggcggcggcggcatgggagggggagggctgtggcttcgacttggggatttttttttccacttttgtttttctttttttcctccgagttttattcgtgggctttttttttctttctcttggctgctctctctctgcgaagaagagaagagaagggaggagaagagggagggtggggtggcgcagcgtgtgaggtgggtgggtgggtagttcggcggaagaggaagagggagagcgtgggaagggtgaagtgggggtgggggagtgccggtgcgcgtgacgaagaggaagaaagggggttatgtggatggagtggcttgccgccgcttgccatctgcctctgcctgccatttcccattatttcctttttttctcataaaaaattgctgttcttgttaggaggataatagtatctatttgttttgttgcatgtaagtaaattttgcttaaaattcacttaaatttttatacatgcagtatttgtttactatataaattttgttcgtgtagctatttgaaatatcaatatgcgtgctgtccaaatgcactacttggcttatgagcctagttcctcgaggaaatatgggttgttgggttatgtgggatctagagcatatggcacgagtagaaaatgtggagagagattatcatgctcgttagatgtaaacttttgcaggcggtaatttgtatagggaatttgattttctagatgtattttgtgtgcatattatgcacccaaaattgccaatttgttccctttcggataagaattgagatatctcatattctaataaactgattcatattcacaagtgttcaattaatatatcttttatccctatatataatgtgagaaatcaactgctatattaaatttactgctccgtttcctttcaaaaaaaaattactgctccatttggcaaaacaattgtatgatatttgaattattttaagtttatgaagtgtgtatttgatcataattttatattagggagaatagccattatggtccctgaagtttcgctatgagatcattttagtccctgaccattgtccaagcaaacccttaaactttatcatatggacatatatagtcattggcccatcaaaaattgccatgtgggcatgccatgtcatctttcgatacaaatatatgataaaatgcccaatttgcccttacacatatcatagggaaaaaggagagaaagatgaggtaggtgatatttgattgtctctgattatactatattttaagtatttgtggtccaccgaaaatgagacaatcaaatacagtcaagcagtttcagttccactaaaaatgggagcggagctgggtgaagctctctcacaaaataaactagagatgtgtagctggatttagacaactctacaactccactccaaacacaactcctggagctaaatttaggagttagagatgtaccaaatatgcccttaacattgaaatgcaattacgtacatagaaattatttggcatggtaattatatatttagtggctgtagctaatttaactttgtattagcataatccagtgaaaaaagtttgtcatatatccatagtcacattggacaaagttcgtaaatcattttcattatttttgtatggtatatggaagtgtaaattggacatttcgcgacatattttgcatgagaggataacatgacatgttcacgtggcgatttaagtgagcccaaggactatattagcctacatgacaaattataaggactcgtttagacaatatgaatggtcagggaccaaattgatcctggagcaaaacttcaaggatcatgttggctattctccttttatattacatgaagtttacagtaatacatttataagaatatgaaatgatttttgtgccaaatatgttacagtaatgtatctttgtttagttttttggtcattgggatattggaacttatttgccaaaattatacaatatcttttagtatttgattgtctcatttgcattctacgggaggtagtttacggaggaaaacttgagactttctggatattttatttgcaaattccacaccaaaaattgacatgatgtttccttttggacaagaaatgagacatcctatattttaataaattgctaatgtgcaaatattcactttaatttatcttcgtgcatctacataatgtgggcttagccatgagattaaattcactacttcctttgggggagaaaacaatgtttgaattatattaagtcttcatgaatttgaccataatattttttttatattacagtaagtttataataataaagttataagaatatgaacctattttttgggctcaatgagtacctagtactaatggtaacgaaatggattaatggaatggttaagttgatgataagaagtgggagggaagccctaagaggagaggccaaaagcgagtgtttttctctttgtttttatcatatattgatagcaatagttataatctatctattatattataaagatagctcgaaaagaagacactatatttctaaattttatctaggaaaagataataaaatatatgtcgttatatcatggtgagaccaaataaataacactgtatactgatagcaatagttatataaaaagtacaattgcatatgtaggaatagagaataagagttgtatattaaaatataattctatatatgaaaatataagctaagaattgtgtaccgaatccaattgaactagtctgcacaaaagaagtgttgggaatcctctaattatgacaataaagattccacgcatcctatcttactataaagttatcttccattgactccttaagcctaacatgcaaagatgccacatcatcatccactaacaagatgccacatcatccattaacaaaatgccacatcatcatccactaacaatcatcacatttaaacattatgcaaacatgctatatctttatagtttttataatttaagagcttttcaaatacaaacatgttaagttatcatccaacataattcacataatgtttcaatgtatatctttattatgttttatgatatcctatatacttatatagattatcctcacttagttagtgctcctatcttactataaagttatccctcactaactccttaagcttaacatgcaaatatgccacatcatcatccactaataagatgctacatcatcattcactaattaacaagatgtcacatcatcatccactaacaataatcacatttaaacatcatgcaaacatgctatatctttatagtttttataatttaagagctttttaaatacaaacatgttaaattatcattcaacataattcacataatatttcaatgtatatctttattatgttttatgatatcccatatacttatatagtttatcctcacttagttagtgcttatatgattaatctatggtccaaatagaattatctttctccttttttcctcaaattaagtcatatcacatcaattgtttttagccttttagatgattaatctatagtccaaactatctccctacttttcttcttctataaagtcataccaccttactttttacgtttgattcactattctacatactatttaaatttaaattattataaaccacattaatttacttaatatgatattatctagctatcttacatgttattttttttattgttatcatactaaattcccgcagcaatgcgcggggtttcacctagtaacaagaatgcttgttcacaaagaataacattatccctaactggttgataaagattttagtagtataatatgtgaaggaaaaatcaatagattgatattacctctttaaaatattcattccttagtgaattaagtctttgtcatgatcagggtccctcttaccgttttcggcgcggttaccggaccacgcgtgtcggtgatatgggaccgggagtatcatgaccagaggcttgaggcagacgcaatcgcccacgtggcctggcaccttcggggacgtcgggcccgagggtgaggtgtccgccctcctcctgatttcccccgaggggggggggtcgggttgcgtttgctccggccccgagggccgaggcaccccgaccccttaaagaagtctgcgccacgtatatgggataagtgagcacagctgtgctcacctaacagcatttattgcagtctggtcaagcgtgtcacgctgcatgcaacgcagtacagcacgctcttttatccggtctgtgaccggtcacagaccggtcagatcaagggtcaggtggcgactggcggtctgacgcacgccttgccccatcccgtcaagacgaaagcctctaggcactcgtctcaagccggagctagcgtgttatttcttagagatggcacgttagccctggttaaatgaataccaggcttcatcctaaccattacaggcaaggcgttacacgaagaagggcaaacatgcacgttgttaaaccgacgcgtggtggacaagaatgaccggtctgacactggtcgcatcagcaacgggcagccacgatcccacgttgcacctgtctccgtcgggagtggaggcaggtatgggctgtcccatcaaagtgtcatttggacggcaaccataccgatctccgtccataaagagaagaaaagtccagtttggaaagggaagggtgcatgtggtatccccttgaagtataaaaggaggaccttgcccatttagaaaggggttggttggttggttgattttttcccggattgagagctgagaacgggggagaagtcagctgacactttgtgactcgttcatacacagatccaccaaaacacaggagtagggtattacgcttcgcagcggcccgaacctgtatacatcgccgtgtctcgtgtttcttccgggcagacgatctttacacatacagagagagagagagcttgagatctcaccctaagcccccggccgaatcagcaaaggggggcctgcgcggtctcccggtgaggggccacgagctccgtcatctggcgcgccaggtagggggctcagcgtgtgttttctgagctctcagactcttccgtgggagccaagtttttcttgttcagcctaatggccgagcaaggagaagcgcacgacctctctccgagtgtgagcggcgacgacggggagccgaatccacgccgtcgagctcgtactcccccacctcctccgcgccaaagccctaagcagggggaggcgcttgagaaggtcgacaagtccatggcatcaccagttgcgggtggtgcaggaggacggcaagatggggagcgccgcctcctcgtctacggcgacggcagcacgcctcagggcgcgcttcaggctgctggcgcgctcctacgacacccgcctgtcgtccatgacccggagtctccagcccaacgatggctggaagacgtggccaacttggtcatgacggctcagcagcgcttgggtgctggtggacggtccgccaccaccaagacctccggcgccgctaccaccggctccgtgtcgtcaaggcggagggcgcggcgagcggcggcggctgcacgtcattcggctgctactccctcgtcgacgccttcgactcgggaggatcagcatggggagccggatgcccgcctcaacatcgagcgccggcgtaatagccggcgtaccccccgtgcaacggagggtgcctcctcgtccagagtgtcacctcgacatggacgtgaggaccagccctccgtgcctccggctggtggtgttggctgtagagcctttgtggcgagtcttcggaatgtccgttggcccccaaggttccggcccgccatcaccgagaagtacgatgggagcgtcaaccccaccgagtttctccaggtctatacgaccgggatcgaggccgctgggggtgacgacagggtcatggcgaacttctttcccatggccctaaaaggacaggcgcggggttggctaatgaacctgccacccgcgtcggtccactcctgggaagatttgtgccaacagttcaccatgaacttccaaggcacatatccgcgcccaggcgaagaagcggacttgcatgcagtacagcgaggcgataatgagtcgcttcgctcgtacattcagcggttttgccaagtccgcaatactataccatgcatccctgcacacgcggtgatttacgcgttcagggggggtgtgcggcacaaccgcatgctcgaaaagattgcctccaaagagccccagactaccgcggaactttttcagctcgcggaccgagtggctcgtaaggaggaagcgtggacatggaactcctccggttccggagtggcagcttcggccgcccccggatccaccgctcagacagggcggcgtgacaggaggaggaagaagaggtcggaccgttccggcgacgagggtcatgtcctcgccgtcgagggcactccgcgggccacccgaaaggggaggcctgcgagcgacaaaaagaaagaggctggtactcccagcagggagcgtcccgccggcaggtggtgctccgtccacaacacctccctccacgatctcgcggactgtcgcgcagtcaaaattttggctgagcgaacgaggaagtgggaggaggacaggaggcaggaacgccgtgagggcaagtccccggcggttccttccggcaaacggcgaagtgaggccaagcagaaggcccccgctgttgacatcgatgatggtgatgatgacctaggtttccaagaacctggggccaccattgccaccgtcgatggaggagcgtgtgctcacgtctctcgccggagcttcaaggctatgaagcgagagcttctgaccatggcccctactcatgaggcgatgcgtcgggcgcggtggtcggaggtcgctctcactttcgaccagaccgaccacccaccgtgcattgcccggggagggcaggttgcgatggtggtttcccccaccatctgcaacgtgaagttgggacgtgtcctcatagatggaggagcggctctcaacattctttcccccgcggcctttgatgctatcaaggccccggggatggtgctccagccgtctcaaccgatcatcggtgtgacgccggggcacacgtggccattaggtcacatcgacctaccggtcaccttcggtggacccgccaacttccgcacggagcgggtaagcttcgatgtggcggacctcagtctgccctacaacgcggtcctcgggaggcccgcgttggtgaagttcatggcggcggtccattatgcctacctccagatgaagatgccgggccctggtggccccatctctgtccgtggcgaccttaaagtcgcgcttgcttgcatggagcagcgcgcggaccacctcgctgccgcgaccaagcccgagggtggtgacgagaggcttggcacctctgcccccaccgccccgaggcagcggatcgccacatgcgacgaggtcccggtcaaggaggttgccttgggcgacggcccatccaagaccacacggatcggtggtcttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaggccccggaacgtcaagccttcatccgcgaggaggtggcgaggcttctggaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgtctcgcatagatcagatcgtcgactccactgcggggtgcgaccttttgtgttttctagatgcatactctggttatcatcagattcgcatggctagggaggatgaggaaaaaactgcgttcattacccccgtaggaacctattgttatacatcaatgcccttcgggttaaagaatgcaggtcctacttttcagcgtactactcgaatttctttgggtagccaaataggacgtaatgttgaggcgtatgtcgatgacttggttgtaaaaacgcgcaaccaagaaactttactttcagatctagcggaaacttttgagaacctccgctccgcccgcataaagctgaaccccgataagtgtgtgtttggtgtacctgcgggcaagcttctcgggttcttggtctctgcccgaggcattgaggccaaccccgagaagattcgagctatcgagcggatgcgcccccctagcaaacttagggatgtgcaatgcgtcaccggttgcatggccgccctaagtcgtttcatatcaaggctgggagagaaggcgctacccttgtttaagctcctcaagcgctcggggccgttcacttggacggaggaagctgaaaatgccctcgcccagttgaaggcgtatctcagctctcctccggttctagtcgccccggagccaaatgagtccctgctactttacttagcagcgaccccccaagtagttagtgcagcgttggttgtggagcgcgatgaggacaatcctcattctgcgcacccccactctgtgccgacttggcccaggagcaggcagggaggagaggcccccgagtcaaacggtggcctaaggcccctgacgaccggagacggccctctgcccgcttgtcaaacggtgctgggtgtccccgaccctcaggaaggccccgaggccactgcgggaaggccgcacttaacgccctttgaccccgaggctaaccctgtgctgagccgacccgggaaagagcagggagaagaggcccccgagccgaacggaggccagaggcccctgacgaccggagttggccctttgcccgcttgtccgacgatgccaggagcccccgacccccaggacggccccgaggccactgtgggaaggccgctcctgtcgtcctccgaccccgaggtcatcggcacagaagacgagtgcgccccaaggggccacttggacgaagaacgccccgggggtacggcccctagcaaagaggatcggccccaccgaagggtgcagcggcctgtctactttgttagtgaggccctccgggacgccaagacccgatacccacaggcccagaagatgctttatgctattctgatggcctcgaggaaactgcgccattatttccaggcgcatcgggtcactgtggttacgtcttaccccctcggtcaaatcttgcataatcgagagggtacagggcgagtggtaaaatgggcaatcgagctttctgagttcgatctgcactttgaaccacgccacgctatcaagagccaggccctcgccgattttgtggcagagtggaccccggctccagagaccgtctcaatgcccgaggccagtgcgaacccctcacagctgcctcatgccgcccactgggtgatgcaattcgacggttctctgtctcttcagggcgccggtgcaggggtcacgttgacctctccaaacggagacgtcctcagatacttggtccgtctcgactttcgagcgactaataatatggcagagtacgagggactccttgccgggctcagggtggcagccgggctggggatccgccgcctcctggtgttaggcgactctcagctggttgttaaccaagtctgtaaggagtaccggtgctccgacccgcagatggacgcctacgtgcgccaagtacggcgtatggagcgccattttgacgggatagagcttcggcatgtgcccagacgggataatgtgattgccgacgaactctcacggctcgcgtcctcgcgagcccagaccccaccgggcgcctttgaagaaaggcttacccagccgtcggcgcgacccgaccccttaggggagacggatgcgcctgaccggcccccgaggcccgtcggagtcaaggcctcgggacccgaagggagcgctccaagctcccttagattgattgcttggatctctgagatccaaacatacctcacagataagactctacctgaggaccgcgaagggagtgaacgcgtacaacgcatttccaaacgctatgtgctggtagaagggaccctctatcggcgcgcggctaacggaatcctcctgaagtgcattcctcaggaacaaggcgttgagcttcttgcagacatccatgagggcgagtgcggagcccattccgcctcgcgtaccctggttggcaaggcctttcgtcaaggattttattggccgacagctctcaatgacgcagtcgatctggtccggcgatgcagagcgtgtcagttccacgccaagcaaattcatcagccggcccaggccctgcagatcataccactgtcatggccatttgctgtctgggggcttgatatcctgggaccgttcaaacgggccccgggcgggtttgagtatatgtatgttgcgatcgacaagttcactaagtggcccgaggcttatccggttgtcaagatcgataagcactctgctcttaaatttattaagggcatcacggcccgttttggagtgcctaaccgtattattacggataatggcacccaattcactagtgaactcttcggcgactactgcgaaaacatgggcatcaagctctgcttcgcctcacctgcccaccccagaagcaatggccaagtggagcgcgccaatgcagaaatccttaaaggcctcaaaaccaagaccttcaacattctcaagaagcacggcgattcatggatcgaggagttgccagcggtgctctgggcgaaccgaaccacaccaagccgagcgaccggggaaacgcctttcttcctcgtctacggcgcagaagcggttctcccatctgagctcaccctgaggtctcctcgggccaccatgtactgcgaggctgatcaagatcagcttcgtagagatgacctcgactacttggaagagcgaaggcggcgcgcggccctccgagctgcgcgctaccagcagagcttgcggcgctaccatcagcgccacgtccgggcccgatcactctgcgtcgacgacctcgtcttacgccgcgtccaaacgcgtgctggattgagcaaactctcaccaatgtgggagggtccgtatcgagtgatcggtgtcccccggccgggctcggtacggctggccacgggcgacggcacggagctgccaaacccgtggaacattgaacaccttcgtcgcttctacccctgaaggggggggtcgggtgtcaggttttggctcgggctaaccccacacccccctcgggtgtgccgggttagccgggggctaccacacatgcacatatattcctttttcctttatttcagcatttcaatagaagcagtttcaattttctaaaggttgtgtctgagccgttttttccttttgaggaatcttgacttgaaataatgtcattcgtgctcaaccccaccctcgggggctcggttcggtcagctaaaatcgccaaacggggcccagaaccgagccgtgccccggggcgtggtgaactccgggggggaatcggcaaaaacccacaatcgggtcacccatacccctcggtcaccacgttcccggcctggccagtctcgacatgtggatctccccaggcactggccccgacccgagccattcgaggactgggacttgggcacgagcccttatttcaagctaaggcgcaaaaggaccatggcacagatcatcctcatcgcatatgtatagcaaaataaaactaacacaaaaattttttcatcatttcgtttctgattgcagattgagttaatttatacaaaaaagaggcatgaaggccttagaagaaagaaaaagaaaaaaagtaaagattggcgggggctcgggggctcattccgatgcgcccgggtagccggcctcgtcgccaccgtcatcctcaccgctggcgtcgccctcctcgtcggagctggagacgaacgcgagccgaggggccgacccctcgaagccgttgacgatgtggtcggcagcatccccgacccgcgcgcgcgcgtcgtcctcggtcccgggagggaactcctccagcgccatccagggagagaaatcggggtcccgggcctggtaactcgctagcacgagttcgaccgccccccgggcgaggtccctcgaggatgacttgatggtcttctcgagctcctcggggagtcgttcgaggacccaggccatcctgttgaggtgcggagcgaggccttccaggttgcaagggcgcgtcctcgtctggcctttccagaggcccgcttgccgaccggcgcgatccatgcgggagaccgagtcccaaagcatgtcgggccccatctcgcccgccaagcggagggcctcggcctccccgatggaagaatccagcgcgcgctgcatgtcagcgacggtgtgttcggcagccgcgaggcgagcggctaagtcgctttcgcccgcagccgccccaccgatgcgcgccctcgcggccagctctttctcccgtgcctcgaggttggcagcccgctgctccagcgcggctctctcggcacggacgcattcaaggttgcggcgcgcctgctcctcttgcgccgcctcgcggagggagaggctgttcgccagccgttgcgtcgtggcctcggcctcctcgagagctcgctcccgctcagcgagtacatcctcgcgaaggcggagcgcggactcctcctcggcgcaggcggcctcgtgcgccgccagcgtcgtctcccggagagcagtggcggcctcgcggtccgtgaagcccttctccacggtgccggcgtgttcttccagcgccatggcacgggcctcaagggcctcctcgcgccgccgggacgccgcttcggcttccgttgcccgccgctctcgggcagcagcggagtcaagaaccccttgggcggcgtcgagcttgttcttcagctccgcctcccagctcccgtgttgaaggcggagggagtcctgcgcctcaatcatcgcggtggtggcgacaagggcggctctcgctccttcttcacctctcgggcgatctccgccagcgccgcttgcgggcttcaagctccgagatgtg

SEQ ID NO: 39096 - DNA, 10506 bp, Oryza sativa
caacacgcgcccatgcggcctcgagctccgctcgttctgcgcgcagggcctccacttgggtgttgaacccatccagcactgcggtgtttgcggcggccagggcctgcagaaggggctcggcgctcagcggggcgacagaagatgaggagaagagccgccttggagaaaaggcgacgcggcttggccccccggaggatgcgctgggctcggggatgtcccccgggcccgtttgatcctgggcgtcgcccggtgaggtaggcccaggcgatgcgcccgcggcctcgtcgcgagccgcctcggaggatgtcgcctgagggccgcccgagggagtgggcccaagtgacgcgccagcagcggctgacgcctcagcctggcgagcccgggcggcctcctcccgggcagcttcttcggcttggcgagcccgggcggcctcctcccgagcagcttcctccgcttggcgaacccgggcggcctcccgggcggcctcttcagcttcccgaaggcgggctgcggcttcacgccggtcagactctcgcctccgctcctctgcggccgctggatcttcggcctcggactggccggacttggggtggcgggaggaatgcgacgggacatcgctgaagcagaaaaaaaaagccagaagacgaacaaagtgagcaagaaaaaaacttctttttggagaaagatggttgcaatgagagtgagacgaacctgcgagggggtcggttgaatgaccaccttggaggggaaatcaggtttccccggcacggttccgtctcccccgtcttgcggagccgcttcttcttgcgcaccccctcgggctgcgacgtcggcgcggccccctccgggcgccgactgctggcacgcgccgccctgccccctcggggaggagatgggggaggtgtacctcccagcttcctcttcccctgggcgtcggcagggcggctgctccccgagcccccgacgcggggcccagaagcacgaccccctcctggggcaggttgttccctccggcgtcgctcgcccgcgccgtcgtggcccttaggggctctctcctctgaggccccgacccccaacataatggttagaatggagacgcggtcgggatctatgcagagggggaggatctcctgaggaaggcgagacgcctccgcggagctaagattcagcaccctttggactacgatcttgaagtcctcaggagcccaatcccatctggctccctggtgggtccgcatgtagtcttcaggcccagtgtactcccaggcgctccgggcgcgccgttggagcggcgcaatccgacgacggaggtaatcgccgaacaccatggccccggtgagcccctgggatcgcaggcccgccaggcggtcgaggacggcgtcgtactcctcccccagatctaccggcgcccgccagctggagacctgcgccgggggctggcttggaagtcggaggcgcgcttcgtcggcgaggggggtgtagaaccagtcgctcttccagtcgtcccacttcttgcggaggacgcaggggatgtagcggttcaacaccggcccccgcggctggaagtagcagccgccaaccaccgacggcggtgacaccgactgcacggtgaagaaccaccggaacagctgaagagaggggcgcaccccaatgaacatctcgcacaggtgtgcgaagatggccaatgtcatcaccgcattgggggtgaggtgcgccatctggagatcgtagaactccaggacatccatgaagaaatgagaaaatggcgggaccagcccagccattgcgaaggggaggaagaagatggaccgccccgggtagtctggtgccgggcgcccctcgcccagcatcactatctcccgaccggtggcggactccggcatgaagcggcgcggcagtccggcgtgcctctcgttcacgatgcgggaaggcggcagtacactgccgtcgagcagagcagagccccgtgccatggcggtggaggaagagatgattgggaacgagcgtgtgtggcgaaagtagggcgtagcagagaaagagttagagctcaggcggcgaaggcaagaggaacaatggcgaaaggaagggagcaaatccttttctcgatgcttttatacccttgcaatcgctgggcctggctcctcgtttctcgcgcccactacttcgctccctcgtatctcgctatctcgctccctcgtttcccgtgcccacgcttccactaatcccattcgcccgcttacggcgcatgaagtggatatgcggttgtggcaatcgaaatggattgtatcgtgcgcgcgttaattacgctcgccgtccgaagcggcgttaccgtatctccaggcgagacaaatctgctcacccagattcgcgcgctgctcaagtggtgtggcagtcttgaatagaccgcccattatggacaaccaaagttatcaataccaatgtgcatggattgagaccgttgggcattttgcccaactacggagaccggtcccacctgtcaccaggctttaggggtggcgtcacacttgaccgcttcccttgggaaaggaaattgctctggcataacgccgggggctactgtcggtgatatgggaccgggagtatcatgaccagaggcttgaggcagacgcaatcgcccacgtggcctggcaccttcggggacgttgggcccgagggtgaggtgtccgccctcctcgtgatttcccctgaggggggggtcgggttgcgcttgctccggccccgagggccggggcacccccgaccccttaaagaagtctgcgccacatatatgggataagtgagcacagctgtgctcacctaacagcatttattgcagtctggtcaagcgtgtcacgctgcgtgcaacgcagtacagcacgctcttttatccggtctgtgaccagtcacagaccggtcagatcaagggttaggtggcgactggcggtctgacgcacgcctcgccccatcccgtcaagacgaaagcctcaaggcaactcgtctcaagccggagctagcgtgttatctcttagagatggcacgttagccctggttagatttataccaggcttcatcctaatcattacaggcaaggtgttacacgaagaagggcaaacatgcacgttgttaaactgacgcgtggtggacaagaatgaccggtctgacactggtcgcatcagcaacgggcagccacgatctcacgttgcgcccgtctccgccgggagtggaggtaggtgtgagctgtcccatcgaagtgtcatttggacgacaaccataccaatctccgcccattaaagagaagaagaacagtccagtttggaaagggaagggtgcatgtggtatccccttgaagtataaaaggaggaccttgcccatagagaaagggttggttgattcttgccagatttagagcctagagcgggggagaagtgggctctcactttgtagctcattcatacacaaatccacaaaaacacaggagtagggtattacgcttggcagcggcccgaacctgtatacatcggccgtgtctcgtgtgtcttgccggcgagcatctttccacatacagagagagcttgagatcgcaccctaagcccccggccgaaccggcaaaggggggcctgcgcggtctcccggtgaggagccacgagctccgtcaatatgtaataaacactagcccaagatgcaattcactctttaaatagtttcataaaaaaaatcaaaacatcgtatatataatataatatgaaaaggagaatatatgtaattaacaagtaaaatcttttgtctactcccttcataaaaaagagtcgatctacgtagtgatgcgactccacctagaacaacgagtctaaacaatgaagtagatctttagactccaagagaggaagcaaacttagcgggagagttgatcgacgacgagcggcgagttgttgacggctgcagctaaccgccgccgccgtctgattcgccgacaagctgtgctgctgggcagcagctagcaaccgggatcagacactccctgaatcggattctccggaccagagtcagactcggattggcttctccggaccagcctcgaatcggacaacctgtagctgaatcgatcgcctacatacgtataccagtactactatatattttggtttacccccgtacgcacgtagagtcaattgatcaatatcgatcggcactatagcgagcgagagatcgatcgatcaagatgagtggatccgtgatgatgatgcagcggttggcgcgtcaagcggcagcacgcgtggtcacccagcatgccaggagcggcagcggcagtggcctcgcgggagcagttcgcggttacaacaacgtctcggcgtcgcacgcagctgctgctggtagtgccagtggttcagccaacaaacaggcggcaagggcgatggcgacgacggcatcgcggcagcggcaagtaacagaaacggtaatggcggcgtcgcagaataatgcagcaaggatacgcaagttagaggaggaggttatgttttacagatccttcgccgctttcctactcggtgcttacgtagcagccaaggtgatggaaaaagcgtaattatgtactactccatttgctattttttcgctcggtttcttcaattcgatttgctatcttaactgtacaagtgttaagatagggggtcaagggaccgactttaatttgtatagctacgctacagtacttgtggtaattagataatacgaaataatattaccccgtccattgtataaatccgtaatactaagacgacaggtaatctagcataagcatccataggctcgaaccgctccatccatttaattttcttgtagttgattgaagtggcattgctatgactgcatcaaatttgctccaccgttaaactataaaagatagctcatgaaactattgcatgagagccccctccttccatggccaaccccaccggccaagggggtatatctaccagggggacagcaagggttcaagccttctactaaagcaagaactatagaaacccccacaaagctcccactaatttattttgtcatacataaataagaagggaaagttgtagctctgtctagttcattcagatcccttgctatttattcctggatccattggctggccacacttcatgacagctgccactccagccccgtcatccacctctagcatcaactattgcttcagcctcgtcacccaatgtcacttgctccttacggcgccattaggctgtgttttgaggcgaaggttacgaactccaccaccccgcacatagaatagagcgatccattcgtatataattaattaaacattagcaaaaaaataatttgaaaatggattagatttcttttaaaaaatattgtttagaaatttagaaagcgtgcacacaggaaaaaagaggaagtataagttgaaaaaggtgagtgcccaattcagccttagtctaatttccatctagcgttcagccatggattccctttacctatgcgaggtggcaagagtctcccaactctggagcttccaaccagacctgttgaccaatctcatatgtccagtagtggttttgggttttgggttctttagacctatatcatctcgtcttgattcctagtaccgtctcgtaaagaagtcgaaggttctctatcatcctacctagcccaccatccatctctccccctccttaatcaagtgccactgcaacctatgttagtcatgtgctccgatccagctccaacatcgccgcctcctactgagcgcgcctcctttagtcactgcctctggcccctatctcactgcttggccatctcatccccacaccaacaacccatccctccatcggatctagaaactgtcatgacaaccaatccctcctgtcgagcacccgtgtgtgttgaccctcgccggtcctcggagtatgcatcctaaccacatccacttctaccagacagatttgtaatatttcgacgctttagaaattagaaattaggccttgattatttgacatcctaggcaaatcaatccacagcacaaggcataactctccatatagctccgcctacaaatcacctctaaataaagtaaaagaaaaggagtacatactctatggacttcactggagataactcatatgatacgtacctgttatctatatttttaaaagaagacgtcacaaggatcaatcgaggtcagggagcgtcttttttccttgttaatctgtggattcttgcacacgtacccttcatccttcgagttttggctatctcaagaagccgtagtgtactgcacgactcatctagtcatcttgtgtccgatattagttagcagaacacgagtgcacaacatcttaactaccacgcatccaaatttaaggagaaaaggtcgagtactcaggttaccatttatagggatgaaaacggtcggaaacgatcggaaaacagcctcaaccatttccgtaaccatatttttctcggaaatgaaatcggaaatggtaaattcggaaacgaaaacgatatcggaaatatcggaaaaccgaaaacggaacaatacggacggaaacatgtcggtacagatcggaaacaggtaacaaatacggatacattaaactataaaaacatatatttaactttacataagtatgttatatgtatacataaattcaagcttatactatataaattataaattaacttcattttagccatgtacaaaagttagagatttgattgaagagtcagtcaatatgtaagctgcgggtcaagtatagacatgctctataaatatcgacatatttagaatatggtaattaccatattataagaaacggtaatttccacaagaatacggtaaatacggaaacgatcggtataacagcaaaaccatttctgttttcatttccatattttttaccattttcatttttgtttcggtcgattaccatttccatatggctcggccggtagaaagtcgaaaacgaacgcccacccctaaccatttatgaggtatacgaatcactgaatagaacaggtcttgcgtgatcctacgaggtgtccacatccaagcaaaaaggttctaaaatagggttattaccaaaataagtgttactgaaatttaatttggcattgccaacagaatttgccgaccatttcgtttcgctaccaagatttggtaatgcttgtggtcaagccttcttggtatatatggcttacgtatatatggctgcttcttcgttaattattatctccattaatcttagaatattatgaccagatattgttcaaatttaaaatttggcatgttcttttagcaataaatttataaatgcttaactgttcggctggatgaggctgataagccatagaaaaataaataaagtaattaaaaataatttgtaggtaaatttttatatttatattattatagcgatttaaaagctggacttggaaaatagactacaataatagaatcccaaaatcaattctaagattaatttttgaaaatttaaattttgatcatgacggataaactacgtacccaccggacaatgagtgtacagtttgtttcatcatacacaaatacaaccaagaaacttccgtctcataatctaaccatttaaaagttatttcttttcgaagttaaaacatcaaagtcaatgtggagaaatgtttggaaacaaatgaagtaacccaagtaatagtagcctacgcaaccttggcgactattgagcacttttctggtactagcagagtaagcacggttattttgccacaatatatattagataaatgtaaaaagcataatgttattaatatttgggtatggctcgtattgacaaacagaatagaataacccaatattaattagattgttacgaggcagcagtttttgtgcttctaaaattttaattattacattcatacgaaaatgcgaatatcaagcgaactttatgcgtcactaacccacgtccttctgattttacgtgagaggaccagtttctacccagtactactatctttatattttaatatatggtattattgactttttagatatcgataattcgttttgtttttaaaaatatttaattggtatttattttgttgtgactttgatatatcaccgagactccgtgcaccgctatatatatggggcttcgtcgtccgcgcgctccgtgtccgcgcgttggtacaccgcagtacgtctcgtgggcacgcagcggcgtgtaccacccctgcaggtgcgcggcggcgtccaccggcgaggagatcaaggagcgttccggcgcgctcgtcctcgatcggtaccaatatatgcatgccatcattcaagctgtttgcgtatatatcccctgattaatcattcgagctcaccaacgtacgtacggccggtgcgtggctgctgcagatgcaaaggcgccgtgagggcgagcgcgccggcgcgcctcccccgttttctccccggtggacgcccgcgccgcaccggccggtgtggtacgcgccgctgcgcttccacggagacgagacgacgagctcgcacgcacgtacgcgcgcggccgggtaagttgccaagatgaagccgcctcagcgcgcgtgcgcgcgcgcgcgctctccgcacgcccgcgccgcgcgccgacccgatggatcatgcaactgctagctgccggccggtgcgcgctcgggccggcttgttgaatcatgcaagagtggtggcgcctgctcgatctgctgctgcttgatttggctcggttagtttctgctgtatggatcgggcgatcgatacagcagaaaaccatctacaaatagctaggaagaaactccttttgacgcattatcctctcacatgagttactgatatgttggccaccagtagtgggttcacatatcagtaactcaaaatcagataatagtaagttagaggatttgtttctcttacccttcctctattttattgttgctgctatttccatcaagttaattggggctattagaccactgcaaactgatatgagaatatcttcctctgtatctcgtctcctactctcggttcgcagtccgttagagctcgtagtttgatctaatcgcaagccacaattactagtacatctttttttttcaagtttagaaaaaagaacaagtttaaattgaagttcgtcaagtgaatttaaatttcaaatttaatttatgaatcctatgataagaatctgaggttttaatgcctgaatcattaaaattcttagaattaaattgattttttaatcatgaaacccaaaattgaaacataaatcccgaagttcagatttttaaaatctagctgatagtcaaggacctcatcatatttcatatatatctacctgataataataatctaattaggagaacaaataaatgcccaaacatgaataaccataatggaaaaacagacagttaaaacagagggacgacgacgacgacgacgcgagcaacgacgtgacgccaacccaaactcagctcggtaatcaaccacgatcgagtagcttgcattcgcctcgccggcggcgacgtcgccgccggctagacaccgccgcagcggtaggtgatcttgcacgtccttccgaccctcaccacgtacgtgtgctgcggcttcaccaggaatggcggcagccgcatcagcgcgtcgcacacgcagtccttggacacctcctgcagccaccggcagcagtcgcggtacgccctcagctcctcgtcgtggtgctcgtcgtggtcgtgctcgtggtcgtcgtcgtcgtcatggtggtcatcgtcgtcgccgccgccgccttcgtcgtcgtcgtcaccgcgaagacggccgcgcctgccatggccgcggcgccgtccgcggcctccgccgcggccgccacggccggtgcggttgccccggtggcccgcggtgtcgttcccggctacggcgggtgcgatctgcgtgctgccactgccgttgcccgccacgagcgccgagaggtcgaccacggcggcgtggccacggcgcccccggtcacggtggtggcggtgacggtggcgcacacggtggtgatccccgccgccgtggtcgtcgtcgtcaccaccaccaccgtggtcgtcgtcatcgtcgtggtcatcatcgtcgtcgtcgtcgtcgtcgtcatcatcgtcgtcgtcgtcgtcgtcgtcgtcgtcgtcgtgctcgtcggggggactaggcgggaggatggagcacgcctggctggcgatggcgaactggctgatgcagaaggccttggccttggactgcgccgcgacggccgcgaagagggaagggaggaggaagaggacggcggcgatcgccgccgcttgaagcgccgacgccgccatggccggctagctagctaagctatagtgtatagatagccgtggcctcactctctggctaagtgccactacttatatatatataaagacttaattgttttcaagtagttgggtaacgtaacttaaccaagatagaggggggggggggggggg

SEQ ID NO: 39097 - DNA, 801 bp, Oryza sativa
cagcctaaaagagtcttttgtcgcagtcatcacaaggtaaatccattccaacccaaggcttgttgtcctctttccatttgaaccagagccaccgtagtcttagagcgcgagaaaatttctcaaggtctggaattccaaggcctcctaaaaatttaggtctacagactgtaccccaattaaccaagctacttcccggatttgttttgtctgggtcttctcccttccataagaaggatctgcggtaacgatctattctgctgattacccatttgggagcttgaagggcagttagatgaaaggtcggcaatgcacttaacactgattgcacaagaattcttctcccttctgacgtaaagtagcgtcctttccagctagggagacgcgatccaatcttttcaattagaggcaagaaatccactttcctaagctttcgaaaatgtaaaggtaagcctaggtagcggcaggggaaggatttcaaagttccagggaaagaagtaatgacatgtgtcaagtcggtggtgtcgcaacagataggagaagtgaatgtgaaggtagctcaactggcacaggaccaaaggcaacaatgacaagcatgagcagtgtggtgcttgagctcagggcagcgaagaagttggagccttcagaaagcataagcgtggagaccatctgctcattttcctagtcattaaggagccaacgaacagaactatgtgggcactgggcaggggcggcttgatctcgttgtgccctgctcatggctacttgctcagatctgcgtggctcttgaagaatgttgtggca

SEQ ID NO: 39098 - DNA, 62877 bp, Oryza sativa
  unsure (1)..(62877): unsure at all n locations
acgctccccatctcgccgttctcctgcatcacctgcggctggtgacgccgcggatttgtcgaccctctcaagcgcctccccctgcttaggactttggcgcggaggaggtggaggagtacgagctcgacggcgtggattcggctccccgtcgtcgccgctcacactcggcgagatgtcgtgcgtttttccttgctcggccattaggctgaacaagaaaaacttggggcacacggaagagtctgagagctcagaaagcacacgctgagacccctacctggcgcgccagatgacggagctcgtggctcctcaccgggagaccgcgcaggcccccctttgccggttcggccgggggcttagggtgcgatctcaagctctctctgtatgtggaaagatgctcgccggcaagacacacgagacacggccgatgtatacaggttcgggccgctgccaagcgtaataccctactcctgtgtttttgtggatttgtgtatgaatgagctacaaagtgagagcccacttctcccccgctctaggctctaaatctggcaagaatcaaccaaccctttctctatgggcaaggtcctccttttatacttcaaggggataccacatgcacccttccctttccaaactggactgttcttcttctctttaatgggcggagattggtatggttgtcgtccaaatgacacttcgatgggacagctcacacctacctccactcccggcggagacgggcgcaacgtgagatcgtggctgcccgttgctgatgcgaccagtgtcagaccggtcattcttgtccaccacgcgtcagtttaacaacgtgcatgtttgcccttcttcgtgtaacaccttgcctgtaatgattaggatgaagcctggtataaatctaaccagggctaacgtgccatctctaagagataacacgctagctccggcttgagacgagttgccttgaggctttcgtcttgaccggatggggcgaggcgtgcgttaaaccgccagtcgccacctaacccttgatctgaccggtctgtgactggtcacagaccggataaaagagcgtgctgtactgcgttgcacgcagcgtgacacgcttgaccagactgcaataaatgctgttaggtgagcacagctgtgctcacttattccatatatgtggcgcagacttctttaaggggtcgggggtgccccggccctcggggccggagcaagcgcaacccgagccccccctcaggggaaatcacgaggagggcggacacctcaccctcgggcccaacgtccccgaaggtgccaggccacgtgggcgattgcgtctgcctcaagcctctggtcatgatactcccggtcccatatcaccgacacatatgttgcatattggactagctagtagcaagttttttcactttagaccatgttttattacctaatattgcgttttggactattttagtgagcatgtcagtcaccaaaagcatcttcttccacctttcatccctaaagacaattccagagcatatgctgctaaatttggtgaggagaagtgaatgtttttttttttgaggtgaacgacggcaggagctctgccggaatttcattagaggagagaaaaatagttcagagaatacaggggaagacatcgaaggagaagaagggagaaacctgaaaatacaaagggaatccgaaaaagaaaagacaattaggggggttggaaagcagtgtgtctgagatcaagttcttcctttactattctcgcaacgcgatcctctgtgtaagagatgttttgaaaaattcttctgtttctttccaaccaaatgttccaccaagtggcgagaagagatcctttaaccctgaatttgaaaggtttggggtgtagttgattgagatcagcccaccaagctgtgttgtcatctgcaggctatgcccccgggatgttttgctattggcacaccataagccaaacttttctgaagaaggggcagacattaaagagatggttagtgtcttcaaacgcctctccacacaggctacaaatccaattgcaaggccagtgccggtgcaaaagattttgggccgtgagagttttttagtgaaggattagccatccaaagaagcgcatctttggttcagctgggcacctccaaatggaatgaaaatcaatcggagagaaggacccttggaactgaaataaataagcactgtttgcaaagtaggatcccgattcattcaggttccaagtgatgtcgtcattggtttgcggtagaagctgaacattttgcagcattcccccaagctggacaagatcgctaatttcttcaattgtagttatttgccgaaaggaaaggagccaagaattgtttgtcaattccgttttaaccgatctctgtttgcgcttagctaggttgaaacacaagggtgcaatgtcttttggacatgtattttgcagccatttatcatgccaaaatttgttttttctccattacccacagttatcgtagtggcagcctaaaagagtcttttgtcgcagtcatcacaaggtaaatccattccaacccaaggcttgttgtcctctttccatttgaaccagagccaccgtagtcttagagcgcgagaaaatttctcaaggtctggaattccaaggcctcctaaaaatttaggtctacagactgtaccccaattaaccaagctacttcccggatttgttttgtctgggtcttctcccttccataagaaggatctgcggtaacgatctattctgctgattacccatttgggagcttgaagggcagttagatgaaaggtcggcaatgcacttaacactgattgcacaagaattcttctcccttctgacgtaaagtagcgtcctttccagctagggagacgcgatccaatcttttcaattagaggcaagaaatccactttcctaagctttcgaaaatgtaaaggtaagcctaggtagcggcaggggaaggatttcaaagttccagggaaagaagtaatgacatgtgtcaagtcggtggtgtcgcaacagataggagaagtgaatgtgaaggtagctcaactggcacaggaccaaaggcaacaatgacaagcatgagcagtgtggtgcttgagctcagggcagcgaagaagttggagccttcagaaagcataagcgtggagaccatctgctcattttcctagtcattaaggagccaacgaacagaactatgtgggcactgggcaggggcggcttgatctcgttgtgccctgctcatggctacttgctcagatctgcgtggctcttgaagaatgttgtggcaggggtcaccaccattcctccatattcggcccaaaacactactaaggaggagattgagtctttattctaagtatccgggtggcaaagagtcattcgaacaggaaaacggtaaaataccattcgagttggaaaacactattcgagcaagttcttgctactaagccaaatcatatgttttgagtgttttctaagttaatgacaggtcaattgccaggtaagccgaaaagggtggtcgagatggaaaagacaacttgccgtagaaaagacccatggagaagacccttggtggtggaaaaggctctcggtcatgaagaaggcaatttgagcaataaagatgccaagagaatattctcggggaccacttgaacactctatctagcttgcgccaaaagactataatgacccctgaaatataccaaaataatcttgggattgctgatgtggcggggggcaattgtaatctcacatgggcccaatgaggggcacaattgtaatctcacatgtacagctatgaactatataaagtagataaaaagcctgtagcagacaggacatattggaatactaaaaatctcatcggtcaaagcgtgtgtacattttgtattcgggctcattcctcatgataggcgggaaaatggtgttttctcgtctatcccccaatcttgtccgtaaccttgggtcacaacaaagaagaagaagaaagagaggagagagatggggcagctggaggagaagacaggtacaatgtaaaacattttgcaaagaaacctggtctaaagtgaaaagtgtattgtaaccttagtccaaagtataacatgggtaaaaatacatggtccaatgtgcaattctctcttaaaaaacgtagtaatatttctaacacaaacaaatatattgtcaaaatatatcatgtgttagctttagtacgtgaaactaatttgttattgtatagataccactacatttttctataaattttaaatttaaaaagtttgacttaaaagttcaaaaaaaattataatgcaaaacagagggaagcaacaagaacaaaataaaataaaataaacagtcccacttgtcaggaataagagggtatgggtgagctacactgccctgacgcatcaatgggttgaataggacacatgcacaatgctccctcctcccattttaagtatagccatgatttttcatgcccaattttgatcgtccgtcttatttaaaaaaattttaaaaaaattttaaaaacataaatcacaagtaaagtactatacatgttttatcatctcataacaataaaaatactaattataaaaaaatttcaaataagacggacgatcaaagttgagcgcgaaaacttatggttgtacttaaaatgagacacagagggagtaagaaaaagaaggaagtgaatcagtagcgtgcgaggagaagggaagagaagggagatgggacgacttttggctcaaagcaagaagatggatttttaaagcctttcaattaaaacaactaggtgaaactccgcgcattgctgcgggaatttagtatgataacaaaaaaaaaataacgtgtaagatagctatataacatcagattaagtaaattaatgtggtttatgataatttaaatttaaatagtatgtagaatggtgattcaaacgtaaaaagtgaggtggtatgactttatggaagaaaaaagtagggagatagtttggaccatagattaatcatctaaaagctaaaaacaatttatgtgatatgacttaattagaggaaaaaaaggaaaaagataatttggaccatagattaatcatttaagcactaactaagtgaggatgaactaaataagtatataggatatcataaaacataataaagatattcattgaaacattatgtgaattatgttggatgataatttaacatgtttgtatttgaaaagctcttaaattataaaaagaataaagatatagcatgtttgcatgatgtttaatgtgatgattgttagtggatgatgatgtggcatcttgttaattagtggatgatgatgtggtatctttgcatgttaagtttaaggagttagtgggggataactttatagtaagataggaatacagaaatgctctccccttcattaaggccttgtttagttggaaaaaattttgggtttgattgtcacatcggatattcggacacatatttgaagtattaaacgtagtctaataacaaaacaaattacagattccgttaggaaactgcgagacgaatttattaagcctaattaatctattattagcaaatgtttgctgtagcaccacattgtcaaatcatgacgcaattaggcttaaaagattcgtctcacaatttacactcgaactctgtaattaggtttttttccacgtttaatactccatgtatgtgtccaaacattcgatgtgatgggtgaaaagtttttgttttcggaactaaactaggcctaaaaatgcatcctatgaaagaaaaattgcttgaaaatctaaaaaaaaaatatgagctacaccacaaatattataccgccaggcagtagtactccaatgagtatctccacggtatctaggcaggtgagatccatacacacatagtaaccacctaccctcacacggtcatgaccatgtatgttttaatgtcttcccatataatactttcagtgtcggacaatgaacaaagaaaatatttgatgagatagataactcagtagtctgctaatgaagcatatgttgcttatcatgcatactttgttggtgagctgaagatataccacggagttcaacattccatggtttaaataatttatttacctttaaatctatatatgttgtgagggtaattagaaaaagatcataatagttgacttcgtgaatctcaagatacacctaacaatgagaactccaatttatatatgttgtgagggtaattaaaatttattcttttagcgataaacgacttacatgtcactattgatgcgcttgtggtgacttgtgaatatcatgccgatttagttttagagtacttataagatagggtgtgcaagtgtgctcacttatataggcgcatgtgtctgtaccctgtttcaaaaaaaatcacaaccgttgagaagaaaaggtaacaagttcaaaatagaacaaaagaatgtgctttttttaaataaaacaaaatcaccctcacataaatattaatattttttaaggtaataaaatttcatgcaccattaaaattaagaggatgcttgtgataagaggcgaagccaagatttatagataggcggtgtcgagattttcagagactcggtaagacggccaaaactttcgggtttttggattggccatcaaaggagcacaacacgtcgacatgtcatgactatagatggccaaaaggcccgaggcccgacggcctggcccacggcatgacattttggcccagcccaagcacggcacggcccgaccaccgggccgtgcctaggccccccactggcacgttgggctggcccaaaatgaccgggacggcacggcacgatgggccgacaggccaggcccgacacacaaagaatagggactaaaaatagacttattttagctatatatatatatatatatatatatatatatatataggacactcatatggggcaccatggtgcccgggcaccatggtatctaatgcacaaaatcactcaaaattttcaaaatttttaaattgtgagtatatacctagttataataattcgattcatacctatacttatcaacaaaacaactcaaatttaactttatttcacaatcagtgattacgtacctaagtaattatatgtatggatgctatatacctagaatcaaaatctaacaaaaacaagttcaaattcagtacaaacatgctttgaactagttagtaaagtagttaatgttaatacctaagtaattgaaaaagtttcatactcatttgaattgggtatatatatatatatatatatatatatatatatatatatatatatatatatatatatatatatatagatatgtagaccagagaggagggaagagagatagacttattttagctatatatatacatatgtcacagcccaacgaggagggagagaaaatagacttatttaaaaaaaggcacgatagaccacccgtgtcttcggaccgacacgacacggggccgtggcagggctggaggtgtagcccatgggccagcacggcccggacgaagtgccgaccgggccatgctggtccgatagctggtgggccgtgtctagccgtgcctaggccgggcgggccttatgggcatctatagtcatgacccactcaccaaccgatgaagcctcaagtatgtcatgaagaagctgagcagccgaacagttgagactcggatgcaagttttattggctcatgcattttgcatctctcttttttagtattgctaatagttcttatactgagaaactatatttaacaacaaaccacctcattactatagaatacctaatgggtgccatttgagaatcccacatagatactagacttcgtaaccgacactgatgtggagaatcatagatgttggtgcacctttgaggttctagaaatgaaaaaataatgtggctcgacgcatcggcttcggctcgaattgagcacatgttttgagccaaggacttaatcccaatccaattacaaatccaacgcaaaaatttaatcctaatccatcacaaattagaataatcaccgaatgatatatagaatatcaacattcaacacaaaaggttaactacaaaaaccgaatcatagtccaccgaggctatcgcggccattagttgctcaccgaaggccaagcctatcaccatcgccactcttcgccagtcctcctcctcgccgtcgtggtggtgccgagctcgggggctgccggatctagcccccgcgcatccttctccacctcacgggacatgagagtagaggagaggagagggaggcacgagtggagaaccttttgtgttggtggaatcggatggccgctgcataggggagaggaagacgacggaggaagacgcagtcgctgttgcaccggggagagcgaaaaaaaccatcaccgtgcctatggtggttgtgcctagcagaggcgtccggccgccactcaccaaccaagctcgggtggggagacgagagagagggagcaaggacaaaatgatgagagcgaacgagagagaagaattggatattgatgacgatagcgttgggaggatagggatgagacttaaaaagatgtttttttttctcttctcccatgctcacgctcagctcggcttggctccaatgaagcgttagtttttttctttttactaaaccaacacttttattccacatataagtgttaaactttgcactaggatcacctaggttagatctagtcgggtggttctatttgggtttgatgaacgacattgtagatgaaagggagagggtttagataccgaccggttgaggagatcgtggaggaagaggcgccggacatcgtcgttgtcgtcgcggcttgacgtggatgcggcggtggcgtttcccgtcactggctgcgccccctctcgatcggattagggttttgtggggtggagttggcggcggcggtgaatctcgtaccatgtgccgtgccggcctccacccctcttttatatggcgcagtgtgacgggggcccaccagccattgggctgggcgcccccgatcagggcgcggtcaaggcccccttgagccgttgggctcaaggggagagagatctatctaacattctcccccttgatctcactttttcttttagctttttctattccatcacagatttgtaaatagagcatgtttcatcgtcacggtcaatcgccgatggattcgacagccactatacacatctctattcagaaacagatactttacttttgggccctgtagtccaggattcataaggcttcccttaaacccatgccggctacatgttccttgaacacgttgggtggtaggcctttcgtgagcggatccgcgagcatcctttctgttttaatgtgctcgagactgattgtttgatcccggactttgtccttcacaacatagtactttatgtcaatgtgtttggcagcaccacttgactgattgttgtgagtgtacattactgcgggttcgttgtcgcagtataactttagtggtttctcaatactgtcaaccacctttaaaccgggtatgaacttctttagccagttcacctgccccgttgcctcatagcatgctataaactcggcatacatagtagaccctgcagtgatagtctgttttgagcttttccatgaaatagctcctcctgccagggtaaacacgtatcccgatgttgactttgtattatcttttgcaaagtcagaatctgagtaccccactatctggagtgattctgatcttctgtaagacagcatgaggccttttgttccttgcaaataacgcaagactttctttaccaatttccagtgctctaggcctggattactctgaaatctgccaagtaacccggtaacaaatgccaagtcaggtcgtgtgcacacttgcgcgtactgtaggcttcctacagctgacgcatatggctttgttttcatttcattgagctcatactgatttctgggacattgcgatgccccatacttttcgcctttcattataggagcaggtgtagcactgcatctgtacatgttgaatttcttcaacaccttttctatatatgtcttttgagaaagtcccaatgcatactttgttctatctcggtgaatctctatgcccaaaacatatgaagcctcaccgaggtctttcatgtcaaagtttgaggacaagaatttctttgtttcctgcagtagactgacatcactactagccagtagaatgtcatccacatacagaattaggaaaataaatctcccattcttaaactttgaataaatacagttgtcctcgacattctcttgaaacccaaatttctttattgtcccatcaaacttcaagtaccactgtctcgaagcttgctttaatccataaatggatctctttagacgacatcccatattttcgtttcctttcatgacaaaacctttcggttgcgccatgtatactttttcctccaaatctccatttagaaatgccgtttttacatccatctgatgtaattccaaatcataatgtgccactagtgccattataatcctgaaggaatctttacaagagactggagaaaatgtctcattgtaatcaatcccttctcgttgcgtgaagccttttgccacaagtcgcgctttaaacttttctatattccctctggagtcatatttggttttgtagacccatttacagcctactgttttggctcctttaggaatttcttctaaatcccaaacatcgtttagtttcattgatttcatttcatctttcatggcttccaaccattcagatgagcgagcgcttctcatggcctcttcatatgaggtgggatcatcctccatatgcgactcttctatattataaactttatagtcatcacggatagccgatcttctgactctttcagaccttctaggggcctgcacatttggcacatcctgtacctgaggctcttgatgagtctcctgtactggcacattatctatttgaggctgttgtagctcctcctctggcgtggcaaccatttctgttgaatcctgtataacaggttcctcactctcattcattgttgccacaggaggggtaacaacaggtgctggtacctcaatgacaggcattgcaggcacaacatcagcaggtagagagaagaaaggttcctgagtcgacggagcgggtacagacacccgcctctcctcaagatcaatttctcgaactaccgagctccccctaatcatttcgtcttccaagaagacgtcgtgtctcgtttctacaaactttgtataactgtttggacagtagaaacgatagccttttgatctttcaggatagccaataaaatggcaactgactgttttggggtccaacttcccaatatttgggttaaatactttggcctctgcaggactcccccacacacggaggtgagttagcgagggtactctccctgtccatagctcatacggtgttttgggcaccgatttgcttggaactctgttgagaatatgaatggcggtttttaacgcctccatccataaaccgagtggtagtgtggagtagctcatcatgctgcgcaccatatccataagcgtacggttgcgcctttcagctaccccattctgttgaggttcgcccggtgttgaatactgggctactattccattctctagcaagaaccttgcaaaaggtccagggacttgcccataaggcgtatgtcgaccatagtactcccccccacggtcagatcttactactttaatctttatatcatgctgattttcaacttcagctttgaatatcttaaatttatccagtgcttctgatcgctctttaattggataaatataaccatagcgggagtaatcatctgtgaatgttatgaacgagtcatagccatccacacttttcacaggaaatggaccacaaatatctgtatgaatgatctctaaaattcctgcgcttcgttttgcaccctttttgatgctctttacaaattttcctttaatgcattctatgcattccaatggaggaagaatttcattcttaactagtctctcaattctccccctcgaaatatggcccaaacgacagtgccataatttcgatgagacatcgggagttcgctttcttttcttgttttcttttgtcaacgaggacacaacattcacattctcagaaagagataacaaataaagctcgtctcgcaacacagcaagaccaatacatgcattattatgccatagttcacatttgccacttccaaagcggcaatcatatccatcaaaatccaactttgatacacttattaagttcctttgcaaagaaggaacataaaagacatctcgaagtaaaagtatgaagccattcgcgagctctagaggaagatctccaacagcttcaactttttcttcaactccattggcaactctaatggtgctttctcttctttgcgtagtcctcgtcgaacggaatgcctttaaacaattacaagcatgaatagttgctccagaatcaatccaccatgtggatctagagtaaccaacataatgagattcatttacaaatgtaataatgttctcacctttctttgccatgatcattttcaaaaagtcaggacaatctttcttgtagtgtcctgtcttcttgcagtggagacattgatctttctcaacagcgaactgttgttgctgaggcagatgctgagactgtttaccttttgaggtgggagacttgtggttctttttcttatctttaacatagtttattgaaccaccatttgattctttgattctctcctcctcttgcacacaattagcaatgagcttctcaaagttccatttctctggacttatgttgtagttgacaataaaattgtcaaactgctttggcaatgaggccataaccagatggaccagaaagtcatctgttatgcccaaatccattggcttcaacttggaagccatgttgctcattctaagtatgtggtctctaacaccacctccattgtacctttctgtcacaagctgcttgatcagctgtgtagcataagtctttgaagagccagtaaactgactctttattctttcaaggtactctgagacagcgtcacactctgggatcgagcccaatatggtaggctcaatcgtattctttaccacagccaaacatttcttgttggctaaggaccatttcttttgttcaatgtcatacgacatgacgagaggagcattgtccctctgtctcttttgccagtcagcatctgactcattttcacctctgacaaggtcagcaggttctataggacatggggtagtcaatacccagtccacctctcccaagataaaagcaaggtcgagttttcttttccattctgcgtagttatctccttttagggtcggaatatctttaatgcaacccatcaaggagtagccacctgaaataatcatgtgcggtgagaacaaaattaacattaaaatattatgcattaagcctacatcaccgttgggcagaattagacataacacatataaccataactataatattgcaattaacaacgttggtcagaaaattacaacatcatagcacataattaatgttcctaaaattaaattctcccgttggttcgaaatttaattttagaaacactaattttcatcaatttcatctatttgcagcggaagactatataaaatcatatgaacagtagcaaaatctctgtaattctctctctgtgaaaattctcccgttggttcaaatttaaacagaggtaaaacatgcaaaaatctattcaaaattctattgaaatttgcatgaaaaatcgacaaaataaaatggaaaaattgctactgttctcttttattcattttcggccccgagggacctaaattgaacttttccggcctttgccggtcggcctatggccactttgcgcgcgggcgagcgccccctcccctcccccaggccgcaacctgggcctgggccgggaaagccgccgccgcgcgctccccacttgggccgatttcggtccggccgccgccggccgtccgatcagctagggtttcgatcggacggccgggcgccgagatcggaggatcaaaaacccccctctcccggccggccgccgaaaaccctagcttctcttctcttctctctctcacgcgaccgcgtggacggcgtcgccatcgccggcgaccttcgcgccgccgcgccatggccggcgctcctttcttttctcttctccgctccccccaccgtctctaacccccaccgtgtgagagagagatggcgacgacggagatggcggcgccgccgcgggccccctcgccggcacgcgcgtgcaggtgcgcgcgcgcccgtcgagtggctcctaggcggcgcctctttgcccctccccccctccgttgccggcgtcaacgacggccggcgacgaggtaagaattagggttagggtttttggttcttttgatccgtgcggatcttgtgcttttctttctttggatttctttccccgaaacgatctaaacactagggttgctctgataccattgttaaactttgcactaggatcacctaggttagatctagtcgggtggttctatttgggtttgatgaacgacattgtagatgaaagggagagggtttagataccgaccggttgaggagatcgtggaggaagaggcgccggacatcgtcgttgtcgtcgcggcttgacgtggatgcggcggtggcgtttcccgtcactggctgcgccccctctcgatcggattagggttttgtggggtggagttggcggcggcggtgaatctcgtaccatgtgccgtgccggcctccacccctcttttatatggcgcagtgtgacgggggcccaccagccattgggctgggcgcccccgatcagggcgcggtcaaggcccccttgagccgttgggctcaaggggagagagatctatctaacaataagtgcaggtatattaaaacctgacacttttgttattattgccgaatttttaataaatcagcacatataaagtgttataggtgccctttttaatttcaatcccgcttaaggtgtcagtaggatgtaaaaagcctcacatatatatgtgtgtgtgtgtgtgtggattttaaattaacttggcacgtataaggggcatgcctgattcagctatcgattggatgcatgcatcactagaacacctggcatattcatttatttcgtcaccgccgcttgcattcttctatttctgcagcttaattaattatgcattacggcacacaacaatcacacacacacagaggttagctacatatggattctatagatcgattattgcccttttcttgcgctgatgctggaaaattaagagacaaataattctactagctacgtacgtagaaatctgcggcgacgagtgaccacctaattatcgagccatcaccctggcggcggcgacaccagcaaagtaaacggagcaacctctccaaaaggaagcctcgtagagtagccaacgaagcctcctcgccgcgtcctcctgcgacgtcgacgatggccgcggccctgcacctgctgcttcctctatcgtcactaccacgtccggatgtcgccgcgccgccgccgccgccggcgtcacgttcttaccaccagctgcagcgacgccggcgtggtggtaaccgcgagccgtagccgccgtctgattcctggcacgctgggtgaccgcgtgtgccgcttgacgcgccaaccgctgcatcatcatcacggatccactcatctctcgaccgatcaatctctctcgctcgctgtattgtagtgccgatcgatcaatcgattctatgtgtacgggataaactaacccaaaatatatatacaggcgatcgatcgattaaactactggttgtccaatccgaatcagattctgagaccgtctcgatgatctcggttgcttagctgctgcccagcagcccagcttgtcgcagcgaatcagacggcggcgccggcggttagttgcacggttgcagtcggcattggatctcgccactcgccatcgatcaaccctgccgtccgctacctttgcttcctctcttggaactaaagatcatcgagttccagacacgagattccacgtgcaacaacgaactacaataccttaattatatacttcctttgttttatattatacaatgtttgaattttttttcaatcaaattgttttaaattcaaacaaatttataaaaataaaggcatgtagtaacatttctatagatgtcggatttagtaaaattaatttggcgttatattagatgttgctacgctttcctataaaatcaattaaattttaaaagtttaaaaaaatcaaaacatcttataatataaaatgcaagaaaaccatcattaccatgaaatatacaaatatatataactatgaacatacattaattagtattggtttaatttgttttgtttacaaatttgaacatggaggctgtgaagtgatatattttgtattaattatattatcattttttctatatatatataggtggtataaaaaaacgagggaatgcatgtcctctccaattatgaaaatccatctccctatatttatatactagaactatttgtaaaatagcactccactgtgaataaataaggaaaaccttcttcctaatcatctctttaatttccccgcaaaaaaaatcatctctttaattaaactgatgacatatgggtcccacttatagtgactggatgatgttacttccatcacaaaacgtactttcgacgacatataattgtcactctaatcaaacgcgatctgcttgcactatatatattaattatagtagtagcactaacgctagccaacgccaagccactccattctaattagtattgcagctgcaccagctgcgccctcaggcgacacgccgccgtcatcggtgccaacgccgccggcgaaccggcggcggcattgtcatcgtcatccacggcggcggacgcctcgaggaagcggccgaccatctcctcgcacggcttccacaccaccgcctcccacgtctccctgtgcggcgccccctccgccatgcgcgccaccaccaccgtcgcgtccacgcgccgcacgtcccacccgtccagcgcgctcagccgccggatcttcgccacctgcgtcgcggcgaggcggtaggtgttggccttgatctcgcgcacggcgccgtcgagcatggcggcgagctcgccgtcgtcggccgcctcgccgcccgagcgctcggccaggaggtacccgtgcatctccgggatcccgatggcgcggcgcacgccgcgggtgtagtagtccgcggcgccggcgccgtcgacgaacccggcgcgcgcctcgcccaccagcccgcgccgcaccatgtggtccacgcgcgccgcggtgtaccaccgcagcaggcccggcgcgacgtcggtccacaggaagaggcagtcgtgcgccgcgcggaacgcgccgccgccgccctccaccagcgcctcgacgtaggtgttcgacccgccggccacgacggggaggcggcccgccgcgaggacgcgggcgacggcggcggccgcctcgcgccggaagtcctcgccggtgaagtcggcgtccgggtggagcacgccgaggaggtggtgggggacgccggcgcgctcctcctcggtgaccttgttcgtgatgatggggaacccgtcgtgcacctggatcttgtcggagttgatcacctcgccgccgaaccgctcggcgatggagatgccgagcttggacttgccggtggcggtggcgccgagcacgaagacgaccttgggcttgggtgactgtccgatgacaccgccgacgtggtactccattgatgaaggtgagctgctcaccggagaagaggtatataagccatcgttaattactttttgcaaagatagtaaatttacgacctaaaatgtacgtgcactcgatcattcttactcccccgtcccaaaatataatatacgagattttagatggatgtgatataagtttgttcagattaataatattaggatagctaagagcttgtgctttgtaacggacaacaaattgagtttctaatttattaaatcaattaacaaacacttatttagtccaagtactgagagccaacggtgaaacgggggaggactcgttaaaagataatgtaatggtatagattgtggggctcacacggtagtagtagagatggtgtgggaatggacaccaccagaactactaacattttaaggactatagattacatctacccaaaatcatttacattttgagatggaaggggaacatatactatatttaaatggttataatacattttctaaataaggattaccagaagacactataccattccagaatggaatactttatttctggcatcaccataacgccagcatggcacaaatttggtacttatatgatactagcattagacatgataaacataggaaccatatctaatatcggggtatcatacatgatactcataggtaacagtatttggtacctagatcccatgctgatgtcatgatgatgttagtaaaataaaccaccgttgtaacgatatagcatttttttttattttttttgttttcaaaaacagtaatgctgattgtaaatgatcagtttgatgctaaattacctatatatcatgataattaattgtctctagttaatttgttgtgaacgagaatttaacataaaactagcaatgcaagttcatggaacaatgtgggtgcacttccaaattatcatgcatgaaagatacatctgtgccaatgtgttaatcttacagttgaaaacattaaatatcatgaaaagcattactaagtaattaatcgctcatatagattattcgcattgaacttccttattttactttttttaagagaagttcacggttcatgaatgaataataaactcatctgtggtcaattttccatcaacttcataaaaccaatctataccaaaggagaaaaggatgacagtacgtataaataaaaaggatgataacatctgctgttgtatgcatattctagctagcaaaattaacaaaatcaatcattaatattactacttcttgagggtaaacttcaataatttctttatgttcatcgtcgctagttattattcagtgaaactttaactttgttttatgttcaccaccttctaactttgacatatagcgcaaaacattatctcatatgtatccgcaaactattcattcctattgaacctatgtctggtgttcacatcatacaaggggtaaagacaaagcctagggcaattaggactccctaatcccttttaggtcctattgaaaagtaatgaaaagtcaaaggtaaaaacaagatgcattagttcggtcttaagtttatatatgacatggaaaaattataataacattgagatctatgtgaatgaaaaatattagcccttaaaaaaagcctcaacttagatatctaatatatcttacataaaaataaaatatctatcgctcaacataaggattacaaagaaaaaaaaatctttttagatcaaacaaaaaccacccatatatatggatctatcacggagacggggtttgagcgcccgctactaatatatggattattagagacccttgagcctccaaaattttccgacatagatacagaaaggccaaaaataagttggagctttgtctagttttttttagcccctgcttttttcccccctagatccacccctacacccacatattttttttgataaaagaaaaagaaaaatggatattaccaagaaaaaagaaaaagaaactagcattgcgacacaaaaccttgcaagcaaaaagcatctatactcatcttatcagttcaagctggattacgaaaaatggacggtgattaccaagagggtaacacctaccgcgaggagatcgaccacagagctagctgctagccggccgccggaacggaatcgatagctgccggagtttatcaagtaccaacttggtcgccggaatcggtggccggagttgtacaggggtgaggtttattccgacgaggtaactgtatatagcctctcttgtgtatttatacagtccctgcaggacctatctggctgatgcagatatgcacagtagtataccgtgtcttaatgccttccataatcagataatcagaagaaaacatgtatctgcatatgtcgacctgtatgacagaattaattggtatcgaattttgagccagccaagaaaagcatggataacaatgcaataaatagaatcttggtcgaacagtcacacgaaaatagtacgggcattgtacagtgctatctcttggctgcagtgtatatccgtcagtaagagtgttgtaattatgtactgtattaattagtactagctatttgtgagaatatgtgagattatggtaaccgacgattgactttcctgttattcttgtatatatccagatatacacatccaccaattttctagccgttaatgttattcctatcctagctatcacccgtttcgagaaatctgaaatggtatttttctttaataaccttaattatcactccccggttgcatatatacacactttgaagtttttctctcccttttttttttagttttggaaacaattgataaatcgagaaggggttaaaaaagtactacattcatccatatatctttttagttatgaacttgaataggtcggctgagagaactcatatctagtttcatatctaaatatatatatatatatatatatatatatatatatataaggatggatagtgaagtttattgctctcaccttagaatctagtagcaaacattgcaaatagttactagataaatacaacgaaaacatgcacaacacgttcatacattatactcattcacacaccacttgacctccacagcacattttttagttttggaaacaattgacaaatcaagaaagggttaaaaaggtactacattcatccatatatctttttagttatgaacttggataggttggctgggagaattcatgtctagattcatatctaaaaatatactttttttaaggatagatgtagtaaacaattttacagtgaagtttattgctctcacattagaagctagtatcaaacattgcaaatagttgctagctagataaatacaacgaaaacatgcacaacatgttcacacatcacactcactcacacaccggttgacctccgcagcacgggaaatgtgctaccctgtgtaccctagctagccatctgtcctatttaccaatttcatcccacaaaatctagattgtttgagctacggttaataagaaataaaacaaataaataaaataatcaaaatagattgaatatacttttatacttctatttatattactagcacgtagtccaaaaaacaaggttgaaaaatagagaacaatttaaagccctaaaatcaactctaaaattaaattgtaaaaattcaaattttgattgtggctttgtaaccagcgagaaaatttatcatgaggcggtagtaagtccaatggtaatatgttactagcctaattgttagcacaatccaataatcgtgcactatgaattgatatatgctcaactggttagattttttatgatgaaacctatctactcaggtttaaatctctgatgtagtatatgtgcccacattttacgatatttttgttgtttctaggtaactgatttacaaatcaacagcgaggcatctacggtaatttcgtcaatgtcacaatgtggtatctttcgagtatgtgatgtttatagggccaggtaggagtgtgtttgggtgttcatatcgatgagtataataatatcaatgtaggtaacgtgttttgaaaagaaattcaatcgtacaactctggatatctttttaagatacttagtactccacttaattgaataccaagtagaagtgaaagctcaattagttatgcaggctcccttatcctaaaacttgcatacttagatggaactcgtttacttgacatgcatggatatggatacttgtattttcgtagagtacttgggtgtaaagacgttgacggccaatctcttcatagacgtacgtatgctggtgccaggacgcatctgcatggatgtatatacgcgtgaatacggtgtgcgcatcagtggcggatccagggccccgacacgatttttttattttttatttttaattttaaaaataaacccatccaaattttattttcaagatatgaatcttttgtccacgcgagaacaatactgttacgccgctccgctggcgtgacagcgttatttggccacatcaacgttgcccgcgtgacagcattatttggccacggcgctctcgctggcgtggcaagataaaactgtcacgcccgctgcaagtgacatgctattattgttttgtcacgtcagacgggctggcgaggctaagaggttcagattttataaataaattttgaaatgatttagttttaaaattaaaaattaaaaagttcaaaaaaattaaaaaaaaaatcccccgacaccagcattggattagatgcttaaataacagtgcttagtcattagcccggctacacatgtactattagattagcactaattgtcatgtttagtcattagccagcagcttaactttgcttccgtatatgataaaatgctctatgtagttttaagaatttgtgtctacttgttaatttgttattatcgtcgttcggtttgtccagttcaagaaaacgtctaattaatccggtcaactgctgtgcatgggttgtgtccgacttagtaaaagaagactatatttatagtatcatattattttataaaaaatagtctatttttttactctacaattacaacaaattttaaaaattacaccgtaatcacagctgtactgtaatttttttctggtacagataacactatatataagaaattaggataaaaacaattgattgttttacttcaaagtttggaagggacagataggagacatataagcattagaaaaggtgactgcaatcaagtaaaatatatatacatcaacaacagtaaaactgtaaaataaaaaataagaaaaccacgatactccctccgtctcgaaatataagggattttggatagatacgacacattctatgtccagatttatggtattaggatgcatcacatccattcaaaatccataatattttgagatggatggagtagatttcaatacatcaactaacaaacatcggccagcctgacacattattcgtaccagaaattaagcctctagctagacctgatcttggtacaccacgggaagcccacagatgcagcgcttgcttgctttcaaccgatgcgcttagccggcgtagccgtagaccacgcaaggccggccggctggcctatcgatccattccagttgcagagacgttaattgcaatgcaatctctgccgtttttagtactgccgcctttcccccctatccactatccattatccaatccatctgatgaacttccttggtgaggtgaggcgcccaatcttcttcctcaatctgtaattttttaatcttcttcctcaatctgtaattttttttttgaaagattaacggcaggagctctggcggatatattagggtaaaaagagtcagacaaaacgaaaaacattaaggttcaaagaaaagaggggacatccagaaaggaaaataaactcataaagcctattacagaggagaagagaaacgactcagctgagacctagcctttaggcttatctcgaaagctcaattaaatcaatattttctttgatcgtgcaagctacttgtgattcgctttagcatttatgatggaagattcgacgattgcgctcgagccagacctgccaccatgttgtgagtagagcgccaatcttcttctttgctgaatctccttttgcaagaaaaatctaggaatcccaccaattcgaaatgggtgtgtcttgccaagattgtgggggagagattgtaaccaagccagctgcatactaaattccacacatttcttatgaagctgcattctttggccaagtgatttgcatcttcgaaagtgtttgtacacagacttcatatccagttacattgccagtgacgtctcagcaaattttccgccgttagggttctctaatgcaaaatgagccagccgaaaaaacgatgttttggttccgcctgggccttccataggggagagaagtttatgttagtgatcatacattagaattgtgcttcataagcgctctttgctgagtattctccattgggagtcgatttccaacgaatgtcatcgggggtgtttttaaggagcatgacttcttacaatcggctacccagccggaccagttcatcaatttcacttatcgtggtaatggggtttaggatcgccagccagtggttgttttgaaggctgaggtgcacattgtttcattttctcctggacaggttgaagatccctagagctaaatctttaggtaagcaaccctgaagccagttatcagaacaaaaggagcatttctttccatttcccagggtaatgactgttccagctcaaaaaagcactctgtccaattcatcacatggcacttcaatgttatgccaaggtctattatcttccttccagccaaaccagagccagtgcagccttaaagctcgcgagaatttttccaaattgagaataccgaggccccccaaattcctaggtttgcaaatgttctgccaattaatgagactactacccaaactgacattatctggatcatctcccttccatagaaaagcacgccgaaatcaatcaatccttttatatagccacttattcttattcctcaatctgtaatctttccactcttttgttctttctttcttcctgtttcgtgttgttcatggatcatctctacgactctacactcatagtattacgtttggggatgatggctctggttgattggtagtaattggtagtattctctagtttcaagctgtagaatttccgtgtgagattattggtcggtgaacattttgcacaaccctgcagtttccactttctagttacagatctgtgtgggggttgatatgtaattggagtgttatgggcgcttcatgggtatggattgttttagttcattttgggcactcctctgtacgtagagagaaggggtcgatcaaaaacggaagttaattgagaaatgaagcgactctagcctctaggactgtttttccgttcagtcgatattgtggtttcgattgatcattgcgcaacaacacaggttatagctaggagcaatgccaccaggaagcttctatatattctacctagtctgaaatataaatttcagttttgaagtttgaaaagttaaatcttttgtcataatatttaatatttatagccatcaccagccactattatatttccttttgagataatagtgtggaactaagagaaatgtaccatatgttataaacttacaatttctatactctctgtgtgcatttttttccttcaaagctactcaatacatcaaagaagtgaattgggtatctgcattgacacgggaaggaggaaactacggcgaaggccttagccctcggaccaacaacggcgacgcctacgggcgccgcattcttgttggggtgttgttgcgtttctcctatccaatggtttctttaggtgaaaaccacgtcctggttctctaggacggatgacggcagcgctcttagcgtcattcagaagaaccattcctctggggtgttgtgtgcttggtttatttttagtagcaagatcagacgtaaatgcgtgttgtgactatctttttcttttttttcctgactatagtcttccaggactatagacttgtatttttcctactatatcaatagaaatatcatactatcttgtgcgggttgtttaaataaaatgggtatctgcatttgtacaattgatataaaatatgaaattacaagatctatcaatacatatcacttgccatgctaagcttacaaactaattatcatcccttttttctcttctgctccaggtgtctaccaatacatatcacttgcctatccattccacttctatgactcggctacttgcttttctacgacacgtcaagccgagtcatgacgtgaaaatccgtggattaccctttatttaacatataagtaagttcgcgggtctgtccgtttgcatccataagcggtgaacctggcgagctggcaccctctgggagggcagcgacactggccgacgaacgccagcttcgttgtccggttcggctccgtcctcccggccaaggaggcggccttgctggctgctaccgtgccaggtcgctgagtatgtcctgctcataaagttccatgttgtgacggctatggcgggggagacgccgccattggcgctcactctgaccgagctgagcatgcggatcgaggagatgggcggtggtcggttcgacgggcggcgcagcctggtggtgctgaaggaggcactgggatgctgtcatcggagcggaaacctggaggaggtgatggagtcgtgtcatgccactcatacctgagggcgcaaagcaagctgagggaggagaagatctgcagcgagtgccggttcgacgctctgtacgtcgtcggtggcattgcagtgtttgttgccctgtgtaccatgtggtacagaaaaaacgctcgagagcttgtgaagctggagcagatgtatgatgaattgatgtattggccatattcttttctccaataaaaactggataaacttttgaataaaagtggcacgcttttcaaactgctaaacggtgtgtttcgtgcgaaaagtttttatatgaaagttgttttaaaatatgagattaatctatttttcaagtttgtaataattaaaactcaattaatcacacgttattaccacctcattttacataaaacacttaaactttatcttcatcttcaggagattcaaacaccaccattaaggcgtaatggatgatagggatttcagaaatgtttgttaaggaccacaggagtaactgtggactgggtagtttaaaatctagacggtaggtagcttctgagagcggtttcccaacttgtagcttttagttcattttctgaattatacaagttatcaaaataattctcaaaatctaaaaaagctatactattaggaaaagtttctatttggatagaaactttcagccccatgtttggttgtttggtagaataagccaaacggtatatttataaataaaaaataatttttgaataaaaatgttatatacatgatctaaacgatttaaaagcaaaggctgaaaaataaactacgatgaaaaagctctacaatcaactctaaatttaaggttgaaattcaaattttatcaataagcataagcgaaaagaagagaccgtttccaaacaaaccatatgtttaatcccaggcgatgtttgtgacatcgtaaccctgcatgttctgttattttggtaatgtggttagaataatacgaggtataatgaaactagaataatcagatttatccatgcaaaaaaagggaaaaagaaaagagggacaatcagaattgcaataagaatagaaccatgcataatcaccactcaacaataagaagatttatacagtatgacagtaccaggaatctcaatacaagagaaacaaaaaagtggaagtctgaacatcaatgtgcataatacattccaaaacctcgctagaaataaccgcttgtgccaaattgagggtaaaaataatatacacatggatggacaagaaccagaacaaagctcggaacaatgtagtgacgcccttggtgctgcatagagcagaccatgtacaaataaagaataccctgtaaaacttgggataacggcagagtaagccaccgcccaatcgtcttcgaaaacatgaccaagattgctggcaaacatggcctctcacgtaccatgtcaccaatcaagcaaaactagtaaacatgcagcctttgtagtgggaaagagattcatgcttcagaaaagatcatgcttccttttctgtagttcttgtttccaccctggctgctggtagaactcttccttcgttataccaaatacagtctggaattcgctgtccgacaaatatgtctgcagaagccgcacaaaagttagccattgaaactcatgcaggccaccattcacattatcaaggtgttcatatgaagcattagcagacagtaaaggctgtgattacagatggttgctagtaatggaccaattgtgagtttgccactgttttgttttaaactaagaatatctgttgcaattcctttttgaaggactagagcaaaaccacaaaaacaatactatcgatgtatcaatccttccgttgaagtttgaaaaaacaggaaaaaattgaagggtctggcagatagatgattggcaataatcccaaaaagggtctggctgaagccaaacatgtacatgcaaacagcaacaatgggggataccaaagaagaacatggtatcatttaattgaggggaaaaaaaggcaaccaaacctcccaccaattgagctaggctcaattcctataatctaaatttctttgagggcactatctagttggcttgctctacctttgagtggcttgcttgcatgttgcaagtcatgcacgaaataacaccaggttatatccacttggaatactgaaaccttgttgaactcactgcaacttctgttatgtactcgagttactaaacaacatatgcattgttactgtggttttactattacaaagttcctccaaagttttattactaaaagtcatttctcctgctattttatatggctgtgctcatatcattttttatgttgcacaggtaattaactcacatatttatgggtaaggtaagtgcttatccatttcacaaggtagcagaaacaacacataacacctactttgcttccaaggttgcaaggaaaataacaaacctctctgcgtttgtaatctatcccacgaacagggttggtagattttgatatcagccgatcatagctgaaggttgtttcacctccattttcattagcagtctgttccactgatacgtcaggctcagttcgccctccctcagataatgccccatctcctggggcatctttatcagcggaaaattctgatgctccttcagacagaggggatgcagcagacggagttagttcagctgtatctgcatcacctgaaattggcaagatccaacatcaacaaaaagaaatatttgttaactctaaattttgcaagcatcgtcttcatctactgttcttgcagttagtcaatgagtacagtatcgcccatccaaaatttacaaaacaatcaatgcacaacaatgcatcaaaagtctcacattataagcttacagaggacaataagcagagacctagggtagtgtttgcatctcctgaagataaagattaagtgtttcacgcaaaacgcgccatttagcagttcgaaaagcgtgccacgaatatccaaaactttatccactctttgtagtggaaacgaacaggactattcatgaaatatgtctagcaaaaagaaacgatgcagtgcctagaatatctattattggttagtagcaccacatgaaggaaattgatattgttacccttaaaatatatgcaggggaaggaaatagtaggccacaagtcatacctgccattggggaagacctacctatgcgtgggctttgagatgaaccctcagcagtcaaaacattagacagcgcagcaacagcagctgctcgctgagaaccttgacctgcacgttgtggtgggcttttgggttttgctgatggattgaacgctgatgttaaggcagccattgctgaagcgcgctgagtgggtccaccatcagagcttttaggcctatcattaccctaaaaagaacacaacattgcttatagtttgtaagatcaacaaattttatattttttctgctgtgcattgggagtgttaacaataccttattcttttgggaagatgggttgaatgcagatgaaagagcagccaatgctgatgccctctgagttggtccaccatcacctgaactcttagatccactctgcaaacagttaatgagatgggttactaacaagtgaatccatacacattacgtctccaaatatctgcttttcacattaagtgaggataattcatagaatttcaaactttaagagcaaaaaaaaattaacgtacctctgagcgcattccgaaaagaagtgaaagcttcttctgaaatgaatttccatgaatctgtttcaagggtgaaaagtattatatcctgtgctaaaacaagtgtgagcaaagaaatggtacgaccaaataccacagtataggcaagtacaaccaaactgaaaaataagcttgcagaattgatgaataaataattgaagaaagcatgatagcttccatgtgccagcctcatagcaactgtgcacattcattcattcatatgggcaaggatgtccttgttctccagtcctttagattaatttaaattattttaaaatcaactggatcctttcttgcctccccaggtcccttttacttctattgaggactaccaacctaaattagcataacgaaaagaaattttccttgtttcttatgacacccttaagtcggattcgacaccatatgtttaacatggcaacaatctaagcatacacaccacaaaactaccccaaacataatagctgatctaatgagacatatatgtggtaggcatttattagtttagctaagaaacagggaatgaaacatatagcaaaacactgaaggagctccgtgtagctacatgcatatgtactgaagtactgatggacatttagagctgctcagaaggaaatatgaactacgaacataggatagatctcttatacgaaaaattgcttccaaggtgaaatctcttaaatacaaagttccaattgatagaactgagaaaaaaagatatagtggtaaatatccaatagcataccacagatcttgtgttatcccaggagaagtaagttctgaagaagcatggttcattcccttcaacgactttgtacagaggcacatcaggagaaagagattcgaaggccgccgcatgttctgcatatttctgagaataaagcagttattgctgagttgagcaaagatgatgatatttaagtcagcaagagtaaatcttcatatcatacctggccaatttcaaatgccttctgcttctctttagcatccacacactgacccatccaaacaaagacttccccatgtgtatcaagaaccatcatgtcttcagtcagcaaatcatcttgtgaaaagttgaaaatttcagtgacctgcaaataaaaaggtttttgagaaactaataatcccaaattgttgaagcatgacaataagagtaagacaacatacctccagtttccctggtaaatggtgatcatgtcagtgcaaacgaaaccaaaaaaaaaaaagagagagagaaacattagggctctgatagaatataagaaacacattgaaacaacaacaggacaaattcagaatcaagttttggctggaactaaccattcctcaatgagaatgtatacaagtgaggctctctaacaacatcatgtgtggcatttctgcttgtgtaattctgctttccaccaagagcaaaccaaaaggcagagctctcagttccctccttgcaatgtttgacagcaacaccaggctgcaagtttggaaacatcagataatcgtattgagtgagaaatagctaggaattcaagaaaatatcaaatgctttcggtttattcagaacaaaacattctggagcaacaaccaagttagttctatcacagcggaaacagatttccagtagttagtaacctcacagggatggtatatttgtgctagtccctttcattcatattggtcaatcacataaaatgataactgtactttagaatccaatcaacaaatgtgtgcccctctgaaaaaggtatgccttacatatatagtttcaaaaacacatttggataatatagtcagaatgttgtaacattgctaatctggactaacagtagatcaactggttgtgacaataggactggtacttattgcctacatgatcaacttcagtcttaataaccatgctgttggaagctttcttccaaatcaagacacaaccaccatattttccttcctaaaggttcattttgaatttctataaaagttcccaagaacagaagacattgttgttttcaagcccttaaactttctactttctagtggacattttggaatttggatatgatcataattagcaaaataaaaaaaagaagaagaagaaaagaaaaataacaggaacaaaatttgaaaatatatttttgacctgcaatataatattcaagtgcccgcataaagaaattctttccaataatgtccacagcatttttttcccgacaataaccacatgaagtggaatattaaatggggtttcctcatttcataccttcaagaattcagcaacttttgcagcccattgttgctgttcatacgaactggcattgccaatccatgtaaacattgaatttccagattgcaggacaaaacaatccgtgggactcaagtttgatgacacctatagaaaaatgttacttataagcagatgggcgcagtaaattaaaatttacagataatggatgcctgtgaatttcaaatgagtctagtaagaagaaaaaggtcattgcaaaggacaagaacaatgtggctaaaatgaaatttctgcatcagcagcacactcagaagaaaatcaatcgatgtatttatgccacactcttctgtgtttccataaaaagaaaaatacagacaaaaataatgcaaggtagattctctagctgcaccctaaggaaatcactaatcaacattatttgagccctcattgtttatctgtttgcagttgttatactctacaatctcactaaggccatcaattatcaattatgctattaaatggtctacttaggcctgccactaggaagggtatgggtgacccatatccatacccaattttacccatatcaatttcataattagctgggcctcacatatacaaatggctcaaaacttgcacaaagttgcttctctgcaataaatcatttctacaaaattcaaccgaatttgacaagtttttatagtgcggatgcaagttttaaaattttgggtccaagctttacacacataaaatgggtatgggtggtaatgatgggtattaccctcccctaatcaaaattgaaatgggtaattcctccctacccatacccttcccaaatagtgtgggtaagggtatgggtgtgggcattggatacccagtggcagccctaggtctactctgtcatgtctctatatatgagcacatagaattttagaatagtttgctattataaagtaccattttgaaaacatacaaaaccaccaacaatattatcatgttgaatcttcataggcacagccattgcaggagaggtaaatattaccgcatcaacttgaagcactttattgttgtgaattgatgttccagaaattcgaaaaagagcaatgccatcgccagaatatgtttcatccttcaagcccttttcttctacaaatttctggtatccagagctgattccaccctgcacaatatgccaaatacacttaactgatattgtttgaattgagattggacattacagttcagctatatagacagtgcgcacctagttccttagagaacacccactattaccaactgcttctatttaacatgaatatggtaaggatcaagtaccatacctttagaatgaccatgggctggaaaagggcaataaattgtggtggttctttcccttgataaatacgaccctacaacaccagatataatgtatcaaactcctttttcccccccccaagggaaaaaaaaatttcttggtccacaatttgtcantagtaggaatacagtaccagaataggccttcctttcagtgaattccaaattgaattagctgtttggaaagccatctcttgatcttcctgtatgaaatcaaccaaagagtaagttcacagatcacacaacagtggtatgaggcgacaaaaatgttgagtatatggtacttagagtcataataggataggattgatttgtatggactccttccttatctctaaatccttccttatctcctctacatgtagtcctatatataccgccccccaaggctcaatacaatctgtccaatatttgcagtatttctctccctatactattcaacatggtataagagataattttgtcacccataagatgatactccctccgttttataatagatgacgttgtcaacttttggacatacatttgactattcatctttttcaaaaaaaaaaggtgcaaatatgcaaaaatataagtcatgcttaaagtacttttaatgataaacaagttacaacaaaataaatgataattatgtaattttttaataagacaatggtcaaattaatgtccaaaagtcaacggcgtcttctgtaaataaataaacagagggaatatttattttcacctgagatgactagtaatatttaattgcacatgagaactggtgattatttgacataaaagtcaagctcttgatgagaacacacataacatggcattgacaggactttgtgttgatcacagacaaagtaagaagaaagcactatagtatagaagttcaagaataagattgccaactactccctccgtttcacaatgtaagtcattctagcatttcccacattcatattaatgttaatgaatctagacatatatatctatattcattaacatcaatacgaatgtgggaaatgctagaatgacttatattgtgaaacggaggatgtacattctaaagcttgggagcactggaaggtacattaccggtatgctgtccttgccaatccaataagtcaaataaaattcttctctcttgtcaccagaatgatatgtatagagaacaatatagcaatctccgctgtaaaactttccaagctcctcctttggaagagcagtcttagcactgccattgacacaataaacctgaaatatccacatgtttcttatggttacattcctattattgcattttcccagtcttcctttatagttgctgaaagcttataaaatatacctcaagttttccatcgccttctagcaaaggaggaacttcctcgtctactggagcgctgctttttgaggctcccttgatatcaactccttgttgcttcaacagagctataggaaaagcaaatattatcaagaatgatctaagggtcaattattttatctcagagaacatgaacaatatacacaacctgcaactttccctcggccttcctccgcgccagcacttcctgcactatttactggccatgattcaaacttagacttgaatgtatgattctcgtacccttgaatcactcgggttactcttgttgtctttggcctattttgagtagcaatgaattcctacaaaggcaaatttagatcctaacaaatttgaataggcaagaaaaaaaaaagaagaaaacaatggcttgagacttacctcaactgctgcacttgcagcttttctctcctccacttgtgttagtcgaccaacccatataaataaatcagacccacagtcgaccaaaaagcacttattgttctcaagaattgattttgtcagaactgtgtcttctaactttaattgaccattattgatgctgcaagcagttgatggcatggaaaaaaatcaggatacaaaaataaagttaagccactgggaaaaaaagtaagataaacatagcgatatatatatatatagtctcagacctaaggatatagtaagcgtagcaaaccaactaaaactgtgatacccatttagtctatgctacaatacaacactaccaaaaacctgagaaaacctatataaaacatgggaaaactattaaacttatgagaagcctttgaaaaggtatgaaacccttcatcaaccagaaaaggacaaatcaatttattggtaaaaatgtatctacctaaacaggaagctatttacagtaacattaagctgcaaatacatacagctaaaatggttgtatctgcatactgaacattcgttgaaattatgtcagaagttgcttaatgtactgtcagaaatccaaaagtaataaagttgaagtaagaagtcctaaaaatggatgtatgtaattagcatcgatacttttcaaatagcatcatcttaatacataaatatacacatgccttgcacacaactgatggataaatttttggagttttatatgaagtttagcagcctgtgtatgatcagggaggaagttagtccatgccatatcatgtgttagaacaatgcttttcggcacagaaattcttcaatgagcgcaccctaaaataacttcactgtgaagtgcgtaccatacatagggaaggcaagaatatgaagttgtttggagcatctgattactaaaagacaagggtcctatctggattcacaattctgtaagcgcaatttaaaaaaaaaatcatacctgtaaagcttgggggctgtggtttcaagaacaacatcatcgtcacatatagctttcttccctattggtgcaaaacctccaaaaagaacccagaattcaccagaatctgattctgcttgcaattttccatcatctatcacaaaaattttgtatgaaaatgtgtagatttgtgccagaaagttacatgaattgagatttggttgtcgagcataccaacaatcgcaacatcacacactccattgtggtatgtctcctttaaatgttgaatcgcttccaaagctttcgctctctcttgaatattggagtttgcaccattgaattgatatattttcttttccgtatccaagataaatacatcatcatgattcaatgacgagcgagcaaatggaacctgaatataggacatttagtgtatataacatgaggagataaagtagtctaagaaacagggaggtgaaatagtagtcacctctttaactctgatagctctcttccctttgcaaatatatagccttgtttcaaacttatcctcttcaggtgttttaaacccagaggcgaaacctccctccaagggtataatgcatggtttaaagtacgataggaacttatcagattcatagccttgaagttctctgtgctgcactgcacgacctccgagcatggtgtcaagttcaactgtcttaattgctgcagtcccagcttcatcctgaatgagaacacatcaaatcaagaagtgggctggaaatgccatttatcagtacatgaaacttgagatgttagagaaaatgtacttgactagaatctttcccaatccaaaagtggatgtcaaaaagataggcgccaccacctttgctgcaagtcgtctacaaaacaaaatgaacagatcattgaaactttccatagtggagataacagaaagattcttctaaaatgtaaatataaaaaaaatcacctggagaactatatatgaatctccattgtaaaatttaccgtaatctgcttttggcaaaggaactggcttaaaatcttgaatcctccatatttctgtgccactatattttaattaaggggctaacagcataaaaggatagaaactcttgtacgtagatttctaaaagaagacaactaaaacaaaccataaaggcatttaaagaaggatacggtttttggccaactccttgaaatgcaggatcaagcactggttttgcacttgacattgagcagcaactttacaaaggtttaattgaaaacagggtagtggaagatggctccaccacagaataataggaacttgcacactgaaaaggggaagaaaaaattatatgtcaacaagattagaaagaaaaaatagccaagctaatttggacttctatacatggatcgaaagaccagatgttaaaagagcaatgatattcaaacaaacaatcaactcgaatcaagacaacaaatagagtagttagctgttgggaaatatgaatgaatggaacacacaagtgaatgatcaaaacgaacatatcctgaatgaaaccatcgtaaaaggggtatatcatgaaggaaagcatcatcaattgcatgcagcccagtaatgactcaccagaatcgcacaatttcactcttataaacgaatcagtaagtcagatcaaaacaggtaaaccggaataaaccatacacgacgtgctgattacatctacctgagcccccatctacatttgaaagacactgtaacgtagagtacccattatatttgctaatggagatgtacccatcagaggactgagacccaaatgcgcccatctattctgattgatctcatcacgaagccagtggctgcacagcgccaccggactcatgcccacaaagcaatcgcccccgtattctcgtcaaccacatgggctgcattacgagatcaatcaaaccaaacacatcatatgcagatctcatcacccagctccctcacaccaatttggaagatgtgtgctcgtgttaatcatcttctatccatcagattggctgcacgagcacgtgccgacggcagccaccaaccagagattgggaaagctgattcggcgccacccaaccccactggggtcactgatcagctgccagtcaccaccgcccccaaagcggaagggagcggattgagagctaatccacggatcaacccccgcacatttcgcctccgatctcaccgatcggttaggcaacccacccacctagacaccccccggatcgccggagacgaacaccattcctgacccaccccgcgcccctctctcccccacacaatggccggcaccaccaaccggaacaaacaacgccgcgcaagagcggatcgtcgagcgagaaaccaaacccaatccgcttcattcccgaagaaccaacgagcaattgcgcgcgcggggagacgcacgacggcgagtcttcgatcgaggagtcgagagggggtacgtacctggagaaggggaggaggacgacgacgacgggatccgatcggaggctgacgggaggggaaggggaagagggggcggcgatcgaggtggccggcggaaaagcggagagaggggtgacgcggcctaataaaggaagcggggcgctatgattgctcccttccgctctgcctctctggctctctctctctctctggcctgtccgtgcccttgggctgggatgggaggggggaggagatgcgaatgaatggaacggggtagatctggcaaagcgcgctccctggttttagagcgagcgtggcgagagcggcgtctagcctcgggccgtggccgcccctgggtccttgacggtgggggaaagaagggcactatgctgtagcggacaaatagggagggcgttttcctcgatggaaatttgaacggctctccctcttggctaacaaatgatgtcatacgtcggtgtcaaagtaagcgtattattaatacggtcaatttgatcctttcattttatatactacctccgtttcttttttttttcattttatatactacctctgtttctcaatatatgcgtattattaatacggccaatttgatcctttcattttatatactacctctgtttcttttttttttcattttatatactacctctgtttctcaatatatgatttttttttatcgacatctgatcattcgtcttattaaaaacttttgtgcagatataaaaaagtttaagtcatatttaaagaatatttgataataaattaagtcacaataaaaataaatggtaattacatgtttttttgaacaaaacaaatagttaaaacatatttttaaaaaatcaacgtcgtcatatattaaaaaaaacagagtgagcattttattttcggttaacctaagttttatttggagggagagacgttttactcctagtttgttgttcgatagtagagatgataatcatgagtcaagtgagaattgaattgtacgcaatgatatacggctttagatttatctagtcgtacctagaagagaattatgtcccaattatatacccctgctcaggcattaaaaaggtgggagttcgctcttaaacttttaacgcccaccaaccgtcctcatttttaaactcatattctctactaacaatttccccccaacttaataagccattagtctctagcgtttcattttgttcgaatcggtccttgagcttttgagctttgctcttttgttccatacgatccataacgcccacctaatgaatcgggtgatcaaggcaactcaatgaagatcaatcttgttgatgaatgtgacgccctgcacttttaacattgaagataaaagtgccagactatagattattatttaacaaactattattcccgcacttttaacattgaagataaaagtaccaggctgtagattattatttaacaaactattattcccccacttttaacattgaagataaaagtgccaaacggtagattattgccaaataataatatagcccttttatcttcaatgttagaagttccaactaccaaataataatctacaatctggcacttttatcttcaatgttagaagtgcagggcgtcacaatgaaccatatagctaaaagactaattcaccattatattttaaattccaacataaaataacaatgataaaataagctatagaatccttcttaagtagtcatgggaccaaccgatgtttattcttagacttgtttcattgttcggactataggatagatataggatagtgaagcaatggaaataggaaaggaatcccaacgtaaactagggggttaaaaaagagtttgagatatgtcatcagtatctcaatgacatgtaggacccacatgagtcaatgacatataggatccacatgggtcaggatggcatatctcaaattttataaaattataatggcatggttacaattttcccttaaaaatatatgtcagttctatcttcctccatccttctttttctttcttgcccatgtgcagttgaggctaacggagatttttatgtgcagttgaggctaacggagattcttatggaaaacgcgacggagtggcaggttccaattcccttaaattcccatgacacatatacaatctaaaataacatatttgtattggcatggatcgaattaacccatcgtttttaatgtgttttttcccgtggaatcgatggtgtaggaaaatttcttgtgatttttttgtgtttggcttttgcgatccgaatggtatgaaaaggaataaaaacctatgaatagtattcctccaaaaatcccatggctatcctgtaatccgaacgaggcctcaaatatatacacaaggatgtaacaatcatttcgctgttgatatcaacacaatagatacacaaggctaaacttttcttgagttatgttcgtattgtagcatattaggttcatccaattaccacgttgacccaaaatgcaagctttaagcactgaactgtacaaaataaagcgttacttactccatttcatattataagactttctatcattgtccatattcatataaatgttaatgaatctagatatatatgtgcctagattcattaacatttatataaatatggataatgctagaaagtcttataaccaactgtcaaaatagcccttaagtgaaacttagagggacaaaattgactattctctcttgtcactaccacaactcattctgttcaaagtgaattctcgttagtttgccaatcatcgatcataccatggatcaggctacaatgcccagaggtgttacacagtagtatgttggtgacgacaaaagctgacaatacctactaagacaatgcataaatgtcaaggatgagcaccgaagcaaggacaactaagaaaatgtcgcaacagaaattgtactattggggtgtttagattcaggggtataaagttttctcgtgtcacatcggatattatatagggtgccgtatggggtgttcggacacaaataaaaaaactaattacataatccattagtaaacagcgagacgaatttattaagcctaattaatccatcattagcaaatgtttactgtagcatcacattgtcaaatgatggaccaattaggcttaaaagattcgtcttacaaattagtcgcaatatgtgcaattaattattttttagcctatatttaatacttcatgcaggtgttcaaacattcgatatgatagggtaaaaaattttgggtgtgatctaaacagggcctgtcatgtgacatattttttcatagacatatttttttagtattttctcttttccaatgtacaataactacatagtatatgcatgagagtttttcaccgattcctttttttccggtgcaacttaggccttatttagttggggaaaatttttgggtttggttgtcacatcagatatacggacacacatctgaagtattaaatgtaagtattaaacgtagtttaataataaaacaaattacatattccgtcaggaaactgcgtgacgaatttattaagcctaattaatctgtcattagcaaatgtttactgtagcaccacattgtcaagtcatgacataattaggcttaaaagattcgtctcgcaatttacacacaatatgtgtaatttttttacctacatttaatactccatacatgtgtccaaacattaaatgtgacaacatggaaataattggaaataatgtgccagatctaagatggtctacccaacgtcattcgccacaaaattccaatttccaaacctgttgtagtataaaggtggtactgtcctaagcaccgagagggttagtacgaacaaagctactctcgttagcgtcgttgccagatgtatagataaggtgtcacatcttgggtggaagaggtggatgccaaatagctggtttatggagaaaatttgtctgatgaatgtgggggtgcaagctaggttccgtcgctaacatcacgatcaaaaggatacagtgtagaagcggcagcgacttgagatggcaatggcgccgtttcctgtttcccgtttcctacagggaattctcttattagggagcagtgatggttagaattggttcttcgtggggatcaaatgggaggattgatattcccgccgggtttcacgggagcggggatggtcctccattccatgttcccgaccgccacggagagcggcatagggatacaagtttaatgctttttttaagttatcttatgtgactaaattacttgtaatctttaataaacgttaatcttattttttttatcatgtgacttagtagatatatgttaatatattaatataaaatatgaatatatgtgttacattgcatatataatttgatatgtatatattgttttaagcggggacatagaccccgcgagggttaattccccatgccaggtggggaaaattttgttattaggagggggatggggatgcattaccccgtggggaattcccaatttccatttctagcggtgatcggccagcaagtggaagagctcaacatctcgcaacacggttagcggaggatggtagctaggcataggcattcgatagttcacaggtggaggagacccggggcagaacttgacaatgaccagagaacgggctacggatgggcaagcggaggatttgggcggtgaacgataggtaagcggacgagtaacgctatccgattggaagtgaacaggtggatgaaaggtgaccggcagacatgcgaacaagcggcgataccgggaagtagataactcagggggtaactcgacgacgaccggtggacaggcggacgagtggtgacgattggcgagcgggcaagcgaagtaacagcacggctcacactgtgcgcccgtctaagtgggtcaagatggtccgctcatttttaccgaacggtttggacccggaactaaggagaatattcctctaaggtgataacccatcccacccatctccaaaccaaacacaatagtaaaaaatagagtcaacccatcccatccttccaaccaaatagtacaaccttaggttcttcatcttcttggatccagcgctagcaggaggtggccgtagtagccatagacgctagcaacaacaaaatgtgggtcgaggtgcttaactatggcgctttgggcagcacatgaccatgacaccgggatatgtgtgacacgtatgggctcctcgcgccaaaccgttgtcgatttacctcgtccaagctatacctttttctcaagctcacccaacgtcgatctctaccttccatatgagctcgcccaccgaagcttcaagccctctcggttacctcctcctcatcatctctttctctccttccaaactagtacgggaagacatgttgatgactagctagctaggtcaggtgatgatagagcttctggagaaggtgttaaagggtgtagtggcccgccatgccttgtcaaattccgtgccatgatgttgcctgcaccgtcgcttgccgtagtttctcgctgccactccttccttgcgccctcgtctacatcacggcaagctgccgcttctcccttctattgctgtcaccgctcgctgcaactcctccgtggctttgctaccttgcaatatactccatccgcctcattttaagtgcagccataagttttcgcacccaacttcgatcgtccgttttatttaaaattttttgagtaaatttcactttggaccatatttgttgaccaaaatttcacattgggctagggctaggcttatgttttcacttaacaccatgtataattaccattgtttgtactttggacctgattttacagttaccatcacacgagttgttgtctaggtgcttagcattttacaagaaacaatgatatggaaatttttgccatgcaaatatgattagcgcaagaacaatgattgtaacatgttataggatatcctatcagattaatgggacttcattactactacatatgaacattcacaacccttatactagagacaaaattggagaaatattgagtttaagaactatttttctagaaaagtacacgttttacaatacccaactgtagtgttagttcaaattattgaattctaagttttctaaaaaaaaaagaaataagatcagatctacaatcattatactatgtgtaatttgtgaaacccggtccaaagtataaattatgataactatatatggtgttaagtgaaaatataagtctaactctagtccaatgtgaaaatttggtaaataaaggttgaccaaagtgaaatttacttaaatttttttataactagtatttttattattatgagatgataaaacatgaatagtactttatgtttttaaattttttcaaaaaaattctaaataagatggacagtcaaagttttgcacagaaaatcatggttgcacttaaaatgagacgatgggagtatgttggaaacaactagtctgtcagaaatacaatatctatcaggagaacaacaaaattatcggtacccatatactggtaaataagaaatatgtcagtgcatacttttctcgactgcttgacccctgacagaccctagtggcaatctaagtgacagcaaaagtctttaccacattgtgccatcaatagctgtttttttttcccgaccgatcgagcgtttgagaaacaacacgctgaacagctcaagaaatcgagcttatctctgtatatatatatcggtgattcagtgtacacgagcgcgggcaagcttaatcatctctgtttctttagaagacaaacgcagctgcttttttagaaacatctcaggcaaggcaggcagagagacgatcgatcagacttgtgatcgcaggtgggccgggcccacgcccagccttaaccacgccagcgcgtgtggcccctccggcccggcacggcagaccacagcagcttcaatttcttagaggcacacgtgggccccacatgccagccagcgtgccaagacaatgcatttggcatcctcctcccgaagatgacgcacacgccccctgtgtgatccgtccctcccctccaactccaccgtctttttcctcctctttttgtagagtggacacgagttaagccacgacatcgatagcaagatggtgccgatacgtacgtactgtactagtgtgctgtagttgactcgatcagagtaatggtcaggctttcgtgatcggaaagtggtttgggctgagttgtttttttcactttgctaacttatttctcccatttgccatgcacatatttttttaaaattactaaatggtatgtaatttttgcaaaaataaattatacgttaatgggtaacactattttctatacgaggctaccgaacacagtcgttgagtggacacctccgcgcggcgttggatcagagataggtgatctctctctgtagcacaagcgcgcgtcgtgtcgttggattcgtggaggcgaagcatttgtgcaaggcgagtacgacgcgtacttcagttgatcaatggatgaacaaaagaaggaacgcatgaagcaacggcgtgcacttccgttgatcgatcgttggatcggtggaggtgaagcgtctgtgcaaggcgagcacatcgtgtttggaaggccgcctgcggcaatggcaacagcagcaacaaccgcatgttactcttatgcttgtggcactgttgtcgttggctgcaccacaactacaaccacggctgtcgaatagacccttagcagaacagacgaaagcaatagaaaagaataaccaaatggctggacagggattcagattatttcagctccactacagtctccatttctaagttagatttaagagttagagaggtactaaacatgttcttaaatttggaccacatacgcatacgtaatgtacaggtatgtgcatatatatttcggatcaataatggcataataacgtgcagtagcataccatgtgtataaaatctaagttcagttcttgtattttacaggcatctaagaatgattattcggtggaccacggttatccaatattgttacagtaaggcacttaccacaataacatatgttaactgctaaaaaccacgtgaatttcatctcaaaatgttgaattcaaaatttcaaaaattgtagtaaggtttacgataacaacacaataagatgctataaccgtgttctttgacttgaaagagatcatatggaaaaaggatactacaacatcacatttgactaatgtcgaatatactagatatatattactactaatcatgtattatttgtagggattttttttaaagaaaaactgaattcgaacaaatttaaccaaactctatcatcaataacccttgccatacttttagcatactttcaggataaacacgttacccgcaaaattaccggcaatgtgaaaaacctaggaggaacccatcttagattcttatatctataatcgcatacggatctaaaataagattaaaggggaacccatctctttcttcctcgtcgcaccccctctcttcctcctctcccttccctctttctatcaatagtgatgcagtgagatagggggacttgatcaagtcttcctcctctcccttccctctatcaatagtgatgcagtgagatagggggacttgatcaagtctccctaaccccacgctagatccatcccattcgataatgaattcatctacaaaacacatgtaaacgtgaaccacattactctgcaaaagaacctacgacgtcgatgacccgcaccacggtgagcttccacactgatatgttcatgccaaatactcccttcgtattttaatgtatgacgccgttgactttttaaccaatgtttgaccattcgttttatttaaaattttcgtacaaatataaaagtatttatattatgcttaaagaacatttaatgatgaatcgagtcacaataaaataaatgataattgtataatttttttaaataaggtgaatgatcaaatgtttggataaaaagtcaacggctacgtatgaaatactgtagcagctgagctagctacccacacaaacagtagcactgcacgctggcgagccccctacctagctcccagggggatcgtggcgaagacgatgcgttcgcacatgcttagcttttaacgcgaggatccttttgcggggcgggcacctcccatctccccagctcgcatatattgcacgcaccgctgtcgaggggtgggcccctgccaaggtccatgtgtgctcgggtaagctgcattgattaatcatgcatgtactctcgctagctacacacatgtcgatcgatccgtcagtttacacattgtggctgatcagcgagtgtgtgtgtggctgtgtgctgctgctcgctagtcgctttacagcaaacatgctggcaagctgcgcagtgtattatatgccagatgcataatcatgcatgcatgcaggaagggttgattaattaactaattaatatcactagattggtataaagggaactggccagttgattaaaccatagtcgatcggcgcattcgtactatcatgtggacaaatctatatattcaagcatgctagcgcagtagcgcgtgagtgaagatacataatatactcactcactcagggagcttcagttgtttgatatactcagggagcactaaccttgaatggttaaaaattgaacatcacataagctagcttagcgcaaggctaatagtataactcgctactagctccaattcatttatagtcaatctaatagccaattcatataataattgcttactatactattaatatatggtcccacatgtcatacacacattacatattggagtccgcgctgcagctggctacagatctgtagcccgctgttcttctctctcatagcaagtttaatagtatagcccactactagcttcaatttatctatacccaatctaatagccaattcatacaatagttacttactatagtattaatatatggtcccacctgtcatacacacatcttgtattggagtccgcgctgcagctagctacagatatgtagcccgctgctcttctctctcatcctttatctcattaaaatatgtttacaactagttaatagcttgctattgtacttgctctcatcttttatctcattaaaatatgtttacagctagttaatagtctgctatagtacctgctcttactggcacatcggccttggccttgaaatacgtgtcttacgtacgtgttcttgcagtattgtcctgcaatgcttctagaatggctgcgccaaatctgggtaactacgctagattgcttaagctgatcatatggatgatctgttgatctcttcgatccggcggacggcggtatatgagtgtatctgtcatcaataaaccgagttccattttcatcgcatgcaataatttccaacaaggtagccaacggtcaagcgcatgcagcttcattatggccttgtttggataacatatacaatccgccccagtgaatttagttcaaaatcccggtcaatttcatgggctcacggccttccaaacaaggcctcaagggcatgagcaatatgttggaggaataagttcatctgacatccctcaattgtacgcagagtctgtttaaggtcccctaacctcaataccagaaatgtatacccctaaactatgcaaaactgtctaaaaaaggtcccaaggtagtatagatgcctggtttcgctgacgtgatatcctagtcagcaaaaaataaaaaataaaaatatatggggcccacatgtaagtgaaaggaaaaatatggggtccacgtgtcagcattatcttcttcctttctcttttcttctcttctcttctgacgttgacggtagatggggagagacggccgccgatgaccccgcgccgctcgaccttgtcgatggcggcggcgaccaaccccggctcccctgagcccaatgcactgcttggcctcagtgctccgaaccacccaacccaggcatggatgagagggagatggcggcgaggagagcgccaagcctagctcgttgtgccatgggtggtgtgcggcgttgcgggggatgggatttgaggacgacgacgacgtggatgatgcggtcggcaaagtcgtggacgatggcgatggactcgcaaggccgccgctcggaccccatgttaagcgccatcttcaccctcgagaaccccaaaatggcgtaccagaaccgccccgtggaacacgtcgacaaacctgccgctggcagtggagccaacatcgacctctgcacgagtgccgtcgtcactgccgtccccatgtcctcgggagcagtggaggtggagacgaagaaggcgggcgagagcggagccacctctttttgccctatcccgtcggcctcatctcccccttctttggccgacttcctctctcccctcactgtctggcctcatctcccttctctccggccatcaccagctgctgtcgccgccatcgccgccgcctctcaccctctactaccagcgggtgaagaagagaagaaaagacaaaaaaaaaagaaaagaaaagaaagaggagaaaaaaaaagagatgttgactaggatgtgggccccacataatattttttaaattttttctgactaggatacagcatcagtaaaactgggcaactatactgccttgggaccttttttttttacggttttaaataatttaggggtacacatttctggtattgtggttaggtgaccttaaacaaactcagtgtacaattaagggacgccaggtaaacttattcctatgctggaggagggaaggcctagtttgatttagattactcaacggatttttgccgcggatatactcaactataatgacttaggctgtgttcggcagcccctcttcccaacccatcttcctcattttccgcatgcacgcttttcaaactgctaaacggtgttttttttgttgcaaaaagtttctatacgaaagttgcttaaaaaaatcaaattaatctatttttgaaaaaaaattagcaaatacttaattaatcacctgctaatcgctgctccgttttccgtgcgggcacttagtgttaggaaccggtggttccgaacacacccttaatggatgcagtgacttaataatgaataaaaatttgttttcattccatgccttttttctactcccccgtttcatattataagttgttgattttttcttagtaaaacttttttaaatttgactaagtttacagacaaatataatattattttcaatacaaaacaaacctattataaaaaatatattcaatttaaatttaataaaatagtattatagatgctgctattttttttataaatttgatcatatcttaaaaaaaaaactttgatagaaaaagttaaacaatttataatagtacttgattattgtgttaggtggcggcataccccgtgctctgtgtgcctcgtacgtgtacgtcttttgtgatttttttcttgggttactgacagtggaaaaatagtccaacggcattcggcaaacagtccaaatcgtccaactcgaccgcattatccaaaatctccacacaatcgtccaccatctgaagcaatcatcgttgcctatcatctcatcatttggagaattcgagggagagagagagatagaatagtagactagagagccactcgggcagttgcattagacgtgaccacctgcggcggcggaagcggcagtctcgccgccggccggagtcgagccgggtcgcggcgatgaggccgccgacgcctctccccttcatgctgctcctcctcctcctcctggtgctcctcctcccgtcgccgtctgcggcggccgcgggcggcgccgacgggtggaaggcgatcggcgcggcggcggcggggggagccccccgcagggtcgcgtcgccgggagagcaggaggcggccgccgccgggttgctccgcaggctcctcccctcccacgcccgcagcttccgcttccagatcgtctccaaggtcggtgcgcgcgacgatttctgactcgggggaggcgaaacggtcgcggcgaaaattacggtcgctgctcgattggatcaggatggcgtcgtcgctgacgggtttgactttgattctctcatccagggtggcgtctgcggcgggtcaagctgcttcaggattagtaatgcggatggctcgcgcagaaatggagcagaaattctgtacgcttctaccgctctcctctgtgtgtgtgtgtgtgtgtttacttcccagttttttttatttggaacagaattctatcctgcttccacggtttaaatttagaatagttaaaattatggagttatggtctcaaaattggctttgtttaaataggagtggttttgtaggaccttcaactaagtctgatgctatagcacagtagcacttatctatctgatgctaataaaactgtaaaatatactaatgggttgacataatgaaaaaacgccagtgcgaagtatctattttggcaactgttccttctcatgccggctgtctcttttagtaacttttgcattttgtttttcaaaactcaaaacattgccttcagctgagcatagataggggaatgaatggagaacaatttgttgatatacggctaccaaaactgaaaatttgctatggttacattgcaaaagtgaatgcaattacttatcattgtgttcaggatccagggtaccacagcggtcgagctcgcctctggtctccactggtatctcaagtactggtgtggtgcacacatttcttgggacaagactggtggcgcacagctggcctcggttcctttgcccgggtctctaccgcaagtaaaagggacaggagtgaagattgagcgacctgttccgtggaattactatcagaatgttgtcacctctagctgtgagtttcacaattttccttttttcataatgtttgttctgctccatagaccatatctgctcagtcttcaacctccagctccaaatcctttattatacccaaaccacttttgtcaaattggtgataatattatattgcactctgaaaaaatgatctcttttcctttttatcgagttatggaattggtcatctaggtctgttgcaaaacaaatgcttggtggatttctaaaacgccatcatgattatatgtttgtactgatgcaatataaatctattattgccactgtgcgtgtcaaattgaagttcttttatttgggtctaagcatttcagtcctgcaattctgccaaaagttttttttttaatttctgtattctacctgtttcaaagatctaccttttgttcttttcaagatcaaaccacacatttttagtttgtaagaaatatctcccaatctggctacttttactcttctttacttggtttccaactgtttatctctgacaaagttcatgtagcatctctatagactcatttgtctggtgggattggaaaagatgggagaaagaaattgactggatggcacttcaaggaattaatttgcctttagcatttaccgggcaggaagctatctggcaaaaggtttttaaggtagtatgacagacacaatttaaactctgaagcacattttcaaattctttttggagtctaaattgttaacatacagcaaccagtgatgttgcttatgatgggccatgcatataaattagcagaagctgcgtctgtttccttacccaataggttacttgggctggctcagtccaataggatgcgtgatcttctctctctctctctctcgcttatctaagggaactttacattctagaaagctcgaatcaaatactctaatttatctccgtgtctgtcactatttggaatattatctttgctgagtgccagtcttttgtgctgccttctataattttatcgaccattttcccaaacgatagtcgataaaaaatttgcattaactgcatactaatctgtaccattgctgttttgtgatcaatctggcatctttaaacattacagatccagaagttatcttcagtttgacatttatattgccactgtttttgttttccatatatgccactgtggaatcataatgcaatttttgctgtgttcaatcccttgctgatgactgagttctatttcagagttttaatgttacagacagagacctagatgatttttttggtggaccagctttccttgcttgggctagaatgggtaacctgcatgggtaagcttagcataaatttattataaagtatttgatctgaaaataattatgagataaatagtacaataattaaaaaagaaataagggtatgttgtctatgcccttttggttttagttcacagaggatagtggattgctttatgtctaacaaaagtgaaccttaacaaaattatcacccttctaaaatacatatcctgttgaggtgttcgcagtttgaaattttttgcctgaggaaaatctttactgaagctaaattaggttagacatactacagaggttttcctctcagctcaaatcatttctttcagatgacagacaatactttgtacttcttaaaaggttaaccatggcttgcattatcagggacccacatagccagtacatagcactgcccaaaacattgaattgatatttttgtagttacacatagtatgctaattatgactatttggtcataggatccttcagttagcagcatatatttgttagtatgatgtgaaaaaaacagtgcagtttgatatatatgtttattttaaaacaaatcttagatggggtggaccactatcacaaaattggctggatcaacaattgacactgcagaagaaaatattgtcccgtatgattgagcttggaatggtcccaggtaataatttgttttacattgtagaatttcagctctttacttctttagcattgtttgtctatttatgtgagacaaactttggacatatgctattgtctattgtttgtctattgcatctttcctcgtttcatgctatgtttaaagctttgtcacatttgctcttatcctatctttggagtcaggaaatatggagagtcagttaacatatcaatgttaccttcgatgtactattagtatagtgcactaaatatttgattctggttatatacttcactgacattaattgcaatttttcagttctaccatcgttctcaggaaatgtaccgtctgtgtttaaaaaattatttccatctgccaacataaccaaacttggtgactggtaatgcactcttctgtgtcatttccattagttggctgacatttcatgctagttcaggtgtgaccaaaatttcaaaatcttgtctgtgttttatagtcgcagttcacatcaagatacctattttataactactgttagtttgggggctggacctcaaatttggtgttgatgtattcatgctttctctttgctaaataatttccagagtttataagtaaccgtggaataaacagataaataagtttcaggctatcagtcttctgttcttccttggcattatgtgggttgtaggtacagggtaaccatgcacacaggatagtttgaagtcattgtttatatgatcgaacatactttgaaggtctagtattctgtttcagcccatgaatactgtatttacagattcctttgcttcaggaacactgttgatggtgatcctaggtggtgctgtacttatcttcttgatccttctgatgcattgtttattgatgtggggcaggcgtttatcaggcaacaaatgaaaggtcagagtctttccatgaaaagataccagatttcatttattccaaacttccaataccttttgactgttctttcgccaatagcttcacgaaattgctgcatggattactaacagtgcaattttaatgtatgtttttataacctgcatagggcgtgtttaccattctaattgtttttgtattttgcagaatatggcgatatcaccaacatctataattggtaagctctgactgatctgcttctctgttttttttttcagtagaatttgcatgaataatttgtttcttgcaaagtacctggactgtacaatacactatagtttagcatttttagcgcaaatgattggctctccttgtaattcatggagatgaaccactgattgttaattttttttttaaaaaaaactataatgaaccttgatgcaagaaatgttgagtgcaaaaatatttgaacatataaggtacttaataccaaaacagttttgtggcaaggtttaaaaaaaaatctggtttttgaaaatgacaagagtcctttcctttctcctcacttgattcttgctatcaggttagaagattttgttcctgataccattcagaattctacatgatatccagataattccattgatatactggttgttgataaaaaaatgtaatattattggtgtattggtttgctttgttcattgatttagtacttatttatgttccttgtccacaatgtctttcatacattatgatcaatatttattgtttgttttcagtgacaccttcaacgagaatacaccacccacaaatgaaccggcatatatttcatcacttggttctgctatttatgaagcaatgtcaagaggtaacaaggatgctgtgtggctgatgcaggtgtgcttgctctcctttttgacctttgaagtgtaaaatattatgtattcaatagcatcgccacattttccaatggaaaaaaaaacatatggagtacccattcatacttgctttgtcccagtttgtagagaaaaaaaatgatgtcttaccatgctgtagttttgccagtaaaaaatcatttgccctaagccacagtggcatatagtgtttaattagcatagttttcatgagcacatgttacactcatggcaatttttgaacattagtataatcttggaaccttcttttcttgattcagggttggctgttctactcagatgcagctttctggaaggagcctcaaatgaaagtaagtttcttcgttttattctgatttctgaacactcatagaaactatagttgagcctggactgatggatatctgtttcatcattctgaaattcgataatagcgaaagaatgtgatgatccaatgttcccttgtatcttgtttcttgcactcaacttgaatagagaaaatagcatctagagctatagatctttaagtgtgctcaatctaagttgccatctatttagaacctatgtagtgtagtggaaataactttagtacttatgcactcaacagtctaagagaaaccttgaatcattactggtgagatttatggaaaaaattaatgtagtgcttctcagtgtttatgctactgtgtttgtgggtccatctggatagggacaatgggacatggacttaattgagattgctaaagaaagctcaactgagaaatggctctggacaatctatttctttccaaatccaatcattccctcctttgtgcctttgtatttctagcttctcaaaccatgcctgttgagaactgtcttaccttttctatattctagcactactggtttgtcctagtcttctagaagcatgtaaggaaaaggctggctcatgggatgcagggcaagagagggccttctgcactaatgtcttttagtttatgcatacaataagccgtaactattatgaatgccgattcatggatatggtaaagatccaaagactggggaatacgacactcgcactaaattaacgccagtaaggctactccctgtcaaaaccaagggagtctgaggcttattggactaactttagagattcaattgtcgattgatagcggggtacacatggtgttcttttttagggagggatccctgctacatttccatgggtagaatctctacttttctaaaaaaaacatatctctaatttcctagtagtaattaactaacaactttcattaactgacagacaggataccaattgactaacccctatcctactaggaaactagttcattattaaggaaatagaattctaatcctgatgccacagtattatggtactgttcacacatggccacacagtggtgctaccatagcagtaacagaagcaaaatattatgtgtattcatatgaacgcatattactatattagcaaataggtagcaaaagcatctacctgtcttttccccatatgtaagtttctgctcattcttatagatggagataaccattgcctgttttgtctttcaggcattacttcattctgttccaactggtaagatgatagtccttgatttatttgctgatgtgaagcccatatggcaaatgtcctctcaattttatggtgtgccatatatatggtatgttttgactccaccctaaagcttcaaatcttcttatttcttaaatatcacttttatactctattagttgtaaaagtatgcatggtggttctcattgaaactaggtgcatgttacacaactttggtggcaatattgaaatgtatggcatacttgactcaattgcatctggccccattgatgcacgtacaagccacaactcaacaatggtacattttactctcttctattaatatagtgtagagcttatatgagctgagattgtccatcatttgttgcaccaaacttgaggtgaatctatcaatgagttccttaccactcctctaaaaaaaaagagttctttaccactgatctggcactgcagattatatatcatggcatgattcctattaatatgatacttacatttgtgccttacctcctttaggttggcgttggcatgtgcatggagggaatagagcataatccagttgtttatgagcttatgtctgaaatggcattccgtagtcaaaaagttgaagttgaggtatgtacaacaaacatgcatatgcctcgcttgttatgaaccactgtgactgtctcatctccttttcttttgtgaccagctcacctgtcttttctccataatactgcctgacatttttcatttgctgaagttgttgcatgtttccaatttgtcaattgccatctaatctgtattatctcccaggattggttaaaaatatactcctacaggcgatatggtcaatcaaatgttgaggtggagaaagcttgggggattttgtatcatacaatatacaattgcacagatggaattgcggtttgacatcatacatatgctcctctacaaattatgctcctgcattacaactgtgctatgattattgacaaatccactgatcatatcttctttcatatgtatattgcaggatcataataacgattacatagttgaatttccagacatcagtccaaattcatttagctctgatgtttcgaaacgaaaggctatttcagaggtgaagaaacataggaggtttgtcttaagcgaggtgtctgcaagcctaccacatccacatctatggtattccacaaaggaggctatcaaagcccttgaattatttcttaatgctggaaacgatctttcaaaaagtttgacatataggtatgttttataatcgccattggtccttcaaacatcctgatgccatgcattcttctttaactaggtatcagttaatgctgaactgtttgtttctagaggacttgtttcgaaaaatgaaatgctgtggcagtttcaacatctttatgctgatacatgaaattcatttctccaattcccagaaaaagaaaacaaaattatctgctttatctcatgcctgtttgatctgctatgcctttctagagcatagatgcatctacttagtttgtttaccaatcatgtcagaataatggcattcacagaatcaacccacattttccaggcttggagtagggaaaagtctgaaatgtggggacactaatggtgaaatgctcatgtgcgattgtaattatgtatgtgagagtactcacaattattaaaatagtccaaaaatgtacagcagagccaattgaagctttgacaagaatacaacaaaaatgaaacaaagccatgagcccatgaatatactcttgaacacaaatcttagccatatgttagaactttcactgccagctgctaattaatcaaacaagctgttctgcatacatgatatttttttttaaaaaagaaaactgtgaattaacgataattgttgtcacaggtatgaccttgttgacctgacaaggcaatcactgtcgaaattagcaaatgaagtgtaccttgatgccatgaatgcttaccgaaagaaagattcaaatggtctaaacttttacacgaagaaattccttgagctcattgtggatattgatacactactagcttctgatgataattttctgctggggccttggcttgaagatgcaaaaagccttgctaggactgaaaatgaacgaaagcaggtaaatttctcccccttcatccagtattagtcacagatattattttttttcttattattgactgactcaatttcttttttttttcttattgttgactggctcaatttcttttctatcagtatgagtggaatgctagaacacaggtaacaatgtggtatgacaatacaaagaccgagcagagtaaactacacgactatggtaatatatatagttgtttcctccataattttgaagtacatgccagatatatgtatgctagttatacttctaggttattaaccttcctgcctttcttgacaccatattaccagccaataaattttggagtggactgctgaagagctactatctaccaagggcatcgaaatacttcagtcgattaacaaaaggcctacaagagaaccagagttttcagctggaggaatggacgaaagattggattgcctactcgaatgaatggcagtccgggaaggagctctatgctgtgaaggctacgggtgatgctttggcaatttccagctcactattcaaaaagtacttcagttagctgcaattgtccacttcgaattattagatgattgaaaatatcacatttccagcccctgcactaggtgcacacgccctaactgttggaataaagccaactgtctactttgttgatgtggtaaataattcatacatcagaaacacactgtttagaagcttgagaatcgtgcaaatgaaggtcgaaaatataaaatgagaaaaagagcaggacctcagctctctaaagtcagtaaaatcacttagcttgaaaaacaactctaaaattctggatccaaataaaaccacaacaaggtaatacccatgctaaaataagttcattttgcacacataccgatacaaagttaaaaggactagggtgtctttactttagcaaatctcaatacaaccatttctcaattcatttacttctaatacattattctctatttctacaaactcagatataatgattactctaaaaataaatttattttgagacaaatgaaagaagctgaaagtaaacttattacgggacaatggaagtattttggtttgatgctttgatcctctttcagacttcgagcatgagtattgtacgtgtcttctctgtattctctccaccataaaaaaaattaatttagtattgaatttaacacatgctatacatatttatagtactagcatgttttaatccgatactaggttaagcttttatgaaacggagcgaggacatgtcttttggacacgcatacttcctccgtctcaaaaaaaaatcaacctatgagggatgtgatctgtgctaggacaatgtgtttgaacgtagggatgtctctatgtctagatacattgttcatatcctctcctcctagttgtttttttttttggatggggggagtaccagctagtcgtaggctgcgacagtgcgaggcgtagaggagacaaccaagtggatcccacatggccacttcacagcatcgatgatcggtcgcttgtgtgttacgagtagttctagatagggctgtcaacgagccgagctcgagcgagtttggctatataggcttgagtttgacatgaactcgagctgagcctgcataccgatcgagcttgggactaagctcgagttcgagctcgagcgagcttcgagcctactcgagcttgacagcttgacttggtgaaactccaaagaacttactcttgtataagagatattaatacaaattatcggtagtcaaaattaatgggtgctacttgtcttgaatgaagcctctgcagcttttctcatgaattcatggctttgaaacattacaattaacaaaagctagctactacatctaataggaatagtagtactaattctaaaaaagaaaaggaatagtagtactattactagcagccagttaattactttattgagaagcattgatgagatcttgagacttgagcaggtcaagcacgatgataagtatacattgacccatcaagaatatcttcctacgtgcaatgcatcttatgctaattaagccctaccgagctattcgagctcgaacttgctaggattgcgagcctcagcctaggcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 39099 - DNA, 13380 bp, Oryza sativa
  unsure (1)..(13380): unsure at all n locations
cggcgcgagctcgattccgacggggagagagagcgacgagtggcggaaacggtggagggaggccacggggagtgtttatatatggttgggagtgagagagggcggtcggatgagggggaaacggccgcggaagatccggccgccattgatgcgccggcgaggtttaggggaaaagatcccgaacgaatccgatggagagagagagggaaaagtggggggaaagagggagggaatcatgggaaatatttcccccctcttgattgcacgcgggccggacggaaacggcggtatttccgcgggcgctcggcgctagggcacggccaagccggcgggaacggcggaaggtagggaatgacgggtgggccccacctgtcagcgagggtggcgagcgggcccgcccgtcagcggcacgcgcgcggggaggaggccggatgggccgcgggggagaggagagagagggagggaggtgggccgagccggcccaagagggggaggggggaaaaagacttttttgggtttttctttttataaaacctttttaactttgtttatttcttcttaattattatttgtgctctgaaaattccactaaaatttatttacgcattttaggcttttaggaaatatacaaaaatcctccaagccttatttgacttttaactttgcacattttaattgttggaggctttcacacggattttaaattattctaggcataatttagaggatgtattttagggtcgttttgggacgcgacagtatagcatggttcattgcagagcaccggactgagaagtggcggagataagcccacgggggtcgctggggagtccatgcctctggtttttgagggggtgattatgatccaggaatggtgcactgtggttgattgtgttgtgcgaggggtaatgtcacagctcctttccgaggtaccgtggtggtactgaggcacatggtgacatgatgtggggctgtgtcttgtgggtacagtggtacacctctggccagagtaaaactattcgaatagccgtgcccgcggttatgggtgggttgagcaatgtttttcgtgattagtctcacacctctcacaataattatggatgttatacctggtaataatttgcttagctcctggtttggagttagatctgtacagccgggtatggttgttcaggatggttgagcctgtgcagcatgggtgtgctattcagtgttgattaaaatttctgattaatcactccactgtttttacttctcttaaaagttttgctaaatgttgtttttgcaaatgaacctatattatgccatcctttggtatctttgtgcacttgcatatttgctgtgtggcttgctgagtatgtcatatgctcaccttgcaataatcaatcaacctcagttgaagaataaggatccagaaggagaagacgtttggcttataccccagttgagctgcctgtgggagtggagccggagcttcgctagattttattttccgctgcagttttcttcatggtgaggactaagtgcctcttaagtaagtacttatcgttttagttaatttgatgaatctgtatattaaattgtcagtttgtgtacctcggctgattcctggacgaggattttatgcacaaataagttcggaaattactagtgaatttccgggcgtgacaagttggtatcagagccatctcgactgtaggataagccaaatggtcaaaccttaaggactaattttccgaaaacatgatttgtgaaaatttctcctttcttccttatctagaattctttgcaaattgtttcattgtctactcccctttctctttcaacttgagtagttctgagacattgaaacttgaagacgccaatgaggtctacttaaacttatggaggccagtcaagtggatcgaggaagaaccgaagtgccaagtggtcaagatggaatgaagtttggatcctaccttagaacctatgccgccaaagtgtctttgaggaatagttagtagggtagaacgcttgttgtttgctttgtgtgtaggtatggttgcattcccatcattggagtagttcattgatgagtgtgtaactatactaggttgcttgcttaatcaacttgaacaatataatggtctacacacatcagatcagtattaacctggttaaggtcttgtctttagtgtaacccctctccttctatcttctctaatatgcaacagatggtgaacactcgcgccaatggaaagtggaacaataacaatgaagggaacccaactcttgctcaagttctggctcaacagactcagttaatgaacatgatgatacagcagatgcagaaccagctcacccaagggaacaccaatgctccaccgccgcagaacaagttagctgattttcttcgtgtgaggccacctaccttttctagcactaccaacccagtggaagcaggtgattggctatacgctgttgagaagaagttggaattgctccagtgcacggatcaggagaaagttgttttcgcttcacatcagttgcaaggacctgcatcagaatggtgggatcattttcggatgaacagagcagaaggacaaccaatcacttgggtggagttcacggaagcattcaagaagacacacatacctgtaggagttgtttctttgaagaagcgtgagttcaggacattgaagcaaaaggatcataccgtggcagagtatcttcatgagttcaatcgtctggcacgttatgctctagaagatgtgcgtactgacgaggaaaggcaggagaagttcctagaaggcctgaaggatgaactgtcagttacattgatctcccatgactatgttgattttcagcagctggttgacaaagcaattcgacttgaagacaagaagaacaggatggataaccgtaaacggagaatgactgtattccaggaggcacaaggtagtagctagaggcagcgtatcaagccactccaaattggtgaatcttcttccgctggtcaaggacagtcgcaacaattgaacatcgctggtgagatcaaattagagactaatgaaagcaatgaagataatgttgagcaagctactcaattagtgccagttcagcaggatcagtctcaagagaataacagtagtggaagggagcagcaggtatgtttcaactgttacaagccaggccactttgcaagagagtgtccgaagccgaagcgtcagcagccgcaaggtcaggtcaacaacattgtcgtcacaggagccaatacagtgccagttgcgtcttcaagagttgcgttttcaagtgttacagctcagccaccagtttcaaagcagcagtagttttctttaaagccttagaataattatcggagttatggaataagatagactgcagtttacctatgcccttttctttctagccgttccgaatctcgggacgagattctttgtaaggggggtagatttatcacatcctgatttttgtttcaggatttataaattatttaataaattattattagaagttatattaaatgttcattaacttacaagtgaagttaaatgtgggaaataaaatttccttaatataaagcatggatggatttaatttttattaaattctccatgattaagtcaactctttgaaattttctcgaatttttcggagctcaattcctaaatgatacaaacaacagttcagtaattatttgatcattaatgatctaattatatttgttaagagtttttcttgtttaaaatccttaaattataaattgttgtttaaaaggaattattagaaatgattttaaaagcctagaagagaagatctaattttaatttgttaaatctcaatataaaattgggctagataaaattttgttaaatactttgcttaattctataattcctagatttttctgggatttatttgagctaaggaagtatttttaataaatggaattgcatttcatgaataatttaaattgaaaaaggtttttaaaagtctgttttggctttgggccgaaagccggcccaaaacctctctcttcctctctctccctccccggcctagtcggcccagtcagcccgcgctccttccttttctctctcagtcgctgacaggcgggccccacctgtcagggtcgtcgttctcctcgcgccgccgccgccgcccgaaaccctagtttcgcgccgcagccgtttccggtgaaattgattgaggggaaacaatctttgggatctcctctaccttttctcctttggaaacatcggctaaatcggtttggaatgtgtttgattcgagttcgaatcggatcggtctctttccttcaaaccccgatctttccttctcgtcgccggccgccgtgggccttcgccgtcgcctccgagcccctttaaaaggttccccaagctcttctctacctgccgccaccctcgccttcgcctctcatcgtccgtagtgccctagcgccatgtagcttcgcgccgccgtcgccgccgtcgctccagccgtgcgccgccgccgttccggtcgtcgttgtcgctcgggaaggccaccgtcgggatcgccaagtcgtcgccgtcctcgtccgccgcttcgccatcgccgaagatcgccggagcaccatcgccgccgtcgacccgatctccgccgccgtttcaacctcgtcgccgtcgccgtccgttgctcctccgccgctcctttggtcaccggtgagttcgccgcgtcgccctctacccgttggtgctctccgttcgtgccgaagcgccgccgttcgccagcgagcgtgcgccgtccgagccgccgagccgccgccgccggtggtgacgtcatcgccgacgtcatcgtcgccctctcccgtgagccggtcgtggaccgatcgatctcggccgtccgttttggatggatcgatctcggccgtccgttcccgtgaaccgttgctatgcacccggttcactgcgaaaccctagccgctgacacaataaataaccttttccttttcaaaaataattcattattgcgtcataattcaattaaaatcaatataagtgttttaatccgatttaatctttaaaatttcataactaattcatttgaactcagtttaatgtggttcaagttgcaaaaattatataaaataaagatctacatattaaaattatccataaattgaatttaatttatttaattctttataaatgggctttaattagatttaatcttgtaaaattcataataaattcatttgaagtcagaatgaggccgttcaagtctcataattcatctaaaattatgatctacatgtttgtttactttttatgtattgtttatttggtttttattagtctttttcctcgttttgcgtgttagcttgtcgtttccgtcgttgcgaaggttcgcaagtgcgtcggaagtattcaagaagattaattgaagaccgattattgcaaggcaagtcacacagatcccaaacaaccctttgagcatgttgatcctatttaaagctattgtttctattcaactattgcatctattttcgaatgtcattgggtggaattaacctattctttgttatggcccttttgtacttgattactttattccttgataccttgggtgattataacttgactagttgggctatatatatattggttcaactagatattagatataattgcttagccatgcttagaaacattagcacactattgggataacttattattcactattatttaatggtggcttaatgatagttcacgatggtcaatcgtgattggttaattaattacttgccaactaaaacttgataatggtgggttgtgagcacatggttttgagagtcgtgctcatgacaattaaggaccggttcgcgagctactattgtgaaacattaaccgtgccaaccacaagccagcgtgggcaacggctttaactttcgtatagcatggttcattgcagagcaccagactgagaagtggcggagataagcccacgggggtcgctagggagtccatgcctctggtttttgaggggggtgattatgatccaggaatggtgcactgtggtggattgtgttgtgcgaggggtaatgtcacagctcctttccgaggtaccgtggtggtactgaggcacatggtgacatgatgtggggctgtgtcttgtgggtacagtggtacacctctggccagagtaaaactattcgaatagccgtgcccgcggttatgggcgggttgagcaatgtttttcgtgattagtctcacacctctcacaataattatggatgttatacctggtaataatttgcttagctcctggtttggagttagatctgtacagccgggtatggttgttcaggatggttgggcctgtgcagccttcatgctccaggaactcctcttctgggtttgggaaaaattgagcaagactgagtacaaccaccgtactcaacaagacacacccacaagtgcagaataaatgcaagggagtacaaaggagttatactataaagggttagggttgcagtaaacagcatttaaagatatttagttgctcaaagctattttgtaaacacgattctagaactatacaattattaatcaaggccgtgaacccacacgaacctgccttaacccaaagcctacgatgattcagaccgaactggcaacccgaccctgggtcccagctcgtcccaagccaacccaggccaaccattccaccttttagttgttaagcaggttttaagaactaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccacctacggccggaactcccgggacaggcaggcaggactgagcccctagcagcaggacaccggccctgtgccatgacatctcgactaccgggccgcagctcgtgtagccttcatttgtcctagagatgtccatcgacccccgacttcttccatctccatccgtgtacttcttccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagaggggacggtgtgaatccaattccacaatactccaacaattccatagtgtccaggttatatgaatatcccaaagtctagagttgtaaaatcacctaatgttacgtaattaaacagcgaagcatctacctaaaatcatactagtggtaccatgagtagagtgtccactagttggggttttgtttattctagggtgaacaaggaaataataacaataacaatattaaggtcataacaaaggtaaataggcatggctaaataaaacagtgataacgcgggaatttaaataaagcgataatgcaataatttaaatcaacataattttataaactgggattcaatatgttcaaagatgatgtgacttgccttgctcgctttcccaaacgtcggcttcaacttccacgaagagcggatcttccgaagctgcagcgtctacacgaccaacggaaaagaaaaggcttttactctaataaactctatataacaagcagaaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaatagatttattgcgtcagccgaggggaggggcgcgcggaccgggtccacgggagtggggcccacgcggcagcctcacggtccacggtggaccgggtgcacccggctcacaccggccggcgccgtgggtcccatgcgtcagccgcacccgagggcgcgggcggctgacggccgggccccacatggcagccgcgggacgcgcccgaaggcggccacgccggcacagccgacgggaggtggcgcactcgcgccccgatggtcgccgccggcgaccaccggcgcggcggagcggcgcccgaaagaggggagggaagggggaagcgaatcggcggtccacggctcaccccgggtcgacggcgacgacgggaacggtgaccggagcgcgcggctcgggtagacggggacggcggcgttccggcgatcggcgaccgaaacggagaggtggacgaggtcggcgaggttgcggcgaacccgaaggaggcggcgccgaggcgggagagggtccggggcgacgacggcggcggaccggagctcggcggcgacggcggagagagagagcgacggcgcgagctcgattccgacggggagagagagcgacgagtggcggaaacggtggagggaggcacggggagtgtttatatatggttgggagtgagagagggcggtcggatgagggggaaacggccgcggaagatccggccgccattgatgcgccggcgaggtttaggggaaaagatcccgaacgaatccgatggagagagagagggaaaagtggggggaaagagggagggaatcatggggaatatttcccccctcttgattgcacgcggggcggacgggagcggcgggatttgcggcggcggcggcgctagggcacgggcgaggcggcgggagcggcgggaggtaggggatgacgggtgggccccacctgtcagcgagggtggcgagcgggcccgcccgtcagcggcacgcgcgcagggagggggagggatctgggccgagccggcccaagagggggtggggggaaaaaaggactttttaggatttttctttttataaaacctttttaactttgtttatttcttcttaattattatttgtgctctgaaaattccactaaaatttatttacgcattttaggcttttaggaaatatacaaaaatcctccaagccttatttgacttttaactttgcacattttaattgttggaggctttcacatggattttaattattctaggcataatttcgaggatgtattttagagtcgttttgggacgcgacacggcggcgcacggctggagcgacggcggcgacggcggcgcgaagctacacggcgctagggcactacggacgatgagaggcgaaggcgagggtggcggcgggtagagaagagcttggggaaccttttaaaggggctcggaggcgacggcgaaggcccacggcggccggcgacgagaaggaaagatcggggtttgaaggaaagagaccgatccgattcgaactcgaatcaaacacattccaaaccgatttagccgatgtttccaaaggagaaaaggtagaggagatcccaaagattgtttcccctcaatcaatttcaccggaaacggctgcggcgcgaaactagggtttcgggcggcggcggcggcgcgaggagaacgacgaccctgacaggtggggcccgcctgtcagcgactgagagagaaaaggaaggagcgcgggctgactgggccgactaggccggggagggagagagaggaagagagaggttttgggccggctttcggcccaaagccaaaacagacttttaaaaacctttttcaatttaaattattcatgaaatgcaattccatttattaaaaatacttccttagctcaaataaatcccagaaaaatctaggaattatagaattaagcaaagtatttaacaaaattttatctagcccaattttatattgagatttaacaaattaaaattagatcttctcttctaggcttttaaaatcatttctaataattccttttaaacaacaatttataatttaaggattttaaacaagaaaaactcttaacaaatataattagatcattaatgatcaaataattactgaactgttctttgtatcatttaggaattgagctccgaaaaatccgagaaaatttcagagagttgacttaatcatggagaatttaataaaaattaaatccatccatgctttatattaaggaaattttatttcccacatttaactttacttgtaagttaatgaacatttaatataacttctaataataatttattaaataatttataaatcctgaaacaaaaatcaggatgtgataaaaggcctacaaaattagtataacacttttctgcgtcaaaaaggattttaacaacattgggctatattgtcgtgagcaagtgttgccgaagcaaaaacaaatgcttaagtccctaaggatcacaacttaaccacgctgatagcaaacttgctgaagtactgtttaggcccaggcccattagtactcccgataccctaaggaaataacaccggaagcaaagcgtcggttcgttttccccgccaaaactctcgccactttcctcattctctgctacagtgcaaaaccacaccggcggagctagggttcacagattcgctccaatccagccttcaaagctccacgaaaatctcccacgcaaccaccgcatcaatctcccatccattcccagccacatttcgaaccaaatcacatcatccaattcgcatccatgacggaagagagagaaagctttgagagccagtgggcgccatccgacgtaacggaggaaaacctgaaggagatggtggcgcacggtgttcttccggccaaggagatcatcgggtggcgtccagcatacggcaaaatgtttccaacccccgacatacacgaagtggttgtattctccatttcttttacggcgggttttctcttccaacctcaaacttcttctgaggaattctggatttctatggtattaacctgcatcacctaaatcccaattccatagtccacattgccaacttcatccacgcttgcgaagctttctagggattaggccgcatttcgctctattccgccgcatcttctttctcaagccccagccaaacaagagcaaaaaaaaccatgtgttgttgggggagccggttttcaactgagggggaccttgagccaaaaatacttctccatgccattcaagacctcgaacaaaggttggcatgcgaactggttctatgtacaaaaccccgagccagtgcttcccgggtactcttgtctgcctccggtatatcaagatacctggaattcgcttcccattggagatgaggcagcccaagcacttgcattgatggatcgcatgctgaggctcaaagagcaaggtctgcaaggagaacagatcacccagcattttataaaaagccgactagcgccaattaaagagagatcctgcacagcctttgaatttgacggcaagcatgaccccaaccgtgaagatccagattctcttgagtttaaagtcatgaaggagagaatgtacaaaatcttctcgaatgctatcgtggtcagttattcgcacttgctgctagtggtgccatacaacgccttcaaccctcctccaccggtatgtcttatacaactcagctattctcaaagcatacttttatcttctgtaaggtcaactgaaaacttggaatatcatgcacaggaattcgctttgatgaaatctgaccctccaattgctcaacgccgctcaccccgttggaagacaagccaggccagtggagggccaaaaatcaagcctgctgatcaatctgacacttcgaagttgactaatcagtctgactctcggaagaggaaattgatttcaagcgacgatgaaggtgatgatgcggaaaagatgggtaacaaaggggtgactggaaaatagtcaaagcaaaccaatccgaagaagaaaacgtccagtcgtcccatgcaaaaaataaggaagtcatccaggtatgtgtcatctagcaatttcttctgtttcgctagtcactcactattgaagcaaagctgatagcatgtctcaaatctgtagaaaaccatctgacatagatccctctggaaaagaccccacgtcaactgacacagagactggtccttcagcagaaactggactgactgccgaagaccgcccgggtaataatcaaccggcaaccgacaatgtagataccaacaacgagcccccgactggaaaccagtcagccgagactgaagtcagtgctgatcaggagcccccgactggaaaccagtcgggttcagaaccaaatagagatatcccagaagtagaagctcaagctaacaaccctcccaagacggacactggtgctagccctggaactagttctcctgttagggtgcaagaacctgctcgtcctcgactggaaattatcacaggtaaacacgtcctccaaacctgctttgatccgacaaactttcttcaattacttcactattattcatgactatctaagggccaatgattggcaatgaagaagaggtcctccggatacaatcggctgaagattctcgtccaccaatattagtcaagtgatgggatgatgaaatgcatccacagggaattgtaataaataagcaaaaggaagacgaggaagtatgcctgctgaaaaagacactcggccaagccactcgtcttgtaaatgtaggtctccctatatatagcctcaaccatcctgtcggtcactttagatgaacaaagataaatttgtggtgcagagaatccatcttaggaatgaggcgaagaccgcaaccctcgaaaaattagttccccaccttggaacccttgaatccaccagagaccagctacgcgaagctaaggagcttgccaagaaaactgagcatgatctgagagaccggatcgccgagctccaagactccaactttgagctgagcggttcgtcaaaaggtaaatatcgtctctgtctgacttgttccgtgttgctgtctatgtgcaacagaccaatgaaaagcaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 39100 - DNA, 2002 bp, Oryza sativa
tttaaattatgcatatcgctttatttaaattcccgcgttatcactgttttattaagccatgcctattcacttttgttatgaccttaatattgttatggttattatttccttgttcaccttagaataaacaaaacccaaactagtggacactctactcatggtaccactagtatgattttaggtagatgcttcgctgtttaattacgtaacattaggtgattttacaactctagactttgggatattcatatcacctggacactatggaatggtttggttattgtggaattggcttcacaccgctccttctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggaagaagtcgggggtcgatggacatctctaggacaaatgaaggctacacgagctgcggcccggtaatcgagatgtcatggcacagggccggtgtcctgctgctaggggctcagtcctgcctgcttgtcccgggagttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttagttcttaaaacctgcttaacaactaaaatgtggaatggttggcctgggttggcttgggacgagctgggacccaaggtcgggttgccagttcggtctgaatcatcgtaggctttgggttaaggcaggttcgtgtgggttcacggccttgattaataattatatagttctagaatcgtgtttacaaaatagctttgagcaactaaatatctttaaatgctgtttactgcaacccttaacctttatattattattccttgtactcccttgcatttattctgcatttgtgggtgtgtcttgttgagtacggtggttgtactcagtcttgctcaattttttcccaagcccagatgaggagctccttgaagatgaaggcttcggtgtctagctcgtgcctgccgtcaagtgcctgtggtcgtcgccctagtcttccgctgtttctcgtttgtctttgtgtgtgctgggccttcgctgcccatgtaataatatttatatacgcttccgcttgttaaactctgtattgtatcaactcttgggtgtaccttgcctcctgggacaaggaataatacacgcacgtaaggaccgcctgttgggttaattccggtcgtgacacgccgccgttccggtcgtcgtcgtcgctcggaaaggccaccgtcgggatcgccaagtcgtcgctgtcctcgtccgccgcttcaccatcgccgaagatcgccgaagcaccgtcgccgccgtcgacccgatctccgccgccgtttcaacctcgtcgccgtcgccgtccgttgctcctccgccgctcctttggtcaccggtgagttcgccgcgtcgccctctacccgttggtgctctccgtttgtgccgaagcgccgccgttcgccagcgagcgtgtgccgtcagagccgcagagccgccgccgccggtggtgacgtcatcgccgacgtcatcgtcgccctctcccgtgagccggtcgtggaccgatcgatctcggccgtccgttttggatggatcgatctcgcccgtccgttcccgtgaaccgttgccatgcacccggttcacagcgaaaccctagccgctgacgcaataaattcccttttccttttcaaaaataattcattattgcgtcataattcaattaaaatcaata

SEQ ID NO: 39101 - DNA, 1111 bp, Oryza sativa
gtatttggccacctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttc

SEQ ID NO: 39102 - DNA, 13738 bp, Oryza sativa
  unsure (1)..(13738): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcctcatcttggaactctggaagaaaccagagataaactgcacgaaaccaagaaggaggccaggagaacagaacatacacttagggaccggatcgccgagctccaagaagccaattttgaactgagtggttcttcaaaaggtaactctatttctgctcaactcattctgacttgactcagtgactaaatagacattgtccatgttatagtccaagctgccaaaattgtcgagctggaaaggcaagttagtatctggtagtttagacgtggtgtctagattacgggatatcattatttggggttatatattgcggatgagaggtgggccgctgatggtgacagctcagtacgggtattcctctgcgcctatatataatcctaagttaattccttggggagggtattcctccgtatttagccccggttatatggtcatgacgggctgtcgtaaggaactcggcagtcaggggtggcttctcgaagtatcaggagggcatcggataaagggtattagctagtatatcagttaactagaatatatgtatactatgtatactagaagtataagaatgagttgttaattcttgtgtgtcactctacccttgaattatcttagcccctgcttagaatatgattatgacaagtaatatataaattattagtggagttctctctacatgatcttcccacttgataaaataaatacgatacccttggaatactctcgggtggaaagctacaatggtatattcgtgcgcttacagataatctctgtaactataataaaccagaagtatttctggcgccatttctgggaattatatttctagtaatgtcgttaagaaataccaacaagcatttctggcgccgttaccggggaagattcataatagagatttcttgaactaatactttatatttacctctgtataatcatttcctttgcaggctaaccttggttgttttcactgttgttgtggaaacagggtagtgcatgactggtttcaacctgccggaaaacttcaaagaaaatccagaagctttcttccagagcgtcaggcaacgagtcgttgctccgcagaaagctctaccgacagagaaaccagtcgtaccagcgccaccaaccttcaagactatggccagcaagactccgcgagttcgctgctccctctgctgacaatgtggccattgggccgcaggtcaacataggggacgtggatttcgacttgaagtccagccttatcacgatggcgcaggctagcccgttctgtggcaagcctaatgaggatgccaatgctcatctgcaatagttcctggagatttgtagcacgtacaccatcaagggcgtcagccccgacgccgtcaggctacggctatttccgttcttcctcctcgggagagcgatgcagtggttctataccaaccgtgctgctatcaacacctaggacaaatgccccatggcattcctcttgaaattcttcccgatgggcaaaaccaatgctcttcgtggaaggatttccagtttctagcagacaagggatgagtctattccggaagcatgggagcgtctgcaggaatatgtggccgcctgtcctcatcatgggatggacgactggctgatcctgcagaattttttcaatagactcaccccaatgtcccgcaatcacctggacgcggcatctggaggagctttcttctctaaaatggttcaaggagccgttgaactcatagagaggatggtctccaatatgggttggagcgaagaacgactccaaacccgtcagcgaggcatgcacatcgtcaaggagatggaactgcttgctgccaagttggacctcctcatgaaacgtttggacaaccacgagaaaaggccacaaggcaccgtcaaggccttggactcacacgtcacgtgtgaggtctgcagtggcacatgtcattctgggaatgactacccagaaacccgtgaggaggcaatgtacatgggaacaacaacgggtaccacaaggaagtcaggggtggaaccaaccacgcccatattataaaggaggtaacaataacggtaacatctccaaccagccctccttgaaggatcttgtttttgcgcaagctaaaactactgattcgttaagcaaaaagcttgctgccaatgataaggtcctggaaaacataaatgtcaaattagatggctttgcttccgcatttcaaaattagctgagctttaataaaatgatagaaacccagttagctcagttggcatctttagtccctgcaaatgaaactgggaagatcccggggcaacccgactcctccattgaaaatgttaaggcgatcacgacgaggggagttaaatccactcgtgatctgccgtatcctaaccctgcaggaagtgaaaggatgtcaaaagaagcgccatctagtgactcggctgacaaagaggttcagccagaaaagaccgtgccgcaggagtactgtgacacacggttgaagccattccctcagtggagtaggaaaccgtcagtggacgagcagttcgcttgttttgttgaagtaatccagaagattcacatcaacgtgccgttgttggacgctatgcaagtgccgacatacgcccgttatctcaaggacatactcaacaacaagagaccgctcccaacaacggaggtggtcaagctgatggaacaatgctgcaacctaatactccacaagctcccggagaagaagaaagatccggggtgtcctacgatcacctgttcgattggggcacaacaattcgaccaggccttgtgcgaccttggagccagtgtcagcgtcatgccaaaagacgttttcgacaaacttaacatcacgatgttgtcaccgacaccgatgcgcctccaactggctgactcgtcagtccgttacccggcagggatagcgcaggatgtgccagtcaagataaaggattttttcattccggttgactttgtggtgctggacatggacacagggaaggagacgccgctcatcatagtgcgtccgttccttagcaccacaggagccaacattgacgtgggaacggggagtatccgtttccatatcaacgggaaggaggaaaggtttgagtttcaaccgaggacggaacaatgctccatggttagaatcaagtacgggccaaacccgcagaatattcaagtggtcgaagtggagcgacccaaaacggatagcctggtggaattcatgcaaaatttcctggagaaggaaacaacgatgaccaggaaccgttattagaggatgccggtaaaatcacctgtaccggctaagaagttagagcagctggctcagaagaagccgtcttccgcatcgaaatcaaagaaggtgcggaaggaaaagccaaagacgcccgctccatcacctccgcgcactaaactgaaaggaggaacggtcctgcacgtcagacctaaaatgacgcgaccttcgccaacaggtaaattggtatgtatccgcatatttgctttcaacaatttgaatttttgcatcatcacatgtttaaatttcaaaattgcatttaggatttttttaattttgaggaaattcttcaaatgaattttttagagcaaaccaaaataaaattttcaacgaaaattccctatgccacgaccacactgaccgttcaaatccaacggccgaaagtggggccggttgggcctaccaggggttcggccaaaccggccaggcaacgactccctgccactttttgcagggtaacggcttgtgggtcccacatgtcatttctgaccgttatgggcaccctataaaagccagccggctggtgagggaattccatcccatttcaacacattttcattccctctctaaagtttgctctcaagttcattcaagctttgatagtttccctcaaattcaaatttttagttgcatatatacaagttgctttggtgaaactaaccggcgggtaaaactcttgtcattcctaacccccgccgagttagtccgttcttgcttcattgtgtagaatgaggaggcgattgtctcgtctgttcaaggggtccggctcttcatcaagtcatcatgacgggtccagtactcgttcatcagctgatgtctcgatggaagacgccgaagctccacgacgactcctgaacgacactgacctcaaccttgtcagtgatcgggagagacaagcctactacatgctgagcgaccgggagtatgctcacacgcgagaatactcaccggagctgctgaaaaagataggtatggatgttgaatttcgttctatttggaaagctattggttggcagagatttgctgtggtagatgagcctggttctcgtttgcttactatgcaatttttgtgcactttgaaagaaatagaagatggtatttcttttcgctttttccgtgaggagttcacgctcacatggaaaggcttaagtacattgttggctttcacgattcctgtaagattgatctccagaaagaaatttctggcttctagaaaaataggttttggaaagatatttctggtgctccaatttgcaagaaacctggaacgaatgatatccatcatcctacacttaggctcatgtacaaatggattgctatgactttgtttcctagaggtgatcagagacccattaggggagatgaattaattatcatgtttgccatggttagaaaaatcaaaattgctcctgtgaaatgtatgataaggcaatggttcgaaagtataaagttctctactcctattgagtgcacttctctgattactcggatagcaaaagggctaggggtcgttagcaaccaaattgtttttatctcagccgctcgtccacatattgatgaggcttatctagtgcaagggcatactttgaaacatggggcagatggatctttgatatactttttccccggttgtacaaatgaaatcccgttgccgaatgcggggtatcatttgtacaactgccatgaactaaccattcccctgcagaccatagaagaatctcgtgcaggtggaacatacagggagacgcgcaacatgacaaggaacgaacgataaagttcatcatcctcaacacccgtgcagatgtatgaagcaggttgagcaccaactggggatgcacccggatggacccaagctccacgacatagcatcggagtctcgacctggacaagcgccagtgaggaccggtgacatgcgcctcatgacatccaatggggggacaatcaaccctccagatcaagagatgtgcctccatctccaagtgaatggcgctcaagttcctctcgttgggacttgggtgaaatcactaggaaaatagacacccttgatatgcagatgggggagatccagtacaacctcacggaacacatagcttagacgcaagaatggcaataatctgcagatgcccagttcaccaacatcaataacatgatgcagcaacagcatgatgaccttcaagcgtactttcgctttcaggggttcaatccttatcaaggaccctgagcgaaagccaagcttaggggaagacatcgctccccccactaaggtaacttgtatcccattacatatttccctttccaattgcatatttgcttcccaattgcatcttataaaacttgaaaacaacataaaaatctgcaaaatagaaaataccaaaaagataagataggtttgagtcatgctatgtaagacaagctagttctctttgttgaaatgatgaatagttgctctgttttatatctctaatatataggttcttggtaagtgctctctcaaaggttaaatataagtagccaacaattatccaggaacctaaggtaaatgggctgcacttgctgatttaagtctaagttgttgcgagatatgaaataataaatatgagttgctatgatcctgatactagtttgacttgaattccagatgttttgtttttcaaaatgataaaattgaaagttcctcatttggtataaattcctaccaaatccaaaaatatgctatcattattaaaccatatacattttggttgcttgacattccattgaactttgtcgaactcttgtgacttgtttagatacttctcatgctctctgatcaagatcatacacccacatatatgcacatgctaaactcctacactgggagctaaccaatattccattccatttccatattaccaccaaaataaattctctatgctttcatgtgttttctcctcttaaaaagaaaaatccttttgaaaaaagagagagaaaaggagggaaaggcatggttatgaaaaaaaaataaagttatgctccatcaagcatgagcatgattgaaaaaaaaatgtagccatggcctctcctaattaataaaagaaggatttttgggagaagaaagtaagcacaaaggagaagcatttttcttttatttttcccatataccatttccaccatatatctcacacattatgcatgatcttgatcttgagtatgtttagttatctgctctagtctatgtttttgacttagtaataaatgtgaatgtaagtatgccatgtttgatccctaccgagctccacatacaacccttagagtaggaatcaacaaggcaacatttggtgaggaaattcatactgatacacttagagagactgagtgaatcatttgaggaacttgggtttcttttgcaaaaatcatttaaaaacttccggaataagagttgaataaagattgggtgattggtactctgattgatgttttgtctttcaaccgcccaaggcaaggagaagtagtgtctcgtgggaatcaagggtaagggtaagccaccgtgccaaagattatttaatctgagagagagagtacatataccttgcacctatatctctcagatatgcagcatagtaacaactcctgatcaacaactaatctttgttcccttttgtccttcacttgggacgagtaaaggttcaagcttgaggggttttgttgacggtcgttatcgattagtttcgaccgtcaatattaccaaaatagaggaaaactaatgatgcttacaatgcataaatatgttagaataataatattccactagtattaggtatactaacctcttgcagggaatgacactaaagtggaggagaatcgacatcaacacagacgataaatcaatcagacgatgtcgagaactagacttatgtatgaatgggccaagaactcagaaataacatgtcgcgaccgagaaaaatacattttcccgaacgctagtgtattaatccccatcccaggaaaagccgaggtacaccaaacaaacatgatacaaaaggcacatctttattatatcgataatatttacattattacaaaggcacttaaggcctgacaatcaaaattaaacagcagcggactagcgggcctatggctccaacttcataggcgctcaactggggtataagccaggactccacctaagacttcttctccaaagcttctcttactgaagggggggaaagattgagcaagaatgagtacaaccacagtactcaacaagccacaccggcagatgcatgattaatgcaagggggtacaaggggtaataatataggggttaagttttacagaaaacggcatttaaaagtcacttagttgcccaaagccattttataaagatgatcctagagttacacagtgttattaatcaaggccgtgaaccttcacgaacctgccttaacctaaggcctacaatgattcagaccgaattggcaacccgaccctgggtcccagctcgtcccaagccaacccaggccacccattccacattttagttgttaagcaggttttaagaattaaaacactaacttgggtacattgctaggcttgcccataaccgagggcgcgactattcgaatagattatactctgatcagaggtgtacatctttacccacaagacacatcttcctcacgtgtaaccacgtgccacataccaccatggtatacggacggaagacgtgacatagttcccaacccatcctagccataaacaagagtactgacccaaccccacctacggccggaacctccgggacaggtaggcaggattgagcccctagcagcaggacaccagccctgtgacatgacatctcgactaccgggccgcagctcgtgtagcctttatttgtcctagagatgtccatcgacccccgacttcatccatctccatccgtgtacttttgtttataaccagactgagccacaaactaagccttacccactagacatgtggaagtacggtagtgctttgcaacagaggcccgagcttaatccttatagtacccgaggtacgactaacaaaacccaaccacgcacctcgagcccagcctaaaaccattttgggggttttgaatagagggggaggtgtgtgtccaattccaacataagccaaccattccatactgtccaaatgatatgagaattcccaaagtctaaagttataaaaccacctaatgttgcctaattaatcagcgaagcatctacctaaattcatactagtggaaccatgaatagagtacccactagttggggttttattttcctagggtgaacaaggtaataataacaatagcaataataataaggtcataacaaagataaataaataggcatggctaaataaaacaatgataatgcgggaatttaaataaagcgataatgcattaatttaaatcaaaataattttataaactgggattcaatatgttcaaggatgatgtgacttgccttgctcagagataacggccttccgaaccttcggcgacgaccgcaaaccacgcttcgggaaccttcagaacgacgaacactacgcgaagcacacacgcaaagctacaagcctataaagaagcaataacaatatataaaaagaaagcacagggttctttaggttataacaaacattaggagacttgaacggatcgattcggagctcgtatgaccaagacatggtcatccgaagtttaatgctgttatatggagatttgcggattattataattaggtttttcaactataaaatatgtgcaagcgctagcctggagaagacaggaaggctgcgctgttgacatgcggaccccacatgtcaacctaagggaccacggcagagcgggtacacagagacggtccacgggtcgacagaagcggatcccgtgtgtcaaccgaggcgagtggccaacaaacggactccactagacaccacacgggctgcacacgtggaaaccacgcggctaccgagcgggcacactaacacagtcaccacacgcacaagcgaacgactaccgacaccggtacacgggtaccggggtcgacaaccgcacaacgggcacggatgacaccgaaaggacgaggacggggcagcgaagaagagatccttaccaccacgtgacgaggcgagggaacgacaacgacgaacgggtgcggcggagacggccgggaatgacggagacgaaagcgaggggacgacttcagcagcgatccttggatgaaggcgagacatggccggcacgaggcttgacgacgcggagccgaggacgaagacgacgacggggctgcagcggctcgcttgatgaacgtggatgacgaacgcgatcggcttgacggagagatgagcgacacaacgagcgaaaccgggaacgacgagaggacgacgatgacgacgatcggggccggcgaggaggcgacaagggcagccgtcagcggctgcacggagacgaggatggcgtggaacacgctgctgcgatgctgatgacggaggcggcgccgcgagatgacaagccagcgaggaggaacgatgacgacgatgacgaacaccggcggggttcggtcgaaggggaggcgaggccgagggcgaccttgccgctgtgatgccggaggtggagatggtgacgtcggccggcgcacgggcacggcggaagaggctgccgaaggcgacgtcgacgaggaggaaggagaggtcggcgcgggcgacggcgttccggcgaaattcgggcgacgccgtggcctggccagggaagaggatggcgccgcggtgccggggaaggaggcgacgacgacagccaccgcacctgcgaggcggcacaagcggctgaagccggtggagtggtggcaacaccactaaacgtcgacgaggacaccgttccggcgagcttcggtagaggggacggtgaggccggtgaaggggatggcgttgcagaaccgagggaggagacggcacggtcggacggcgcgcgggcgaggcggtaggggcgactggaggcggccggcggcgtgggagatagaaggaggacggcggggagaggcggggcgaccacgggagagcgcgggagggggctaaaactggagaacgtaccgagggggttccattttataggcgcggggagggagccggccacgggaggagcggggaacggcggcggaaaagccggccggcggccatggaaggcagccgaggaaggcgcgggcgttcccgacgattgggggcacgaatcaagggggaaattagggggaattgaagaggaaggaaaggggattaattccccctaatcaattttggaattcctggtttgaatcgcgtggatttaggggaggaatcgacgctagatttcacgggagagagaagagagagagaggatgccgggcgggaggaaggagacgaccgggcgggtgggacccatcggtcaggcgcgcgtcgtcagcgcgcgcacatgcgcggcacgggcgggagggcgccgctcggcttgggcaggggcgcggcttgggccgggtggccggcccaggaggagaggagggggaggcggcctgggggacagagggaggaggagggagtgggccgaggggaaggagaggaggcccaagagaaggagggagaggaggagagggagaggaagagagggaggaagagaggactttggccgcgggccgagagagagagagagagggaggctttgggccagagggaggagggggattatttttaggttttctttttaataaactttgttaattgttgttgttgtttaataaatatttccggtgctctgaaaattcaagtaaaatttgagggctccttttagaccaaggagaatttaacaaaaattctccggccatattcgaatttttcttgtacatattttagtgtttgccaatttcttttcgaattttaattaattctattattccttttagaaaatgatttttattttgggatgaatttatcaggacgtgacataacacgacacattgggccaaaattcacaagtctgcggagaagaacaatggagaaggccgccagcagaaattgggctggttttggctggacggttgagataaagccccaatgactgttgaagggtattaccgaccattccaaccgtcacaaccgtcatagttcagctataaaaggacttcaccttctcacttcactcacacacctcaaggaatagctctcttatttctctcaagtttagtttagtagtatctagctggtggaatagaaatagaataggaatcaggagtccggaagctttcggaagagttcgggtatggctctagcagatttcctttcctcttttgtaagctttgtacttttattataatactcttctttatacatttatggtattgaaatacttttcgtgtatatgagtacctaccttacattatgttcgtgttatactaaatatacggctggcgtatctgtgagatgctttggtgcgggtataatgtttgcttatacaattactctatgtcatgacgatgatattagagtagtatctggtagtttagacgtggtgtccagattacgggatatcattatttgggattatatattgcggatgagaggtgggcagctgatggtgacagctcagtacgggtattcctccgcgcctatatataatcctaagttaattccctgggagggtattcctccgtatttagccccggttgtatggtcatgacgggctgtcgtaaggaactcggcagtcagaggtggcttctcgaagtactaggagggcatcggattgagagtattagctagtatatcagttaactagaatgtatgtatagtatgtatactagaagtataggaagagattttcttactcttttctttccacctagcttagatcatttattatgagaatgagttgttaatgcttgtgtgtcactctactcttgaattatcttaacccctgcttagaatatgattatcacaagtaatatataaattattagttgagttctctttatatgatcttcccacgggagaaaataaatacgatacccttggaatactctcgggtgaaatgctacattggtatatccgtgcgcttgcggatgatctctgtaaccataatataccaaaagtatttctggcgcctttgctgtgaattatatttctagtaatgtcgttaagaaataccaacaaagccataaccatgaaacaatcacggatatccaaacaaacaacctgaaaccgaaaccgacacagagtcggccggtcagatcgcgggctggccggtctgactgctcaatacacgtcggtctgatcggcagcacttgcccggtctgaccgaaccacatccagcagtacctgtagatcacctgtgaaatccaatcatctccaaaaccacttcgcaaataaattccaaataacaaaatcaataatttccaatacccaattgttcatcacagaataataatcaaaaacacctttagttttacacaagttgccaacaaacaatcaagaggattttcctactcgcactatgagaaatctggtatgttactgggcgaagtgcttacaagcttgctctgaatctgagtgtgatgcagtatgtaggtgcaagcagttctgcaaaagatggagaaaggtagatatgggcaaatatttggtctgcacaggttccgcctaaggtgaaaatctttgcgtggaaactcgctttggatcgacttcctacacaagaaaataagcatcgaagacatcttgctccatgggccatttgtgttatctgtggttttgaagctgaaagcagctatcatgctgttcttcgctgccccaaggcacgagagttaaggaaggaaatgaaagcctactggcacatcccaagtgagaagaagttggagtatactggtacagattggctgcttgttttgcttgattccctgtcacctactcacaaagcacaactcctgttgcttttctggcgagcgtggcacattaggaatgatgctgttcatgcacaaggtagagaagaggttgctggctcctgttgttttcttcgtacttactgcgacattctttttcctatccagcaaaatgatatagtcaacaagggtaaaggaattataggagttaacaatctaaatgttcttggtaaggataagtcagttagggttgcttgggagaaacctgaacctggctgggcaaagatcaatgttgatggggcctttatagctgagtcaggacaagctaggataggtgttataattcgggatagcgcaggtttacctctgttatcgtcctggagaatga

SEQ ID NO: 39103 - DNA, 24046 bp, Oryza sativa
atcatgaattagctcagctagctaggagattaaatagttgtgcagtttggcggtttgatgctgctctctgtattagaacttagaacttctgactgtaatctctctggttgagtaaaaaattcaccctttccccgcaaaaaaaagaaaggaatatgaggaagatttcagagagagctacaaattggacgtgggcgcccacgtcatcatgacgtcatcctacatgtatgcatctaagcgaactttaaactatttttttctcttaaattatttatccaaatcatgatccgattgcactattaaatccgttgcaactaaatctttaaaacaaaaccacacatggatataatccgatgaaaaaattagcttattattaaactattttttaatgttgcacgctgctgcaccaagtatatcggaattgtttcactaactagatcgaaaatgtttcatcggacgttgtttcgccttatatgaaaacaatgtttcagcaaatagcgaaaggatgtttcaattcactgcaacatttgattcatacatagtgaaacattatgaatacactaggtgaaacatttttttgtggaacaaaaaatgaaacggattcctttaatagagagtttccataatatgtgggtgatttgttgcaaaagaattgtttcaattcactacaacatttgatccatacatagtgaaacattatgagtaccctaggtgaaacatttttgatgaaacaaaaaaattaaaagaattcccttaataaaggagtttctataatatgtgagtgatttgttgcaatggcgtgcatggtggggacacgtggcgggaatggcgcgaggaaacgtgacgggcagggcgcggggcgcccgattttactcccccacgtcggacgcccggttgtaggtattcccggaagatttcggtgcaaaagggctgggataagtttaagatgcacgatgatgcaatccagaaaacaatttgtccaactattcctgtaattacaactccttatgtttgcaatacattcagacacatgaaaaacatgtgtttgtgcttgcaggtgaagaaggaaataataataaatgcatgctcatgatgctcggaaacaaaattctcaggacagacttttgggcgtaaaatctaatccatgcgtgcacatggccacatgggttagtcttacggacggcgcgacctctgccgaagccgtcagattaaagccatcacgtgtgcacgtatgcatgcatgtttttttatctcgacgcttttagcttgagagttcaatgtgagtctttctaacttatatagtacttgtatatttttaatattggatgatatatttcaaaccatgtattggttttaagatccgttttaaccattgatcccacttaaaatatatgataaaatgagtatactattgaatacattgaaatatttaaaatccaccaggtccctttccctgtttgtgacatgcccatgtgcatttacatttcatattggattatttggcacaaaagaaatcaaatatcaaaaacaagtaatggaaggtgaccgaatggcataaatctaaagtgtggaaactttcagtagtataccctaaacttatcactagtgcagaactgatcttttacagtggtacccaaaataaaaatatttccgttagattattagtaccggttctaaaagtccgagtactaaaaaatgcatctttaataccggttggtaacaccaaccgagactaatcatggaggatctttagacccggttggtgttaacaaccggtactaaaaacaccaacctggactaaacatatttttagtactgattggtattaccaaccagtactaaagatatctccagggttacactactacaaaaaccctcatagagaatggcttataggtgttggttcatttaaaaccggcacatatggagcttttcccaccttctacgacggaaaaacagagaactgacacctttaaacactataggtgccggcacctataatatattataggtacccgtttttttaaaaaaaccggcacctatagctttgagccgagcctgcgagccgagcccatcagaaccgcacaaccacacccatcgcgcgcgtccttatctactcgatcattctccgcctaatccatctaccgtctctttctcgtctctcagctctcgggtctctctccctcctgtctctctatctctctctctcgcatctctctccttctcccccctctctctatctcgtggtgcctgcccagcgaaaacggcgagcccccgtggctggcagccggcctagtggacgctgcagcggcggcggtggccgcgccctccccttcgccaaatccggtgggagggcagacggcgggctcctgcggccagcggtagcagcggcggcggaggtagttgtggtgcacctcggcagcggcgacggccgcgaaatccccatgcggcgacgacggcaggggtgaagaagaacactggtggcacgggcgaggtggtggctggcggtttgagttctttggtgtttttctttttgagttcatgagttcttgtcccaaactttttgagttctttatgctttgtaccatgcatatactattttgctgttggttttgatctcggattcaaaggcggtgatgaaggggaatagggctgggttcgacggaggatgacaacgacggtggcatgtggttggtgagttcggctcggattcgagccggctctctttttttttggctcgagcaatgctaaaggtgccggttcctaaagagccataggtgtcagttgctagtattggtgcggaccaattggtcccggatgaaaatccggcacttgtggcccatttggaaccggcacctatgaccattattttagttgtgttagttcaaaaagaaaacatctctatgcaagttagatgtgtgtagtagtgttgacggctgttaagtgccaaaataatgccgtcaataccttcctaaaaccataaatgtgaaacatccaacatagtggtaagatttatttctaacaatttccacgagtgttgatgtatacttgtatgcaggtgatcaaccaccaaagttgggagagaatgagcataaagagtggaaatatattttgctctgatgaactcacatggttttgagctacaatatataaaatgtgcaattatttggagccaaaacatggagcatcatgaagtggggcccacatatcagcatcctgaagaaagatgtgggccaggggagccaaccatggtttggccaaaccccggccgaacccctagctggcccaatccagcccaacttcggtatgacggttgtgctcctcatactatgacggttacgggcgttaataccggtagaaaccgtcatcaagaggacacatggcaagaggagaaggaagatgctctttggattctatgtagaatattattagcatctccactctcccaagcaagctccacactataaatacccctctcctctccctcattcacacacaccaaagcatgagctgaattacaagaggctctattgtactttattgtatattagaatagggagagagtaaggtagaagaagtcagaggaatcccagagttgtcggtaatcctctcttatcttttgtcccggtacgtagtagagcgacatttgggaacagtgggttgacagtgcctggtgtattgcgttaggattaaagttaagctttccctagacattgtttctcattaggaaatcctctctgccctctgcccatattagttttgtgtccttggatgaacctgacgaggaaatagtcacacacgttcccttggattcgatacccttggaatactccgtaggggaagtgctacatcggtatatcagtgcgcttgcgtatcttatctgtgatcgtaagaaataccaacaagcatttctggcgccgttgccggagaacggttgctgtttatctctgaaccttgttcatcctcgtatcctctttatttttctctcttctaccttcacccctactaccccagagaagtatttctgaaaaaaccttctcaaccgatggagccattatctatcttccaattatctactcctcggggtgaattttacgagccacctgcttcatcggagcctattttgacacctggctatgaaattcgtcccaaattcatcagtatagttagggagaaatatttctctggtttaggccaggaaaacccctaccatcatctgcgggaattcgaacagctttgttcgtgcttaagatttgaggcatgaagcaagaaactgttcggtggaaattgtttccattcactcttcatgagagagcgtaacaatgggtggctggtctgtcctctgggatagtccaggcagctacaaagtcagcgaggacctgtgacttgacggctgttttaggcacgaagtggacattgaattggctcagctcgactacccatttggcgatttggccgaccatgtctttattcctgacgacttcgcccaaagggatggaggagacgacggtgaccttatgagcctggaagtagtggcgtagctttcttgatgtcatgactacagtgtagagcagtttttggatctgtgggtatctagtttttgcgtcgtggagggcctcacttacgtagtacacaggacgttgtacttttttccctctctacgatgataactgtactcacgaaataaggcgtggcagcgatgtacaggaataattcttcattgatttgaggaccaacaagtacagggggatttgacaagtagcacttgagcgcgataaatgcgttctcggcttcttggttccacttgaatttgtcttgcttcttgagcagggcaaagaagggttgtcctcgttctcccatttttgcgacgaatcggcttagcgaagccatgcatcctgtcagccgctggatttccttaagccttgtgggcaactttatgttctcgatcgccttgatcttctcaggatttgcctcgattcctcgtcctgaaaccaagaatccgaggagctttcctgacggtactctgaacgtacacttctctgggttgagcttcatctggtatcttcggaggttgtcgaacatttccctgaggtcgtcgattagtgagtcgatgttcttggtcttgacgacgatgtcgtccacgtatgcctcgacgttttgtccaagctgagtgccgagtgctccctggatcccgcgctggtatgtgttgcctgcgcttatcaatccaaagggcatcttggtataacagaatacaccgaaaggcgtgatgaacgctgtcttctcctcgtcctcttttgccatgctgatttggtggtagccggagtaagcgtcaaggaaacttaacaactcgtaaccggccgttgagtccaccaattggtctattcaaggaaaagggaagttgtccttggggcacgccttgttgaggtcggtgaagtcgacacacatcctctagttcccgttggctttgcgtaccattactgggtttgcgagccactctggatggaggacttctcttatgaagccagctttgagaagtttgtcgagttcttctcgtatggcttgtttttgatcgggtccgaatctccgcagtttctgcttaactggcttggcatcaggtcgcaccatcagtttgtgctcaatcacctccctgggtactctcggcatgtctgacggctaccaagcgaacacgtctacattgtcttagaggaaggtgatgagcgcaagttcctatttgtcgtccagcgttgccccgatcttgacggttttgtcagggttggcgctagacaacgggattatcttgatggtgccatctggttttggcgtcttcttgggcttgctcactttgttcgggttctctgttgtggcgggcaggttgggagtatgctcgatcatgtcaaggctccgcttgtcgcactacactgccaacttggcgttcccctggatggtgattgtcccttttggtcctagcatcttcagcacttggtatgcgtagtgcgaggccaccataaacttcgcgactgcagctctcccaatgatggcattgtatgcggtatcgaattccgcgacatcaaaggtgatctgctctgtttggaaatttttggcgtgtccgaatgtaacgggtagtgtgatctttcccaacggtttagacgacgattccggggtaattccgtggaagggctgatctgttggcgtcagcttgcttcgagttattctcatcgtgtctaaagtgctggcgaagagtaggttgaccgaactcccaccgtcgatgagaactcttgccaccttgatattccgaatagtgggttcgaccacgatgggatatctgccaggtgtagtcacgatcttggggtgatccgcttccgagaactcgatcttgtgctgggaccacttcatcttggtggtagtcatctgcgaggtggagcagacttcgcgttccgctttcttgtactccgtcttagaggtgtacgaagtggatcctccaaaaatgtgggagacatgcagatcgtactccggcaaggcagagtcagagttgttggtggcagcttcttctgccgtctcaacgactcgtacttgctttcctctttcgattgctagttgtctcgcgagctcctttttgacgacgtagtagtcctccaaggcgtgtttgcttgtcttgtggattgggcaccatggcttgcgggagtcgtcgccctgggggttggagtgtctggatggttttgcttgctctgtggcaaggacctctcctgaagatttgcgttttccactcttgtgacttctcttcttacttgactctggtgcatctttatcggccaacttcttcttctcatctcccattttgcttttcccctcattgcgcctcaaagcgtcgtctgcgtgagcgcacctatcgatgatctcgaatagttttcggccagatgtgattcagtgtgttgccaactcctgagtagtgtatcgatctcggacgccagacttgaatgctcaaatgacagaagcgtcggtgatctcggggatcgtatttctgcactcattgaggcgccgaatacagccccgcaatgactcgcccgggttctgggttaaagtatgtaggtcgtcctcaatcgtgtggcgcttgtatgtcccttggaagttgtcgacgaactgctgccacaaatcttcccacgaagagattgagttcggcgggagatggacgaaccatgaatgagcagaacctttcaacgcggctggcagatagtttgccagggcgttgtagtctgcgccagcggcttagagaattgtggggtagacttgcaaaaattcttctgggtttgtacttccatcatatttctcaattgatcccggtcggaacttgtcgggccacctcacattgtgaagtgcgggtgtgaatgccctgcgtccgttgcctgggacatcatgtggcccatggtcgcggcgtcgtcttggaggccaattcgaagaagatgatgaagatgaggatgaggggtcgcacggatcaggagcccggcttctcgaacggtggtcacgtccgcggtctcgactcggatgagcagattgggagtttcgatctcatcagttgccattgtccctctcctgtctttggtgatgatttttccgatcacggttgttgtcgtcacttcggtcatcacgggttcgtcgatcttgatcctcgttgggggtgttcccgcgaccatcgtcctgttctcgccgcaagggagagcgatgacggtgttgtcggtgtggatcaccgtcttcatggcgagaaggagaacaatggtggtgacgctcgttctcgttgcgttccctcctattacgccgatgtccgtttagatgctcgcggaggtcgccatcttcacggcgtggtggtgtagggtcacgtcttggaggagagcggttgccggtggcatgtctcccatcgagattttcttcctccgcatccccggtgggccgttcttcgttcatgttcggctctggaccgcctgcggcttcagcgaacgtggtattgaggttggtcacagtttcccgtagtcactttgcccatcggctggcatctgggtttgtcaccagatacaaaggactttccctcaaaatcgcatctacgttgcgcaattgatgagctagcgttctcgctgctacgaacatgcttgtttcagtgttgtcgaccacgttcacttctctaggtgactgcaaagaggactcgtagccttctaagaggtgtaacacggatggctcattcgcgccgatgaatcccacaaaccgatctggggccgcaactggttccttggcaacgcatggggtttgaactcgtggttgctgaacgcgatgatgcgccggtttaagggttctgaggaagatcctgcagttggtgagatcatacactttggatctatggatcggaaagtaggtggtactcgttggtgaagtgcattgtatccctcgttcccaacaggcgtagagttcagcttgcacatggaatatcaccgggcagtcctcaagagcatgcttggttgtcttatgcacaggacaccaagttctcggtcttagggtggtcgtccttgtcggctttgatctttcacatggagaatgaaattcagctgcttgaggatacctcccaggtgttggggccgtcgatgttccgttctccaccggagtgggaggaattatcggcggggcgtcgtttctctcagtcgttgccgtacccttctcgctcccgatgacgatcggaccagtcgagattgttgtaacgatatagaccggaaagacaatagatccgacttgagtccacaccagcggtgtcgaggtagaaactccttgattggcgctggtgatgagactgttgtcggggagtcctgaagtcatactagcatatccataagcgccaagtgcccctacctggcgcgccactgtcgacgagtggtactcgcggaccgaaagaatagggtattggcgtacgttggaacagggatctatgtagtacgacattaaaacagacaaaagactaggattatactggttcaggccccttatcaggtaataggcccagtccaatttatatgggattgatgatgatgaggacagattaccaagacagtaaccgaagcaagcgatactgataagatcgtagtcgagggattcgacgagatctcccggcgagttgactccgtggacttcggttccgtaaactttggtgggtgtgttggcgatgaaatgcgatgatctttgcctctccccaggggtcccttttataccgtggaataccttgaccctcaagtaagtcttggagatatgtaaacctacacgatatactagagatttcaccctttccgaggacttatgcaattccttaacttcgtggagttattttccataatctgaggtgaattcctaacggcgtatatgggaaccaaccttatatgcgaaggtataccttatcggtatattccataagtcgtaggatagagggtatgctttatccgtaaccctgacacacatctaccgtcgggtatgtaaacggtgaccgggagaaattgcgagacaggttatgcctcgcattcttccctataacccgtattactactcttcgtgtagaaattctgagtttccagcagataaataaagaatcgattgatgcagcctggtccaaattcactaatttagttcagtctggcccaaccctatctatagccgattacgtgctattgcaacattttcaaatgggtttagatagggagtctgcattctaccttgacataagtgctggagggtcattcatgcacaaaactcccgccgaaggcaaggaaattctcaatcgcatattagaaaatacctcctttgtcgggcagtatgttgaaccccatcaagaagcatgtgtcaagaagggaggaaccttcttttgccgagcctaaacccgagccttcaacatcttcaggtctgactaaagagtcctccctggagccatcgccggattccaatgaaattcaagctccgggttacgctcctaaattcagggatgatcctcataccgattatgagaaaaccttgacaggcatcctccctgataacacgccgatagaggaagtaatgttagttctgcttcatgaatcccctgaatcaattctacaacaggatgatcttcatttcattcaaaaagattctggtgagacccttgaattgctctccatagaaccaccatcacaacctcctatcgagcctaaaccttgtccctctggccttcaaaacgtcgttcttgataatcatcaagtatcaacctcattcttgaatgacgtctctcttgagaaggagaacattcaggccagggacaagtttgagacatcaactctggaggatgagaactccacaaatgagcatgaaagcttctatttcaaaatcaaccaggattcatgctcacataaggaatctctagagtcttgtctgatcagtgccgcttcttcgtgcgaggaccacaaccaccttatggtcctcatttctaacatgattagaagtgtggttgtggatgctttcatttatcagaaatattgcaaatctcgtatgtgtttgtggcactaatcttgcagcgagatgtctccatggtcgagcctgtgaccaaaaacaaagcactgtcgggagataccccagattatcttggtaagttttctttccaataaaagcaagaaccagtttttaggataatatgcaccttcgggtattcttggtcaataaccatttcagattgagattaagaacgagggacgtatgatgcctaagaatatgggagctacatcaactgttcattttggtgatccttggtgctgaaacacactttatgaagactccaacaacacacatttggttttgatgtctcgtgacacaaaagtccaagtgtgagggaggccgacgagcttgcatgacgagttccatcaaccaaggccattttggtttgcagtcgatgttagtcttaccttgctgaaaaaaagagaaaaaaaagaagaaaaaagagagaaaagtaaagaaaagagtgacggaagaaaaaaaataaaagatgggagaagaggaagagagcaagagagctggcgggctgcatctagatcaaagaccgcattatgtgcgagtctttaaaatatggtcatacacctcattagtagcaatcatgctgcctggctacaaccagcccctctcttgagctcatgtgcagccttggcttagccttcatccactcctagctgtgcacaacctctcgctccagcagcgcctacacgcatacacgcaagaggagatgccctcttcttttctaggtgtttgatgctacactccagttggcacttgcatatttgcccaaaaagagatgcatcctatgtctctacagcattgtgccaaaaccactcgcttgagttggtgtggtcaaagtgccttcctccgccacaacccacatcaagacggaggagagatcgacaatcacatgtgaccatgccaccgctctagaagtttcaacatatacattatgctggcagtaagtacactcaggtatacaacaaaagattcaccatttcttttacttgtacttatctctagttgagtctggcttgatcgtacatggttatgcgtcctcgggtccattttcatatgctatggtttgggtggtcgtcgacattcataggctttttaaattaagcatgatgcttaggatagatagcctgctttaatcaaagttaacatggtgtcaagtttgcttcaatgaaccatagagccagtactttcatggacttcggatgtatacccttcgtggattaaaccttgcaggaaatcatttcaatttaacggatgagttctcaagcacgagtcacactggaggtaagttaagggccaggaacaaatcaattgccaaaacaggcaaaggagaaacatatcacctctcaaggtgcacggtatgtatattgccaaatgctgctttgctatgttatgtaactttatctcaaccttgtatgagttttgcttaaataaaagtttcgtgaacaaaataaaaattgtttttaagaataaaagaaatgtctctcgaaaaaaaagagaaaaaaacatttttttctctcgagtaaaaagaaaaaaaaatgaaaaaaataaatggcaaatttatgggatccatgctcattaagttttcaatttaattcctttttaccatggatgtgatcaactaatcttgaggctacgataaaatcttttcaattttttgtagtccctcaggtatttgttgtccactaaccttttgcaggaaatatgtacaataacctcaacattcgtaccacgctccttggactatgagaagacagatgctcagggaaccaggcagaacaaatgcaaagttgtgttgcattcttgcatccgaatcaaagcttggtaagtcctatctagtaagaattcgaaacaccctgtgtatcattgcgtcacaaatgtccaccctgctaggttacccatcacctctattgctgccataaaaaatgataaaaaaataaaaacaaaataaaacatgaaaaaaataaaagaaattttaggcacttcatgcgcctagaattacttgaataaaatttggctcaccggtattctaccccgatgaaagcccattttgctttccatctttttgttgaataaagacaaggtacaaaacaagtgtgggggagtcttttcggaactcccaacgcacaatagaatcaattcaacatgacaacatgatgaacactggccaatgactgcgcacaaaattcagtagccagaaccgagtcctggctgggtcggttgaaccaagtgttcgcccaacccttgcctggctcggtactgtcatccttcgccgtatggtcaggtttgcgtgtctccttccttatcctcccttgtttgtgaattaaactttggtagaaaaatcgaatataatttagtttgactccaaatgaaatattgaaaacattaactctcaacgaatagaattgccctatgaatgatcatgtatactttttattctttgctaacacttgtcacttgtgaacaaccatctatcataggaaaccttgctcatctatgtaattaatatttgtgatatggttatgacgaaagaaattattgtccaactgtcatgatacttgggattttgttttgtgaaaaataaaactttttcgagcaatactcctcagtgactatattattaccttccaatgccatatatgattatcattgcaaaaaccttgtatatgtataggctgcttgacattacattgagccttgtcaaattattgtgacccgtgtgagatacttttcatactttcatgatcaagatcgcacgcacactccacatacacacactatgctaaacttttacactagaagctagcatttctcatccattatttattttatccattatccacaaaataaatactccatgtcatttatgcttcttcctccaaaattctttcaaagaaaaaaaacagagatagagagaggcatggctatgcaaaagaagaaaaaaaaaagtcttgctcatacaagtatggagcattgatgaaaagagagagaaaatagaaaaaaaaatcttgttcatacaaagtatggggcatgatgaaaaaaaagaagaaaagatatagccatgcagtctcaaatttccaaagagagaaaattggaggaggaggtatatcaaaggagttgtcttctattttcctttttccacccataaaacaaccatacacatacatacccatacacatatcacacacatgcacattcttgatcagagagtatgacttgctatctcctagggtccgatattttggctttgcaatatatgtgatgcaggtatgccccgattgatccctaccgacctccacctatatagccttttagaatagggacaattcggcaaacatgccttggtgaggatccacaaataaaaccacatgagtgatctgagagaaggtcatttgaggagtatagctactttgcaaaaatatataaaaaccccaagagattgacaggaggattaaggaggacttgagtcatgaccgttctattcatcaattgcccaagatgataagttagacacttgaaaagttcacaggtacaggtatagcttagagtaatttgtgtacttgtattatatcttgggaaaatttattccacattaatccttaacctttactcgggacgagtaaagagccaagtttggggggttttgttgacggctcttaagtgccaaaataacgtcgtcaatacctacataaaaccataaatgtgaaacatccaacatagtggtaggatttatttctaacaatttccactagtgttggtgtatatttctatgcaggtgatcaatcaccaaagttgggagagaatgagcataaagaatggaaatacattatgccctgataaactcacatggttttgagctacaatatataaaatgtgcatcatgaagtggggcccacatgtcagcatcctgaagaaagatgtgggccaggggagccaaccaaggttcggccaaaccccggccgaacccctagctggcccaatctagcccatcttcggtatgacggttgtgctcctcaaactatgacggttacgggcgttaataccggtagaaaccgtcatcaagaggacacatggcaagaggagaaggaagatgctctttggattctatggagaatattcctagcatctccactctcccaagcaagctccacactataaatacccctctcctctcccttattcacacacaccaaagcatgagctgaattacaagaggctctattgtactttattatatattagaatagggagagagtaaggtagaagaagtcggaggaatcccggaattgtcggtaatcctctcttatctcttgtactttgtttattactctgctttaatagaaatatcattctgagtaattgagatttgcgtagtgataattacttcttggttagttcctaattagcatacgggatcattgttcactatagtccatttatttatagtgattgctttagtgtttgatcggaactagagtagttattaattgcgtagacgccgtgtctgggtaattaatcttcagtggttgctgcgtatcgcacagtacgtttgaggtgggtgtagaggtggaaacagcgggttgacagtgcctggtgtattacgttaggattaaagttaagctttccctagacactgtttctcattaggaaatcctctctgccctctgcccacattagctttgtgtccttggatgaacgtgacgaggatatagacatacacgttcccttggattcgatacccttggaatactctgtaggggaagtgatacatcggtatatccgtgcgcttgcggatcttatctgtgatcataagaaataccaacaagtagttgagatggtaacgtgcgtgagggttgaggtcagagatctttagtttaaatcccacatcgctgacattttttcgacatcttaaggattggggtacccatccttaaaagaaaacaactgaagccctagcctactctaggctcctatggattgctaaacatgtccatttagaatagcagaactcgatgataccgacgagaccatagtcgagttggttcgactagatctcccggcgacttggctcctgcgtgctctagctccgtaggctgtggtggatgtgttagctttatgttgatctattgtaccgtctcgtgtcccctctcctcctagggggccttgtatttatacacataggtgtccccttgtccaagtagaactagggaaacctatatggatacaatccgagtagtccttgttatttccatgtagaactctgttcatccttccttatgcggaactcctcctatatccaaaggttgtttccgtataagagatggtatgtggtgggtcctgccgagatttagtaaactactattaggtatgtggtatccataaccctgacaatagcccccgacttcaataaaaatgaacaaatttatattctcaaccgcagaccttggagtaactattatcgagctcacgtgagcattctcggtgagttcagagataatgttagacttcccttatcagcctcgtgcgggcacctgtagggtttgtctgagtcaatctccgacgtcaaccaagaaagtacaaagcatacgactaagtctgtcgtgttgctgtaatcgagaatttggattgaagtcaagaatttttatctcagcgggtacaccatctcttcatttcgtattccttgtcaagatccaccaaccgttctcgaatgatcgagaaggcgcagagtctacgacggagccttgtcaacatttttcgtactcgccttagtcgatcttggtatagaaccatagagacatggagtcttcaacaatgtcgaatagaattttcctgaaatcaacactcaaaaaagaatattagatagaaatagcccctgagcgaatgctcaaagggtgacatgttataatatgtatggaaaactggaaatgaattaaatttacagaccaatgttttgtgtacaagtgtcttctcttttaccgacttcgatcagtcagtttgttgagtcatacactctacctagcccccagccttgtcgtcggagaatcgttctcggaggataaggctcttggaccctcgacctgccttggttgaaaaagcactgatcctagcccccagccatgaagttggaaaactcaatttctgattacacggcttggttaatacgcactgcgagaaatcttacatgaccagatcttacatggtcgtttgtctttacatgatccgataaggccttatccgctctaggcattgctagccgaagttcccttaggttcctcagagaccttgtcggaacggcgtaaagggacatgaggataggtttcaactctaggtgtcgtcatggtaagggatttctgggtaaaacgcttggcgatactgtgtacctgatatcaactttgttggagtaaaggtagcgggagaatcgctacaccgctggtcggggaccaggggtagtcataactcgaccacttgaagtggatgcagtgggagaaacgctacgccgctggtcgagaaccaggggtagtcataactcgaccactagaagtaaaggtagtgggagaatcgctacaccgctggtcgaaaactaggtgtagccttaactcgaccaccagaagtagaggtgggagagatcgctacagcctactggtccgagaaccaggagtagcctcaactctctgccgattgatgtcgaggtacgagagatcgctacggcctacttgtccgagaaccaggagtagccttatctctggaccggttgaagtcgtggtgcaaggaccactacgctgctggtcgaagacaagtcgtagtcgtacctcgaccatctgaagtcgtggtgcgagagattgctacgatttattggttcgggaaccaatgagtagaattatctctcgagcaccaatggaagttgcggtgcgggagatttctacgatttactggttcgggaaccagcgagtagaatcatctctcgagcaccaatggaagttgcggtgcgagagattgctacgatttactctgggggcgctaaagttggtatattacatgtgcatctcatgtggccagcatgactcacatacccaacttatagcatatccagatgtctgttcgcaatcatgtcgggtgatcaagccgacaatgttcacgaggaattatccgttaacaaccttttctcgaatagcccagctatggccggtgctatgagataggtcgtcggtcttcgttggtaggttgggtgcgataactctgcatttgtcgagaacgttctcgataatggagtgtgctcgaccacaacctactcgagtgctcaattgtttctgaaaaatattttctagaaggcaagacatgtagcagataatatcgagtatgtactcaaaaaactgcatggatcttctagtattatcaggatataacgagcaaattaaatatccgggattatgtaaaccgtaaacaagcatgatttatacagaagaaaatagagcgagcccccagcgttagactgtagttggcctaacatcggtaatactcgcacaatagatattgtataaaaaacatgctctaggtaaaaataaattattgatctgacaatgttgtatgatctaaataagtacgataaattgcatataaaatgcgtacctttgtagatatatgtcggatgtatctacaaaattagtagatcaatttgaaaaaccaatctaccaattaccttattgcgtactcgttcgacatcatatgatctgacatcttttggtacgccgcgtatcttgaggcttggatgatctcgatagaccgagttgtcgatgacgatgatggttccgatcttatcggggcacgtactctggtttggtttgacttctcagatctaaagtagttgaagtatccctcgtcaaaaaatccatagtgacgatgtcttggcgaagcttgacgaatatcccgatccgcctgagaacgtacttcgttcgggtcatatcatccagcataagaagtcgttgagtagtttgttgaggaatccatctcttgaacctatctcgtcaaaatcctgaagcaccaaaatccccctacctggcgcgccactgtcgacgtttgatgtcacgattccggtatttgcatagtatggggatcgttggtactaggatatacgcgagattgtagtaaaagagatggggacgaggatttttatacaggttcgggcccctgaattgtcaggtaataaccctacatcctattgatatgggattatatgatggaaaccacagattacaaagggaatagcagaactcgatgataccgacgagaccgtagtcgagttggtttgaccagatctcccggcgacttggcccctgcgtgctccggctccataggctgtggtggatgtgttggcttgtatattgatctattattccgtctcgtgtcccctctcctcatagggggccttgtatttatacccataggtgaccccttatccaagtagaactagggaaacctatatggatacaatccgagtagtccttattgtttccatgtagaattctattcatccttccttatgcggaactcctcctatatccgaaggttgtttccgtataagacatggtatgtggtgggtcctgagatttaatcaactactattaggtatgtggtaaccataaccctgacaacatccaacgaccagatcgaccccacgatccccacgccctatttcctgccgtatccaccctcacgatcccggccctacgccctcaccacttcccgcattgcccccaccaatgcgctccttccctcccccgcgatcccggccggctcctccaacacgcggccgctgccaccagatcagcggaaatccgcccgcgcccccaccctcagcacccattcctcccgctgtgccgtccgttgtcgccgtcgtccagcgccacggccgccggaccggcaagaatccacgcacgccctcacccccagcgccccatccctcccgccatgcatagggccttcatcctgcgtcaccgccgctgccggatcgacgggaatccgccgtgcccccaccaccagcaccccatccctctcgccgttgctccgtatcgcctcaccgtgcccttcgtcgtccaggaccgtcacccacgacaccggcgacgaatcaccgccatcttacacttccattgcaccgccgccgtcgtcgtcgtccaacacagcgattcgccctccgtcctccacgcccaccgcgcccttgcggccattcacgatggtcctggaagaatgccattgcagcgcccaagcttagcctccgtcatcgatgatgcaggtctgcagcactacgtcaatatacctacgtccatgtcccgcgcggctcatcgctgccaaccccgccgacgaggtaactagatttaaagctcattgctttggttcgatggattgacggccgggcaacatggatcttagttcttcgtaccgaaggttccagcagaatgttgttgatcgtgatctttgttaacacagaaccccagttactactactttcgttacagagatataccttttgctttggctccagcatacaaaaaaaaagggaaattaacatttgctatgaagtatataaattgaacttgtaggaaccagtcctgagggtcaacaattatgacagcattaatagaggatgctgctgcaatgtcatttgtaattgcccatggacttttggtaggtcagcctagccagccattcgggtccctacaaagagagttaaggtttggtattcaatcaagctgtgaatatggtggtgtttggttccaggattaagctttagtccatgtcatatcggatgtttggacactaatttagagtattaaacatagactacttacaaaactaattgcataaatgagagctaattcgtgagacaaattttttaaccctaattaatccataatgagcacatgtttactgtagcatcacataagatgatgatggattaattaggctcaatagattcatcttgcaaattagtccagggttatcaaataggttttgccattagtctatatttaatacttctaattagtgtcccaatatccgatgtgacagggactaaaaaaatccctggatctaaagagggtctatgttttttttctactagaaaaaaataccatttcgttgcaatgggtgaaggctattttaatcttattattgttatatggtttatttaagataaaattcactgttaaattcgcttggatacatagtttgttagaaaatcataagctgcaattaggaatccgatcgtctcagagttagcatgcgagttttctaaagagatttcctatacaatttcttttctatttccaaaagggaacaaacttaaaaaccaactcaaatacattatagttccaaaagcgaacgaatttaaaaaccgactcatacacaaatgacgtatcaaagtaccggtaaaaacatcttaaattttttataatagtagagatcatggtccagcctgagttagagttcttgacttgagacaagggtacagcaataactgaccaactgaatatcctaactgacagtccgatagtaattcttccagtaccaatattgccctgtttaggatgccaaaattcagaattagaaagaattatactacttcaagcagcttcaaagtaaattccatactattattactaccactgtaattattccatactgtcataactaccactataattagtgcaattatacgcataattgtctcataatgaactatttggttttgtcgcagtgcactttaatttgtgctgttcaatgctcgatttgggttgctgttaattgctgtggagtggagctgtatgggaattgctcaattctaaacacacttagttatagggctaaaaaaacaagaatttcaggggaaatcatccatattgaagtttagttagatttgccaacttattaacactcaatccctagggggatcaaaggaaatgttgtgactgactaaaatgttggtcggccatcaagagacacaaactatttggttttactttgttaggatgatttcctatttgcaagaaccatgcgagtacttttctttgtttttcctgtacggaattaaggatttctacgaacatgataaaatatcatctcttttggattgtgatttattttaattgtgagaattaacaaatagtgtatgtcttagtctgaatttatacctgagactgtcaaaaacagttgcaagggtatgccatatgtagttgttaatatctatggatcaatccatgtgggtagccaattgtacgacatatagccatgtacaggtaagcctggtacatttgtcaattgataaatatatgaatatgtatcagatacaaattattgttatttttttcctccaatccattcttaactatctaaaccactaatttacatataagcacgaaacagaaagtaagcaagtatcttaacacattttcagcatatttgaaattgataatatgctagactgattactatctgtaaataatgctatactttctaataaaaaggtttaataaccatgccgcttctttcatttctgtagctactatatcatgatgaagcaagttgggtatgtcaatgaaagccaattagaccaagagcagcagatctctgctttataagggagatgactaatcaggttacccttaattccaaagtagtttttgcaatgaggatagtattggattttttaaaatggtaccgctgagtgtgagatgatcagtacagttgtcaagaatacaccgctatcatttagccttcagcttatcagcataagcgataatttgaattttaaaacttaatttagagttgatttttaatcgctaacaagttgtttcacatataataagtttgagcaaaacgatgaagcctataaatgtcattttcaaaaatgagatgtgttgtttgaggggcagcttaccaatgttctagcggaaccagttgaaggtattttagattcacccaatgaagaaacatgcaaaggttctttaatgtcagacaaaaccagctattcagatctttagtgtaatatctcatcttttgagctcaatggacaaactcaataataacttcttttgtaagctagagcatcatggttgaagtgttgttgaatcgaagggcaaaagaggaagctccaagtttttgatttagatggacaagtgaggtgcacattaaatccaacttccaacttgatgaacaatacaggtcctcgacactattctacttgatgccaagagtgtggacatgaaaggacatataaagtcattgctaaagctactttttttagagagtcttggcagttagttttaatgaaaataggtgggtttttaaataaaaacaatataaatttgaatttttgtgtttcatgtgtccttaaaacggtctttgtgaagtttgttatcatttggactcatttggagagaactatccacaatggagaaaatcataagcagattgtttcttgctattattctgagtttttgaggggtcgaatgacattttgacccatcgttttatactagcaaatgaataattgaattgtttcaattctgttttgtttgccaagtttgattttatatgtcaacgatccagtaagaaatctagcagcgtaaacatccctatatgttctctacttgctaatttggggtgagaccaataattttagttacatgatagtgattttgctacatctaccaacatgtaatatcttgttcctacttgatagaatttatgactgaagacaaatttttgtttgatgagatggtcaaattcaaaattggtattttcacttgaatgattttagcaacacgtcaactttgttagctttaaaatgcttttatacccgttgcaatgcacggtcactaaactgtaggatcgaaacacaagaactaagccaaccagaggggggtgaatggttggtgtacccaaaaaccaaaatttttagcggaaataaaagttaccctcaatttcgatgtagatcggtctgaccggagtagtcccgtcggtctgaccgtgccagtgccgccggtctgaccgatgtagattgcccggtccgaccgccccaaagtcgccttagcctcctgatgccgccatcggtctcaccgccgtatgcccgccggtctaactggaccgatgccgtcggtctgaccagtggtaactcgccggttggaccgccgcacccgagaaaaaacaaatcgaagaactctcaaagtagatgacaactttatttcttctctctgtgtttacaaagtgcaccaatagcactccttacaaaaatcttgacaaaactcaaaaccctaactaaacaatcaactcaattgctctcaaagcgatactgggaagcctcacgctccctctctatttatacatgaggtaggcagcctaaagccacgaaccaaactcatactagaagtcctaatccccataggaaacctcctagtacaagaaacaaactttaaataaccaatcataccaaatttggact

SEQ ID NO: 39104 - DNA, 3462 bp, Oryza sativa
  unsure (1)..(3462): unsure at all n locations
aattatgtttattaatctttaagagcttagcatacatatagcatatcaagtcatgtgttgcaataaaaagaagatgaacccatctataatataacaagcatgcattaaagtataatcatgaaccgaagattttacaattaagtttgaatcaacaatcaaaattcatgatttcatacgatttataatgcaacatctttacaagcacataggttgaagaataaacactaaacatatatacctattgcatttatcactctttctcaaattagctttagcacaaaacaaccaagagaattttttaactttttcttttcttgagcctttttgcttatttttttctcaattattccgggtacgtccctatcgtcaagactgtttccagggattcggcacccattatttttgctcacatcgaatacgtccttgtcgtgaagactgtttccaaggattcggtattcatttttttcatttttattctctatgcacaatgagcaattacaaagctatttgaggaataataattcaataaagcatttatagatcaaaccatatgctagcatcaatattgcatatttgcttaattcaagtagaatgtaagtgtcatgcatcatctcccttaaaagcaatatctaaacctcataaaaagactagaatacatacaagctatgctagagacaaataaaccttcatagtattgctagcatgcacaagaaaataccatatgtatggaacaaagctcttttttttttaatttttctcattgtcatatttttgcttgataaaaccatgaggtacgaaaaactccccctcaaacaatgccaaaaggattcacgaaaaaaaacacaaactcccccctcaaattaacctctaattctccccgaagaaaaatcaagaagaaatcaaagattttgaaaaagacatccaattgccaatgaaaccaccaagattcttatgaattgatattcaaccactcgtataaaccaaaaccactacctcaaacactagcacttgaaaagctaataaacgaggaagtaaaaccaaagttatatcaatcaaaagtaaattgatgttaccttgaaagcaatcgtcatctcaacattgaacgctcatggggagtatgccatcaaaatacctatgaacaaaaagatgtcgaggcctccgtgttggggttagaaatgtaactaccccaggtaaccacgtacctagaatgccacaccaaaatacactcaaaaactaagtcctaaaattattagaaatttcggcaaaatctcccctaaaaatacggacatcacgacaggcagttataagaaaggtcaataccgatataagccacacaatccaaaccatcctagctccacaaatcccacgtgaaaaataaggatcagaaccttaaatgacctttacaagttctatgcaaaacttttgctgagcaaaaaatagtctaaaactaatttcaattgtgtgcaataataatgtgtagtccaagggtgctactcccgccccatgccgatcgatgtcattaggtacctaaaaaccaaattaaacacaagagtgagtaaagaatactcagcaaatacaatcttgaactagtaaaacatacgcatgatttatgcattaagaaaccaatatgaagggttggatttactttatttttaaaccaaagaagtcaaaagatagtagttccctcccgggcaggtctgaatatcctcttagcattaccggtaagccgagcaagcgtgatcagcgcttctcaaggatcatgaataaagacccaaattgcactcccatggctacgcatggttcttgaataatgtaaacagaacatccggaataatgaaacatgaataacgtcatgaatttgaatatgggtcgaaacacgaataagtagcataacgtcagagccatacaatcagtaatatcaagcaattgaataataattatgcaagtaaagccaaacaaaacaactcagtttgtccatcacataagtctgtcttgtacttgccttaactccttcgatactccgactcaactcctccaacgttggaacccttcacacctgtggagcaaaactacgcataaaccactatattcaactaacgatggttacaagggatatttactaaaatcgaaacctagaacatataaaccttttaccgatttgattaaataacctatagctgntccattactggtttatgcgtaactcacaaaccgtctaacggaaactagcaaataatacaacttcagacatctagaaaaaattctctacaactttcatgttgagcacaaaatcagattatgcctctgaaaatcccagattaaggaaaacgaactactgtcctgagttcctgtctctgtcagcagnattggttttgctgtttctcctaaaccggttatcggaatcgagtgaaactagcaccggtggaaagatatcgacaatgactacaaactttatttaggacaactaacccgattcctgatgggttaataccagatttgaaaatacggtttcagcctagcggtcgatataaaataaaattcaaaaaaccgggaacggatcgtctttaatataaattagaaacaactatagactaaaacggattacctagcagtactaatgtataagaaaaacgaagaatttggaaatattcaccaaattccccaaatttcccttcttctatcaaatttccccttctttccttccttcctgttcttctctgccttctctccctccttcctgttcgttgcaggccaacagcagcagcagcagaaacgaatattggcagcaacagcaagccgtgcatcaccagcaaggaagagatcagatcggcaacagcagggatcggcagcagcagggaaattaacagaaacaacagtagctcaccaacgaccggctgtggacgacgacggctgtggcgaccggcgacggctgcaccagcggcggcgccggcgaagacaggaatagcagcggcagcggcagagcgcacgaggtgcggcggctagggctacagtagcgattctcctgttttttttttcgtttgttttttttgtgggttatataaagagactaaataagatctaacggctcacatctatttaatcctcgggacttcgttcggactccgattactataaatttatagtctattttgcactactcggcgagctctacgcatccacggttcccaatcgcctatacgaacaatggtttaaaagttgaacttttgcgcaattgctctaatactccgcgaaatatattaatttaaaactcggggcattacaagaaataagaaattttggaatccaacactgagtcacatgaccagtagaaccagtaggcacatatgcactaataaaatcagaatcagacttacctgaaaacttaccttcatgcttcacaatagtctaacttagattatgcacaaacttgcctcgatgccaatctgaccgccactgtacctg

SEQ ID NO: 39105 - DNA, 4431 bp, Oryza sativa
cacttagaaaaattttgagaaatcaaaacatctttgttttgtaaagccctatttgcacatgaagtattaaacaaggaacttgcacaaaaaacaactttgtattttctcaaaacattctttatcaaaatcaactcatcaacaacacgagcatgcaaagcaaatccaagagtaaaagaagactccaattttttagacttttcaatctcagattccaatttcaaccaattaacagaattgacatctcgtaaagcgttaatttcagaaaataaaacttcacaagatttacattcatcatcattagtaaccaaagattttaatctatcaatttcagaatttagaatctcaatagtgtgatccttctcatcaagcatagtagaacatgtttgaagtttcttagcaaatttgtaagcagcatgttctaattgatcataactaagcttttcttcactatcactgtcagattcatgaacaccagaacttgcattacgagcaataaaagctagatcaacaacttgcttacctttgctctcgtcttcatcttctgattcatcaaaagctgctatgagttcttggattaaccactgcatgcaattcttcttcttctccttcgtgttcttcttcttgtccacttcaacctcttttactctactattttcttccttcttgcctctcccaagcttaggacaatgtgaacgaagatgatcaagtgcaccacactcaaaacaacgattaggacctcctctttttctgttcctgacattgttcatagctcgagaaactttgttaatagctcgagaaactttgttagataacaaagccaagtcctcctcctcaaactgttcgagttgctcatcggacatggcattaaataaagcaagtacagaagaagatgatgaagaagcaccaacattcaaagaagtcgaagaagaaaccaaagcactagacctagaatcaactttacgagcaagaatattcatctcatgagttttgagttttgtgtaaagcgaatccaaagtcaaagtagacatatcaacagactcctgaattgatgtaactttcatctaccaaatagacatatcaagaccattcaaaaagtgacgagaaacctcagattgtgaataatttgcatcataagaagaatcaacagatctaagatcactcaaaattttgttaaacctagaaagatagtcatccaaagcttctccaggtttcatctcaaatttaatgtactcctttttgaaaagatcacgacaaagttctttaatattatttgttccttgatgaaagtttttcaaagctttccaaatctcatgagcagtttcaagatgagagacacgatcaaaatccgaacgagaaatcccacttaaaagaatattgcgagctttgcaattttgttcaaattcaagttttaaaacagcagtattaatttgttcaggaatcacataaggattagaaacttttctccaaatatcaagatactcaggttgaatataagattgcatcttactacactaataaggaaaatccgttccatcgaaaacatcaggcttaattgcaaacttaagagccatggcaaaaactcaagatcggtaaagatcaagaagagcaaacgtggctctgataccacttgtaggatcgaaacacaggaactaagccaacctgagggggggggtaaatggttggtgtactcaaaaaccaaaacttttagcggaaataaaagttcccctcaatttcgatgtagatcagtctgaccggagtagtcccgtcggtctgaccgtgcctgtgccgccggtttgaccgatgtagattgcccggtccgaccgccccaaagtctcctcagcctcctgatgccgccgcggtctgaccgccgtatgcccgccagtctgaccggaccgatgccatcggtctgaccagtggtaactcgccggttggaccgccgcacctgagaaaacacaaatcgaaaaactctcaaagtagatgacaactttattacttctctctgtgtttacaaagtgcaccaatagcacttcttacaaaaatcttgactaaactcgaaagcctaactaaactatcaacacaattgttctcaaagcgataccgggaagcctcatgctccctctctatttatacatgagatagacagcctaaagccacgaaccaaactcattctagaagtcctaatccccataggaaacctcctagtgcaagaaacaaattttacataaccaatcataccaaatttggactccttccaaattcgacttcgcatcccatacgcacacaatacctccatcgtatgccatatggaatcttcaccaaccacgtgcatcaactctaacctaagtatcccgcatgatatctgaccaccacggacatcgtcttaccaccaagccgactcccgatccatcactgcaaatactctcccgaggcatcgagtcaactacacatgcaataaacaaagaaaccatatttcgagaccaagctatccccaacttgactcattgttagcaaacaacagtatcatatacgtatagtatccatctagaagccataaacatgaaacaatcacggatatccaaagaaacaacccgaaaccaaaaccgacacagcgtcggccggtcagaccgcgggctggccggtctgaccactcacatagcgccggtctgaccagcaacacctgcccggtctgaccggacccgacaaaacagcaaccctgttcattacctgaaaatcaatcatctccaaaaccacttcgacaataatctccaaatatcaaaaccaataatcacagatgccaattattcatcacagaataagaatcaaaacacacattgatcttacataaactagtacatcaagaatatgcaagatcgtactacctccatcaataaacaacggtatgggcttttgaaagtaacattcgattattcatcttaatcaaaaatataaattatgtaagtattatttattttttgacctttctttattattaaaaatattttaatcattgctaatgttttttcatatttacactttttttgaaaaaagaaaaatgatcaaatgtcgtattcaaaagttttttcatatttacactttttctgaaaaaaaaagagtgtatatcatttaaactataaaggaggcgaccaccaaagcaattctcatacaagtaacactaatgtaaaattcatcgccatgccacaacagaacctaaataatccacatctttaactcaccatgacaccatttttatgaattttggatggaagttccagtatgatttacttgcgtacaaatctcggttcttctttacttgcatgaaaatttctttccgatttatttgttgggtccctacaaatctgcatttagcagttactctccttcctcagcccacaagcacatgccaccaggtctctttcgttgtttatgtcatgcctatgcggatacacatttaagttgacacatgctggtatacagttatgtgacggcacaagcaactagtacattggaatttggttctaattaaggatatttttcaatttgttcataattaatttggacacaagcatgcatcaagcgtgtgcaatataacaatatatccgcctttaaattgagctactgacttttgaatataacatttgatagtttgtcttattaaaaaaatagaagtatcatttattttggtgcgacttgtaacacatctctaaaggtattttaatgatgacttacattttgcatatttacattaacgttttgaaaaaaaaatacaaagggtccaacaccatattcaaaagttaatagccatgtactctagtttatattggttgaactaaagaggccccaccgaagttattttccaatacatgtaatactaatgcagaattcatcaccatggcacaacagaatctaaatgatccgcgtggttaactcatgacgatgccatcggtcttatttttacgcttatcttatacttatacttatcagctaaaatttaagttttcagcattaaatttggagttgatttttgttttttttcatcgaagtttatttatcagcctttgtttttagatcgctaagaacacatatataaaagttttatcacaaattatttttcatttgcaaatatgggccgcatttttacgaattttgggtgtaaaccaaggtttgaaaggcctgtacttatttagttgactgattgacaaaacaacaaaaaaatatcttaggaagaagtctatatttgttctatcaactctgcaagttgtttaattttttgtctccaattccagtaacgcacagaattcggccctgaagtatcaacaccatacaaaggaaaaagtacgaattacctccgtactatccgcggtcgtatgaattacccccctaaaccacaaaaccggatattctgcagctccaactatgcaaaccggacgaatt

SEQ ID NO: 39106 - DNA, 1203 bp, Oryza sativa
cgccaggtagaccaaacccactatggattgggtcgagggaggtaattcgtccagtttgcatagttgggggtgaagaatgtccggttttttggtttaagggtataattcggacgaccgcgatagttcggaagggtaattcgtactttttccccatacaaataatgtccctggctaagtacgtacatcaaggttttgtcctgaatggcatcctattgtgctgaatacataggaaacaagttacaaaaataagaaagtaattggacctgttagataacagattatccatctaggtaaatttattatttttcatccccttcctcgccattcgttttgtattaaaaagaaagaggaaaaaaactaatagaaaatattgccatttctcttaagaaatgactacggaatgggaatccaaatatcctttggtttctgtccaagcttagacagaggtctatcagaccacacaccattgctactagacactggatcagcagctttttcggggaaccgtgcacagttcaaacttgaacttggctggttccttcgggatgattttcgtgaccgtgttgtggaaatctgaaataagccagttaagggccacaaccctgttcaaagatggaacaataagatgagtgctttgagaagacatcttcaaggttgggcggctcacaccagtggttcttacaaacaagaaaaaaataccgtacaaaatatcattgatgagttagacatcacagccgaggtacgggaattaactgatagtgagagagagcatcttgcttaatctagagatcagttatctagacttcttcgagaaaaagaaatcaaatggtaccaaagggcaaaagttactgacctcctacgaggggacaacaacaccaagtattaccatatggttgccaatggtaagaaaaggaaaaaacgtattttttgcctcgatcaggacgaagggaaattagaaggtaatatagcattgaagtcctatattactacattctattaaaatctttttgggccacctgagaatacttccgtcacactagatgaatatagaagggaggatattctgcaggtaacgaatgaggaaaatgaattcctaccggcacctttctcgtaggatgagatccagggaactgtgtttgaaatggaacacaacaaagcccttggtcaaaatggtttcccggcggagttcgaccaaaatttttg

SEQ ID NO: 39107 - DNA, 978 bp, Oryza sativa
aaggtttctcgcctaagtggatctcttgggttgagtctttcatttctggatgaagcatagcggtaaaggttaatgacgaagttggatatttttttcagacaaagaagggggtacgtcaaggtgatcccttatcacctatattatttaatattatagctgacatgttgactgtacggattaatagagccaaagaggatggtcaaattgcaggagtagtaccacatctaattaatgatggtctctctaccttgcaatatgccgatgatatggttctctttatggatcatgacctagaaaaagctcgtaacatgaagttgttgctttttgtctttgagcaattatcgggtcttaagataaatttccataaaagtgaattatattgctttggtgaagcgaaagattttgaaaacgaatacatggaactctttggttgttccactggtcaatttccatttcggtatttgggtatccctattcattataggagattaagaaatgccgattggaaggaggttgtagaacgctttgaaaagcatctaagcagttggaaaggaaaactcctatctactggaggacggctaacattgattaattcggtgctaagtagcttcccgttgtatatgatgtccttctttgccataccaagagggatacttacaaagcttgactactttcgctccaggttttactggcaaagtgatggtaaaaaaaaaagtattgtcttgctaaatggaacatactgtgccgtcccaaggacaagggggattaggaattcatgatttggaaattaagaatagggctctacttagtaagtggttattcaagttgctctccacggaaggggtttggcaacagttgatgcgtaataagtatctgggtgataaacctctttctcaagctcaatggaaggcaggggtcacacttttggtctagcctcatgaaggtgaaacgggactttcaccgttttggatcctttat

SEQ ID NO: 39108 - DNA, 1456 bp, Oryza sativa
tctgtttggtccatcatccaagcagcatctggacttcctccaccacattatgtagcgcatatgtttgggagctggcttgatggaattcataataatttgaaatcacatgttctgttaggagcaactgctacttgttggtcgctttggctatgcaggaataatgtggtttttgataaaaaaaaagtcatatcttcacctttgcaggttatatattctcttatccattggcttcgtacatgggctatcctacataagcctggttcgcgggatatggtagttgcggcatgtcaacatttggagaagatggttaaggagttatttacccagggatatgggtggcgatctagtcttagaattggtggtccttaaaactctgtgcttttggaggagatggccaaggagttgttcatgagtggcaatttagttgttagattgattgtacttaatactccatgtcattcttttttcctttcgagtgtggttttgtttgttcagctgtgtgcatattagttatgcagaggccgaaagtgttctcaggataattgtatcaccttgatgtaattgactgagttcaataaaagcttccattatctaaaaagaaaatattgccatgtcttttaccacatcatgcatgcaaacccacatattagttttttttagacgtttagacgttttgatagttgactaatgagttctggcaaatattggagctgagggacgaaaatttaaactatgaggactggagggaccaaatatagacatttcagatcttacatggtagtcagtcattgagatactgtcatgactttgatctaaatttgcactgatactggtgcaacgataagcagctacttctacagaatacttcctccattcctaattgatcttccattcctaattgatcttcatatatggtttatgcatcaataccaagataaacttgcggagcacttaatcagcatcggaaacatgcattagcgtttcgtatccatgaatgtagcgccatcagttttgcatgccgcataacctgaccaatcagatgcatgcagtgttcagtaggaagtatgattaacgtccttcccgggattttcaccgcctcctcaccgtaatgcgacgatcaaaatggaattatcattttttttttttgcatacgacgatcaaaaggtaacggaggtctgctttaagcgttcacaagtcttcagcagtaaactctcgcatgctgcacttgagagatgagagcatatcattgccttgcccactgcttttcactgtcaacataatagacaggggttagcgactggatgacaaaagaaattaactgagaaacatagttagcacttagcacattccagtgcatatacctgtggtggatgttctacttgtgcagttgttactgcaccggtcaaagcagcagcctgctttcttcttcatcatcctgaagctcctgccctattct

SEQ ID NO: 39109 - DNA, 3448 bp, Oryza sativa
gaagaagaagcatgtgtagtaagtgattagttatttttgtttttgacttatctagaaggcattctactcccgccgtttctaaatatttgataccgttaactttttagcacatgtttgactgttcgtcttattcaaaaaaacttctgtgaaatatgtaaaactaagtatatttaacaatgaatcaaatgatagaaaaataattaataattatttaaatttttttgaataagatgaacggttaaacatatttaaaaaagtcagcgtcaaatatttagaaacggagggagtactatctaagaagtataacaggcaaacatgtataatctgaaagcttatggcctctgcaaagttcagaacgttaatttgtttgtaggtgattttgatactgaaatgagtatttgttctgaaaatttcttttccacagtttacatctgttcgatgatattctgctatccacttcttcttccttaattaatgtgttccttttctttcaaaaatcacatgcatgtaaatattttgtttgttgctttctccttctctctaatataatggcagaaaaacctacctttggttaaaaaaaggagtcctcaatgaggaaacaattaatagccagggaattggatgaactcaaaagcagacaaaacctttttttaataaagaaatttatttcggcattttctttgaagaaattaactatagtcaactattaccataacgaagtttgtagttcaaactactgcatattaaaaaacgcagtttgatagaaaacaagacaactatatagaacacctgcctaaaaacagatgtgttagtctattgttaaaacttcatttgcagttagcgaaaatctacataatcgacaaagtcaaaaccagtagagaggatacatagtcacccatgttctgaattcaaattcaaagtcacaaatagactcatcaaattccatgaccaatcatccatccgaatacatctcgctcacatcacagctgacgattacaatctaaccaaagcgaaagataagtttagaaccaaatgaactacaatcagagcctacgttttcattagggatggagaactggacactgtcgccaacggagaagaacaaaaccttataagtagaaggaacaaattcattatcaacattctttagaaaactttttaaattatcttttcaactttccaaatacttaatttatttgttcgtgcctccaaataattatcacaaactttagttttatgaaccatccatcattcattgattgaacgcaccgggacttgagattaggattaaactagtcaaaagctcgcgcgttgcagtgaaaatttataaaagtgaagttgtgatgaaattttaggggacgaaaaaattgatagagtggtataacatatttataagacatgtgtgtgaattgaagcaaaatttgcaataatgatgatcaactatgagaaagttgttgaggcatacttagtgagatcagcattagaaagataaaaattgtcatcgatagagcttacctcaatctcgaaagtactcttaaattatgcctcaacaaatatcattttaaatataaaaaacttaccatgtgtcactaattatgtttaaagtacagcctggtagcaggagccatgaaggtagatttcgtgcttaaattgttgagattattgaagagaaagagcgagtgattacttgacggtttatttgagcattaagataagtaccactatttaatcatgcaatgagcaacaatcaacatcatgaatagaggagggattcatttgcagttaatgtgaggaatggagcacatgttattagcttctctattgtatcggatggttaatatctgagatgcacaatatgatctaacggctataacattcttgatgatgtggttttacgaattcacaactaattggagtggttatatagaaatagtagatagttgggatgtactcccttcgtcccaaaaaaaaaaatccactcatagcatgtcaaggtggaattagtggagatgaagagtgactaaaatgcccttaatcattttaggtaaagaatagtgaagggataaaacttctctttttacgtgctgagagtagatagtatgggataaaacttaaactcttaaagttgaatttttttttgatggaggcagtactgattacgatgactccttcctagtgagtagggaactatattatatttatatttatagggtatacatagtatgggttgcgcaagcgtgtgctctaagttaagtgaagtgatctttattaggagatcgaggacccattcccctgccacattctcctcttaatgacttgcatactcaattagtggattagtcgtcgtactactactaattaatttggtttggctgctcacatgacccaatatatatgcatatatatgcatcatggtcccatgtggacagagagtgccatgccacgctacctcacaactacccatcatcatcatcatcgatcatcgtcaccatctcaccattgcatccatgcaaagcatggtcccaaaccaaccaacggtagatagatagcgatgctgcgctgctactgtccaatactgtacagctacgcctagctgtactatatatgaattttctcagtgctttttgcgagtgaaagagagagagagagagatatgagaaattgagaaggaattagcataaactagtacgtactataggagtattatagcatacatataccaacttcggtactttttgtacttgatttctgatcaatgtaattagaaagtcttcggtcatactcttttgggggttcggcaatgggcaagctcaatccctatgaaatgaaatgcaaattcaatctgcagctaatagtgaattatttttagccgtcatgcccttccagtgagtatgcttcgttattacatttttaacaatcaactatgaaaaccatttttcgtgacggccattatggatttttgctggcggaatttacagccgccacaaagcaaaggccagtgaaaatcaagatcttcgctagcggttattgaccaccagcaaaaatccattttcgctggcggtcgtcttaagccagccgccagcaaaaattcattttcgatggcggctgtgttatatcggccgccagcgaaaatctatttggggaacaaaaaaaacacgcatgcaactgcccagccgccagcgaagatttggagaaaagacaatagattcattttcaaaattcaaatccaattcatatacatatggctgctcatttccaaattcaaacacaatataaaatcatcattagcacacatgtacacatatcaaacatcacaacatgcacaaaacatctacatcatcaggaaacatgcaaaaaaaaaaaaaaaaaatcgtgccgccgccggtctcttgtcgtcaccacctcatcgctgccagtggggagggaggaggcgccggatctgctcccc

SEQ ID NO: 39110 - DNA, 10569 bp, Oryza sativa
gctaccgccgccggatctagcctcccccgtcgtggcagcggcggatccggcctccctcagctgccgctgccgggccccttcgtcgtcgtcaccggcctccctcatcgtcgaggaggcggatccggcctcccccgttgacactgcagccggatccggtctcccccagccaccgccgccgggccccttcgtcgtcgtcgcccgccggccttccctgtcgtcgaggaggcggatccggcctcccccgtcgtcgcggtggccggatccggcttcccctagccgttgctgcgccgccccttcgtcgttgttgcccgccggcctcccccgtcatcgaggaagcagatccggcctcccccgtcgtcgcgacggcccgcgtcggtggatcaagagttcgcggatcgagagacggagaagggagagaggcggatcgagagctcgcggcggcctgcggcggagaggtagaggctgcgcctcgccgctgctcccgaggcggtggagctgcggcaacgggagccggcggtggtggggagagggagaagggggaggagaagggagaagggagggaggagaaggtggaggagaaggataaggacggagaagaataaggataagggcgggcggtggatttattggcctcaatttttttcagcggtcttcactacctgccgccagcgaaaatcacgttttcactggcggacagctaagaggcccacctcaaaaaatagagtttttttttatggcggatctcttagcgtggccgccagcgaaaatcggttttcgctggcggtccatggccccccacccctcgaaatatttttactggcggttttcgcgtatggccaacgccatgaaatatcgtttttctagtcgtgaatgtattataaaaatgataaaaaaaaactaactatggagaagtgttttttaaagataaatttactttagtgatactatttgcacatatcaaatcttgttactttgatatttattgacgatttaagtttttaagatttggctacacttattgtacgacaatgtgatctatttgaaaacagttggaggggatatctttgatttgccctcttcagtttcgtagttcttgatattttgaacaacgacacagtgttctaaacatattttgactatatttttctattataacatataaaaataagtaaatatttaatattatcaaattacttttaagactagcgttttcaaaccaaatattttaaaatctatatatagttaaagttctagttattttatttaatttcaaccttacctaaaatatgaagaattatagaaccagataaagcaacaatatacatactatatacatatagtaatatggtaaggacacaagagcatatgcatatcagcatatatacttgtatacatgcacgcttactttgagatgatcaccacctagcctagcccttttttttccttttttttttgttgcagtgagcgagcaagcatgcaacaaagtgtgcctctcttttggcacataccattattgtgtcttgttggaacagctagcagcatgcctgcctgcctgccttgaccacacacacactgcccggccagctcaaatgcttctgatgaacagagcgagagatcagctttgcaattcttaatcgcccatatgtaagtacgagcaaaagctcacctgaaagcacaccggacactagcaaaaggctgggatacgttgcttagtttttggtttaagataataataataacaacaacgttaataatacacagtagccgatagcgaaagagcgcagctttccgcttggccatttgtgactactccctcactcccaaaacaagcgcaaccatgacttttcctgttcaactttaatcattcatcttatttaattttttattactattagattataaaatgtaataatactttatacgtgacttattttttatttttttaaaaaaaattaaataaaatagacaattaaagttggattagtaaacttatagctgcgcgtattttgggactgagctactaagtgatcgtggtttttttttcactctagctcttgtactatgacagttttactgatgtaccccgggggtattttacgcaggaaaccctagaggttggggggtcgccgccgccgctgggcccacgtgtcagcctcactccccactcccccctacacggtagccacacgggctatttgctcgcacgcctcagtccacctcccctgagctgtgctgctgcgctgcgctctcggactcctcccagatccccaatccccccacgctctccggccatcgcgggtggagcagggccgccgccgagggctgggggggagcgcgagtcccggggatccgagccatctgccggtgggcggcggcggcggcggcggagttggggttcgtcgtcttggtcttgggtcttcttcgtccctcgctgcgggtgggtagcgcagcgtcggggcagatccggctagccactgcgacgctgaattctggagatccccgcacatggagtcgcagcgaggtccgccgccctccctccctctctctctctctctctccttatttagtagtagtatgtatgcctgtgctgtgctgcctcgagaacaaacgttcaccgcgtccccggcggcggcactcagccggagcacgcggctgcggtgtggatcgccctggctttcaggggtgaataagggaacaatttgttgtgaagactagtagcttatagtcaatttattcaattccttggtctatgtgtgttgtttataattcaacataaggaatgctagttttgtaaagtaggattaattcagtgctagggttgccactcaattgaacttcaaggccaataggcacattttagacgctcagagcgcaagaactaagataatgatttagctcaagttattctgtgggagacaaggaaaacatcagtttgtacgattagtttcaaaaatggtgccccaggagacatcgtataagctcttttgagcctaacaagtgttgtgcatttcacattacaaacaagttggccccctttgatttgtaggaaaaacataggaaatttggaggatttcaatcctataggaaaaatatctatgaaggtctttgaaacaaaggatatcttatccttccctttgaaattcctatagagattttgaaggaaagttagcaagagctctaacctcttggaaaatttcctttggagtctatctctctcatccgattcctgcgtttttcctgcgccctaataaattgaccattcttgtatttttttcctgtgttttgcaatcatctgttctgcacttatattcctttcaaaatcctgtgtttttccaaatcctcctttttttcaatcctgtgcttcaaaggagcactttctgtgttacaatcacataacagcacaaacaagaccttgttctttgttatactcaagtgaagatgccatctataatttctatacactacatcttattatcagtatgccaatttttgtgcacttgttgcctctgtttggttaataaatcatctcaacagtagttcttgaatctgttgttaatttgatgaatatatatcaacttgagaaatctattttgtagatacgttgagcatgagtgctcttactttgtccatatacaaatttctatcttctctattatacatttgcttgttggtactttaaagtaaaatacaaaaattgatgtgcacaatgtgttgtacatttaactttctggctcaactgggaagccgtgccctttctttacctgaaatttatttgtttgattgcttctcatttgcatgatgtagcactaaccaatgggacatctaaacttcaatgctgaattgctgatcatatcatttactttctgttacctacttacctgtacttaactaaaaacctaaaatttcttgaagccctattgtccaactgtaacatattttttgacaatttttttaatgacatttggcagggcaatctcctgatcgtggatcagacgcatcaggaccaaaacagtctagtgtttcatcacatggtagacaaaggaattcatcatcttctatctgtaaagattttctccggaagtttgtggacaatgaactattgacatcaagcctagaggactggttctctgggcacagtgaagactgtggtttcaagaagccagcatttgatgttccttttgacctaagtgaactacaaaattttgactatgctatagaaggtgttactttccaacagctagtacggatgccaaatgctcttcatgcctcaacatcagatatttttgaagctactgcacatcttgctttggaagattttcttcatgcaagtattaagggtttgtgggaaactttctggggccctgatgaatcgatgcctttctctgttgcctgtatacacagcacaagctccaaattttatcctgctgagaaggctattagcagtgggagacttgatggcgtttgtgcaacggctgtattgctgaagagtttaaagcattcacaaggaaggtgggatcatattgttgtactggctttgttgagacctgatattggaatgttttcggggcagaatgaccaacagccatctccggctgttttgggggaggcactattctttgccttgcgtgttctactttctcgaagccttagtaggtcttccacagttcttcaaaattcagattgtgtttacgtccttcttgttgattcacagtttggaggagtggtaaatgtccaaggtgatctgaacaagcttgattttgatttgaacaatgtttatgactctgctgcagagtggataaaaaagcatgcacaaatcacagtttcttccatagaccgcgtatggaacaaacttggcaatgctaactggggcgacattgggactcttcaagttctccttgcaattttccattcaatgatccagttctgtggtgcaccaaagtattctcttgatgaactagctacagagcatagttcccgattacagagccgaagatcagaaagacatttggttggcaggcaagctaatacaaatggtttgtttcgattccagcagcaaagtcattctcctgaaattgttgaagtacaagaggagggagctgttaatgtaaaaccaaaggaaattttgaagcttgaggtaggatctgttgtattgatggaggatgctgattggcagaagggttttcaaatcaatgatattcttacagacagcgaacctcctatctatagtgctactcctgtagaagaacctaccaaaacccatctgttgtatgtaggctccagcccttctcatttggagccagcatgggaagatatgaattcttggtatcaagttcaaaggcagaccaaagtacttactttgatgaagcaaagaggcatttcaagtagatatgtcccacagatggttgcttctggacgtgtcgtccatccaggcccttgtaacaagcctaactctagtgggagttgtggccatccatggtgcagtactccaatacttgtcacctcgccagttggtgaaactatttcaaatctgattcgtaatgggctgtttggtgttgaggacgctctgagatgttgtcatgactgtttgtctgcgcttgctgctgcatcatctgcaggaatccgtcatggtgatatccggccagagaatgtgatccgtgtgagcaatggttcaaggcatccatattttgtacttattggatggggccatgctatcttagaagacagggatcggcctctaatgaatttattcttctcatctacatttgctctacaggaaggcaagttatgtgcagcatctgatgcagaaagcttaatttatctgttattcttttgttgtggtggagtttgcccagagcttgactcagttgaaggtgcacttcaatggagggagacatcctggtcaaggagagttatacagcagaagttgggtgatgtctcagcagtgctgaaagcttttgcagactatgttgacagcatttgtggaaccccatatccgatggactatgagatatggttgagaaggttacgaagaaccatcaatgaagatcatggcaaggagattgatacatcaagttagtactgcagctcatgttagtgcggaagtacgatatggaagatcaagaatggtcgttccataccctgtattgttgttgtagataatttattcgcctgtctcgtaaaaggtccataacttagtatccccctccatcttgctccatttcatctaaagggtatttccatagtcacaatctgctgctgatatcctcaacttggatttctgaaaatggtgtcgcctttgcacaagactgcagtagagatcttctgaggatatctgcaacatgatttattttggcgagtgctcctcttaagtctttgcttttcttcgggtctcgagtgtgtggtatagttgatcaatttttggtccttttgcttttttgaaattgttccagaatggatttgtgattagaggtggtgtggcagagtagcattttgttctgactaaattattttgcgggtgctatgttccaagtgcacctagttcttgtaaatgttgttcttgttcagctgtacaaacttcaatcatgctaggctgcaactgctgggtgttgatatgttcgatgaaatgtcaaaaaaaaaaagttgttccccttatgtgctataaggagcaggttttttacctgacgggcatatattgttgtgagaatttcaggccatagataatctggatatgcagacaaattattgtttctttggagattcagttaatggcgtgacgaatagaattcaactgtacgtgtatcctactcccttcatctactttcgatagtcatatttccaaatctaaaaattttatttttttccaaatctaaaaaatttatttttgataggcatatttcaatccaacaacttatcatctcaataactttctcaaatttaatgcatgattcttcattgttccacacatgattggctacatgaacattgagaaatgtaaatattaatgaatcgcttatttacgaggaatgactagtagcatgtttaaatggatgataagtagaattacttatccttgatctatgtgtcaagatgaaatatgactatcaaaagtagatggagggagtatcttatttttgggggcaatttggcttgactagttgggtttcataattatagttctggaagtttgctagctccctccaccttttccaacaatgagcaatagaatcattgttgttaattactccctccattctataatataagtcacaactaccgttctatatattataaggcataactacctttttttttattttagatgttttataatatatggcatacatgtatgcatacaattaattaggacttcttctccattaaattattatttttttaaatcctccatcctcaatatctctaattctattggatgcatacattatatttattagggtgatctaaactagaagatgataataattattttttcatctttgggttaagggtggttgtgctttatactattatatactattatagaacggagggagcaatgatataatagtagcataattttccatggtattgaattccttttgatgttctcgagtacttgaaatacttgtacgcagcgcacatagttcatttcagtgacgttcgcagattttgctgtaaaaaggtacttcaccctgtgcgagcatatgcatatttctgaaaataaaaggcattttcggagtgaatagtcggtaatacactggtggacaaaccctttttaatcccgtttcacaaccctcctatattcccgcttatataactgggactacaaatcaaatcatttttagtcacagttgaaataaccgagactaaaaatgaatatttagtcccggttggagttaccaacatggactatagtccctcttggagttaccaaccgggagtaatgttctttttttcttttttttcctgctgcttgcatgatttcgagccccacaaatcactcatattatccaccaatcattcgaacaccacgcatcattcacaaaatccccaaatacatcaagctgcattttctatccccaaatacatcacaaatcattcacaaaatcacaaaatcatatcccaaaatcattcacacatcacacatcacacatatcagaataagaaatccacatcgctcagatcggccgcacatatcagaaaaagaaatccacatcgcatagatcgaccgcacacatcgcacagatcagaaaaaaaccacatcgcagagatcaggtgccgttcatccgccgccttgccggcgtcccgcccggccgcctcgaggtccgccgccgcctggggagcgttgccacccgccacccgcctcctcggcggccggtgcccgcccgctgccgcctcgggctccgctgcccgcccgggaagcgccgtcgccacgccgggacccgccggccctcgattggccgccctgctcggccagcccggccgccggccctcgcaggctgcctgcccggccgcccgcctcgctggcctcgctggccgcccgccgccggcctcgcaggccgcctgcccggccgcttgacacttcgcggccctccctgccgccgcgcgccgcccggcctcacgtggtaggaggaggaggaggaagagaagagaagagaagggagaggaatgggagaggagaagggatggaggattgggtgaggctgagaatggagaagggataaggaaggctgtttaattaatgagaggggaggggagaggaagggggagagaccaagccggccgcgcgcgggcgcgtggcttggttgattttttggtctcggttggtattaccaaccagagctaaagatcaaaaagtttttaaccgggactattgtggattttgggcgaccgagtaaagatggtttcttcaccagtgttagctcagggaaagatcgtttatgtgagatttttttttgaaataatacgattttaatggaaaatcgcaaaaatataagtcggttaggcgaaattgcaagtttagcaccctatcgaacatccgtggttcgacagggtacctattgaacaaccgcagttcaacagggtacctatcgagagttcgacaggtgataaaataattttataaaagagaaaaaaaacactgtagagcactgtagccgtgctcctatcgaacattgcctgttcgatatgtcctgccgcacacctatcaaagttttcatgttcgatatgtccctgctgggtactgtagcaagtacttttttttttttaccaactaccggtcgaactgcagttgttcgatgggttcccctatcgaaccacggttgttcgacagggtgctaaacttgtgattttgactaaccgacatatatttttgtgagttttcattaaaatcatattattttttaaaaaaattcgtttatgtgaccccgaaagtccgcaagttaatagttcggtagagccttttagcttagcttagctaatcagctgcacggaaaacaagatagatatgcatgattaatcaagtattactatgaatatgaataaaatatttgtttaattttgtgaaaaaaacttttatgtagatactccctccttccaaaaagaagtgaatataggactggatgtgacatatactagtataatgaatctagatagatatatatccagatttattgtactaggatgtatcatatctgttattatgttagttttttatgagacggagggagtagtttgtcacgaaacataacgtttaaccattccaaaaagaatacatactcacgtaaaacgagtagcccagcttgtaagctttcccgagcgcaccctatactaagcgtgggtgttcggtttattcggtttgtttttttaagctatatggaattcagtttcttaaaatgtcaaccgatcgatgcaaagttctaggaaaaaaaaaagaaccgagcaaaataaaatgaagaagttcggttcagtttttctggggcttggtttttaccgaggaagatgttgatcgtacgccgtggtcgacttcgagcgattacgcacgcttagcgcccgcccagctacactcaaggggcccgcttgatcaaggaatggggtttgtgtacgtgttagctctcatatattttaagggccttagtaaaaattgggttacatgcatgttagtgggtcttgtgccagttggattggctacagagtgcacacccatttagaccatgttcggaagataggtaaagctgtaaaagactaggatcctggcttttttcccagcctagaagggaaagcccaccacgaaggggaaaaatccccagactacccaaaagttcattttgcaaggtccgggaaggtaagtttcctggctgaatacccccaaatcataaggaaattcatccatgatcctacctcgtagaacgaatcccacacgccgccatctcctctatacgatgcgaacgccgccacctcctcttgcagcgaatgctgcctcctctcaccccatccaccggagctgccgcctctagatgcatcagccggcggtgcttcccttcctccctggtgctgtcgccgcctccctttttt

SEQ ID NO: 39111 - DNA, 25795 bp, Oryza sativa
  unsure (1)..(25795): unsure at all n locations
tagttatagaactccaagttgttagttcattgttttcacttgcaatgagatgctattattcataccttttgaatatggttttctgatggcaagcagcgcatgtaattcaaaatgtgaaatttcatccccagtattgctctttggattgtagaataattcagattcagaattatcgtactgttctttactccatgtccaaatactctgctcagaccatgtttcaggctatggctgcacacgcagatgaagcattttgtactaatcactgaccaaaattcctcctaaaatttgcacattggatgaagcttaagattttcgtggcacgcttttcaaactgctaaacggtgcgtttcatgcgaaaactttctatatgaaagttgcagtaaaatatcatattaatctatttttcaagtttataataattaaaacccaatcaatcgtatgtaaataccacatcattttacgtaaaaaacttaatcttcatcttcttctttttcttcttcatctttagaagaaaaaaacaccaatgtagttttgcagcaaatctgacgagttaaagctctgaatcctaaaaaaatccccaaaaaacactctctgtatctgaagagtgaaatatctgaatatgtagatgtaaagtcatatatgcagcagttaagcacgtagaatagcagtctaccagttgccaataaacaatttttttttcatgtaatgattggtgaacttatatcctgatgatgatattttaagttttaccttttttgacatctttgcaaggatcactcttttcctcactacattttttactactatcaatgggaggtattgtctaatgaggaaatcaattttatcttgtatacctctgaaattttagctaatcccttctatacctttgaattttgcttactttcttatatacctctaaaatttggttttgatcccttccatgcccctttcgtcagttgaccatctaatatccataagagtgaaatacatggccggtccttaaacttgttgtgtggtgtcacttaggtccgtgaacttaaaaattgcacgattaggtccgtaaacttggtttaatgtaccaccccagtccaatcgtcctttgactatatttgaccgccaacgtggcataccacgtaggcaacacttttattctcagcccctccacatataccttcgcacataacttaccctgaccagtgcatttcaacccaaatccccccaaatatccctaaatcggctagggttttgatggtgagtttagcggaaggaggccgagaggtagtggttgtggcagcctcggcggtgagattagcggtaggaggcagcgcagtgaaacggggttagcggtggcatagtgcggcgggaggcagcacagtgcagcgggaggtagtgcaatgcggcttgcacgctaggcatccccatggattctccaagctcgtcctcatcttgaagtcgctggaagaaggtgttgttgatcaagtacccgttgcataaggataagattattttggagtgcagagcaatgtcaattgctaatcgggaccacatcttctatacatgcaaggagaagaatgagagggaagaacaatttgagattttttcttgggattttggtgtcgctatatagctacaaggagatatatgtgacatgttgtgatgtggaggggcctaagagcaaaattgttgcctacgtggcatgccacgttggcggtcaaacgcagtcaaatgacatttggactagggtggtacattaaatcaagttcatggatctaaacctgcaattttcaagttcacggacctaagtgacactactacacaagtttagggaccggcaatgtattttactctttcgataaaaatgaccattttaacttttggatgaacacataaatttatgaattacataattgaaaatgtaaaagtttgtcgcatgagactattatagttatgagtttgttgtgcgatacattatttatgacaaaatttatttttatataataaaataaaaatatatatttatttttttaagaaaaaaatcataaaaatgaggagcattcatacaaagataggactaccaatgctcacgatattttctttatgaatgctcccaataaagaaaatctattgccctattaaaatttcaaataaaaattttaatttattacatttttatttatgtcaaaaatttctgcactaattatttagtctcattagtttcataaaatgcacgtactatgcattaaatttctgcactaattatttaatcttattattttaatcattttttaagcttatattcaaacctaaataatcaagggcataaaagacatttgcaaccaaacttaacagtgaaatgaaggaatcaagttgaaatttcagagatatagaagggatcaagaaaattacaggtatatgaaaggaattgagtgagttttaatgcttaggtcttgtgaactctgtgaaggatctgttgcattgtctagtgactagtggcatgtagttagtaaatttgattaaggtgcataagctactatggcactaatgagaattaattatgattcattattggatagtcactaagttattaaataaaattgtagaagaattacccacaatcaaaagttagcactatgccagaaccctacatctgtgacagcataccagtgacgggcctatgaattggtcacagatgactgtcacctttgacgggttgctaggtttgctgtcatcggtggggcatccggccacggcccgtcacaggtatcccctcacctgtgatgggccagaaggaaaagccgtcacaggtgaggaagtgacgggttttcctcccaacccgtcactcgtatcctctcacctgtgacgggccgtggaattatgagccgtcacaggtggtggtccgccacctgtgacggattttttttatggctcgtcacaggtaggtcaatacctttgacgggcaactcaattgaagcccatcaaaggtatgaccaacacctttgatgggcttttttaatctaacccgtttgaggtgtgttgggtctataaataccccacaaactgccaactgctttccatcccgaccagttcaatgttcacaaatcggttgggagggcaagggggggcgaatttttgctaaaattcaaggtaaaaaacacattattctccattcattctcaatatatcgatcatcatatatttttctttgtatgttgttgattttagatggatcgtagatggatgtactatgcgcatcgttcgtctaccgagtatagagagggggtcactgaatttgtcacatttgcggataatgacagaaaatgtaggatgcacatgttgtgtccatgtagggactgtaagaatgaacagatgatcgttgatagcgatgaagtgcatgctcatttgataatgaatggattcatgaagaaatatacctgctgaaccaagcatggagagcaagaggcgcctgatgtcgcagctgaagaagtgttggatcaggatgtagagaacaccgccgcagctcgagaaggcatgttcgtaccttctcctttaggtggagagaccatagatttggacactcaatgtctatctacaatgttgcatgacaatgaagacgcagaggacaacgacagagattttgagaagtttagtaagttagtggaagattgtcagatgcccttgtatgatggatgcaagtcgaagtacagcaagttgtcatgcatgctggaactcatgaagcttaaggctagtaatggctagtcggacaagagttttacagaacttcttgagctgtttaaggacctgttgccagaggggaacaatttaccatagacgacatatgaagcgaagtaagtattatgtccgttgggcctggaggtcagaagaattcatgcatgtccaaacgactgcattttgtattacaaggaatacgctgacttggatgtctgccctgtctgtggggcatcaagatacaaacgagcaaagagtgaaggtgaaggaagtaagtcaaagaggggaggccccgcaaaggtggtgtggtatctcccaattgcggagcgcatgaagagaatgtttgcgaataaggaacaagctaagctagtgcgctggcatgccgaagaacggaaagtcgatagtatgctgaggcacccagcagattcagtacagtggaggacaatcgataggatttaccaggaattctcaaatgacccaagaaacatgcgtttcgcaatgtgtacggacggcattaatccatttggtgatttgagtagtcgtcacagtacatggctagttctgcttgttaactataacctttctccctggttgtgcttcaaaagaaagtatattatgcttgccatgctcattcaaggaccgagacaacctggcaacgatatcgacgtgttccttgaactaataatcgatgacttcgaaaggctatgtaatgagggcacacgaacataggacgcatatgcacaagagtatttcaacctctatgcgatgttgttttgtaccatcaacgattatccggcccttggcaacctttctagctaaactgtgaaagggaaatggacgtgttcgtgagtgtatggaggaaacaagaagcaaatggtgtctacatgggtcacaggagatttctcccaaggtatcacccgtataggaatatgagaaagaatttcaatggacacaaagatacagccggacccccagcagagctaacagggatagaggtgcacaacttagtgatgggaataaccaacgagtttggaaaaaaagagaaaagttggaaagtcaaaagagaagagcatgtcaaaggaaaaaacagaggagcatgtggaaaaacaaaagacaaaagagatgagcatgtggaaaaagaagtcaatattttggagactaccataatggaaggatcttgaagttcgccactgcatagatttgatgcatgtcgagaaaaatgtatgcgagagtttaatgggattactgcttaacccagctactacaaaggatggtctcaacgcctgacgagatctggaagaaatgggtgttcgctcggaactacatcccataaccacggaatccggcagggtttacattcctccagcctgctacactctctcgaaagaagagaagattgatttgctaacatgtttgagtggtataaaggttccatctggttactcatcaagaatcagtaggctcgtttcactgcaagatcttaagttggtaggaatgaagtcgcatgattgccacgttcttatcacacagctgttgcccgttgcaataaggaatacttttcctcctaaggtgcgacacacgatccagcggttgtgttccttcttccatgcaatcggccagaagatcattgatcccgagggactagatgaactacaggctgaacttgtgagaaccctatgtcatcttgagatgtactttcctccaactttctttgacataatggaacatattcccgtgcaccttgtgaggcaaacaaagtgttgtggtccagcattcatgacgcagatgtatccttgcgaaaggtacctggggatccttaagggttatgtacgtaaccgttcacaccccgaggggagtatcatcgagagttacaccaccgaagaggtcatcgatttttgtgtggactacatgtcagaaacatcttcaattggattaccacgatctcatcacgaagggaggcttgatggtgttggtactgttggaagaaagactgttaggttggatcggaaggtgtacgataaagctcatttcacggtactgcagcatatgactgaggtggtgccgtacgttgacgaacaccttgcagttctccgacaggagaacccaggccgatcagagagttgggtcagaaataagcacatgtcttctttcaacgagtggctgaagaaccgaattgccaggttgcagaacctttctagtgaaacacttcagtggttatcacagggtcctgaatggagtgccaccacttggcaaggatatgacataaatggatacacctttcacacggtaaagcaaaacagcaaatgcacagtgcagaacagtgggttacgcatcgaggctgctagtgacggtggttggcgtgatcaatactatggtagagttgagcaaatattggagctagattacttgaagttcaaagtcccgttgtttcgttgtcaatgggtcgatctttgcaatgtaaaagttgacaatgaaggtttcaccactgtcaacttagctaacaacgcgtacaaggatgaaccgttcgttctcgcccaacaagttgttcaagtgttctacatagttgacccgtgtaacaagaaactacatgttgttcgtgaagggaaaaggagaattgttggattggacaatattgcagactaggatgattacaaccagcacgtccacagcataggtcaagaaatacctctagaagatgaggaagaagaagatggcgttcaatatgcacgcgtcaaccatgaggaaggattatttttgtaatttatgtacgtagtttatgtctacatgtctgttatctatatgactctaatatgttcgcaatgatcaatagtatattgcttatgaaatagtcaaataaaataattaagtgaagcacccactagaagtgaaataaaataattaagcaagtataaccatcggaacaaaaataaaataaaaatgtagtgtatgtggaaatatgttaaggaaaataaaagaactaagtgaaatagaataaaattaaataaaatattgtagtccatgtagtcaaactcacctgtcacaggctctaactgtgaggccgtcacaggtgcccagaacgctgggcccgtcacaggtggcctcagctgtgacgaacccgctctttgcgcccgtcacaggtgacctcacttgtgacggccccacagttggcgcccatcacaagtgagtttgactagggttacctagggttggacctcttctagatccagatccggccactctctcactctgactcactctctcgaccgccacctcgaccgccgacgctgctcgccctcgccgcctcgccctctgaggccttctttgcaccggcgccgactcgtcctgtgcgacgccatctatgtcgacctctacgccttcctcttcaccgtcgcccctcgtactcttcgccgtccatccatcgacttccccgacctccccgaccccgacctccccgacaccgggatccacgatgccgtccacctccacctacacgacgccgggaccccgaccactgccgccctctccgtcgccatctccaccaccactgccgcctagacctctccaccgccgcccactctgccaccatctccaccaccgccctcgtgtgtttgccgccgtccgtccatcaccggccccgacctccccgaccccaacctccccgacgcctggattgacgacatcggcttgcaccgccgaccgcctcgaccttttcgccgctgcctctccgccctcgtcttcgccgccgccgggatccaggacgcctacggcctgcgccgccttctccaagtacgccaccaccctccccccttcctccttttttcgatggatgaattgcattgtttagatgaatgaaatgtgatttgttgtttcgattgttggtgctgctgtgtagatgaattaaatgtgatttgttgtctgtagatgttttggatgaatgtaggggctagattttggatgaatgcaatattagaggaattattctattggtattagaggatcttagcatgaattttgctgcagtggatgttcttttctttatggataagaacagattatctacacttgttgatttatatacccttgttatctatgaataggtgaattgcatgaattattgtttatatacatgatttatatacccttgctgtctatgaataggtgatttgcatgaattgttgtttatatacatgatttatatacccttgctgtctatgaataagtgaattgcatgaattgttgtttatatacatgatttatatacccttgctgctgctgttttagaaattattgtgggctgttttattatctacacttgcccctgcttgataaattaattgtgggctgtttaagaaattattgccatgggtatgataattttttttgatgccttgctgtctatgtttgcccatgctgctgcctatggttgccttatattaaatagccagtgatgaatgctcaagaacagaaatacctctaaacttgttctttttttaatgcataagaacagattatctacacttgttctttttttttatgtacacttattcttttttgatgaattgctgttgctgctgctacccctgctgcccctgtgccccttattcatttttttatgcatagattatctacacttgttctttttttaatgcataagaacagattatctacacttgttctttttttatgcataagaattgcccctgaatgcctgattttgatgaattttgatgattgttataaaatgaattgatgctgctgctgctgctgctgctcttatagaatgagtgttctttttaatgcataagaacatattatctacacttgttcttttttttatgtacacttgttcttttttctggattgataagaggagactatctacacttggttcttttttacgctttactttgggttgcttttccctcctattagctgatttcctcttctttttcccttcatgcaaatgatggtaattgatgcataatttctgagcaaaactgaggccatatgtttcatagtataccccgtattacattggttctaatgttatttagtataatggtaggaaatttataagctttttggggaaaattagaccatgacaacgcccggcgcaaacccgccctccccaacacctgcaaggatacaggaaaagcaaacccagccacggagacagttgccgaaagtcatccctcgacaacggcggtcgaacaatccaaaattcatgataatttataggataatttttcaccatatgaccacaaaattttagctagcaccccttagcatatgttgccttctgtctgcgctgcagaatcgccccaggaataacatacgtcgatgtcggacgggacaagtgcaagtaggtcgagtagaaatccccggtcacaaaatatatggccgaccacattgcaagttataagagaggttgacgctagtggtaggcccacggcgccgaggactgtcattggaagatggtctaactgctgcgggctggcggcacgtgagaatttcgggatcctccataaagatatcgacaaggtcacaaaagccgagaaagagcgagcttggacggcaatggagaaatggttcacatttccggctaaagcaaaggataggctcaagcggaaggcattccataagatgggcaaagcttggaagaattggaagtcgaagcttttcaccgagtttgtcaacctgcccggcaatcatacgccgttcgatgaataccctcaaataaccgaagcagtgtgggaggaattctgctctctcaagaacacccaagagtttagggaatcaagcgaggcacatcgcctactgcagcagcggaatgagcacccgcatcggctgggcaccgcagggtacatcggcaagaaggcaatatgggcccaagaagatgcagccgctgcagcagcaaatgtccctaccccgttttcagacatccctgaacaaagagctcgcaactgtgcgcgggaaggggtaaggtcaacccagacggctctgtcacatttgagaacaaaagtgatgccgtcgtctatcaggaactggtgagttcactacttaacctaactaatttccgttcgtataaagtagaagttcgtataaacgactcttttttttctagttgggcttggttgctgaacaagcttcacaaagcgaggttgagtccgcgccgaagaggcgcgaagatgacatcctcacaaaggggctcggaaccaaagaacatcctggccggactaggggaattggtagcgatgtgccctggaagcatggactcccgcagtacagctcccaatacaggaaacggaaagtctccaaggaagaaagggacgctcgtttgaaggccgaacttaaggttgaggtcattcaagaactagaagctagcatgaacgctagggtggaagaaaggtttaacaaggtcctcgccaacatgaatataccccgaggcacaacacctgctgtgcatccaactcctcgtgcacaacacgacgcgagtccgtcacagcataggagtagttgtgcatccacagaggtgccggcccctggtctcccggtcgcaccactagctgcagtggaccacatagaggtaattgatgttatccgatctatatctaataaaaaacctttacacgttccaatattaaattcaaactttcacatgtgcagggcgtagcacagtgtgtcctactggcgagggtccacccaactttcgctcccgaagtcgctgagggcatggctttcaagccctcggttacagacaaggtccactgcgcatacctgctagctgggtatgccaaggtgtccaacgatacagtaaaggacacctggtcaggctatccgctgcccgtgccccccaatgatgaaatcatgactttgggcgatgcgcgcaagacgttcatacaatggcccaaagaagacatagttgtgaagatgactcctcgtccaagtcgaccgacggagcttacacctcccaagtctaagctatcaattgaggctccccgtggaccggcattgtcagtacctcattctcctgatggagctaatatggacttggcagatatagctcaaagcttggctctaataaagaccacaagaaaggctgatagctccccgccacttatcaagggccagaagcgtgaacgcggcaaggggaaggtcgggaagttggcaccggagccaaaaaggggcaaggctgtgacgtcgatgccggtgagcaaagcggggaaggtcgtgagggcgccggcccaatttgagctaggcatgctattggtggaggacaatgtgttagccgtgatgggtattgcttgccgagagctacataagcaatacatgaagctaagcaatgccaagcaaaaaatgagggtcatccatagttggacatcacgaccaccaaccgttcctatcatcgcctgcctatataactataggctttgatgacctcttcgacctttttaggatccggaagttggacactggtcttctaaaatgctactccttgtaagtgcataccttctatacttgtgatatgattggactatatctcctaattaaattagttctaatatgtaaatgttttaaggttgtgttggatcgagagtcgtcgccttggtaatcaggttgggttccttgatccatccatggtgaacgaggttaatttacgacagagcttcactgaggtggttgactatgtcaaccggtgtttatgggcccatcaagacaaggagtacatcatgtgcgcacacaaccaagagtaagaggacaatacccttcgtgtatattgtttttgaagttaaggttcttagtactaacgctacataaccactgcgcaggcgacattggattctcctagtcatcgtacctaagtggagtagggttacctaccttaactccaataagtccaaagattatgatttcactgaaatcaccaaggccttaaatatggcttggggcccatatgtggaaaagggtggtaggcacaaggagggcaaggacgaactttatcatgacaccaagttcgcatgcgcacaacagatcgaagaccaatgtggtttccacgtgtgccacaacatgtcaacacttctaagagaggtgaaagatttcgaccctgaggttgttgctaatggcgaataagctcatttcaataccaacattgctattcaaaacgtgctaacctcttatttattaaacagaaaggtagaactggcttcaagatctcacccatcaaccccccccccccgctatcagaggcgaagtgtgcgccttcattcttgcagaaataatgaacaagaaaggacgttttcacgtcaaatagactcatgaatttggctagataatttattgtgacgtaaaaaagatgtttttataatttcttgtgatgtaaaaaaatatgtttttatcgagtgcaatgtaatttactttcatatgtgcaatatttatggtagtttactaaattgtcatcaaatttaatcaactacgatttacgttatactattcatttattttctcctttttttttcttattgacaggtcgtggaggtcgaggacattatgactttaatccatttggtaagtatatatgcggttctatgagcaatgaccgaaattgtggctttcaagaggtgtgaatttgctgtgcaaaattgtggcatttgaactgcatatgtgaatgatgtcaatttttgatatggatctgtgttgttggggatctgtgatatttgagatggatctgtgatgttatattggaggggtgactcgaatatatctgtgatgtatctgtgtttcagagggcatggctagcaaatcctgaggctagccaatattgagcatttattttttttctggaattaactcatcagtgacgggttggaacaaaaatccgtcaaaggtaaactcacctgtgacggactagcaaataaaggcctgtcagaggtgacctacctgtgatgggcctttacttttgaggccgtcacaggtagatcacttgtcacagcttctatctacggagaccatcacctctgacggcctttatttaaagggccgtcagagatgagtcacctgtgacgggtcccaactcgccctaggctagcggagaccaacacctctgacagccttctagtaacttgcccgtcagaggtgggtgtcacctgtgacggccggccacccgtcaaaggtgggtgtcacctgtgacggtcggccacccgtcaaaggtgactggactcatcagtgaccactgatcactgaccatgcgcgaagccgccaaagatgagggtttgggcccgtcacaggtgaccttggccagtgtagtgtagattagatggggctggtcatgggctgaagattagatgaaatattcctttttgtgactatcaacatgcatgcagttagctgattattaatgaagagttaactgccatgatgcctggaatttttagaagtgcattttcaggtgcctgtcatgcttttgacacaaatgaatacattgactttgccatattcttttggtgtgcagttttctgatatgtgatgtctacgggccttttgtttgctgcaccaaggatgcaaggaaacgtcttgtgttatacctgggaaagtgttgttactatatactccctcaattccaaattgatctctatatattttataggtacaccaaaaccaagaaaagctaataactctctcatactatatttactctagcaacaaactctatgcatgcaccatccccactatttcctagctaatagcaaatcaagatattgcatgtgggttataaatacttgtgtgcatggatgcatgcatcaatgtccatttactccaatgcacaaataacgaatatacttaatgaatgaacacaaatatatagatcatttagcaataacctaaaaaaactatatgtagatcaatttggaatggaggaagtagaactcttaaggaaaccaagctcaaattaatattaatgatttagctttagttaacatagttttatcttgttcaatttaatacttgttattgtgagagacatgtgcgtgttctaaactcaatgtgcattggcttctaatgttggttgcctgttctttttccaatactgtaacaattatgacatggattttgtagctggtcttcagtatcatttttaattttccaaaattttcatagttttctaggcttttttatgtatttttatgcattttcctgaaaattcagatttttgttgtgcagtatttcgaaatttctacgtgatatttgaattttttttaatgaaattataaaactgaagtgatatctcacggctcactattattgaaacacaccaatacacaaagatcccatggtggaggggattgacgaggggattgagtgttgggaggggatccacccaagtggtgtacgttttccctaggaaaaaaatcctccccacatacttatcaaacaaggtctccctagtagtgttttccctggaaaaatcctccccatataccgaacaaggtctcaatgagtgtttttgactaggaaggctttaccatcccggtccttgtaaatttatgagctgagattacaacagtttgcgtatctgttcatctagagctattcaatctcgtgtttctgactaggaagactttcccatcctgatccttgtaaatttatgagctgaaattacaatagattgaatatctcatcatctagaactattcagtctctagacgaactttatttagccttatcgatctgttactattaaatggtgacctctctctctagtggagtaaaggattgggggtctttgatattgctccgtatggctacgctgcaacctgcagttgcgttataaatacgttaattaacttgcaaccagcagtttaccaaacaaatataaacgttttcttttttgacaaaatatatataaacgtatttgcggcatcaaccgcagcatcattttctatggctggctactgtggctacagcgctgcactattgcagcacggccacagccagtgctctaacgagcaggtccattcgttacttcgataattaagctaatagatggggtaatcattatcataaaatccaaaaatgttgctatcaaaacaatttggctcatatatctcgctatttgaccgcctctttgttacttcatccgtttcacaatgtaagtcattctagcattttccacatttatattgatgctaacgaatttgtctagattcattaaagattcattagcattaatatgaatgtggaaaatactataatgacttacattgtgaaacggagggagtagaaccatagccacattgcccccatccttcccaaaatagtttgtggcagtggatcgacacttccatttttttcatctttcgtagtggattggacaccggaccgaccggtactacgtactctctggtttgtaatactttctccactccatttcatattataagatatctttatttttttaagtctattttttaagtttaatatatttatatagaaatatagcaatatctgtaacaccaaaatagtatcactaaatataattttgagaatattttatattgtatttgttttatattaaaaatgttgttacgttttcatacaaacttgattagaattacataagtttgatttaggaaatactaataacccttataatataaaacggaggagcactggtcggcttaaatatacaccaatatcttacattttagatggaggtaatataatttattttgtttggacttggtaaaacattagagtaacactttttcatatttaaatgaaataaaacatttaaatatatgtccaaagaacaacagcgtaatctattaaaaaaattaggggtgggtagatatgttatacacactctttttggcttcacacacacactcggacacacatctccaatcttgagcacacagccacacacacacacaccatatcgctcaagttccaatggaggtacaggaactagtaccgtcgccatggtcgtcgtcctcgtccttcctagtgctcgtgctggccaccttgctcttcgtcgccgccttcctccggcggcgacagggagcgcggcgcaagtacaacatcccgccggggcctcgcccatggccggtgatcggcaacctgaacctgatcggcgccctcccgtaccgctccatccgcgacctctcccggcggtacggcccgctcatgtccctccggttcggctccttccccgtcgtcgtgggctcgtcggtggacatggccaggtacttcctgagggccaacgacctggcgttcctggaccggccgaggacggccgccggcaggtacaccgtgtacaactacgccggcgtgctgtggtcgcactacggcgagtactggcgccaggcgcgccggctgtgggtcacggagctcctcagcgcgcggaggctggcgtcgacggagcacgtccgtgccgaggaggtgcgcgccatgctgcgcggcctgagccgccgcgcgggcgccggcaccgccgtggtgctcaaggagcacatgctcatggtgacgctcaacgtcatctcgcgcatggtgttcgggaagaagtacatcgtcgaggagggggagggttcgtcgccgacgacggcggaggagttcaggttagggttttaaatctccagctatagctgccgttatcttcggctataataagtttgagaagggctctagctattaatttgctctcatttataacttagccgctatatatagctccatttagcctggtcggtattgctgctgctataaactatttgagaagactaactgctaaatatcttagcccgttattcaaaacgttggttggttcaggtggatgatcgaggagatcttcttcctcaacggcgtgttcaacatcggcgacatggtcccgtggctggggtggctggacccgcaggggtacatcgggaggatgaagaggctgggcggcatgttcgaccggttcctggagcacatcctggacgagcacgtcgagcggcggcggcgagagggcgacgggttcgccgccagggacatggtcgacctgctgctgcagttcgccgacgatcccagcctcaaggttcccatccagcgggatggcgtcaaagcattcattctggtataactacttgtttcattattaaatatacttgacgttttatatatacttttatatatcaaaaacagaggaagtctatgctacaacatactgtttcaattcatccaagagaataaagcatatgcagtttttttttaaaaaaagatattaagattgtggttagaaatggttgcgtggttggttgagataggaagatgacggagaaattaaattaggagaggttatggttgattaagatgggagtatgtgctagtaaaagctttgtaagcatcttgaaaaaaaaataggtgaaaccccgcacattgctgcgagaatttactatgataacaataaaaaaataacttgtaagatagctagataacatcagattaagtaaattaatgtggtttataataatttaaatttaaatagtatgtagaatggtgattcaaacgtaaaaagtaaggttgtatgactttatggaagaagaaaaatagagagatagtttggacgtagattaatcatctaaaggttaaaaataattgatgtgatttgacttaattagaaaaaaaaagagaaagataatttgtaccatagattaatcatttaagcactaactaagtgagaatgaactatataagtatataggatatcattaaacataataaagatatacattgaaacattatgtgaattatgctggatgataatttaatatgtttgtatttgaaaagctcttaaattataaaaactataaagatatagcaagtttacatgatgtttaaatgtgatgattgttagtggatgatgatgtggcatcttgttaattagtggatgatgatgtgacatcttgtttagtgaatgatgatgtagcatctttgcatgttaagtttaaggagttagtgggggataactttatagtaagataggatttaaaactccaaatgttctaataaaagcgctagtaaaagcattgtaagcatctgaacatacttacatcgaccattaacaaaactattgaatactccgcgtgtttgtagcaagaaatttacaaaaatgttttggacagctcgtagaaaaaaattttgaaaatcacagtaaaaaaccaatttataactcatatattctttttttgacggtctaaccatcaaatgtaactataatatatttatagtgtaattatattataactaatatataatcataaatgtaatttagatgtaaattatatgtaactataaaaaacaagttagctcgctgatagtgatgggtgcctacgactaaaagatcacggattcgagtcttggcgcgtgtaagtggtttttgtttctcttgtcacatgcaggaatctcagctactccgttctttttgaagcagaataaaatcatgaatttatatgttaattaatgtggattgcacgatagtatttgtcatcttgtaaataatagtacatggattgttgtgatatccaaattaatgatgcgtggcggctgcaggagctgatcacgggcagcacggacacaacatcggtgtcggtggagtgggccatgtcggaggtcctgaggaatccgtccgtcctcgccagggccaccgacgagctggaccgcgtggtcggccgccgccgccttgtcgccgagggcgacatccccaacctcccctacctcgacgccgtcgtcaaggagagcatgcggctccaccccgtcgtgccgctcctcgtcccgcgcgtctcccgcgaggacgccttctccgtctccgtcgccggcgccgccgctagctacgacatcccggcgggcacccgcgtgctcgtcaacgtgtgggccatcgggcgcgacccggcggtgtggggggacgacgcggaggagttccggccggagcggttcgccgccggcggggagcgcggcggcgtggacgtgaaggggcaggacttcgagctgctgccgtttgggtcggggcggcggatgtgcccggggttcggactggggttgaagatggtgcagctgacgctggcgaatctgctgcacggcttcgcgtggaggctccccggcggcgcggcggcggaggagctgagcatggaggagaagttcgggatatccgtctcccggttggtccagctcaaggccattcccgagcccaagctcccggcacatctctatgatgaataattcatgcactgacgggccgcatgcatgtatgctcgtatgtgcgctctctctctctctctctgagttcatagttatattttactgcagagtacttgtttatttatcgatctacacgcagatgataaacggagtacagtataatgaaaaaaagtttttctttttttttactgtacctttagatggtcctgggtcgtctactagttcagatccaaagaccagcgatataatttgttttttttaaacagtagacggtaggagatctaccggatatattagaagaagagagttgatcctgtttattaggaaaatcaggtcaaaaaccatacaactgtacagcttactaaaaggaaaccggcaaaaaaccttacacaaaagacacgaaaagcatgcgataaaactacaaaccacagtagtgaccgaggggagagcaataccttcaaggcgaagcctccaaggaggtgaacaacgacataagccactgtcgactcccgcccaaagaactaggctgggttttcacccaaagggagagagagtccacaaggcaacacctccaagaaggaaacggcgcccgcaggcatcgatgtcgccgatcctggaagaccagacaaggctttcgcttaagattccctcaaaggtgtagagcctataagaaaccagagtcaaagtgttaagtgttatcgttgcccagctcatcggctagacccgatgcagcaactccgactccgtcttaacacagaaactctagcattgtagagggcaagcaccccactcaaaactcggcactacgacaggttcatacagacacaggacacttaaagcatcggcgagacccaaaagccttgactacagacacactggaccccaaacacggacaaacacttctcctcaataaccgaaaggctccacgaccgggtctggagacggccaaaagaagagaggagcaccaaggagtgaaggagtcgtggccggcatgaaaaggaactgagagctgaagtcaggggcaacaaagaccactgtgtcttccatgattccggcaaggaactccggctatcgcgggacaatccttacgactgcagcaaccaccaccaacttcaccgccagcgcagagaaaggtacaccagggcgagcagaagagcaactaagaagaagcgatggtgagaggaagggaggaagggatgtggggtggggggaggaaggaaatgaggggcctcagcagctgccggcgatggccggaggaacagagaggaaaagagaaaggaggaagaaagcaaggaagaagaaacgggtggttgcagggacggcttccgcagttgccagcgacagggggggtggccggacgccaaactcgccaacccggagccgactgatgccgcgctgccacgcgggcactggcaatccgccgcccacgctccggcgcccgcacggccgagcatgaccgccacctcgtgagcagacttgcgcgacgatccggccgcctcgcaagtcgccagacgccgcagcagccgccgccagccgggccaccttcgctttacgccggcccacgacaccgccaccgacgcaccgtctagatccggcgacggcgtctagctgggatcccttgccgccgccactccccaccgccggcgaaaactccacctcccccatgcctgagaggggaaaccaccgcggtggagaagtaaattaggaaacaaattgcatgtcatttaataggtaaaatttgttggacaaacgagactaaatcagtcgattaggaggcacttgacgaggcggcggttagaagggacgatgcatcggcggttctgcgtaattcagatgaaggcgacgaccgtagtaataacattaaaggtttgcaacctcgccagcgcagggcaggctggaacaaggccattctactcgactgctcgtccttgccacactagtacagatccttctatctgtgacgggctctaatatgcttagaaatagcgggccgtcacaaggaagtcatctcaatcgggccgaaaagtgcccgattgagatatggtcgcacagacatgttagatgggtataaaacttaagcccgtcacggatgatacctatcagtgacgggccacaactttaggcccgattgagataacatcccatatctgaaacgatgactaagttgtggcccgccacatactgaattcctatgtgacgggcactaaagcccggccccgatgacttttcattccttattcatatgaaatgtttatatttgtaagttgactatagcaaaataattttacgggtagtaaatgatttcaaatggaaaaaatgtcaacaacaaagttgtataacttatcaatatttacaacttttagtttggtcatttttcaatataacatttttttgaacagtttgaatttgaatttaaaaatatgacaacttcaaacaacattttcaaatactaaatgatttcaatggaaaaagtcatcaacaacaaagttgaataactcatcaagatctaaaacttttatttttgttatttcttcatctgacgaaatgttattaatattattcacaaattttacatatatgtgttatagtttataaaaccagataagagatatgtcaattttataaacaatgttactatcactttgtcgtatgaagaaatgaccaaaataaaagttttagatcttgatgagttattcaactttgttgttgataactttttcagttgatatcatttagtatttgaaaatattgtttgaagttgttatattttcaaattcaaattcaaacggttcaaaaaatgttatatagaaaaatgaccaaaataaaagttatagattttgatgagttatacaactttgttgttgatgactttttcagttgaagtcgttcactgatctaaaattctatttgaactttttaaactttgaatttcaaatttaaaattgtttaaatagagtcagatggagaaatgaccaaaataaaaattttgcacctcgatgagttctacaactttggttttggtgacttttccatttgaaatcatttagtaaccccaatttgacatcctggcctagggcataataggattaatagaatactcataccaacatgttacaattacttttccagaagccaatctctaaagaattttgacgttaagtatgcttggtctggagcaattttgggatgggtgaccgaccgggaaatttgaaagcgtgggtgcacacgagtgagggctagccaaaaaatgaaatttatttaattttggaatatactcatctgtgatgggcattactcaaatttgaacttcctgcgtgggtgcacacgagtgagggctagccaaaaaatgaaatttatttatttttggaatatactcatctgtgatgggcattactctagcataagttaatgtaatgcccgtcacagatgattaatgcccgtcacagataagggtcatctgtataagggtcatctgtgacgggcgctagttgtggcccgattaagataggtcatctgtgacgggctatagtttgactggtcgtctgggtcaaaactatcggtgacgggctttacttatggcccgattgagatagaatcatgcgtgacggccgtttgcccgattgagatagctcttcacatcagtgacttctagcatgtgacggacgccatgcccgattgagatgggacttaccgcccgattaagatgagggtatccgttctagtgcctgctccaaaaatcccgcgttagccgttgcttagcactaggatgggcgcctgcgattggcggcgcggtaggaggggtggtgccgccatgcccgtgctcgcgcgaggggaaggagaccgatggcagatgatggccaagagcacgagattgtggcggtggccggccgtcctcctgcatcgtcaaatcatgatggattgttattggacctgcaaactcagcccgtttggtccatcatgaataagttcactttgactccattactctgaaccgcaaaactagatatcttatctctaaactgttaaaaccggtgcaatttgattccctcgacgattttaacgtggcatgttaaaaaaatcaaacttataatatgaaataaatagtcccatgaaaaaaaattagcagcccactcccaataacaaccagcaacccatagttctaagaagaaaagaaaaaaaataaaaatagcagaaaagcaaaataaaaataaaaaggggcaggcgaagagaggaaagagaagacgaaggagaagggagatcctcttcccgctctattcccttcccttcccttccttgccgacccccgtaatattcccttctcctcctcctcccgcttgctttcctttcccctcactctctctagctcgctcgctcccaccacctttctttgctttctttgaccaccaccattgtccccctccgctccacatgctgtggcgggcgctgtggtggtggcggcggtgggtccccgtcgcgggcgcggtggcgtggttgttggcggcggcggtgcggccggcgggcgcggcgtggtgcatcgcgaggagcggggcggcggagaggacggtgcaggcggcgctggactacgcgtgcggccccgcggggggagccgactgcgccccgatccaggccagcggcctctgctacctccccaacaccctcgccgcccacgcctcctacgccttcaactccgtcttccagcgcgcccgcgccgcccccggcgcctgcgacttcgccggcaccgccaccatcaccctcaccgaccccagtcagtagtcctctcatctcctctaatcatccaccgccatgaaatccatccatgattactgtagtatcatcggttcattgtcctgcgtatccatccatctctgcttctcttttgcttttgctttttttgttttttgcttggtctccgagtatgtctgtctcttttgcttttttcctgcttcggtattaccattgccacactatactagtgctgctttggtagtagctgcttttcttttctgaagctttggtgttgtttcttgcaacgtctttgccgggttcgtacgattcatatccatctttctttctctagtttcctgtttgctaacttttctttctgttttctagtacgtaatcatgtgataaaccgataaagacaagcaatgtcagtcagcatctttttttgaaaaaacttttcgattgtttcttgtgtgctatctttgccttcccgctggtgataatcctgtagtatatcttcctttaatcttattgttgtagtgattaatcaggatctatctaagctaataatgctcactgccagtgccacaagagcatggatttcccttttcctgtttgttagttgttacattcattgcgcaatctgcaaattattctttgagaaagnagaagggaatgctttcaactccagttcaaatgaattcaactcaggccaatattattttcactattatttatgctccacaaaatcgatgactaactgtagatgagtccatgttataaacctgacataatgaagtgaagtggcagaacatacttaacatggctaatgtaaatctaatgacactactgcaaacacccgaacagaacaaaactgtattagggccatccatgtctattctaagctctttgtatttatgttaaaaatgatttttttcccttggggtaaatttggtgagacgtaaagaagtcagttcaagataccacttaatacttgatttgggggagaaaaaagtatgcatgactcttgtgctagttagaaccattgaggtggcagcctttctactattggtgttaacatgttgattgattggcttaaatgatgtttcctgacggagaatttcagataacgtattttctacaaaacaaaataccttcatcatgcaagtgcaacaggtgaatttatttatagccatcccaatttatcttcaatcctctttcgaagtgaaaaattgaataaaacacaccataattatacagtcagaaacgagtgatctacatggacatttttgtgattgtacatgcactcaaggtaagtttgtggtatgtatgtcttcaacaaaaacattcttaaggttctaagttctagacgttgattgctacctagcaccttctatatttctagcctacatgtttacatgcaattggcaatgtaacaaatgagttggatctgtaatggaagtattggaatcggaaataggtcttgaaattctcatatctaagttccctttcttctgatatagacatgtccttagtttttcctttttgtttctcttttagttttcttagtgcattgaggttgctttatattacatctactgtgtgcatccaatcatccatgctttcttgttatcttcttgagatctctcaaggtgcatactattttaactctgtgtgtacttctctctgtttttttttttttttttgcgaggtgaactgtgtgtacttactctgcttgttcctgtatttcaggctatggatcatgcacctacccagcatcaccaaggtacacgcatcacatattatcagtttattgatctgctccatatggagtacatctgctgaacgttcatctagaaatcacatctcatataaccaagcaaaatagtcttttagaagataaaattgagtaaaagcgcagcagcatacagagtgtctgagttgtatagatactagcttttagagctctctgatattcagttatttcacttcacagctattcttaactcccaccacaatggacagtgctcacttaattgcatgaattagacctgtacatcaaaataataatgccagttggtgtaactaatgggatttgaaagtaaacaccttttgt

SEQ ID NO: 39112 - DNA, 3359 bp, Oryza sativa
  unsure (1)..(3359): unsure at all n locations
ttctattttttttagttttaaaagtcacaccggttgctaccccttacttctgtcatattattctttatttgcttgcttgatctaccactagtttctatttattctccttggaacctttaaaaattggatcgaaaaacttataggtttagagtttattatcctgttcggcatcttttttataatttctagaagtcccgtcgaacactgccattatactcatctacgaccgtccactgcatcttctatttattgtcattgctattttaaaaattgaacataattatcgtttaggttcattttttttactttctagaagtttcggcaaaacgtcagcaactttgtcactgtactcctttacggctcacctgctgccgcccttctttattgtcgttgagattttaaaatcaaacaggattatcattggggtttttttttatttttttagaagccctaacctttaaaaattggaccttatagtttttaagtttattatcttgttgggttttatctttttatatttttagaaatcccgtcaaacgctgccaccatactcctatatgacccgtccgccacatactctttattgttattaggaatctaaaagtcgaacataactatcattggaattcttttttttttactttctagaagacccaccaaccattggcgactttgccattgtactcctatacaacccgccgctgcctcttatttttattattattgagattttaaaaatcaaatatgactctcattggttttttttttactttctagaagtcgcgccacccgcctcgaccgattgcttcacgacctgtctgttgtaattccttttaatcgtcattacgattgtatttggtgttttattaatagtttttagatgtcccatcaaccgccaccactctgctcctctatagacctgttacttaattaatctcgtcatttgtttcatatggttttttcttttagtaatctttattttttatcaccaaatttagttatttataaattgtattcctagttgatatcttatttttctttttctcatttcagatttatattatttttcgtattgggttctttgatatttttatttttattttcagtttagttggtttaaaattgtattcctactttaactctctttntatttgcctaatttcagattatattttattttttattccgaatttagttaatctactattgggttcttatatggacccttatttcaatattggttatatttaattctaaattttagttaattttaaattatattcctacttgaactcatcttttcgactcttttttctaattttgaatttctttatttttattccgaattttaaattaatatggacccttcttccaatattccttatttttaattccgaatttcagttatttttaaattgtattcctacttggacttttcttttcttttttttttgctaatttcagattttattttatttttattccgaattttaattaatctcgtattaggttcctatatggactcttctttcaatacttattatttttccgaatttcagctatttttaaattgtattcctacttagactctttctttttgctacggattttatttcatttttatttcgaattttgattaatgttgtattgggttcctatatgaaaatttctttcaatattgcttacttttaattctgaattttagctatttttaaattatatttctacttggactcttcttttcttttttttttctttttctccgattaatgtagaaatttctagcccccacagcgaacgtggtgccttctttcaagggtgttttaataatataatagatagatagatgttagtgaggttagcttgttaggatacacactacagccagacaacatggtttaacctgagttagaattcttgttttgagtaactcgaggaatattgtccaagggattgactattgatcaatccatgtatactcaaaagcgaaggggggacaccacaaaatagatttctgattgaaacaccaagtattcacaatcaaatttgatgtttattcgcaaacagttgtgtgaactctgcaaactactacaacattacaaaggaagtttagtatgaagctgtagttcttttctagaaaagaacctctgttcatttttaaatgtatttttgcctatcttttgtaaaatggaaaagtattttacgaaattgtattagaaatggattcactttgtgtagccgtgcattttatttattaatcgatgttttgagaaaaataaactgcatttatttttctgaaaaaaaaacatgtgcattttagcccttaatcgaccgacacgacacacatataaataagtttttattattctactgtgctttggattcaccagaaatcgtaacattcaaacctgtaatgttgctcaatcgcattacaaagcagatcaacagaaattacgttactgatgactaaaccgtaagacagttgaatataacaaaaagaaatagtcagtctgctgatcaaggtgagatctctgttttttttttctgtgcagcactgcagggcagtcaggatcaaccggcggcataccatcaccgccggccgccgacggcggtggcctgagccccccggacctcggctccagcgacgactctggcgccgccgcccgatcccgcctcgccgccgcgccattccttccccggcttgctctgtcctgtctcctcgtgtacttgctgcacacgcagcggtggtgatgaagggtgagagatttatatagcattgcatacattgttgcacaaagcggaatttgtaagaaaaagaacaccacatttttgttgatgggagacttggagagtagtggctcgtgtcgtgggcgtacgtagctagccgttggtgagaacctgcccccgttcaagctgaaaggggggctagagtgagtggcaacttggatcatgttggattcatatattctcttttgtttgtcaatctgtttgttgtttgagttttaagatttttcgtttagttttctagttttgcttttgcttctagttgtctagttactccaaaatatcaaataattctattttttaagtgtataataattaaaactgaattaattttgcgctaatggcttatacttattttgcatgcccttacttaatcctcatattcatgggttgcaaacaccaccttaatgtgtgaaaccagcccaccacattgggccaattggcaggcaaattccttatttctcatgacccaaaaggacaatagatgtcaaataagattgtgtattttgttttctgttaaaatgatagtgtcaagggagcagcttagaatatgttcgccaaataggttaggaaat

SEQ ID NO: 39113 - DNA, 1367 bp, Oryza sativa
ctaggatctcagatatttccttgacatacaagtttagaatttaacccgagtccttttaaagatattctatctatacatggcaccccatacccagtcggactatacatgccgtgtaggtatggggtatccataaactccacagtagccccagagacctttacagccgacgaaacaatctcttctcgtagcacagaatgataatccgagtactccgacttcttctcccctgatctcccgagtaccaaaaatcaaagactgtgaaggtctaaaaatagaaaaaaccaggtgcatcgactagatgcacctaattaggtgtagcccccgactatgtgattagttaaaaaactaaacatatagtcaagatgcaaacaacatccaaccgagtggttttataaccgaatatcatacagcaaagaatatgcggcgttcaataaagcatccagccgaatgctttagctttaatatatcaaaaatggagatatgaagaggcctgagtgagaaacactctaaagatctataaatccacacatatgataagaatccgagtaaaaactcttaaaaagatccatcaaacgtggtataaatgtgataacataacaggtgatgagtctaaatagcctaggctatgactcacgccataatcaaaataagcatataacatgccgagtaaatgactgtattaaaaccagtcatctcaataaaacccaaacagcctttgcagcctaaaaaggtgtcacgcccggaaattcactagtaatttccgaacttatttgtgcataaaatcctcgtccaggaatcagccgaggtacacaaactgacaatttaatatacagattcatcaaattaactaaaacgataagtacttacttaagaggcacttagtcctcaccatgaagaaaactgcagcggaaaataaaatctagcgaagctccggctccactcccacaggcagctcaactggagtataagccaaacgtcttctccttctggatccttattcttcaactgaggttgattgattattgcaaggtgagcatatgacatactcagcaagccacacagcaaatatgcaagtgcacaaagataccaaaggatggcataatataggttcatttgcaaaagcagcatttagcaaaacttttaagagaagtaaaaacagtggagtgattaatcagaaattttaatcaacactgaacagcacacccatgctgcacaggcccaaccattctgaacaaccatacccggctgtacagatctaactccaacccaggagctaagcaaattattaccaggtattacatccataattattgtgagaggtgtgagactaatcacgaaaaacattgctcaacccggccataaccgcg

SEQ ID NO: 39114 - DNA, 1471 bp, Oryza sativa
ctattttggctgtgcacattattttgccgattgtgttttgtctaagtaaatattcatggtcgatgatggtatgccactggaggtagcatcccttggatgtggcggccgtggcatacatgcatacgaaattgatttgcagtacttagcagcgacaagaccatccttttatttctgaattgactatgcattatatatgttatttgcatagatggaagaaatgcaacgcattcggcggtccctgattgctaaagcagctggattagttgctgtaatgaatgcttacattctgtttattacaagaagagccatgcgacgtacccctaggatctcctatggcccattgtccgaaagggacatagctagacaatccaatcttagtttcatctatcatacagatgatacaaattacttaaatcagctcagaatgaagagagccccattttttcagttgtgtaacttgttacgagaaagagcgttgttgcgggacagtatacatagctcagtggaagaacaagttgccatgtttcttcttgttgtaggccacaaccacagatttagagctttgcaacccacttttaggaggtcaattgaaactatcagtagatacttcgctgaggtattattctctattggtgagctgcgaaatgagatgataaaaccaccctcatctgagcctcattcaaaaattacatccaatcgaagattcaacccttattttaaggtaaaaatttgtttgcagcgttttgactacaaaatatgttctttcaacaatcatgtcctaatatttctcactggtcattaggattgcattggtgcaatagatggaactcatgtgcttgctcgagttccatcaacaatatctgctgcctttaggggtaggaagaaagagaccacccagaatgtaatggctgcagtggactttgatcttagatttacatacgtacttgttgggtgggaaggatctgcacatgatgccctcatacttgcagatgccttggagagggatgatggtcttagtgtcccctcaggtaatagaagtgttaaaactaacgattaataaggattctcatttatctcatatgattattacactcatagcttttatctcttaggaaaatactatctcgttgatgctggatatgctgctagaccggggttccttccgccatattgtgggtgtcgataccatttgaaggagtatgatagaagaaactaccctcatgattcgagagagttgtttaatctaagacactcctctttaagggtcacgatcgagcgggcatttggcgcactcaaaaaccgcttcagaatactctataacaagcctttccatccatacaagacccaagtcaaattggtccttgcatgctgcatacttcataactggatacttcagtttgggatggatgaccatgtgccactagagagtgattggaactcagatagtgatgatgaggagtccgatgactta

SEQ ID NO: 39115 - DNA, 17004 bp, Oryza sativa
tatagcaacaggtgttaggactgacaagggtttcaaggaagttcaccttaaccaagttgctagatctttgtctgatcactatggaattgaaattagtagaacccaagtgtataaccatcttcgcaaatggcgtcaaaggtgggtgcgtatcactaggctcaaagaccttagtggggctctttgggatgatcagacctcaacgattatcctagaagaggagcactacatgggacatgtcaaggtttgtgtctaactatcacatacaaaacacactgcattagtacacatcatatctcactttaaatctaatgttctcatataggaacaccctaaggatgctgagtttctcaatgtgcctttagagaactatacacaaatggcaataattttttcaaataggcaagccactgggagatttgctatggggttaaatgaagcacttggaaaccctgctggtgaggctgacagtggtctgggacctcttgatggcactattggggatggtattgctgctggaccaagtggtgtgggtgctgaaggtcctggaattgctgctcgagcaagtggtgttgggcctactggtgaggattctacctcatataagaagaggaagagagcatctgctttgaatgaaggtgaagttgctctcatcagcaacatgacagattcagtgaacaacatggcttcagcaataggcgctactgcacatactgaggttcaccctgatttgtgcaacacagtgatggattttccaggtttcagtgaggatcagttggaccttgttctagcttatctaactaaggagaaggctgaaagccttgtatacattcagaagaatgaggctcgtcgtgctcgttgggttaggaagttcctgaatgagcatcaccctgagagcatctaactatttaactaactattatggagaggtggtactgggacaccatattatgtaatattgcttagatgcagattaaggtggtagtggacaccacatatatgtcttttgtagaatgttggctacctgttgattaaggtggtagtgaacaccagtagctgaatggcttttgtagtgtaaactgcagggtattgcatgacccatgttgaatctctgccttgcttcttcaatgatgattattgccactgatgaatgcttcacgccactgtttgtgctgcatatgaaaggatgcttctgcacttgctttttttatgttgttatggttccaagatgcttctgatgcatatgaagagatgcaattgtgagagatttccaagatgattaagattaatagtgttgatttgtaatgcataataacatatttcctgcacttagttcttttttgttagggtcaagctggaaaatactgcaattgatgattaatagtactaatctgtgatgcataagaacatactatatgcacttgtcattttaccagattgcatatgtataacaatttattactaatataccaattggtttagttttgtataacatcaatgtaattgtatatactcaaagaccaaaatatttgatctgttccttgtatatactcaaagaccaaccaaataaaatagacgtgcatagcaatattttaagcaatttagctcacaaataatagtaagccaaagagcaaataaaattttaacacgacctcatggagtaacctcaccgcacagaagtagacacttgagaaaattttcacaccacaaacttattagggtaacctcaccactcataggagagggtgtttacacccaagatgcatccatccaaccaaacaacatctcctgcatgcaaccattccaccaatcctttgctgcaaccaaccaaacatcatctcaacagatccaggttcatcagatgcgggcaaccaaacagctgcatgtgtatcctctcaaccaggccagactcagcctggatggaagagatgagccaggctaagggaatacgagcaaccaaacgcaccctaaagggatacaacatatcctaatattgtgaatctggatagactctttattcataattgtggtattaggatgtaaattcgtaggaccagaatgtgtcacatctctctaaaatctcttatattatgagacggatgaaatagatagtgcgtacaggcaagcgtttgttacctcctcgagggtcgtttttaggatcttgaaatgtgtcatgaggatcagactcaggttcgagcggaccaactggcagccaaggaagaaccgatcgatcccatatacatgagagagaatagataattggaaacacacatattagagtactcattcgttacggcgttacctggagaagaatggggttccgttttaggatctttacctgggtcctgcaggctatgcattggaccaatcgacgtcttagtaactggaccatgaggaaggagaatgaaagggtgagagctgggtcattaattagctagggaagggatcctctgacatgatgattttctcttgatttcacgtcggaggatccctttccggtcaccagggccacgtcgtggcttggatcatcaaactcatcgagccaaggcgaaagtgctatagctaagagcgtgttaattaattacctggaggaggcttggactcgcagttgggtgatatgggacggaccacggcgcggatcgtcagctctatgcttaacccgggatgttctactagaacgggtgttagtttcagttgacaagctgcaattaatatgccaaacaacagtgttaacagaaaactagcaatacatcatcattcagaacatacaaattaacacagtgcaacaccagccggtaattaatacatacctggagcggccggaggctcgacggccggcggagcagaagcagcagcagcgtcgccgcctgcagaaacgggagtggctgccacgacgctgctgataacgggcgccatcttcctgctactccttttggctgcctagctagctagatgtacgtagtattgtgtactagtgtgtatactagagatgttcgcttctacagttctactatatatggctatttatatatgcgtttcatatatcgatcagattcccatgacagacctcagtcacacctcttatggttattttttttatatgtggttcataaatagatcagattcccgtgacacaccaaacaccgttgaaccgtgaagaagctagaggcgtgcgtctacaccataaattaaaatagagtgaattagatattaggccacatcttattactagacttgcaagttagactaggggtaaaccaatattgtcactttgcgataaaaaaaaattgtcactttgaaataggtagttttgcacaagtttcatattggactggtgtttcctaattctcctctttctttgcttcattaagttgaggccgatgtctattagctcgagcatggtacaccaatgccactaatattgtcccatgctcgagagtgatcagatggcatcagtagtgggctctttgatttagaggaagaggagagggtggtgttaggtgaaacaaatggcaatattatgtggtctaaagtgaaaatcttggctaagacctcgtccaacccgcaacaagggtcaaaatatatggcctaaactgtaatttactcaataaaatatggcatacaccctctgttataaaatatacaaatttagtatgggatatgaatactacgaatttagacgacatcgaaattgagagttagaaaattactggagaaagaaatgtggcataaggttcagaccaaaactcggtggagaaatgaaatggttcgtctgtcaactatcaagtgctttgctcgtaccgccggctagaactctacatttttagataaatgatcacctactgatatatcaactctcacgaacaatgctatagacccccctcatcactaaaggcaaccgcaatgtataagttgaaagttggtattaacgtgaggcctcaagtagaaataactttgtgagacttaacaatatatattgtttggctaagaaaaataaggtggggtcaacccataaaaaatcatcctctaccttctttgaggtattccacgagtgatatgcttcccatgtgcaatcttttttttttcttttttttttctttgttgcttgcttgttgtaggtagtagtgtaaagacctgtaactattactacctcctcgcacaatgtgtactactagataacaaaggtatattaattgtttactacctggtttctaccacgttgtggttgctccaagggctcaaaatctttatctgtaatgggcaagccagtcaattaaaatttttgccggtgatgtggaggcttatctatagtggctcaaaatgatgagctgttagtgatatgaaaaatccaggcaacaaaatggaaaaaaaaaagaatctgctcttcctacccaagattgtcagtatcccgatttgtatcctagtatcttacgatactacgatcctaccaaaccaaaacgatatcgatcccacctagtatcctaattttcataatatctcgatcctactattcattactacacgatcatatgaaatcttaggtgatatcccgattctacgatccctacgatactacaaaatattatttaaaataacatggtttgaaaataattaaataaatatgcttaaatttatataaaactcagttaaatatatcaaaaccaacatgatttctctcgataaatgtctctatttgcataacatatatcattattaatttttttatatagaatggctatatataactaatataaatattaattaaacttaaaaaaaggaaaatcgcatagtatcccgatactacaatacgatattactttgagcaaaacgatattatctagtatcccgatcctgacaaccttgctcccaccgctatcaaagcactcgctcaaagccgctcttgccagctcaagctcggagtggctgtcatcgctatgcccactcgatgtagtcatcgtcgccgcttttccaccgcaccacccctcttcatgccggcttgagctcagagtggtcggatctagggagaaacggtagtaaggcaagacagggtggcagaagagggttggggcctgggggacaccatgtggttgccgagcatgctcaaggagttcaccatggctgcatcagtcaaaggtcaacatcatctctgtggctgtcgccgtttatcatcgagtagctgacgacgatgacgatagcggcaacagaggtgcggtacatgagtgggaggctggcaatggtgtggcttagggggaggatggacaacaccgccaacatgtgagaagtggatccgatgtagcactaccatgtcactgaatgtggagatggggcaggcagaggtggaaaggcggtgaactagtggagcgagcgatagagagggtggtggactaggaggaatgcggcataaaatcactattaagagcatgcctagctatcacattttgtaacagaatgaatgaagttaagttggacaattgatgtgtaattttgttgaatgaatgaagacattgtttaatcaatcaatgagtgaaatatagttttgtttaatgaatgaacggtcactgtatgtggtttgaataatcttagactgaatgtgggtcagcaatgctaatgcttgcgtcatattgttggtctggaattgttatcgtcggcaaaaatatgttggtcggtaaaaataatgtcggccggcaaatctaaacaactagaatatattgagtggtcagttggcaaaaatatgtcaatcaggaaatgtctttgccgactggtactggtcatctacaacaactcataataaagagttgttttaattagaaggttatttgtaacaacacctatttaggacatattacacacaatactccctctatttcacattatgagacgttttagtctttacatctctcatatagatttactaacatccatatgaatttaaacatgtagataaagcacatacatggatctatatgtatgaaactattcaaatcccaaaacgtcctataatttagaacagatgaagtaattatcactaatgggtctaagtccctgtagatacttttgactgttgatttaaatagccattatatatataatcatatgtaacatgttttttttaaccgccacaagtgacacattaaagatgtgagattctgtagaagtatttatatattttatgattactctctattttaatggaagatatgctttcaaatacacgtggttttactagcgactatccttggtcagttcggtcagagttatataccaccgcatctctgcaaagcatatataatttacttgccagttacgaaaattactccaacaacccatcggtaaaaaagtttagggtaaggcttttcaaaagccaacctagaatcatccatgccaacttaaaagtaaggtcctaactaagggcatgttcactttgatgccattttcaaccttaccaagttttggtaaagttaccaaaaaaagtggcgccctaaaccagcaccggggcaaattccaatcagtgagggctagttatttcagtgtggtagagctgtcctcgttgatgagggaccattagatgatattataattttatatttaattaaaaaaatagcataatgtgcattaggctggttggtaggatattctactccagcaatagactatagaatcggagcgcccgcggtaaacattgccgatatagaatattaacaagacggaacagagcgcacaccgttagattatatgttttgggacagccggcctatcaagacttcactacttaaaaattacatatagaggtcagcgctagatgtgtcagaacaactaaaaccagcacccatagtacatttcctatctccacatacaaaaccggcacctttaatatattatttataggtatcagttaattaaaaaccaacacctatgataaggtgccagtttcttttagaaaaccggcatcaatcccaaactgagctgaaccgggcaagccgatcacgtgcccttatccaccactcgttgtccgcctcctctctcttgctctcgccacctcctcctcgtcctcctccccgtatctggcatcggcggcggtggcttttcccgtggcggatacaacggtggcagtgtcagcagcgggtggggcggcgttagcgggttctcccacggcaggtccggcagcggtgaggtctcccacaacagattgggcgttggcggcaggtaggcggcatcgacgggtgttcccacgacgatccggcatcggtggggttcccgcggcggatccggcgtcggcggtgggcgggaggggaggcggcgggctacaaggcgagagtatgagggggagaaggaggctcaccctcctctccatatggcaacggtggcagaggtggagaaaaatgccggttgcatcgtgttcttgatgttttttatgttaatctttttgatgttcttgatgttttttgtgtttatgtgttctttgatcttgtcaggatgaagtggagctacttgagcattgagccgctttttttttgttcatgtaacctcaaaggtgtcggttcctaaaccgacacctttgagaacatctcagaggtgccaataatgggtgccgttgggaaaactgcactgtcagtttttatccggtaatataccagacagtgctaccaagagcaacactagctgtttagaaaccaatagagttgtcgaatatcactgttggttcatctcataaacctgcaatgatattcatttccagccaaaaaatagattcataacttgatttacatttacatccatttcaaattgcacctcaatttgattggagaaaagaacgaatttgcatacatgcaaatgctccacgtatctacatacttgcatacacacagcaacaacgacaaaacttcacaacttgcagcaatagctttcacaagttgcagtaacaacaaagttttccaacacacaagttgcagtaacagcaaagttttccaacatacttgcagtaacttcaaattccaacttgcaagatttgcttagcaacaagaatctcacaactagttggtttgtgtgttgtatcgacatggcgataacttgttaaatggactctagcaacgatagtctaggctcccttgacatcgcggaatctagggctaccatctttctgatgaaacttaaaaggatttccaaactagttaagcatcattgagtgcctcatgctcaaattaagatgaatcgagtgctcatgctcagactaagatgatagattgatggtagtgtatatggtaagaatgaggaagaatctagttactactcctatatagtaggatagaattagtttatgaaaaatataagcgcacatattatatttattctttaaataagtcacgacattaaatttgtaaactagtagaaccaactcaaatgatctaaacatatatacgagaaagctacacatgaataaatcaaatagaaaacatgaagacgagcatatggatgatatgttgtgtggaggcgatggctcaagaaaatgtacacataaataaattaaacattcaaaacatcaggacgagatctagacatatatataagaaaattacacacgaatacatcaaacatacaaaatatgaagacgagtatacagacaatatgttgtgtgaaggcggtggcttggtactctaaaacgcataaccaaacgagaaaagtcacacctaattttttcggactctatgccaattcatcggagaacccgatgagatttcaaacacaaaattcacacgtatgtcacgtgtgcacgcacgcccctggagcccagccaggcgaagcgaggtgagcatgtacacggatgtttctccagttccctctacaatatatacattgctcaaatggctagaagagtattcactcttttaagaaagtctctcccctataactagctatgtggtactaaagtttcacatgcaactcttttcatgaggttgatctttatgatttttctaagaattattttcttcgagggctaatgcccatactataagtctaacattagtttctttcttttatttagtattgtttggttgatgacttatactttcatcccaacaacccacaagcccatttgcgcagcatatcgtccactattccacttaattagtgcaatttgcatttgcaatctcatttgtatccgtttcacacttgcacttgcaaacagaacgctcattggacagcgttggacagagatagatgattgcctccagatccagatcactcgatttataacgttgttttgttttgtttatgggtttagataccaggctgacagtctcacaccgagagctgctaccttgaccgctaatcatgttcacagattcattgctcaaagaggatgaaggcatgtgttcatatttggtcctattcttcggtcaagttctttgctccgggtttggtcaaaataactcatcatgcattcctacagatggatagatttctcagtctgtactgaagtgtgaataatttaagccaaaaatgcaggttcagaataatgtagtcgtccgtacatatagtttgctgtgagaatcttttaccagttcttggtatattgtaccccctcgttcttggaggaaacttttaatttggattgtgtttcaaatcagtaaaataaaaggatgcagctttctctctaaaagaaaaaagaataatgtactcatacgtacatagtttgctgtaagaatcagaaaaaccctctttgcctatggccaattaatgctggataaatcacatatctattttgggtgtgtttagttcacatcaaaattaaaagtttgattgaaattgaaacgatgtgatgaaaaagttggaagtttgaaaaaaaaaagttgggaactaaaccaggcctttctcagtctatactgaaatgtgagtttaagccaaatgcaggttcagaataatgaagttagtacatagtttgctgcgagagtaaggtacacatgaattcgttaccttaacacacactaaaaagaacaagtattaacggcagttccttgatctcactaaatttctgttaaaaacacacacgcgtgtaatatttgtggtactaatatttgaatcctactggagtccaccacacttatggtgcttgcatcaattccaatgtccaaaactaatattgttcgactaaaaccagttcattttgcggtatgtatttgctaattgtttgtttgattggattttctagaaaacttattcgttggtatacaacttttagaagacatacgtgaatgtagaattgtgaataatataggagtaattgctgacagcttcccaggagtgagagataaattcagctgaggactatataggctgaattctcgattgcccatgacagtatatacacatagcaactggcaactattctagttgcaaatgaaataactagtgagaacgccctcccaagcccccaacatcatactgaaaaacaaccactggtaggtacaaatattcaaatgtggttgaattgcattgcaaaaaacgtgtattcatggatcatacaagttcccaccgtgtcatggattagatcgaccagatgcctggtaccatagagagtatttatgtagcgtagtactcctattacaaagcaagttttcatcaactatagaagcttagccacacagaactaaatggcatgtttgggcgtcttgtcctcaggcattgtttggctttgcctatccattatctttatgattctaccaatagccatcagtgatgaacatgaaaatgatcgtcaagctctcctatgcttcaagtcccagctctcaggtccaccgggagtactagcctcatggagcaatgcgtcccaggagttctgcaattggcatggtgtcacttgcagcacaccatctccccgtcgtgtcactgcaatagacttggcatcagaaggcatctctggctccatatcaccttgcattgccaacctcacctctcttacaatgttgcaactatcaaacaatagcttcaatggcagcataccttcagtgctcggtctactcggacaactcaacaacctcaacctcagcatgaactctctagaaggtaacatcccttctgaactttcttcatgttcccaacttgaaatcttagatttgtcgaacaatttcatccaaggtgaaatcccagctagcctaagtcaatgcaatcgtcttaaaaagattcacctcagcaagaacaagctccaggggaggatcccttatgcttttgggaaccttcctaagcttgaaaaagttgttcttgctagcaatagactcaccggcgacataccagcgtctttaggaagcagcctttcgctcacatatgttaatctcgagagcaatgctctcacagggagcataccacagtccttactgaatagttcatccctcaaagtacttgtcctcacgagaaatacccttactggagaaatcccaaagcctttgttcacctcctcaactcttactgatatttaccttgatgagaataactttgttggttctataccacatgttactgccacccctctccctttacagtatctatatttagggggtaacaaactatcaggaacaataccttcctcattaggaaatctttcctccctacttgatctaagtctcacacggaacaatttaaccggtagcataccagatagtttaggccatattccaacactagaactgttgaatttgaatgtaaacaaattaactgggcatgttccatcatccatcttcaacttgtcatccctgaaaagtctagccatggcaaataactcactcacaggggaattaccatcaaacttaggttatacactcccaaatattaaaacattaattctgtccaataataggttcaaaggcccaatcccacctactcttgtcaatgcttccaatctgaaatcgctgtacttgcgcaataatagccttactgggctcattcctttctttggatcattgctaaatttggaggaagttatgttgtcatacaacaagctggaagcagctgactggagttttatttcatcactatcgaattgctccaaattgacaaaactattgatagatgggaacaatctcaaaggtaaactgcctcgttccattggcaatctttccagtagtctcaaatggttgtggctaagagacaacaaaatttctgggcatataccaccagagttgggaaatctaaagggcttggaaatgttgtacatggattacaatcttttgacaggaaacatacccccggcaattggaaatttgaacaacttggtcgttctagccatggcccaaaacaacctgtcaggacaaatccctgatacaattggcaaccttgttaagctaaccgatctgaagttagataggaattactttagtggaggcataccagcaactctagagcattgtactcaactggcaatactcaaccttgcccataactcactagatggaagaataccaaatcagatcttcaaaattttgtcacttcccaagagttggacctgtcacacaattacttgttcggaggaataccagaggaagttggaaatctcattaatctgaaaaaccttagcatctcaaacaacaggttgtctggcaacatcccatcctctcttggcaagtgtgttgctctggagtctcttgagatgcaaagcaacttattagtaggaagcataccaaaatcttttgagaagttggtaggcatctggaatatggatatttcacagaacaacttgactggaaaaataccagattttctttcaaacttcagtttactatatgatctgaatttatcattcaacaattttgaaggagaagttccagcaggtggtatttttcgtaatgctagtgtggtatcaatagaagggaataatggcttgtgtgcaagaacatcaatgggaggtataccactttgctcagtacaggttcacaggaataggagacacaagtctttggttctagtcctaatgatagtaataccaattgtttctatcactatcattctattaagttttgctgcatttttttggaggaagagaatgcaggttactccaaaattgccacaatgtaatgagcatgtgtttaagaatattacatatgaaaacattgccaaggccacaaataagttttcttcagataacttaattggatcaggatcatttgcaatggtttataagggtaatttggagcttcaggaagatgaagttgccatcaagatttttaatcttggtacatatggagcacacagaggtttcattgcagagtgtgaaaccctaagaaatgtccgccatcgaaatcttgtgaaaatcatcactttatgttcttcagtggatgccactggggcagacttcaaggctttggtgttccaatacatgcagaacgggaacttagacacgtggctacatccaaagtcccaagaacttagccaaggaaaggttctaactattagccaaagagttaatattgccttggatgtggcgtttgctttagattatcttcataaccaatgtgcaacgccactaatacattgtgacttgaagccaagcaatattcttttggatcttgatatggttgcatatgtcagtgactttggcctagcaagatttgtgtacaatagattgactgcacatgaagatacctcaacaagtttggcttgcctaaaagggtcaattggatacatcccaccaggtaaataggcttccaaacttttgactcagtttgttctttatatacttgtacagaaattttaaaaaatagagcctagccttatagttttataaaatttaatgcagagtacggcatgaggaaagatatctcaaccaagggtgatgtctacagttttggaatacttttgttagaaattataattgggagcaggccaactgatgaaaaatttaatggcagcacaaccctgcatgaatttgttcatggagcatttcccaataatatctacgaggtagttgatccaaccatgctacaaaatgaccttgttgcaaccgatgtgatggagaattgtatcattccattggtcaaaataggcctatgttgttctgtgccactgcccaacgaacgaccagaaatgggacaagttgcaaccatgattcttgaaatcaagcacgcggcctcaaacaggcatgtcagattaagctaacagctgccaggttctatttcatttatagaagaatataccaatataacatccactggatatttcactgtaaacgtagtatagttaatgacctcattagaagcttgaatggtagccacaatgcttgcacaggcatccctagtttttgaatgttgaaaccttttatggtttatattgtgcgacttacttgttcatcctctaatcactatgaagaaacatcgaattatgagtctttgagattggctcccttccatttttgccatctccggtggctaccggacgctgccgtggtgtatgaaaaacagcatacgcaaaatggtagctagtgttctacttgaatgacactggttgtgtttcagctacctttccatttttcatttgcattctgtatgtttagcgacatgcatgtttctcaatccaccgaaatttacttatcgtggcattagcatttcgtgtcgtttcttttgatataggatgataattcataataaaatgtaaagcagcataaaacatttgtagcctggttaaggacttgaagtaaaagagtagtagagacgtagagcggtaagcatatagaatgtcatgctgtaaacttactccacttctatagatggtttaggtagccaggtaggcaccgttcctgccaagttcttcaaaagcaagggttgaataactatgagcaccaatcaaattgtaaggaactcgaccgatttgcatagccctcgcccaacgggatacatcaagtaagaccgtcaaaatcgattaggtattttggcaaccaatttcgttgggaactaattagtctccgatcaaagccaaattataggtgtttgcagaagctggatttgggtcagattccaaaaccccaagttcaaacatgaccccaacacgaaattagcccaatgaaaggcatagattggagaccggatatatacagatcaatctcacaccgacctaattagcagaaaatcagatgatagatcaagcagataggcattcataggactggatagggggagcacctgctggctgcttgcctgctcgtgttcctgctaggctgctactctcggagtcccagctgccggcgccgctcactccagagtcccgagcggcggcgccgcccgtttcggtttcccttgcggactcgccgtcacctgcatagggcgccgccgccgccgtcggctgttgtcgtgggagcccgtcgctaggctacctctggttgtggttgggccatgaatcttgggctatcgttaccatgggaaaacggggagttgggccaggtgtctcgtggacctctcttggcccaagtcagctgtcggtatagaggtcggtcttcaaattcttaaccctgaaggaattcatttcaaaacttgtagccaagtaaaaatattcttctttttttctttcttgaaatatttttaacagaaatactatatgacaggaacctaactatgggacggcatacttaatgatccctacccgatgcgctatccgcttacaccatacattcgtggccctcctcctccttggctccttgcgatctctccatcatcctttttctcttccacctcgcttgtacatgtcgagaatggctcactgctcctcctcctcgttgtcgactcttgctcatcctcctactcaccactctctgttgttgctccatgcccctgctagcctgctcccgtcatacctggtatctaggtacaaacatgacatggcaggctgtggcttgctggttttggttgagaatctgagggcagtggtacaagcagttgcaccgctgtatgggcacggagatggcagtggcagcgctcgaggtttcgatggccgtgggggcgcgatatggtgttcttcctgtgatggggatgtacaaggatcctcttgcccttcctttttcttgatagatctaacggagcaagaggtcaaaatgatcaaatctagagcatcgattgcctcactcgcgttatgtgcagatacatcgtgcggctcatcatcctcggctagcacccgcaattataagccttaggagctgtttagttcacatactaaggtgtgtttagttcacactaaaattgaaagttttgttgaaattggaatgatgtgatggaaaagttggaagtttgtgtatatatgaaagttttgatgtgatggaaaagttgaaagtttggaactaaactcggcctatattgcctaggttagccatactttctttgtcaaacttgtcaaatgcgaggctatcaaaatccaagccacactttagccaacaaaattaaatcatgccacaccttttagagtcactaacatctaagaccaatattataaaagagaaatcttgccacacttatggaagccaaccaaacacctatctaacatggtcaaacttacttaaccacaaatatggcaacttattggcatcaaccaaacagccccttagtaccccagtacccagtacctagctaggtacgaggtaccaagctgctgggagaagcagtgcgctgtcgttgcctagccaaccgacaagctacctgccaccggtggggaatttaactatttgccacttttaggtttgccaattatccaaatgcccctcttaggtttgcacttaataatttgtcaccggagagagataattttttaactatttgccacttttgcctacgtggcgtgccaccgtaccgtgccagcgtgaaaagcaacgtggaccccaccatcagtccctctcctctccttcttatctacctccgatcgtcgccgtgacctcccgccggccccgcgttggccccacaccgtcgtcccctgccggctgcagcggcagcgcgtcgttcggccgtagcaaccacgcgaggtagaaggtccacgaggaggacg

SEQ ID NO: 39116 - DNA, 22790 bp, Oryza sativa
cacggcggccgtgccgcagcatcgccaggacggagaagagtcgtgtcgcgtcgagtcgccggactctagtggtgtctgagctattgggcgtggcggcggcggccgcggggcgagcgggcgagcactggctggcagtcgactacggcctagagccagcggggggagtgggcgagcacgggccggcggccgacgatggtgtgtggccagcgtggggccggcgggaggtgggcgacaaccactagagagaagaaggagaggagagaggctgacgggtgggatccacattgctttccacggtggcacaatacggtggcacgccacgtaggtgaaagtggcaaatagttaagaaattacctctctccagtgataaattattaagtgcaaatctaagaggagcattttgataattggcaaatcttaaagtgacaaatagttaaattccctgccaccggtgattcctctccacttcactgttcctctcctcagctcgtccctttttcctgctgctgttggtgttgccctgctcatactatggatagagtttcctttctgcgctgtggatttaacattttttttttttgggaaagttcaccagttcttctcaagacgtgaaatctccttctctttttttttttgtggggttctgatttttttttttttgatcgtggttctctctcccttttttttttccaggtatcttgagcggagggtgcacgcaaatgagaaaacgggaattcgaaagatcgttttttttttccagcggctaacatatgtgaccgaagcaacaaaaactaattttaagataagggtttaatttgcattgctattcttacctatacaaaacctaaaaccagatgacaaaactgagcaaaaagttataaaattagttacagtttacaagccgaagctaaaacaaatatgaaaacgctgcaagagggctcggtcgatcgatcttgcatatgtactacacgtcgatagacaccagataaatcatttcttgcctccttcccggtgatgcatctcttctccggtgccgagacccagcattgtttacagattacaatcaggaaattaaactggttgtggtgtgttccgcagcaggttcatgttcagagctttgagcgaccttgcagattaacctggacccaaattaattaagaaccggtcatacatagggatacaggtaactaacccacgaatctacttataaatcaacataaatggattattttgatcaataaatagtttcgcgtgttaatcacttactcccttaatcataacatgactgaaaataaaacaattaaacggtacattgtacatacactcattgtgacatattgcaagcgaacctgctggccttaccttgagaagaacgagcaggggggtgttaaggatcaggaaacgagtccacaggtgaatgctgttgatcttgaccaggattacggcttggaggccctggaccaactggcaaccaaacaagatcagaaccaatcacacatgaatatgcaaataattaaacacatcatgtacacacacgaattgtggcacagatgtatgcaatcgcgaattaattaattacccagaggctgatgaggagggtgtttaggatcaggaaatgagtcaacaggtgagtcatgaggaccaaactgcggagcaactggcagccaaacaagaaccgatcgatatatcacacatgagagaaaataaacagtgttgtaacagatactagcatagacaagcgtatatatgttacctcgatgactaggaggagggtttttaggatcaggtattgggtcacgagggccatgtcggcttggatcatcatcggatggcgtaactggcagccaaagcggaaccaaattatgcagtgcatcattagtattcattccgtcttaaaatatactcccctgttcctaaatatttgatgccattaacttttttaaacatatttaaccgttcatcttattcaaaaaaatttaaataattattaattcttttcctatcatttgatttattgttaaatatatacttttatgtatacatatagttttacatattttacaaaaagtttttaaataatacgaaatgttaaacatgttttaaaaaatcaacggcgcgtcaaatatttaggaacggagagagtactagcgtattaaagccgttacctgcaggaggaggctttgactcgctgctgggtggtaggggacggaccacggcgtggatggtcagttctatgcttaaccctggagaggctggaggcgcgacggccgccgccgtaggggtgacggccggaggatcgccggcaggagcggccgccggcggagtggccgccacggcgtcgctgatgacgacgggtgccatcttactctgcattttcttttggttggctgtactgtagtctgtactggagcacacgcgagataactgatcagttgcttataaggctatttatacatgcgttaataactctcatatatatatctccatcggatcagtttcccatgacaccgtcacaccatggaacctagacgagtggcgtgcgtttacaccaggaatgtgatgtggcatagacttcaagctcagagtcagaaagtactccctggagaaaacaaatgtggcatagacttccaattttcaaagttcagagtcagaaactcggtggtgaaaagatatggtttgtcgggggaggtgctgtcctgcggtcaactatcaagtggtttgctcgtgcgtcagcctaaaactcaataaattcagatttcatggcgtcattcaatctcacaaattagccccactagttacgcggtggatcacgagcgttcacatctatattttcagattattctttattttagagaaagaaatgcttgcatatacacaatacgcataactcttatccacgataccctaccaataccggtttagtaaaaaccggcactaataggggtttttttttttttgtcccatggacttgtgcacgcactggcaagagaaaaaagggtattgataatatcacatcattatatatcgctggattgctagtcgaaccgtcactaaatacttctattctagtttttttttaaaaaaaactaacatagtaaaataactattcgtgttggtttttaggaataactgataaaaaaacgagccgagtgacaacggggctaagccgagccgagtgagggaaaaaatcttgaagtgtcaacccatcgctctctccttctctccctcttctcactagtaagtagtagtcccctcatcctctcctccgtgagcagcggccccctccctctctccttatgctgcattggcacccccccctctctccttggatctaccaccacagctgcagatcgatgcctctcccaggtatcttttttttttggtttgtagacgtgaattagtgccggttaaggatttcctttttttgttggtgaacacgaattactaccgattctaggaaccaacactattgggggatggccccgggcatcctccggagcccatagtgagtgacctcactccacctagggagccccaacctacgcgtcggtgacattgggctagctccagcccgaaaggacgaaccaatgtctcctcaagatgataagctaggcaccctccgaaaacccaaaggcttcgaataactatcaatgcttaacaagacaaggagcattcaatacttccacctaccaaccacctagttctaggacttcgagtggttgggttgcaatcaaggacctggaaatcttaggcccatccttgccaagatctgctaggatgctaggatccgcaaagctctattgacccaccaacataatgggccaccaagggcggccccctcaggaattagccccctgccccgaggagggggccacttgtcaatcgcccactagccaaggctacccggagccgtactaagaaccagctttgtaattccccatgtcataaaccctgttatataaacaagtaaccatgcctttgagcggcaggttgttcaataagtctatttcgctcatctcatacacacaagtctatttcgctcaactcatacacagagaactattggatttcgttccaacagcctccccccaacccaaccactccccctcccccacccccagcacccccgcggtccacaatgctactccctccatcctaatatatagggcgtacctgccctgaacgcagagaccaaggatgcgtacccgttttgctcgtccaacgtgcaacgcttcgcttcacgcgcagccctcgaccttcacgcgcagttgtgctgggagagagagagaagcctttttaactaaccaaactgataagcaaatattgcatgcgtgtaaacgggagtgtgagtcttgaatgcttgtatgcatatgtatgggaacgaggaaaactttaatgcttgcatgcgtttaaacggctgccgaggaggtgccatacgtcctatattttaggatggagggagtagtgttgtagttccgattagggaaatgatacttatgagggtttctatggttttctaaacattccgaacttgagaccgccacatcatcctcctatgtcaccatggggaggagaatgcatggaagggtgggagggagagaatccagttgggcagtggcttccatgcaagagagataatagagggagaggagccgcggcagaaaagagggagtaacacgggagagggagagaatggagtggaggagaccatatgggggatttggctcgtgcaattgattggccagcttcaaccgatttcactattggtcaggtagaggtagtatcactgtcaatttttaacgtgaaccagcaacaaaattatttttgatggtgattataaataaactggcagtgacgaaaggagttggactgatggctctttactagcgaatgcaatttgcatttgcaaaccgcattgtattagttgcacacttgcacttccagacaaattaaatcacattaggaagcggtcaatcactgcctccagacccagatcgatcacacaatctttgaagttgtgttttatttattcattgctcagaaaggatgaagccgtgtgtccatatttggtttactagcagcctagcaggactgcacgaggtcaagttgtttgctcttggcttggtcaaaataacccagtggatagacttctcactctgtattgaaccgtgaagcttgtaaaagaaagagacaggttcagaataatgaaatcagtacgtagtttcattgtgataatgaccagaaaaaggctattttctatatggccagcgtggatggacgactcaattttgcgttgtctcttttcagttacacggaagacaacacatctgtaatacacatcattacacatggactgatggacacaacatttacttagctgcgagggcacctcttaacatacacacacacacacaaaaacatttattaagaagaaattgtaaatgtgttgggattaaatacaagacctcgggttaaaatcatacacctcttgctactattctatcaagtcacacgctaaataaatgtgacttctagcaaatcactaacatcactaatattggtggctgcaggacttaaacattaatgaccacattacatgactgaagcttttgcatcaattccaacaaaatgtccaaaacttatattgttcaaccaaaatcagtttagtttgcaatatgtatttttttactatttattaattgcattagtagaaaatttatttattattacattatcaatactagtgttagaagacatacatgaacatacaattggaaataatataatttgatcctaggtagtagttgctaactacttcctaaaagaaaaaataataataatttgcggactgcatagtctgacttctccattgttcatggtagcaactggcaactattcaagttgcaaagagaacatatctagtcagaacacccccttagtccccaactacgtaaataactcaattgcaaggcttacttggcaactattgccacttcatattatacaagcttcaacgactacgagccccaagtaacttgtttttgaaagaaaacctccaagtaatttaagcagtacagaaataaataataaatggtaggtaaaatagtccatgggttgaatggaagccaacagacctgaggtgaactacaaaagcgtgtattcatggatcatccaagtccccacagtgtcatggattactagaaacctgatgcaatacagagtatttatgcatcacagtgcagctattgcaaagcaagtttttatctccatagaaacttagccacagagaagcaatggcctgtttgggtgtcctgtcttcaggcattgtatggctttctctgttcaccatctttgtcagtataccattagctaccagtgatgatcatgaaaatgatcgacaaactctcctttgcttcaagtcccagctctcaggtccaacaggagtactagattcatggagcaatgcatccttggagttctgcagttggcatggtgttacttgcagtacacaatctccccgtcgtgtcgcttcaatagacttggcatcagaaggcatctctggcttcatatcaccctgcattgccaacctcaccttccttacaaggttgcaactatcaaacaatagcttccatggcagcataccatctgagctcggcctactcagccaactcaacaccctcaacctcagcacgaacgctctagaaggtaacattccttctgaactttcttcgtgctcccaacttgaaatcctagatttgtcaaacaatttcatccaaggtgaaataccagctagcctaagtcaatgcaatcatcttaaagatattgacctcagcaagaacaagctcaaggggatgatcccttctgattttgggaacttgccaaagatgcaaataattgttctcgccagcaataggctcaccggcgacataccaccatctttaggaagtggccattcactcacatatgttgatcttgggagcaatgatctcacagggagcatcccagagtccttggtgaacagttcatctcttcaagtacttgtcctcacaagcaatacccttagtggagaactccctaaggctttgttcaactcctcatctcttattgctatttacctcgacgagaatagttttgttggttctataccacctgctactgccatttctctccctttaaaatatctttacttaggcggtaacaaactatcaggaacaataccttcctccttaggaaatctttcctccttacttgatctgagccttacacggaacaatttagtcgggaacgtcccagatagtttaggtcttattccaaaactagatctgctgaacttgaatgcaaacaacttaattgggcatgttccatcatctatcttcaacatgtcatccctgacaattctaaccatggcaaacaactcactcataggggaattaccatcaaacttaggttacacactcccaaacattgaaacattagttctgtccaataataggttcaaaggattcatcccacctactcttctgaatgcttccgacctgagtttgctttacatgcgcaataatagtcttactgggctcattccattctttggatcattgaaaaatttgaaggaacttatgctgtcatacaacaagctggaagcagctgactggagctttatttcttcactatcaaattgctccaaattgactaaactattgatagatgggaacaatctcaaaggcaaactgccccactccattggcaatctttccagtagtctcaagtggttgtggataagagacaacaaaatttctgggaatataccaccagagataggcaatctaaagagcttagaaatgttgtacatggattacaatcttttgacgggtgatatacccccaacgattggaaatttgcacaacttggttgttctagccattgcccaaaacaaattatcaggtcaaatccctgatacgattggcaaccttgttaagctaactgacctgaagttggatcggaataactttagtggaggaatacctgtgactctagagcattgtactcaactggaaatactcaaccttgcccataattcactagatgggagaataccaaaccagatcttcaaaatttcctccttttcccaggagttggacctgtcacacaactacttatatggaggaataccagaggaagttggcaatctcattaatctgaaaaaacttagcatctcagacaacaggttgtccggcaacattccatccactctcggccagtgtgttgttctggagtctcttgagatgcaaagcaacttgtttgcaggaagcataccaaattcttttgagaacttggtaggcatccagaagttagatatttcacggaacaacatgtctggaaaaataccagattttcttggaaacttcagtttactatatgatctcaatttatcattcaacaattttgatggagaagttccagcaaacggtatttttcgtaatgctagtgtggtatcaatggaaggtaataatggcttgtgtgcaagaacattaatagaaggtatacctctttgctcaacacaagttcacaggaaaagaagacacaagtctctggttctagtcctagtgatagtaataccaattatttctattgctatcatttgtttaagctttgctgtatttctttggaggaagagaatacaggtgaagccaaatttgccacagtgtaatgagcataagttgaagaatataacatatgaggacattgccaaggcgacgaatatgttttctccagataacttaattggctcaggatcatttgcaatggtttataagggtaatctagagcttcaggaagacgaagttgctatcaagatttttaaccttggtacatatggagcacataagagcttcattgcagagtgtgaaacactaagaaatgtccgccatcgaaatcttgtgaaaatagtgactttatgttcttcagtggatgccactggggcagacttcaaagccctggtgttccaatacatgcgaaatgggaacctagacacatggctacatccaaaggctcatgaacttagtcaaagaaaggctctaaatatttgccaaagagttaatatagccttggatgtggcgtttgcattagattatcttcataaccagtgtgcaactccactaatacattgtgacttaaagccaagcaatattcttttggacctcgacatggttgcatatgtcagtgactttggcctagcaagatttatatgcaatagattgactgccaatcaagatacctcgacaagtttgccttgcctaaaaggatcaatcggatacattccgccaggtagagatgagcttctaaactttttggcttaatttgttctttattatatacttgtatgaaagcagagcctagcatctagttttataacgtctgtaaatctgatgcagagtatggcatgagcaaggatatctcaaccaagggtgatgtctacagttttggaatacttttgttagaaattattactgggagaagcccaactgatgaaatatttaatggaagcacaactctgcatgaatttgttgacagagcatttcccaacaatatcagcaaggtaattgatccaacaatgctacaagatgacctggaagcaactgatgtaatggagaattgtatcattccgttgatcaaaataggcctatcttgttctatgccactgccaaaagaacgaccggaaatgggacaagtttctaccatgattcttgaaatcaagaacgcagcctcacacaggcatgcttgattaagctaagacctggcaggtcctgtttcatgtatagacgaagagtgatttcatagtccttgaagaggtacaggaggtaacatattttctaatgtaaaatttggtacctctcggtaccgtactactaaatattttggtacctcttggtgcctctcaaggactataaaatttctcgtagaacaatgcaccaatataacatcacgtggatatttctttatgaatgcagaatggttagcgacattattggaagatttggtggtagcacgggcatccctactctttgaatgttgaaaccttttatggtttgttctgtgcgacttattccttcatcgtctaatctctatgaaaaaaaaactaggccgttttcgtgaactgatgagaggaattgggagaaaaaagttaagacattgcaacagaggagagaagagtggacgtacagtagcagagaagagaagtgaagattaggaaggcaccagagacaacaagcatccaggtgtgccacaaatagttgcctgtaaatcagagctcaaggacattagggaaaaaattggacagattagagagagcatacagtatatgccaaatatatagacaaaggcgcaatgcatgaatatataaaagcatttataatcaagatttacaaatccgatcccaatagaagtgtggatgcctcgccgcgaaatccgcggtgtcgaccatggcctagtgggcacctgtgcaggaggagaatgcagcaaggaacagtttggtcaggtagttccatggcagggagaatacatggattgagattgggggctcaccgttgtccctgttcgcaattcaccatcgccggctcaccatagcgagctgcagagaaaggggggtaaatccggggggcgaggccccagggggagagggtagccagccgcgggcgtcggcggaagtggagcggaatgcggaagccggaagagctgccggcggcggaggattcatcagccgccgcggtcgtcttcttcttccgtccgctagcctagccatcctgtacggaggggcggcgatgtacgggacgagggagcagcgttggagtagagaaacaggacaaaacggacaatacgacattcctccatccttaagggccctttgaatcgcatggtagaaaaaacagagaaataggaaaaacacatgattctaacagaaattgaagtgtaaaacagagtattgcaagacacagtgaaaatccaggaatggtcgtttgattgaagcgcaggaaaaacgcagaaatcggatgagagagatagactcaaaagaaattttccaaaaggttggagctcttgccaaatttcctccaaaatccacatgcaatgtgccattccataggaatttcataggatttgaaaaacttcaatcttttgaatcaaagggccaaataggaaaatttcctataggatttgaatcctatgaaattcctacataaatcctttgattcaaaggagccctaaaactttgaccatgacagaatacgcaaagctccttaaaacttgtttgcaaggccgatgttatcaaatacatgttatcgactctaatattgaagaggaaaattagaaagtggatttttgacttgacataatttgatctcagaaaatgaatcatctaaggcagtcaaggggcaagctatagccaattttattgttgagcatcgtaatgactaaatcggcttggttgatatagttccttggacattgtttttctatggatcggtttgcactcatggttatggtatcggtttggtaatcatatcgcctagggaggcaagttttgagtttgcctatactattaaaccttatgtaaataataatcaggcttagtatgaatcagttctcaaaatattacaattgttgaaagaggttgaagccgatactgttaaaatcatgggcgattctttgttggtcattagccaattagccggagagtatgagtgcaagaatgacacgttgatgatctacaataagaagtgccgggaattgatggatagttttcggttggtgacaatgaagcatgtttctcgagagcaaaatgctaaagctaatgatttggctcaggaggcatcaggatacaagccgatgacgaaaaatattgagatagaagtcgttacaattgcagccgatgattggaggtataatgtatttcattatttgaagaatccttctcaatctgcttcaaggaaattactgtcaaagtgaggttgttgaaaggctttgccgtggcaagtctcattcgttgggacgtaggctcatgtgttgggaaagtagcggagtacgggtaaagtgtacatccactgcagtgtgagtaaaccaaatctattcgaatagccgtgctcgcggatattgaaccccgagacatgtattacacttggctagactctaaattcttagggcctgtttgggggagctttagattctgagaagcagctgtttggtagccagcttctgagaatctggaaaagctctaaaatccagcttctccagcttctggcttcttagttcatttttcagaatcagtaactacatattctcagaagctgtggactgtttggggcagcttctagcagaagcagcttttgggaaaagctgcagatgggacaagctcccccaaacagggccttaaactaaatgggtgggatgttgcatgatgattttatactagtggatcaacttctcgagaggcgagaaggggtagaccccagaaaaccatgacgaccagtggtaggaagctatccttgggaacacaatggaaggtggacataaccgtcgttgtttaatgaacaatggagttaaagcttgatcagtttatgctaggtcttaggtttgtgcactgatatttgaaaactcagctttacgcaaagtaaccatagccactccttgtattatcctgtacattacggcattttgtgtggtggcttgctgagtacttttgtactcattgttactctatatatcttttagcagagtgttgaagagaagcccttgttagtacgcttgcgtacctaacaagataatcggagtgcggttccattttaggtctcgttccccagtcgactgcttgtagcatgtcaaccgggcccttgtatattattttgtcttccgctgttgttctctgatagatgttggcctgcctggccctaatgtaagcatttaactctcttagcctgaattcattcgtgatatattatgattcggttatgtatgtgtgtactaactactgatttagggattggtactgaagaacacataagatttctgattttcaaaatcgggggtcgacaaagggggatgaaggggaagaaagggggaggtggaggagatcgagaaaatgagaggagaggaggaggagaagaggaggggataaggacgaggcagcgcgcgcggctcgaggcagggattttcgtgatttttttaactttggtcctggttggtataaacaaccgggactaaagataaaaatgtgcatgtgtgttttcaaatcggtaataaatatatttttagtcccagtttttactcaaatcgggactaatgtgatttttgagtgacccaacaaagatcatttctccagtagtgaaataagggcatgtacaacggtctttattagtggtctctctattgccatgcaagtaaatttaatggcatggaagaaagagaaatgagtatggttgttatgcatgacaacggctcagaatcgactcttaacatttattagagcaaattttctaagaaaaagtattttaatacattaatgattagatatcatattatcttaaactgttttcgtacactagtctctagataacgtagtgatcatatccgactctatctttgtacatgccctaagccctcctctatcagaattctggatccgccacatagaagaatggaaggtgatgacacgccatcgatctctcttctataccaaatagaaagggagaaaggtatggtagagtacaaaatgcaggcattagcgaccatttggtgctgatgttttatttcctgggctaaacgccattagcgttaagcttgtcactaacactaaggcctagttctttttctcaactccaaatttcaactttcttgtttttttgttagtacacttttcaaactattaaatgatatgtttttataaaaaaaagtttctatatagaagttgttttaaaaaatcaaataaatctattttttcaatttttttttaataattagtacttaattaattatgtgctaataaattttctcgtttcacatgcactgaaaaatatcaccaagtttgggcgcagctgcccccgttaggaattccccagctagattcatgttggcctctccaacacccaagtcacaagtaattaataacattactgtccacatatatataaatcggaccaagtttacatatatggcatataaatcacgggagtttcctcatcttggacgaagtggataggccggcgcttccatatccctcttccacggtttctaccagacgcgacgtgggaagtggaaggtcaccttttgtcttcatcagtgacggagctagaaaatcttcacatcaagtgctgaactgataggagtttaaatatttccataaattacatggtatttttaagattataacgagcaattaaggattatggaaccaggcataaggtcagtggcggatccatagtgtaagcattgatttcagctgacaccaataacttctcgctaatctctttgctaatacactctagaaacaagaattatatgtattgacatcactatatttgagtagtgacctcaatgactctattttctggatccgccgctgcataaggctgaaggcctactgccccataattgtttccgcccctggtcgacgacgccggctacgtctttattctctgtcccaaccgcgcagaggcggggttgggattgtcatgggggacctgggggacctgggggaggatgtcgaggatcaggagggttgtgaatcgggtcaatagtaggcgtgtgtggaatacctgatgcagcaccaaggaaggataaataaattcactattaaatgggaaatcaaacaaatgaagaagaaatatatggagccatatatacgtgggaagacaatgatgtactagcattcgaaggaggaatagaaaaattcagttacatttacgtacaagctgcaggagtaataatgacatgtaatccttccgtactcgtaaagaaagttgtttaggataatgtttaagtcaaactttaggattataaattataaatagtacttgttgagtttgaaaatgtaaaaaatacttcctccatctatttttgatagtcatatttcatcttgatacacagactaaggataagtaattctacttatcatctatttaaacatgctactagtcattactcataaacaagtgattcattaatatttacatttctcgatgcgcatagagccaatcttgtgtggaagaatggagagtcacgcattaaatccgagaaagccattaagataataggttgtttaattgaaatatgcctatcgaaaataaatttttcagatttagaaatatgactatcaaaagtagatggagggagtatatgaatatatttgtcttgaaaaatactttcataaaagtatacatatatcactttttaataaatatttttatagaaacaagaagtcaaagttatgttttggagaccgtgtcgttgtccaaaacgatatacgctacagttgcaaaattctagtaattaatacgtatatcaaaagtcataaatctcacttaagaaataattaatgaaaagttcatgtaggttccagctatcctaccccgtggagcacgatcactgtcatgggatggtgcagccggaggaggaggaggattgttgatggcagcggcggcaggacagctgacggcggcaactggaggctgagctgccgatggagagccgcaatcactagcagcggctggatgctcagtgtcccgacgagcaggcggcggatcgccgccggcgccgcagccgttaataagtgacattacggtctgttgctctgggtgagtgacggctgatgagtggctagctgagttatagatggaactttgccgtatcagacgagtcagttgtcaacgcggctagacaagtctcctgtagaaaccacacgcgttcagatcgtgaaaataacatcatgtaacattggccggacaaatgttatagttggccgggccaatgcagtgcatggtggagattggagaatggtgacatctcgttatcaatgtctgaactcacgggtattgaattgtcaaatttgtctgaactcactaccattgaatacatttcgtcacatacttttgattacacttggtttttcagaaaaaaatatatttaaatatttaaaagatgtcatattagtaaagtgtattgcgtcctaagagcacccgcaatggtaaagtaaggtgctatctataaaacatgtgcatctcagcaatatactagattaatagtaaaccacctcaatagtaagtctacatgggtatctatagctctctcatgtattgcctcgtttttctctattgactatctctaagttagtagatagctttgctctctctctcttcatttaagatcttccatgtagaaaaatatgctgacatggatctcttgcagagagcctatagatattgtgggtaccctaagcataaaaataaattttccatgcaccgtagtataatcatttcaatttggaaaaaagtttaaattacgctctaaataattgcagcagtatgaattatatcccctaaactacaaaaccatacatattacatcccaaactttttaaaccggacgaataaccccctaaatcaatccggagtggttttgctcctacctaacacacaaatggcaatccagacagcttaataataataatcatctatttagaaacgaggggagtagtacaagtagccaaagtttgaattggcttatgaaagttattttaaaacataaaaggagtacattctaattctgtcggctcccaattattttttaagaagaaattgtaagcgtgctggggattaaacaatgaacacaggaccttggggttgaaaccacacatcccttgctattgcactatccagtgcatatcacagtgtatctgtataatgaatcttcaatggatggcatgtgtgaaagggaatatcgactcttgttaaccttccaggcaattgaattggtgggagaagacgacgacttgtacagctgatcaaaagcatttactccaactgctttctaaataattcacgcaactgataaaagcatctccagttccagcttgaataaaaactagatcagctttagagcttagaacagcaatggcctatttgagggttgtctctattggttgcctttatctatttgatttcttatgcttcctaccaatagccatgagtgaccaaactgagacagatcgacacgctctcctttgcttcaagtcgcagctctcaggtccaactgtagttctagcctcatggagcaacgcatccttggagcattgcaactggcatggagtcacatgcagcatgagagttcctcgccgtgttatcgccattgatctcccatccgaaggcatcataggcccaatatcaccttgtattgccaacatcacctctcttacaaggctgcaactatcaaacaatagtttccatggtggcataccgtctgagctcggcctcctgaaccaactcagaaaccttaacctcagcaggaattccctagaaggtaacataccatcagaactctcttcatgttcacaacttcagatcctagatctgcagagcaattccctgcaaggagagattccaccaagtctaagtcaatgtgttcatcttgaaagaattttccttgccaacaacaagctccaagggagaatcccctctgcttttggggaccttcctaaactgcgtgtacttttcctggctaacaacagactttcaggtgacataccaccctctttgggtagcagccttacgctcacatatgtctgacggagctcgtggctcctcaccgggagaccgcacaggcccccctttgctagttcggccgggggcttagggtgaaatctcaagctctctcggtatgtggaaagatcgcgagccaggaagaaacgcgagacacgggcgatgtatacaggttcgggccgctgggaagcgtaataccctactcctgtgttttggtggatctgtgtatgaaccagctacaaaagtctcaaacagccccccctccagccctccaaaatcctccttttatatctcaaggggataccacatgcacctctccctttccaaactggactgttcttctcttcataaatggacggagatcggtacggttgctgtccgagtgcccttctgacgggacggcccatacctacccccacttccgccggaaacaggtgcgacgtgggattatggctgtctgtggatgacgcgaccagtgtcagaccggtcacagatcagtcatctttgtccaccacgcgtcagcttagcaacgtgcatgttcgcccttcttcatgtaacattttgcctgtaatggttgggatgaagcctggtatatatctgaccgggggtaacgtgccatctctaagaggcaacacgctagctccggctagagacgagtgcctagaggctctcgtcttgacgggatggggcgaggcgtgcgtcagaccgccagtcgccacctaacccgtgatctgaccggtctgtgactggtcacagaccggataaaggaacgcgctgcactgcgctgcatgcagcgtgacacgcttgaccagaccgcaataaatgcggttagatgagccctgccgtgttcacctaacccatatatgtgacgcaaaaacccacaaggggtcggggcgcctcggccctcggggccgggacaggagtcacccgacccccctcggggaaatcaggaggagggcggacacctcaccctcgggcccgacgtccccgagggtgccaggccacgtgggcgattatgtctgcctcaagcctctggtctcgatactcccggtcccatatcaccgacaatgtcaatcttgggaacaatgctctcaccggaggggtaccaaagcccatgttaaatagttcatctttgcaacaactcattctcaatagcaatagtctcagtggagaactcccaaaggctctactcaacacgttgtcacttatcagcatttacctcaaccagaacaatttttccggttctataccacctgttaaaaccgtgtctccacaagttcaatatcttgatttaggagaaaactgtctcacaggaacaataccttcctctgttgggaacctttcctccctactttatcttcgtctttcacagaattgtttagatgggagcataccagagagcttaggacatattccaacactagaagaattgaacttgaatttaaacaacttttctggagcagttccaccatctctcttcaatatgtcatccctgacatctctggtggcggcaaataactcactcaccggaagattacctctagacatcggctatacactcccaaacattgaaggcttaattctttcagcaaataagtttaagggctcaatcccaacttcccttctcaatttaacccatctacaaatgctatacctagctgacaacaagttaactgggatcatgccatcctttggatcactgacaaacttggaggaccttgacgtggcatacaacatgctagaagcaggcgactggggctttatctcgtcactttcaaattgcacaagattgactaagctgatgttggatgggaacaatcttcaaggaaatctgccaagttctgtaggcaatctgtctagtgatctccaaagattgtggctaacaaataataaaatttccggacctataccacaagagataggcaatcttaagagcctcactgaattgtacatggattacaatcaattgtcagaaaaaatacctctaacaatcggaaatttgcgcaaattaggcaaactgtcctttgctcgaaacagactctctggtcaaatcccagatgacattgggaaacttgttcagctgaataatctaaatttggattggaacaacttgagtggaagcatacctgtgagtatagggtattgtactcaactcgaaatactcaaccttgctcacaattcactagatggaacaataccagagacgatctttaaaatttcttcactttcaatagtgttagacttgtcatacaattacttgtccggaagcatatcagatgaagtaggcaaccttgtcagtctgaataagctcatcatttcatacaacagattgtctggagatatcccatccactcttagtcaatgcgtggttctagagtatcttgagatgcaaagcaatttctttgtaggaagcattccgcaaacatttgtgaacatggtaggcatcaaggtgatggatatatctcataacaatttatcaggagaaattccacagtttctaacgttgttacattctttgcaagttctcaacttatcattcaataattttgatggagcagtgccaaccagtggtatttttgccaatgctagtgtggtatcaattgaaggaaatgattatctgtgcacaaaaactccaatgagaggtgtgcctctttgttcaaaatcggttgacaagaaaaggaaccataggtcattggttctagtcctaacgacagtaataccaattgttgctatcactttcactttgttatgccttgcaaaatatatttggacgaagagaatgcaagcagagccacatgtacaacagctgaatgagcacaggaacataacgtatgaagatgttctaaaggccacaaatagattctcttcaactaacttacttggctcaggatcatttggaacagtttataagggcaatctgcatcttcctttcaaagaaaaggacaatctgcatcttcaggaagaacatatcgccatcaagatttttaaccttgatatccatggatctaataagagctttgttgccgagtgtgaaaccctacaaaatgtccgccaccgaaatctcgtgaaaattattactctatgctcttctgtggattcaactggggcagacttcaaggctatagtgttcccatattttccaaatgggaacctagatatgtggttacatccaaaatcccatgaacatattagtcaaacaaaggtgctgactttaagacaaagaattaatatagccttggatgtagcacttgctttggattatcttcataaccagtgtgaattgccattagtacattgtgatttgaagccaagcaatattctgttggatagtgacatggttgcacacgtcagtgactttggcttagcaagatttgtatacactagatcaaacgcacatcaatatacatcaacaagcttggcttgtctaaaaggatctattggatatattccaccaggtgagataagctaatttttaagttgataattctgtttaatgatacacgtggtgtctggtttctaattttatgacttctgtaaatctaaatgcagagtatggcatgagcaaagatatctcaaccaagggtgatgtctacagcttcggaatccttctcttagaaatggtaacaggtagtagtcctattgatgaaaaatttaatggtggcactaccctgcatgaatttgttgatgcagcattgtccaatagcattcacgaggttgttgatcccacaatgctacaagatgatgtcagtgtagccgatgtaatggagaggtgtgtcattccattggttaaaataggcctctcatgttcaatggcattgcctagagagcggccagaaatggggcaagtttctaacatgattcttcgaatcaagcatgcagcctcaaacatgagcgtcaaatgaggcaaattaagatttggcaatttcatgtatggaagaataatgtaatgtaacatatttgtagcttttgttttgttttctaatccaatgtagttagtgttcaaatgaggcaaattaagatttggcaatttcatgtatggaagaataatataatgtaacatatttgtagcttttgtgttgttttctaatccaatcaatgtagttagtggtgttagcattcgccacattcctcttaattcttcaaattgaatatttctaccagcacagttcaagccaccagagctcagtcgatttgcagaactagcatcagaccaaaccaagtggatttggtgtcagttagtaccaaatcaggcgtgaatccaatccagggcaaaattcgcccaatcaagagcagggtggagaggggatgcacacagattgatctcccgcagcctaatccagcccaaaatcccacaataaaccaatcagagagacgggtgaatgagcacgtacctcctagccgcggaagccctagttgccgcgacggcccgcttccttcccaatcccaagcgccgcccgccttctgccgccgcttggacctcggcaaccccagcactcggctggcactgcgccggtaaccggtcgccgcgctttcaccatgggcggcgattcgccgacgagccatggcgattgccgttgtcgccggcggggtgcgcgggtgggtggatgggcggaccacaggagtaaatcaggaaataagttcacggagatgcgagattttctaagttcccttaaccgcaaaaccagaaatcttcgcccctcaactttacaaaaccgtctaatttggtcccaaggcagtacacatggctagttttgatgatgtggcatcctagtcagcaaaaatatttaaataaatatgtggggcccacatgtcagtgagagaaaatgatgtgggcccaacaactctcttttttttttttctttttctcttctcttctcaacttctcagctctcacgtgcaggcgggaagatggcggccgacggcggagcgggcgcggttgccggcgcagcgggcgctgcggcgcgcggggaagaagcgggaaagggggagagg

SEQ ID NO: 39117 - DNA, 9182 bp, Oryza sativa
cgagcaagcggatgggcaggccgtcgatgctcgctgccgcttcgcctgcctccggaacgcgccccggaacccgccacggaacgcgcgtctgtccagccgacgcatcgcctccggcgtccgctccttcggcggcaccgtccccagctgcctagtctgcctccgcccgccgccgttgtcgtaatgaaacacccattaattagtttgcacgctgcatgcagctagctagccaaccggattcatggggttgtccaccatgccctgcccgaccatgggctggtccaacacgggaggaggccgtgcttctccagctgcccacgcagcccgacgccgctgaacatcagcagctgcaggccgctcagcatcagcagctgcaggctccccagcgtcccggtgtggtcgcgtgcgccgatgggagcaccgggagagggctcggcggcgagcgggagaatgggcagggaaggttcgagctacggcctgcaggtggctgcggccgccgcccgctgcaggctccgctctccgccgctccgcgtgcctgctcgcccgccgtcgccgctagtagccgcgctcgcccgtcgctgcctgccgcctgcttcgctctccaacgctccatctacctgcttgtccaccgtcggcactcgcagccacgcttgcccgccgctgctcgtcttgcctgcttcgcagccgccgactccgctctccgccgccgcggcgactgctgcagctctcccctctgcggcaagaaaaggaaaagagaagaagaaaggcagcgtttggctaatgggatggggaaatcatttcccacccatcaaaaggcatctttaaattctaaccattcattctctctctttcatttaatcctaacccttcattcatttcccaatctcagtcccaccctccatttcccattatccaaacacacccaaagagaaaggaagaggatgatgctgacaagtgggcccttactatttccttctcacttacacgtgggtcccacattattatttttattttttttgctgactaggatgccacatcagcgaaactggacgtctatactgcctagggactgtttttgaacggttttacataattgaggggtacacatttctggttttgtggttaagggactttaaaaaaatctcgatgttaagttgagggacctcgggtgaacttattccgagtaaatcaccatctttctgcagccaagggcccatttgccgtaaggcctagaaagccacgtcgtttgtggtggaatgggctggaacggcatcaacaactgtaggctatcggtaacgaatccataataaaaattattatagattgatattctaatgatataaattagctagacttatataatctgccctaggtactaggtacagtgaatcaggaaagtgtacataggtacaccactgaaggctactacatatggcggttgacggagagatttcatcacatagcatttattacgatgcgaagaagggaaagataacctaaagggagcggatgcacaaatgatcagcattcgtttgatctccgtattatcttacagagagcataatatcgcaagtatggttgtaatgttaactatagaataattacatgaaactaatacaaataactcaaacaaatattttactatatcatagcgaattcattccaatagttgtgatctaaattattgtttagcctaagccaaaggtggctacgacaaaagatagtaaaagaaaaacatttgcaaaaaggagtaaaggacatgagtgcgcaatatggctcccaagctagcctgccgaaaggggccaccgtagaaaaactggtcaccaacaatagatgtgaaggtgtagatattctcattggtggagaagccaatcaaatcattctctgccgaccaagctcgtccttgcccatcaatgaactgaaggtttttcgtggatactgccatattgccaccgtcaactgccatgtaaccattgcccataggaggtggaagaggtgttggttgaaaagttacattagtaactacaatgcctccaaaccacatattgatggcagagtaagatagacttttgaagaatgacaaagggatgcgcccgacgagttcaggatgcttgttattaaacccatagtgcaccaaccaatcccctgatgccatatcctgcacatcattatcaaagagaaaatagattaaacttttttttcttgttctcgcgtaggagtatcatctactgataaacaggattaatttatggattgatgaaaaccaaccttgaatactttaagtgtgatgtattgcttggctccatttggttgtgagataccagggattgggtcgccaggacgtatgtatgcgcccctctcgggtcgaaaaccagggcagtcttcgtccatatgggagggatctgttaacggagagctaagatccgacgtcttttttaaagagataaatgattatttttagtagcagcaagagtatcactaaacagaatacaaaaggtcgaatattatggatgtgtaaataaaaccacctaccttgcaatagaggtcaaaaacagggcgttcatcacctggtttgacctacgaggatagttaaacgatcaactagaaactgatgctatgatctttaagagaaaaatagggacaagaactaagaaaccttccctccaaccaatctgaaatacttctaaactggatgctggggcatcaccattatcagttatgatccaaactgaaccataactgaccaattggcctggggttaacgagaagccataaacatccatcgttgctataaatccatagcgcacttcatatgtgtttgttatgtacccagtcctctgggaaataaacaacaagttagttacataaataagtaaaaataacaagaaaattatttttcctctaaacttttccctatccctttcatgcttttgagttttgtcatctctcttgtatgccctggagttctcattttgaaccactctatccattcagttagttgaaaagcttcttataaaataattactaaggcgaaagcttcagtcatagttaattgaatgagagtcgttttacaaatcgaagataaaaattttaaaagaatcgcaatcaaatttaatgaaatttcaaagagcaaaaattcaacaaataataatttgcttttcctatgtttcctctacttagaaaccagaaatttctacttttaaaacaacttcaaccaaaattttaatatatctccatagcgagagatggtcaaataccatttaaaattttatcaattttaaaaataatttcaaaattaaaatttgcagtaatataattatctcctttgtttttaatctaaaattgtttttgccttaagaagtatacctttcaagttagcctctatgtaaggaggtagtcattaaaaaaatctaacgacaactaatggaatggggacagagtagatcaaaacgaaaactcataggtataggcatataaaggagatgataaaacttaggggtatggacagaacagcgcaaagatttcagggcacacaaagaattttctcaaatataacaccgtatggcaggcaatattaattcttgtatgtcaatctatttactagtataacactagaaagagatgactaaaatgaaccaccatatacgctctatcataactacttaaaaaattcgcaactttctgatcgtcacatccatatgtccgtgtcatgcgagcgtcttcccctgtcttcctagcgcagtcagtttccgtggcacatacaccacgcaacaggccgcaagcgatcaagcccataagctgtccgtctgcatcatcctcaaatcttaggttcctccatctcatgcgacgccctatcctattcagtctcatgttcttatcctcgcgacgcacaacatctaaccgaagatccttcaagaagggttctgctgcgtgtatcaatcttcattgcggttatcaaccaagtatgaaaatggaacagctggtaagaaacatgttccgcaagacgtcgtggaaatatgctcaggaaagcaggacatcaacgaacataatttaataaattttaaaaattatctttaaccatatagcaacacacgggccattttcctagtgagcataaatattactacattaatataaaaatagatacacgtagctaattataatgggatcagattataacgggtttgatcaattaatgcaattatatccaaactacaattatgtctatagcaaaacgtgatatgtatgtccaatgcaataatactatttgcaaaaataaatattagtcttgatccatgcaaacgggttcgtttcaagtaaagaactgacctcattacccttctcatgaatgatgtagtatccgttaacgagctctttgcagaccgctgttcctcccattgcaccaacacatttgccctgatgaaccaatcccaagagtatatatgatttgtagatagaaatataaacagatcgatactgcttgcaagccgcttccattgccaaatgcagaggaaagaagcaggaagcaggtcagaagaacgccgacgaagagaactatggccatctcggtggtcaataataataggtggtcgtagtatgattcgaggctttcgatctgtatatataggtgcaacaagcaccggtgttgtgaggaataattgtcgtgtatcttttttacatggaaggtgttttaagaaagaatatgtatctttccttcgaaagaaaagttgttcacgaaagaaaacaaactgtccttaattgactaatatatttatatatgtgtgtatattttttagataatggaaaaaattccagcatttgctttaaagaatatatgtgggtatatagactatagcaaggaaaattatagaagttcggggagctgttactcccttcctatccctttcatggctctaacatgcctcttataaaccaggccaactagctaagtggctgacaatgggaacattttttttaaaaaaaaattaagccaataagaatttttaaaaatttaaatttaaaattaatttaaggatatttttaacgtattttttttcaaaatatgtatatataatttttacttatgaattttggagaaaacatattttttaaagcgtgaagtaaataatccagtgaataagcgaaagggcttataacctagtggttacaagagcctcagtagcacctaagatcctgtgttcgactccccatgggagcgaattttctaggatttaggcgttgtacccgtcgacagcgaggcgtctgtggtaacttcgtcaacgctgtcgtttgtggtaacttcgtcaatctcaaggatttgtcggcccagtgttcgaagatgcatatagagatagggtttgtgtgcgcgcgtttataggagtgagtgcgcttgcgttgttagtatctgtgttgtactgtgtaattctaaaaaaataatctagtgaataagctaaaaagaaggcatttgtaagttgtgacgatgcaaaggaagggagataacgtagaagagagggatgcatgcatgcattgacatccattgatcctgcactatcttatggtcagcttaatatggaatatcttaagtattaagtacaattgtaatgtttaacagtgttacggataagacatatctcctttacgtggatttatagtgtacggagatactacatatctaatattatacggaaaagtatattcaaatatggaaataaaacgagtcaaaaaggaaactactttcatgggaatagaagacttaaaagtctgactcggaaaaggcaaggtcttctcggcctaaaagtctgactcggaaaaggaaaggtctcctcagcccatatcctaatatggttctttaagttctacttggagaagaagacgcccgaccatataaatataccacctcctaggaggagagagcatcgaatcacaaccttaactagacccacattaagatacagccaggaggaagacaagccctaatcattgacatctactcatctagacatactcgacgtatcctagttggcgggttagaatagctaacttgctcccactgtaatcaatatgatactctccacacacacacatactcacatacatatatatattattgtgaaggaaaagaaagattaatgcatcataagtgcggcgcccgatcgccacgtggacattccagatcaatccaaagggatcagacggccacagcaagaaaagtccccactggccattccaaccaagaggtggcggcacatgaagcctgatggtcgccgacgacgaccatccaacacgagagtgggatgcggcgaaggaagctagggagggagaaggagtgcttaccgagcgcatgcgaggtagataggacgaagggagcacgctgatggcgaaggccctcgggttggcgacaatggtagcggtacggttctagtctgcgagcgaggagtagtagttgggtgcctcttcatgctgggcacaagaagaggggttaggggatcttagggtgggtagaaactgcggagaaggacgaccgggggccggtaccgaggccggtgctcaccttgctcaaagaggatggagtttcgattgtatttggcgaaggcaaagaggcaccgaggtacgtggagagctttcgaagccagcggagcaggcagagcagcctgacatggctctaatcgctagcggtagatggctggaggcggcaatcgacagtggtaactcgggctcatggagaaagaggcattctggtggcctctgacttcaaagcaggggacaccagcctacggcgtggcacggctagtcacagctgcaagaggcagctggatgcggcgaagctcacatgacgtggtgaggagaaggttataggcacggggagctcgagcgcgagtaggaaaatgagagagggaggtggaagggccttgatgtggcctagagggggagaggatgaataggttgtcacgcccagaaatttaacccaaatttccagactattttgcgtattaaatccctgtccaggaccagccagggtacacaaaacgacaagtaatatacagttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaattccatcttcagctcagaagcactacacttctaaaaagggggaataatagcaaggctgagtacaaccaccgtgctcagcaagccacaccaacgatgccgacgtgcaaggggatacaaggaggggtttgtggctatttgcagaaaggcagttgtaaaacactttattgagcaaaacagtaaaacggttgggtaattaaagtaatattgaatctccactgatcaacgctacaccacgttgaacaggcccaaccaacccatctgaaccacagtgtattgggtcgatttattaagatgggactaatcacggtgaatctgatcgatcgcccataaccgcgggcacggctattcgaatagttttactctggccagaggtgcacaactgtacccacaagacacaacccaccgacatgtcaccgcgtcatcatgtgcccatgaagcacacgtcaccatgtcgagtgattgtgacgagatccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggcaagcgctgtaagtcttacagggtttcccgtgaaccggtccttaattgccatgggtgcgactcacaaaaccatgcacccacagcccaccattcagttgcattttagttggataattacgaccatgaaacatggccagatgtcacgagcacgcagctcaacaagatactaggatgtctaatactgcaattatcccatcgactgagctagtggtaattaagcatggctaagcatatagttctagctaggtcacataagtaacacgagctagtcaatttatcacccaaggttgacaaaggatagatatcaagtaaacatggcacaagcgagcagataggtaaaccctgaccccgtgtaattagcaaaacatgcatatttatttgtaaacggtaaaacatttataaattgggatcaacatgctcaaggggaatgtgtgacttgccttgcttcttcacttggattttctgaactcttttcctcgcgaccgcggacttccgaaacgacggaaactacacgctggcacgcaaaacgaggaaaaactctaataaaaaccaagaaaacagtacataaaaagtaaacaaacatgtagagcttaattttagatgaattttgcaagttgaatggctcaattcggagttcgaatgaattagatatgaattttagaagttttgagccatttaaatgaatttctagaattaaactcgatttattgcgcaattattatttatttttccaaaggaaaagagggttgctgacgtcatcaacggggagggcggcgccggcaagcgggccccaccggtcagcggcacaagggcgccggtccaccgtggaccgggaccaccgaggcggatcaccgccggtccacgggaaccgacggcccggatcggcccaaagccgatcggacggccacgaggcggcgcggctgggcacggtcacggctcaaaccccggcagccgagtgatggcgcacggcagcgcggccaccggcgacgacggccgacgacggcgcggggagcggcagcgcatgcgggcggtggcggcgcacgctagggagcggcggcgcggcgcggtaaggtgaggaggcagccggctgcccggcacagccggcagcggcgcggagcgcggcggcggcgacccggtcggacggccaccggcgacggcggcgcgtcgcgagcaggcacaggaggtggccgacgaaggggaggaaggggagagggaggggagtgctcaccgagcggcacgacggcaaacgggcggccgacggcaaggaacggcggcggcgaggctcctcgggaag

SEQ ID NO: 39118 - DNA, 4666 bp, Oryza sativa
tgggaaaatgtatgaggggaggccggggtacacttttataggccccggagggggagatcgtggccgagtgggccggcaacggccggcgaagtggcgaggcatcgtgggatcgtggggggcaatactggcgccggtttttggggaaaaacgggggaggaggtggaggagaggtgtggcttccggtcccacgcgagagagggctcgaggaggccgggaatggcggtgacgtgggcggttttcggcggccatggcggcaacggcagctgccgacctgaggttggggatgacaggtggggtccacgggtcccacctgtcggagagagagggagggagaggccggctggggaggcaaaacagacttgagggagagagagagccgagcgggccgagggagggggccggcccgagagggagagaaagggggcgcgcgggccgcgggagagaaaggaggggttgggccgaaaggggcccaaagagaggaaggaggattttaattgttttctttttattttaattgatacaatgatctttgtgctattaaaactatttctcgagctccgaaaatttgcggaaaaatccggagagtattttagggcacaaagaatattacaaaatattcttggccaatgatttttaattccctcaataattcacttgattaagttgatttaacttttatttaatttctagaaaatgcattattaattgatttttaaacccgaacgaaaatcggggcgttacataggtgttcctaaaaatattataacttcatagcatattagaataaacaaaaatttcggttcaaatcagaactttcggtatgggatcagaagttctggtctcaaccaaaatgttcgatggataaaacataatctatgaaattgtagctcaaatagacaatatgtatatgaaacaaaaggtgacaaacaagatatctaaataagatatatggctaccaactagatcaaataagaatacaaatagaccgtgcaaaaataagcttaagcataatattagtaaaggcaagaaagggcaaaccaaaagagaagacatgtgatttatttcctgatgttcggatctactgttcctacgtttttgttgagggccataaaggctaggtctctttcaaattttacactcctagacttcacttttgatttcttccattgcaaaggtggaatcgaaaccttcacaatctttttgtggtacaccacaaccttgggtgctcaccggtgacacctagccatctaggaggccttagtctccaaaagtaatgaattcaacaattattttttggggacgaatctagagttatttagatttatcgaatattttactaggggtcatgcatggtgatgtaaattttatatatgcatacatgactatctgagaagttcaaacagaggcaatcaagtaaacacgttaggtgaagaaagtaaagctaacaacatggtcacaactcaacctcgccaggaaacgagctcaatcggccggcaacaaatacaaacctatgaaaacagaactacaacgataataatgtttgattttaaaaattctaatgataataaagagtaggggtgacaggtgggctgtaaaggaatagtgtggcataagttgaggtgacttctaaaaactttaaaaacgaactccaatgatgattaggttcgattttttaaattccaatgaaaatgaagatatggaccatgggcggcggtggttgacgcaacttataaaaactataaaaacgtaaaccctaacgagaatcaggttcaatttattctaatgataataaagaggagagacgacaagctgattgtaaagtagtagggcagtgtcgattgacggaatctccagaaactataagacgaaacaagagagaggaaatgtttgatttttaaggtcacaagaacaataaatagaaatggtggcgagccagacaagcagtggagtagcaatggttggtgtgacttcttaaaaactacaaaattataaacataattatgataaggtccaattttttgaatgatgtgacaacgagttgactatttaatacattttaaagaaaatgatgtctaaatagatagataattttgtatcaggtgatataattacgcgggccaccatacttttttccagggcctgcaaggtttacagtgtaaatggcataaatcacgggagctccttcttggatgaagcagatagaccacgaccggagcttccatcctcttctaccggacgagtatgagaaggatcgtccttagagctggtgactttgtcatgtacgtcgccggcgatgccttcattctctgtcacagcggcgtggagattgtgcgagggcgggcctgggggctcaatgggtttctcaggaccttcgtgaatgggctctccagaaggggaaaccccgtgttgaccatccgatgcaactgcaacaccaaggattcactgattaaacatgaaatcaacaaaagaagtaaaaatatatatatatacggacgctcatgtgggatatcatattagagctccaaaggggacatataagtatttgtcgctttttaagatgcgataattaaggatttgtcactcactgtccatagcatgtgggtccagtggtaaatcctttttcaccacttgtaagggttgtcagtatcccgattcgtatcgtagtatcttacgatacaacgattctaccaagccgaaacgataccgattccacctagtatcctaatttttatagtatcgcgatcctactattcattactacacgatcctaagaaatcttagatggtatcctaattctacgatccctacgatactacaaaatattatttaaaataacatggtttgaaaataatgtaaataaatatactcaaatttgtataaaaatcagttaaatatatccaaaccaacgtggtttctcttgataaatatctctatttgcatgacatatatcattacgacattttttatatagattggctatatataactaatataaatattaattaaccttaaaaaaaatctcataatatcccgatactacaatccgatactactttgagtaaaacgatactacctggtatcccgatcctaacaaccttgcttgtaaaaagagtggcaaatagttaattatttcctccaaaggtgaagagaaaaaaaatccagttacagtactgaacatccagaaggagtacctacataatctctccattccaaaatataaagtaactttaaaatgatgttaagtcaaatatttttgactttaactattaataacaaaaatataaaaaagatcaatcatgtgagaatgatgttactagaattatcactaaacaaacaacataaatatgttactctatttatttaaaataatatatttttataaatattatcggtcaaagtagtatatcggagacagtgataagtccaaaaatatttgtactctaggacgaaggcactaactatataaatttactagaccgcaccatgatgccacgggaaggtggcatgcaaaattgtattatatgacttctcgtgatgacttcttcttatagttatatagacactaagagtgacatcgatcatatatttataaatatatataccccatccatctcaaaatatatattagcattgattttttataacgttgaaccattcaccctattaaaaaaatataagtataatttattttgttataacttatattttcaaaaagtttggtgtgatggcatgaaatgaggctacagcggcgtgactttttcgaaaacatcacagagtttcactacatatatgcatagatgcatagtttgaggaaaacttcagtgctacaaagaaataaacataaaactattatacagagaaaattatatatgcactcttccttttttttaaacatctcttgtgtacgtaagtacatacgtacatagagaggtattatagttcgtttttagatagtatatatctaatctaatggtttaatggttgaaagtaatggatgtactgatttaagtgtaaattgatggccatatatttttttcttaatttttttctaattcattagatctatcatgtgacatcttaagtgtgctggtaaaagtgtagaaatgtattactgatactgaccatctgtttgtagtcgactattgtttgttgtggtaattaggtgacatgctctactttacctactatttgttgatagttcctcacttagtatagtttgttaactttggtgcttgatgatataagtgctcgttggatttcagctaattattaggtgtggcttgccaaatgctggatagaacttacatacttttggattagtggtaacatacgattgatatattaggctaattcttattgacacggactattatatagtactacatattaaacgttttagtaaataagcaattagttctaaagtagtattcgattggctgctccttattggttgtaagcacataccccagtgatcgacccattgatctagaaattattacaaaagaaatatctttttataatagtatcttaatacaatccatccactactggagaagtgctcatctctcccggttcgcaaccccctttactcccgggtagcgaaccgggagggagaatccagaactaaagatgggtatatttagtcccggttgataacaacaaccgg

SEQ ID NO: 39119 - DNA, 9704 bp, Oryza sativa
  unsure (1)..(9704): unsure at all n locations
atgatcttacctctaaatatttaggctgggacttaaccgatcagagatgggagaaaaatatttgctcccggttagtaacttcaaccgggactaaatatagatctttacttctgggtgttactaccaactgggactaaagtgataatctttagtcccggttagtagtatcacccgggactaaagatccttggtcccctgacatggctctgacagggtataaatcgggattaaagatcaaaatttttataaccgagactaaaaacaatttttagtcccggtttttactagatctgggactattgtagaaatcagccgaccgagcaaagatcatttctccagtaggatctgagtcattctattcactataattaaattaacaatcataacctacatcgtatatatttaaatgcaacgtgcgtattactaaaatatattttatataaaagtttaaaacaaatcaattaaatatattttcagctttataatattttatatttaattaatcttgcactaatgacttgcgtcatttcatgtgtcctggataagctcagtcatagaactagatcaaacaaagcctaagtagaagatatatgacatcggtatggtgtgaaaagaatatatacgatccttaatttttaaaaattatactaatagagaaaacacataatacatgaaaatagattcatgataaatttaatgatatcattttgacatatcattactttttacgtagggagtggataacttttgagaattgctagtatcacaattagagttgtttttatttttaaaaatgcaagtataatttaactattatataatatatatagttaatttatttttgtttttcattggtgtttcgacgacatgcgcctaattagaaactcaaaattacgtatatttgtacacgtaataaaggcatagttaatatgggcagtttccagttccaagtgagaaagaaaagaaaaaaaaagaaaagaaaaataatgtcagtaattcgcccggtgtgcatacgtacgtacgtacgtttttttaaatacctactaacgtacttatgtgcacgtacggcaatttaattggagataaatttaatcggtccaccatattaaatgaaaatcgatggctagatgtttttttagacattctataattattagaacgccacatggcggtctaggagcgtttttaggggtcctatgtagcggcttaggagggtttgtaggaagtttaatggacttttagtatataataatagaaatagaagatagatagataatagatagatatctcctagtttttcaaggtatctttaaatacggggatccttcatactccaccattttatacgaataaagagaaataacaagtttatatctactaccttgacgtgttcttattctttgatccaaagaaaaatcgcaaaattctaaatgtcaccccaaacttgagatcctccctgtaagattatttggtggtaatacccgtcttctaatttatcttggtttgcgacccaaaccaaggtaataaatattggttattttgtgacccgaatcaagcataccactaaggtaaattttgctacaggatatttcaaatttgtgcattttactggtagaaaccgtaaaaatgtgtcatggctagaacacccttaaaacctagtaatttgctagagaacactctcgaatcaatcagagagaaactcttcaagatgagaatgcccctagggacaaaagcttgaggctggagagaagatgcaatttaatataagctagcgatttacttggtatgatggcagatttcgagttgcacaattttcaaatttttttttactccaacgctatgtttaaagcatatggcccgggggcattctcatctatttgaataatttctctctacaattgagatgaaagtatcctctagcaaattactaatttcctaggatgccactactacctaaaccctcatacgggacaacttaatggtactggtttatctaaaaccgacacttatgatcccttcccacccctcgaacgtgtctacaattaaaagccaacatctttgatccctcataagtgccggttcattaaaaaaccagcactaataaaaatcaacacctataactctgctataattgtcgattaatagaaaaccggcatcaataattattagtattggtgtttttgaatggcgtgggtgtgagtgcgaccatgagaggagagatcatctttttttgtttaagtcgccgtttccactgagtaccctcctctccccatcattatccactccaagtctcatcacctctccgtctcgaagacctctacggcgtgggttgggagagggggaggaggggcccgccaacgatctctccagcgcaggcggcgtctgcctcttcttcaaccctcatccttgctcgcctcgaccaacacgcctcctcttctttgttgtagccgcgcaccggtcctcttcacccacggcgctcctctccgccgatgcagctgtagccgtcgatggtcctgttcatccatggcgtctcctcctcttcaccactgcagccactgacaacccgcatctcctcctcctctcttggggctggtcagatccatcatgagcacggtggctggaggattcatcgctgcgaccacaggcgacccgctcaacgacggcagcaacggcgacggtggtgttcttctatgtgtgattttgatcttctctctttctgtagactctaggatagcattgaatgttgattttgtttttcaatgttgattttgtgattgtgttaccggggtgatgggatgatggtgatctcagtggtgatcgggagctgctcgaagcatcgacttgaatcgagctagccttttttttttatccatggaacctcaaaggtgccagttctaaaactggcacctttgtttctcctcatcagtgcatcctactaggtatcggctaggaaatccaacacctatacatggcggtttaccagtcggcaccaatttactttttttaaagtgtcttttaatcattacccgttttttgatatctaccaacaaattacataaattttaggtgttctgtaccaaaaaccttggtgctatggttgattttgggttgcagattaaacaatatttaactgcagcccaaagaggagagtaggttgtcatatgggcctgtttgggggagcttctagcagctgcagcttctactagaatctccagttgtcagaagctcccccaaacagtccagctttttacccagattctgagaatctgtagttgtagaatctgaaaaatgaactagaagccagaagctgggttttccagcttctccagattctcaccagctagcttctcagcagctgcttctcaaaatcttaagctccccccaaacaggccctatcttaagcttctcagcattgtagcgtgggtgtggtccagatttgttgagcgagatattttatattttgacactctagaaaatgagttttgataattttatacaatggcccagtcatagactgagatggccctacttgtcatcgtcacaagtgttaattttaatggaagtaacaattagtaacgtattgttattgaatggacaactacgtcacgtcgaaagacgtggttatctcaactgtggttggaaagggaaacgattgtattacttagtgaaaattttttggatccccctattacatgaccctagggggctatttatagccccattacaggttctccctcttagggtttaggttttacaggggaatttacatggttacccttatgatagggacattattaggggtacacagtgtcctttacatgtttgggcccctattggcctaggtagcttggcccattcatcttggtgaagccctccgagagtgcgatggcccgctgggccttctcatgtgtggtttgatgcttggcgaagcctatgtcttcgccccaaagccttcgcacgtaccgctttcgcccgggtgcccatccgacgaggtctcttccagcccatacggttctctcttcgaccttcgccgcttgcctccggtctgagcttgttgcctaagctttttggtttcggtaggtccggccgaaggcccttcgtggtgtacctccaacacgtatagagcgtcgaaacatcaaattttattttgttgcactggtggagaaaccatctttggtcggttgaccaaatttcacaatagtcccggttgtaataaaaaccggactaaaaattatttttagtcccagttcaaaaggttagagctacttttttatctttagtcccggttcaaagaacaacaggagatgttagacccctctattatctttagtcccggttggtgttaccaaccgagactaaagatctatttttagtcccggttggtaataccaaccggcaaaaagatcagcatgcgcggcggagagaatgaggcgtgcgagagatcgaggaggtggaggcgacatcaattaataagttctatctcctcctctctcaccttatctcttcctcctcttcaccccatctcttcctcttcctcctctcctcattctcttcatctcctctcctccccattgcggcggcggctgggtggcggtggatccggaaggggaggcgaccggccaccgccggatccgaagggggaggcggccgggcggcggcctcgcgtgaagggccggcgcggaggccggtgcggcggcacgcgatggaggccggcactgctgcgtggattttttttcttttttccttaatgtatgattcgttctgtgttgaatgtgtgattcgatctgtgttgttgttgtgaatgatttggggatgaactattatgcgaatgatttgggataaactattgcggtgaatgatgtaaatgatttgttgtgaatgtttgatctgatatatttggacaaagaacagtgaaaaagaaagagagaaaagaaaaaaaaaacctccagtcaggactaaactaaagatcaatctttaatcccgggtatttgaaccgggactaaagatagtgatctttagtctcggattcttactgccggttggaaaaccaggactatagagggttaccgaccgggagtaaaaagggtttctccaccagtgttgggctggttttttacgagccagatcggggttgctattgacgtcaggcccatctcagaaacacacaaagcgataatcctttttatttttttcaaatgctctcgcagacagactgggcaatggccggcggcttgtttatgatttttggttcatccgtacgcctcaccattggctgctcccaacctcctcctgcctctcccttcctccatcggccagaggaatccagcgagggcgttgcgggcggcgcggtactggcttcaaatggggatttagggcatccctcgatgatatatatggtcagtgaatcatctctcatgttgcaatttttcccctgccctgtttctacacatgttaagtttgctctagattttggctcagttcgattacagcttgctatttgggattttctctaaccagcaaacaaaataaaactggcatcttgtgtttgaagccatgtgaaaaagagacaaaaaaatctgtatcaaacacgcatcaattagaacatatagacaactaagcttagccggatagagaatttctaatggtgatttttattccaggatatgcttaattgcttaccacttctattacacgataaacccaaattgatagctaaacagatttcactacatgcaaatagttctcgaaggaaaacaaattcctgtgaagctaaaggatatgaaagcctatgccattatgcaccgtagtaacatatggacatcagtaacaatttggtgttggaattaatgaatgggccttagcccactcgaagattaattctttggaaaatcacaaaagcccacctcatgggatggcatgcatgtggagtttagtaccaccttacttattctaggagagggggacctccttaaaagggaggatgtcctcctaaccacttgaagcatgtgtggtggagagaagaggggaaacacacgcgcgcgctcgctcgcctcgcccgggtagggcaggcggcgcgcgtgcacgacgtacgcgtcgaatggtccgaaaaattgactcctcacccttgcgcagatgcagcctccttttgcagttttgttttgctgcaaattcggatttgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacctgccgtcttcacgcaacgattgcgaaatcaatctagggtttgcctcctactctgtactgcgccgtcgctcgtagactactccatcccgctcgccggcgtgcaccggcgatcgggagagcaggtctccggaacctctgcctttgacgtcctgcaccgggagaaggcggcaataaggttttttaggaagcgcttcgcgcgactgctccctgtttgttcgcgacggctcgccttcctcttcgctcgcgtgtttcatgtcttcgtagacacctgcgaaaagtttcgaccaagcaaccggtctttccgtcacctcggtatgtgttcaatatgttgcgcatatttgatctgttcatgttatactgtgtagtttacatgtatagatctaatgatgcgttcattctagttttcatctgtaatatcatgatttatttatggaatagattaaatcattatatgtctataatctcaacaatccaaaaaccttattataggcactgtgattttactatggctggttttgccgatgcactgagaccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaagatggctgacaaccgttctgtagtcgaacaggctcatgagatagaaaccatggctaaggaactcgaactccttaagtgtgtcttacccgacaaatttgtggccgggtgcattattgcaaaactacctccatcttggagaagtttcggtactgcactcaaacacaagagacaggaatactccgttgaggggttgattgcgtctcttgatgttgaggagaaaactcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctagaaagtgtccacagcgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaaatagtcgtgtctaaacatggatattttattggtaaaggttatgagtgcggaggcctgttccgcttttccctttctgatttctgcaataagtctgtgaaccatatttatggcactgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacagggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgagaaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagaattcctaacagaaataaggacaaaacaccatatgagatatggattggtagaaaaccatcactttcttatttgcgcacatgggggtgcttggcgaaagtcaatgtaccaataacgaagaagcgcaaacttgaacctaagactgtggactgtgtttttctgggatatgctcatcatagcattgcctatagatttttaatagttaaatccgaggtaccggacatgcatgttggtacaattatggagtgtcatgatgctaccttctttgagagctttttcccaatgaaggatatacatagtggttcgaaccaaccctctgaaataattcccagttcaatcacaccaccagaacaaactgaacatacacatgaacttgtctctgaggaggatgtcagtgaagctcctcgaaggagtaagagataaaggacggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaacctgtggggtgcaagtgggtgttcaagaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 39120 - DNA, 23005 bp, Oryza sativa
  unsure (1)..(23005): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccttgcaaataatagcttatgtgggcccattccattatttggatcattgcagaatctgaccaaacttgacatggcatacaacatgctagaagcaaatgactggagctttgtctcatcactctcaaattgctccagattgactgaactgatgctggatgggaataatcttcaagggaacctaccaagttcgattggtaacctttcgagtagtcttgagtacttgtggctaagaaataaccaaatttcctggcttataccaccagggatcggcaaccttaagagtttgaatatgttgtacatggattacaattatttaactggtaatataccaccaacaattggatatttacacaacctcgtattcctgtcctttgcacaaaacagactgtctgggcaaatccctggtactataggtaaccttgttcagctgaatgaactgaatcttgatggaaataacttgagtggaagtatacctgagagtatacatcactgcgctcaactcaaaacactcaaccttgctcacaattcacttcatgggactataccagttcatatcttcaaaatcttttctctttctgaacatttggatttgtcacacaattacttgtctggaggaataccacaagaagttggcaatcttattaatcttaacaaacttagcatctcaaacaataggttgtctggtaacatcccatccgctcttggtcagtgtgtgattcttgaatctcttgagctgcaaagtaatttccttgaagggataattccagaatcttttgcaaaattgcaaagcatcaataaattagatatttctcataacaagttgtctggaaaaatcccagagttccttgcgtccttcaagtctctaattaatcttaatttatccttcaacaatttttatggaccacttccaagttttggtgtttttctggacactagtgtgatctcaattgaaggaaatgatcgtttatgtgcaagggcaccattgaaaggtatacctttttgttctgcattggtggacaggggaagggtgcacaggttattggttctagctttcaaaatagttacaccagttgttgttgttgttatcaccattttgtgttttctaatgattcgttcaaggaagagagtgcctcaaaattcgaggaagtcaatgcaacaagagccgcacttgcgactattcaatggggacatggagaagattacatatcaagacattgtgaaggccacaaatgggttttcctccgctaatttgattggatcaggatcatttggaacggtttacaagggcaatctggaattccgacaagatcaagtagccatcaagatttttaaccttagcacatacggagcacataggagctttgctgcagagtgtgaagccctaaaaaatgtccgccatagaaatcttgtcaaagtcatcactgtgtgctcttcagtggattctacaggggcagaatttagggccttggtatttgaatacatccaaaacgggaaccttcaaatgtggttacatccaaaggaacatgagcatagtcaaagaaattttctgacattatgccagaggatcaatatagctttagacatagcatttgctctggattatcttcacaaccgttgtgcaactccactcgtacattgcgacttgaagccaagcaacattcttttaggccctgacatggttgcatatgtcagtgatttcggtctagcaagattcatatgcacaagatcaaattcagatcaagatagtttaacaagtttgtattgcctaaaaggatcaatcggatacatcccaccaggtgagatagcttttttaaaataaagttgttctttttttgtttttcttagacccatgcaaaacaatttgctgtgcctattatctaattttatacttatttttaatttaactgcagagtatggcatgagcgaagagagatcaacaaagggtgacgtctatagttttggagtgcttcttctggaaatggtcacaaatattagtccgacagaagaaatatttaatgacggtacaagcctgcgtgatcttgtcgctagtaactttcccaaagatacattcaaggttgttgatcccaccatgctacaagatgagatcgatgcaactgaggtgctgcagagttgcgttattctgttggtcagaataggactctcttgctccatgacttcacccaaacaccgatgcgaaatgggacaagtttgtactgagatccttggaatcaagcatgcgttatcaaagatagatggtgaatgaagagaagagaaacatttgcattgttggcgcgagcaccagtccctgctacaacagctgtgagcgcaaggggaaaggtgactcaggagcgagcacagcctaggatgacggctatactagaagaaggaagagatttgccaggattgtagctagcaacagagatggatgtaaagaagaataccaatgtaccatcttatgttttcccccttttttcagtccatttccgtttgtgacatttgcagaaggaagcattcatttgggcattagcatgtctcatgtgctgtgtacatccaagtggatgtagaggccgggttatttaatctattatcttaaagattagcaatgtctcatttttctttaattatcgtgagtgggatattcctaaaagaacaattccaagcggttagagcgcaatccatctatgcaattggtatccagacaaagctaattaatcagatgtctacagaatctggatttggggactaaacctcgaatccagacatgaaattcgcttaatcggaagaggctgcgacagcggaaccctacatggatcgatctcgccacacgtccggatggattgacaggcatacgtggggttgcgcgtacctgctactctcggagttcgagctgccaccgagcgccggcgttcctgcggagggagcccggtccgccggcgtggggtcgtctctgtctctcggcttggctctatctgggcttgattaaatcaggggctatcatccagtcaaataatggaaagaagtccaccttctcgactgcttcctcagttcccaaaatgtataactaggatgaggttctatccagatctgtttatcttaggatggattaaatctcgttgtagttgtaacatgttgtggtggtcggccggtggaggggcgccggcgcggtgtggtggaggcctcgtgctgatctgcttgtcagatggtttctgagttgatgggcgatggatctcaagcaaggttgaagggtttccgggtgaaagcctcgcctgatgattcatcgggctggcagcgtctacgcttttgggcgtcgtaacccccttgagggcgctggcaaggatacctttctcccttggctagttttctctaggtgaaaaccacatctccttagatgggcgatggcggcatccttgatgtcgtgacctccttggaggcatcgcttttagagtctcgtctttgtggtgttgtcgttggcccggcggcgatcggccacaaatagcgggggtcatctcggtgctaggtttttctctcagtgggctgtgcttgtgtgattagcatgtggctttggttatgcatttcaatgcacctccgacctcgacagtctctgtccagaatttttttgtaactttattccttcttaatatacttggatggcctccttcagccttcccggcgaaaaaagttgtaacatgttggaatggaatcaagtagtacgggttaagctgtactactagtatttgtgctactcagttgctatgggctgagttttatttgtgctcctcagctacaatatcgacctctaaaatcgatatttatcaactccctcgatagtaacttttataatgtcacaatcttattactatatgtatatgaagttattgtaaaaaatcattatggataaagttacaactcaaagatcgtaaaaagaaaaatcaaatgccatatatttgtaaccggcggaggtcgtactttgctgctgatgcggtacgaaagtagtggtcgctggtcgccgactcgctacatcagcgctagctgaagatatcacataaaaatcaatacagaagaagtgctgaacaatctgaggcatgtagagaggtatactttggcaccaactggctgcactttattgatacaagacaattgtctacaattgcacagcctgatctgcattatccctagcagtaactagcctaacgccagtggggatttattccctgatcatagtgtctgaaattatctgaaacaacatcacaatctcacggtgcacagtacacgtaaggcagttccggacattcgatgtaggagaacggttttaacacgtccctgtgcccagtgtatttaatctttacccccgggaagtggatgcccagaacccatacgctcctctttgctaggatcgatcaccggaactgcatcacataagcatgtagtggtgaactactgactagcagaaatcaataacaaaaatagaccaagagcagcaatacacatgtactccatatatttgcagaaaatgtagaaacagttttgtatggggtgttgttagataccagctggagaggcttcttgagacttggcggccggagcagctggaagatcactgcctggaacgggcaccggcgtcgcagacggaggatcaccggatgaataggccaccggaatgggggaggcggcggagctgtcagccattctcccgatctaggtaggccggtggaaactggagagcatacgctgttcagcgatgagtgcatccagaatatatagcccaagggtgcgtgagtgtgtctttgcatggttcgatatagagaggatactccctcattttttttttaaatagatggtaccgttgactttcagcacgatgtttgattaaaacaagttataacaaaaataaacgatacttgtattagttcttttaataagacaaatagataaataataaaaatataagaagttttggttagatgtgacacatactatgatgggatgtagaagggagtatctatttatgcttcaagccttcaagcacccgtccaatggatgtcgaagaatcacgtgcgctgatatttttcttcaggaaataaggtgtgcgtttacacctgtacacggaataatagtcgtggttgaattttcttggcaagatggttgtggcgaacctgaagagtcaaaaaaaaccattgtgtgaaagatgtagcttcagaaactctaaactaagggtgtggttagttcgcgaaaagaaaatttttagatgtcacatcggatgtttgaccagatgtcggaagggattttcggacatgatgtcggaagggattttcggacatgaatgaaaaaactaatttcataactcgcctggaaaccgcgagactaatcttttgagcctaattaagccatcattagcacatgtcggttactgtagtacttatggctaatcatagactaattatactcaaaagattcgtcattcgtctcgcgattttcatgtaaactgtacaattagtttttgtttttatctatatttaatgctctatacatgtgtccaaagatttgatgtgacgtttttgggaaaaaaaattgggaagcctgaatgaatgcatatgttctgcgagtgctctgctaaaaggttcagcaactttggataaaaaaaaaaaaggttcagcaactgcaactttccaaatataaaaagcgaccagtctagttccagtgcatctcacttctcgcacctcgctttcagtttggtccatgcccttccatccaaccaagtgaccaactcaattgcaaggtgctttcctgacaagaagatgtccatccatgttgtaataagcgttcacaaaaggttttcaactttgaacaaacactaggtagtacatctgtttatcttcctagttccttgccaccatatattggactaacaattaacagtaccatttttgaacaaccattcgcacagaagatctcttctcagacggttgtaatcgacagcaatggcctcttttagtgccttatctcaaaatgttgcatgggttctttatctctgtaccttcttttgttccatattgttagccatctgcaatgaaactgaatatgatagacaggccctcctttgcttcaagtctcagctatctggtccatctagagctttatcctcatggagcaacacatccttgaatttctgcagctgggatggagtcacctgcagtgtgcgacgtcctcaccgtgtcattgcaatagacctcgcatctgaaggcatcacaggtaccatatcacgttgcatcgccaaccttacctcccttacaacgctacaactgtcaaacaacagcttccatggaagcataccatccaggcttggcctactgagtgaactcaacaacctcaacctcagcatgaactctttagaaggtaacatcccatctgaactttcttcatgttcccaactagaaatcctaggtttgtggaacaattcaatccaaggtgagatcccagctagcctaagtaaatgcatacatcttcaggagattaatctcagcagaaacaagttgcagggtagcattccctctacttttgggaatcttcctaagctgaaaacactggtcctcgctagaaacaggctcaccggtgacataccaccatttctaggcagtagcgtttctctcagatatgttgatcttggcaataatgctctcacaggaagcataccagaatccttggcaaacagttcatctctccaagtacttagactaatgagcaatagtcttagtggacaactcccgaagtctctattgaatacttcatcgcttattgccatttgcctccaacagaatagctttgttggttctatacccgctgttactgccaagtcttccccaattaaatatctcaatttaaggaacaactatatctcaggagcaataccttcctcactagctaacctttcttccctacttagccttcgccttaatgagaacaatttagttggcaacatcccagagagcttaggtcatattcaaacactagaaatgttggccttgaatgtgaacaacttgtctggcctagttccaccatctatctttaacatgtcgtccctgatatttcttgccatggcaaacaactcacttacgggaagattaccctccgatataggctacacacttccgaaaattcagggcttgatcctctcaacaaacaagtttgttggcccaattccagcttctcttctcaatgcctaccacctagagatgctttaccttggtaaaaacagtttcactgggctcatcccgttcttcggatcattgccaaatttaaacgaacttgatgtgtcatacaacatgctagaaccaggtgattggggcttcatgacatcactttcgaattgctctagattgactaaactgatgttagatgggaacaacttacaaggaaatttgccaagttcaattggcaatctttctagcaatcttgaggcgttatggctaaaaaataacaaattctttgggcccataccatcagaaataggtaatttgaagagcctcaatagattgtttatggattacaatgttttcaccggtaatataccaccaacaattggaaacatgaacagtttggtcgttctatcatttgcacaaaataagctctcaggtcatatccctgatatttttggcaacttaagtcagttgacagatctgaaattggatgggaataacttcagtggaaaaatacctgcaagtataagccagtgtactcaactccagatactcaatattgctcacaactcattagatgggaatataccaagtaaaatatttgaaatttcttccctttctgaagagatggacttatcacacaattacttgtctggagaaataccaaacgaagttggaaatctcattcatttgaacagacttgtaatctcaaacaacatgttgtccggcaaaatcccatcctcccttggccagtgtgtggttctggagtatctcgagattcaaaacaacttctttgtaggaagtataccacaatctttcgtgaacttagtaagcataaaaaggatggacatatctcagaacaatttgtctggaaatattccagagttccttacatcattgagctccctacattccctcaatttatcttataataattttgatggagtagttccaaggggtggtgtattcgacattaatgctgcagtgtcgcttgaaggaaatgatcatttgtgtacaagagttccaaaaggaggtattcctttttgttctgttttgactgaccggaaaaggaaactcaagatcttggttctagtcctagagatactaataccagctattgttgttgctataatcattctatcttatgttgtgagaatttatcgaaggaaggagatgcaagcaaacccacattgccaactaattagtgagcacatgaagaacataacatatcaagacattgtaaaggctacagataggttcagttctactaatttaattggcacaggatcgtttgggacggtttataaaggtaatctagaacctcagcaagatgaagttgccatcaaagtatttaatcttggtacatgtggggcacaaaggagctttagtgtggagtgtgaagccctaagaaacattcgccatcgaaatcttgtcaaaatcatcacactctgctgttcagtggattctagtggggctgactttaaagcccttgtgttccactacaaggccaatgggaacttggacacatggctacatccaagggcccatgaacacagcaagaggaaaactctgacttttagccaaagaatcaatatagcattggatgtagcatttgctttggactatctgcataaccaatgtgcatctccgatagtacattgtgacttgaagccaagcaatatccttttagaccttgacatgattgcgtatgtgagcgactttggcctagcaagatgtctaaacattactgcaaatgaatatgaaggaagttcaaaaagtttgacttgcctaaaaggatctatagggtacatcccaccaggtgagataaccatattcataatggccaactcatttgttcttcatataattctgagactggacatatatatattctctaatttattgcattcataaattaaatgcagagtatggcatgagtgaagtgatatcaaccaagggtgatgtctacagcttcggtgttcttctattagaaatggtaacagggagcagtcctacggatgaaaaattcaataacggtacaagccttcatgaacatgttgcaagagctttccccaagaataccagtgagattgttgatcccacgatgctacaaggagaaatcaaggtaacaacagtgatgcagaattgcatcattccattggttaggataggtctttgctgctccgtggcatctcctaatgaccggtgggaaatgggacaagtttctgccgaaatccttaagatcaagcatgaattgtcaagcatacatggtgcgtgaaacaaagcatcagcaagacgatatagctagtgttctacttaaatgatactggttgtaccgagctacctttttccatttcatttggatcctgtaagtttattcttgtacatccattaagattttacgcagcgctctagccatgtttttcgaaaaagaaaaaaaaagttggcctagcaaatggtaagacctcaatcggtttgcacagctagtctccgatcaaggccaattaggtatttgcagaagctggatttgggtcagattgcaaaatctcgagtttggacatgaccccgatacaaaatcagatgatagatcaagcagatagatatacatacataggataggataggggcgcacctcctagctgccgcgccgctccctctcgagcgcggccgccacatgggcctcgccgtcgccggcgcatccccacaccgacctactacaccagccgccatgtcctcgccgccgctcgcgccagcagaccaagcattggtcgccgcagagagcagcaccggcggcggccgtgcgccactgctgaatgctgatgccagccgcggcgaggggatggcctgctgccgccgtgtggctgctacgtgctcgccgaggcgccgccgtcgccggctgccgctggcctgagatggctgacttcctcggtattgggctatgaatgaatttcatgggctattgttaccacaggagaaaatggacttgggccggcctctcgtggacctctctgggcccatgtaagctgtgtcgcagtgtaggccggtctcaaattctcaattcggaagtgcctaacctttgtgctttcggctacaatatagtaaaattttgctatatatttatcgataaattttctataaaaaatttgatagatataattatagtgtaagttacatgtaactataatataactcatactcatacgtaaatttcacaaaattttgaaccaactagatttctttcaatattcaggtaggcaaagaaggaaaaaagaaacgcagcgtacatacatgtgagagaattcagtcccacaacttcgatttcatgaaaatagcatgctacgaaggagttttcaaaagttacatacaagttacatgtaagttataatacaattatactataattatatttatcgtgattgtagtattgtaccataattacatttatcaaattaagaaaatttgtcaacaaatagatgtaaccgtgtaagtgactcatccacgaaactcatttatagatcaaaataagtcttgaaattttcacctataagtgaatatgtggattagccactacacctacttgatttcggtgtcagctttaattttataacatcttcggtgcggtattatgcagtaataagctattaatccttcctgtcaaataatccggagtatctgaaaacaacattacaaatctatcctgcggtacacgtacacgtaacgcagtagccagtaggtagctgctctagcagttagcaatgcttgcagcttgacgacgactcaacaatcttctggtaatggaggacggttctcccagcacgtccctgtagtctctcagggatgattcttcagatactcaggaagccggtgtgtagggaagtaacgatcctcgtcgctcggatccattggtggatctgcagcacatcaccgttaaatgccaaaccaatattaattactccttccatctattttttttatagtcatatttcatcttggcacatagaccaaggataagtaattctacttatcatccatttaaacatgttactagtcatttctcgtaatcaagtgattcattaatatttacatttctcaatgtccatataaccaatcaagtgtggaagaatgaagggtcatgtattaaatccgagaaagtcattaagattataggttgttgaattgaaatatacctatcaaaaataaattttccagatttggaaatatgactatcaaaaatagatggagggggtatatcacaaaccaattgttaaatatgtgattcaaattttgggcccacaatatattcggattagttatctaacaggactctactttataggattagttttctattaggactcctagatttctcctatatatatatcctttgtaagccgcacagagagggtgcgatagcccaatgtatcccttgcatttgtatccaattcctttatagtgatcggcgcccgtggtttttcccgtaagggttttccacgtaaaatttgtgtctccattgtgcatctattttcataacaagtgctatcagagcattggagatcgatctactaatcacacatccaccggtgtgatttttcggatcggagtatcgatctgattggcctcgtcgtcgacgccgccggggaaggagcagcagcgcacgtcgcggagaatcggccgcagcagcaacgcgtcgtcatcgtcgcagaaataaattcggtgagattgaggtggtgtttagatccagggacttaactttagtccctgtctttagacactaatttagagtattaaatatagactacttacaaaactaattacataaataaaagctaattcacgagacaaattttttaagcctaattaatctataattagagaatgtctccgtcggctgctgtcgccgccctctcgactccgtcggtcgccgtcgccactgccttccgccgcaaacctcctcggcgtcggccacctccgcccgccggccgcagccatccagggggactggatccgccgccagagtggccggatctgtcgtccccccccccccccaccaacggtcgcggtcgccgcctcctgtcaggagcggcacgcccctcccgatctggccgcgataaggccaaatccacctccggcggagccggatccgccgcatccggcccagatggcgccggacactgtcgccgccgtccgcttcgctcgggtcccgccggtgccccggccgcgcttctcgagagagggagaaggccccgccgccgccgtccttgccgccgcgcggctttgccggcagctgctcgggcggcggcgaggcggaggggaggaggagaagtttgtggcggcgtgcgcggtgtccccgcttgtgtcgccctggggcgagcgacgcgggcgttggggaagttttttttattgctaatttatggttattcttgtacatctattaaaactttaggtagcgctccagccaagttcttcatcaaaaactaaaaaagttgagtatttccatgagcatcaagcaaatggtaagacctcaaccgatttgcacaactactctcggatcaagtccaatttggtatttgcagaagcttagttttgggtcagattgcaaaacctcgggcatgaacaaaattagcccaatggaaggtaaataagattggagacggaggcatccagatcaatctcacaccgggtaaatcgcacaaaattagattatagatcaaacattcataggataggataggggcgcacctcctagctgccgcgccgctccctctcgagcgcggccgccacatactcgcatgggcctcgctgtcgccggcatagagggcatccccgccggcctactacaccagccgccatgtcctcaccggcgctcgccccagcagagcaagcattggtcgccgcagagagcagcaccggcgacgagcgtgcgccactgctgtgtgccagcccacggtgaggggatggcctgctgccgccgtgggctccgtgctcgctgaggcgccgccgtcgccggctgccgctctagctggctgacttcctcggtgggctctatccgggcttgcgtgcggtgcgctctagtggttgggcccgtatctcgtggacctctctaggcccacgtaagctgtgcagcagtgaaggcccggtgtcatattctcagctctgaagtgcccagcccaaccttactacctcaggcgaaacgctaatcagcagtggagtaattccacgtgactccctcgtacgtcaatctaattagtatcctttaaccataataccagaaatcttaaatcccaactattaaaaccagtacaaaattactatctcggtggttttgctaaccggctgagtcggcatataggtcccacatatcatcctctctccctttctttctccccactctctctctctccttcgtccctaatcttatggattcagcagcagcaagagtgggtggcatggtgccatggcgacgggaggttgaggagaaggcgacagtgacggaggagcttgaggaagttgtattgcccccgtatctcagcggtggcaaggcggcaggagttcgagaagagaacaaaggcgggtgacagtaggacaacagtgatgaaggagctcgagggggctaggaggcaggaggcattacgaaggtggacgcagtctccatcgtgcggcgccacttatgtgaggagatgaatgccataccagggggagatgtaggtgaagagatgatggagaagggaaagaagagtggaggagaaagaaatagggatgaagaagtatgcggcaccggagcccgtcaccacaatcctcctctagaaggagattgaggacgggtgggtctccctcgtcggctagccggttaagggcgacgaggctgcagcttcatccatggcgagcgctgtggcatccggtggcaagcggcaccggagcccactgtcgtgagcatccatgaggaggagaccgaggtcgtcactgccacctgtcccgtcagtttacaccggttttaataggtggaggttcgagatatttggttttgcggttgagagatacgaattagattagacctttatttgagggattcaaagtagatttgttgcaatcagcggctgatgaagcgcgatctgatccacgcggtcagttggcccattcctctttcggcctatgggatttagccttttccatttttggtttttttttttccatggatggcttttgttttttaagcgggccgacccaatttattttcacaggccaaattgggcattttgtttttcttttttagcaggcttttttccctttagccgtatttatacaaagtttatgtttgtaccaaaacatttatacagtacatgtatctttatatatatatatatatatatatatatatatatatatatatatatatagtaaatttgtttggtgctccatggtgcccgggcaccattgttgaaattaagtatatacctaattcaaatgagtatgaaactttttcaattacttagatattaacattagctactttactaactagttcaaagcaagtttgaactgaatttgaacttgtttttgttagattttgattctaggtatatagcatccatacatataattagttaggtatgtaatcatggattgtgaaataaagttaaatttgagttgttttgttgataggtataggtatgaatcgagttattataactaggtatatactcacaatttgaaaattttgaaaaatttgagtgattttgtgtatttgataccatggtgcccgggcaccatggtgccccatatgagtgtcctatatatatatatatatatatatatatatatatatatatatatatatatatatatatatatacacacgtatatgtatatacatataaaatttatatgtatgctaatacgtttagattttatacgtataagtatatagttatatacgtatagggttggcgcgcgggcagccgcacatcagcggctcagagctagctgaagcctgaaaaaatcacgtccaagacaacaaaaacactcaataacaaagactgatggacaatgaaccatgtacatattatattttggcagccttcctgctgtgctttattgtacaagactgttgtctacaattgcacaaaccctagcagaaaccgggctaatgcctgggatttattcactggtcacagtatccggagtatctgaaaacaacattacaatctatcctgcggtacacgtagatgtaacgcagtatccagtaggtaggtaactgctctagcagttagcaatgcttgcagcttgacgacgactcgacaatcttctggtaatggaggacggttctcccagcacgtccctgtagtctctcagggatgattcttcagatactcaggaagccggtgtgtagggaagtaacgaccctcgtcactcggatccatcggcggatctgcagcacatcaccgttaagtgccaaaccaatattaatcatatcacaaatcaataacaaaaacaccaagagaataatgaatatgtgtatacagagagaaaatatggaagcaatttgtgtggggcagtagcttagctttacctggagcggctgctggagactttgcagcaggaggattgacgaccggagcagctggaaggttgccgcctggaacggccaccggtgcagctggaggatcgccggctgaagcggacgccgggaaagcggaggcggcggagctgtcggcgaatgccattcgttgtagctagtccggcaaggcacaaggctgttcagttcagctacccaatgtctccagaatatatagccattgtaaaggttatttctttgttggctagacagatagatcatcagagatccattatattccctgggaactcaagaagaatcacatctatcgatatttctcttcaggaataaggtgtgcgttcacatggcaccagtattcgagaatcatagctagtcggggttagtttttctttaggactaggaggctagcagatgtaggaaggtaagtggcaacctgaagagtcaaaaatcttgggcatcagcttgtagtttcagaataactaaatgggggattgtgtgagtgccaaaaggcctaccaagaacgaccagtctagtaattccattgcatgccacatttcactttccagttttctagaccctttccaagcaactcaattacaaggtgctttgctgacagtgttggatagaggttttctgttttgaacaaacaccaggtagcaaatctggttgtgcatcttccttgttccttgccactatatcttggactaccaacaaaacatttgatcagccatttgcggagaaggtctcttgttgatagttggaattaacagcaatggcctcttcgagtgtcctgtctccaaacatcgcatgggttctttgtcacttcatcttttgcagcatatcgttagccatctgcaatgaaactgacgatagacaggctctcctttgcttcaagtctcagctctctggtccatctagagttctatcctcatggagcaacacatccttgaatttctgcaactgggatggagtcacctgcagctcacgaagtcctccccgggtcattgcaatagatctctcatcagaaggcatcacgggcaccatatcaccttgcattgccaacctgacctctcttatgacacttcaactgtcaaacaacagcctccatggcagcataccacccaagcttggcctcctgagaaaactcaggaacctcaacctcagcatgaactctttagaaggtaacattccatctcaactttcttcatattcccaaattgaaatcctagatttgtcaagcaattccttccaaggtgcaatcccagctagcctaggcaaatgcatacatcttcaggatattaatctcagcagaaacaatttgcaaggtagaatctcctctgcttttgggaatctttctaagctgcaagcactggtcctcactagcaacaggctcacagatgaaataccaccatctctaggcagcagcttttctctcagatatgttgatcttgggaataatgatatcacaggaagcataccagagtccttggcaaacagctcatctctccaagtacttaggctcatgagcaataatcttagtggagaagtcccaaagtctctattcaatacttcatcacttaccgccattttcctacaacaaaacagctttgttggttctatacccgctattgcggccatgtcctcccccattaaatatatttccttaagggacaattgcatctcaggaacaataccgccctcactaggtaacctttcttccctacttgaacttcgcctttctaagaacaatttagttggtagcattccagagagcttaggtcatatccgaacactagagatactgaccatgagtgtgaacaacttgtctggtctagttccaccatctctcttcaacatttcatccctgacatttcttgctatgggaaacaactcgctcgtgggaagattaccctctgatattggctacacacttacaaaaattcagggcttgatcctcccggcaaacaagtttgttggcccaattccagcttcacttctcaatgcctaccacctagagatgctctacctaggtaataacagtttcactggactcgtgccattctttggatcattaccgaatttggaagaacttgatgtgtcatacaacatgctagaaccgggcgattggagctttatgacatcactctcgaattgctctaaattgactcaactgatgttagatgggaacagcttccaaggaattttgccaagttcaatcggcaatctttctagcaatcttgagggattatggctaagaaataacaaaatctatggaccgataccgccagaaataggtaatctaaagagtctcagtatattgtttatggattacaatcttttcactggtactataccacaaacaattggaaatctgaacaacttaactgttctatcatttgcacaaaataagctctcaggccatatccctgacgtttttggcaacctagttcagttgacagatataaaattggatgggaacaacttcagtggaagaataccttcaagtatagggcaatgtactcaactccagatactcaaccttgctcacaactcattagatgggaatataccaagtataatattcaaaattacttcgctttctcaagagatgaacttgtcacacaattacttgactggaggaatgccagacgaagttggaaatctcattaatttgaacaaacttggaatctcaaacaacatgttgtctggagagatcccatcctcccttggccagtgtgtgactctggagtatcttgagatacaaagcaacttctttgtaggaggtattccgcaatcttttatgaaattagtaagtataaaagagatggatatatctcggaataatttgtctgggaaaatcccacagttcctcaacttgctgagttccctacatgacctcaatttatccttcaacaattttgatggagtcattccaacgggtggcgttttcgacattgacaatgcagtatcaattgaaggaaataatcatttgtgtacaagcgttccaaaagttggtattccttcttgttctgttttggctgagaggaaaaggaaactcaagatcttggttctagtcctagagatactgataccagctatcattgctgttataatcattctatcctatgttgtgagaatttatggaatgaaggagatgcaagcaaacccacattgccaacaaattaatgaccatgtgaaaaacataacatatcaagacattgtaaaggctacagataggttcagttctgccaatttaattggcacaggatcgtttgggacggtttacaaaggtaatctagaccgtcagcaagatgaggttgccatcaaagtatttaaccttggaatttatgggggccaaaggagctttagtgtggagtgtgaagctctaagaaacattcgccatcgaaatcttgtaaaaatcatcactctgtgctcttcagtggattccaatggggcagacttcaaagcccttgtgttccaatatatggccaacgggaacttggacacttggctacatccaagggctcatgaacacagtgagaggaaaactctgacttttaaccaaagaatcaatatagccttggatgtagcatttgctttggactatctgcataaccaatgtgcatctccgctagtacattgtgacttgaagccaagcaatatccttttggaccttgacatgattgcttatgtcagtgactttggcctagcaagatgtctaaacaatacctcaaatgcatatgaaggaagttcaaaatctttggcttgcctaaagggatctataggatacatcccaccaggtgagataaccatattcataatggccaactctttttgttcttcatagaattgtggagacaggacatataaaatatctaatttattacattcataaattaaatgcagagtatggcatgagtgaagtgatatcaaccaagggtgatgtctacagcttcggtgtgattttattggaaatgataacagggagtagtcctactgatgaaaaaatcaataatggtacaagccttcatgaacatgttgcaagagcttttcccaagaatacctatgagattgttgatcccaggatgctacaaggtgaaatgaacataacaacagtgatgcagaattgcatcattccattggtcagaataggtctatgctgctctgctgcatctcctaaggaccgatgggaaatggggcaagtttctgccgaaatccttaagatcaagcatatattctcaagcatacatggtgtatgaaataaagcatcagcaggatggtagctagtgttgtatttaaatgacaatggttatacagagctactaccttttccattttcatttgcatcttgtacatctattaaagttttaggcagcggtcatgtcaagttcttccaaaagaagttgaatacatctatggtaggaccaattaaatggtaggacctcaactaatttgcactagtattccgatcgaagctaggcaatcgtcaaagctagatttgtgtcagattgcaaaacctcaagtttggacatgaacccaatagtacaaaattagcacaatcaagggcaaataagagtagagacggacgcacgcatcaatctcacaccgcctgattcgcaccaaacaagatgatagatcaaagcagacagataggcacaaattgcaaaggttagggccaaagggggcgcacctcatatcatagctgcctttgtgtcccggctactctcggaaccctagctaccgcgccgcgccacatggacctcgccgtatctccggcagcgtgccccgcaatagggcgtccccggccgccggccaatcacaccacaccagccgccatgcctcggcgccgcagctcgcgcgccagcgaaccaaaacatcggtcgccgcaagagatcagcaccgggccgcgagcgcgcgccgccgctgatgccagcctcggtgatgggatggcctgcgaccgccgtgtgtgctgcgcgcgcgctcgccggggcgccgccgtcgtcgcgcgtcggctgccgcgcgagctggctgatttcctcggctcgggtctatctaggcttgtgcgctggctccctcttctgggtatggttgggctataatttgggccatcgtggttcgtggacctatctaggcccaaatcagctctgtcggtctcgattctcgaatttcctcagtcatcaagtgtcaaactctgcgcacaattcatgttaagaagactagccaaagtgaaaatcttcttgtttgcaactccaatacaattatttttatttttatttatttaacattgtaacaaaactcagtcctcctcactatgtgatttaatttatttcctgtgtggttctgatttttttctctctctcaaagttggcctctttggaacgaaggatttttagatgaatgtattgcacaagaattaaaatatttttttaaaaaaatactgtaaacttcctttgttaaaaaaggagcattctcatttaactcattttttaataatagaaatgatttacatctccgatctatgccccaataagaatacgactactgagtcaagaaaacataaataaaaatactcgaggttatgggagcatttaactcataacgttgaagcagcgagaaatattggcccggtttagttccaaaaagtttttccaaaaaacatcacatcgaatctttggacacatgcatgaaatattaaatatagattaaaaggaaaactaattgcacagttagggaggaaatcgcgagacgaatattttgagtctaattagtccatgattagtcataagtgctacagtaacctacatgtgctaatggtggattaattaggctaaaaagattcgtctcgcggtttccaagtaagttatgaaattattttttcattcgtgtccaaaaactctttccgatattcggtcaaacgtccgatgtgacacccaaaaattttcattttgcgaactaaacaggcccatattaagataagactttatatttttactaactaccacaaaacttcctatcggaaccgtcagattaccgtcggttcatttctgtgtgagccgccggtttcaaatccatttgattttggatggtctttttaacgctttgtatgcaggcagcagatcaaatgaatcggagctgaatatacgtggttcgaacaagagagcgtggaatgcatttgttgtccttccatggatcttttatcatggagcgttagatgatcaacgttccaaattaattccaagcatgaaagaagatcgtctctcattggaccgtaggaatcagaatcggtacagttccataacaaaagattgatctacagtccgttaattttaaggggttttatgcctaacgagaattcgttagttggactgagcatgaagaagaggagaatattgatgtatgtttagatttaaatattttgccaagaacatcacatcaaatatttagacacatgtatagggtattaaatgtggggaaaaaaatcaattacacagtttatatataaattgcgagacgaatcttttgagcctaattatgctatgatttgacaatgtgatgctacagtaaacaattgctaatgacggattaattagacttaataaattcgtatcgcagtttacaggcggaatttataatttattttgttattagtctacagtttagtaattcaaatatatatccgtatacttccaaaactttacacccaaagaattaaacacatccgtattagatggtacggctgaagacaacaatttcaatggaatgatagacaatgtcggatacgcttcagatccacctgaaaacattcataatgaacctgatgttgcctgatgtaaagctacacgtacgtactccctcgatcccaaaaaacttaatttctgaagtttaaattttatctcacaaaaaatcaagagaaaattccctatctagcaaaaaaaaaaaagtgctcttccctctataacacctaaacttcaaaagttcccaagacatttctaaa

SEQ ID NO: 39121 - DNA, 3995 bp, Oryza sativa
ctagttaacaccgttaagtgtaaaaactaacggaagtgctacatagggaagaaaaattttagaagtgcctagataggaaacttttgaagtttaggtgctatagagggaagaacaattttttttatgctagatagggaattttttcaaaaatcaacttctatcactctacctactccagcatataaaacgataagttttatccttaaataccttttacctacctattacttttactactttttctaataatgaggagtattttcatcatttttacttcccactattttcttcttggaagtctaggagttgatattttgtgggatggagggagtactgtacgggtgacaagtgacaaacagttcgaaagtttccaaagtttaatattggactccgctacactgctgtacccaggttacaagaaggtagtacaaaattaacgtagaatattattccctatgtttcgaaaagaacccaattctgaatttaaatttggagtttttttttaaaaaagaatttaaatatggacatatagtctgtttagtagagctccaactcctaaatttagcttcagaagttgggtttggagtgaagttgtggagcagcttaaactgttccacctctgtagtttattttgtgagagcgtttcacctagcttcgctcttattttggatagagctaaaactgtttagctgagttctagctcctggacaggtggaggcgtggagcgggagttagagctatgccaaacaggctcgtagtgtatattcaaatataaactcagtattatatttttttacgggcaattgtaaatttaccaatgctttgaattgttattttaaaactgccactagaaaattacaaaaataccactggaactatcattcgagtgtcatccttgcaaaattgaaaaaactagttgcaaatttgcaaatgcctcattttttttaagacagtgggagtactcttgagctattacaattaaaggctagcgaccgttgatctgataaaaactttactgaattattgattatgtctcttggtgaacatgcttaccaagggaaatgtttcgccagcaaacacgtaccaagcaaagaaaatcgtacgcccattggaagtagaagtggaaaagatgcatgcgtgtccagtgatcacatcttaggccattcattgtgggcctccgtggtatccagcctcaccagcaaaaggagaatattcgctgccacgtactcaatctacatagcattctcaagttcgcgtagctaaagttggctacgggttcctcgtcaggtttgaaggagggacccatgcttgacctccgcgctatcagcgaaaggaaagagaggaaagagacctcgtcagcatccccgcactccacgccgctgagctcgctactccgctcgggagaggccgctcgacgccgaaccggactaccccattctacgctgcagcagctgccagaggaggagggggaaagcgcggcggaggagatgagaaggggacagggaggcgtcagagaagtggaggcgctcaaggtcgaggccgacgtcgattcagagtcggcgccgtcgccgctagggctggctagcacctgtgtcgcgtgccgtcaccgctagggctgcgcccagcactggcatcgtgcgccgtcgctcggagctacctccgcccgccgcaactgcgtcgcctcgttgccgtgcccattctgcgccgccgcttgtcgtggtcccccgccactagatcctgccgccccgccgctcagcgttgctcgagggagagaggaggggtggtgtgccgagccgccccgctactaggggtgggcagaataagaccgaaccgaagaaccgagaccgaaaagaccgagaccgaaaaattcattctcaactattgaaagaccgaaatatattcggtttattcggtcatgggcctcaattaaccgaattgaccgaaataacctaattaggcccaacagatctagttggcccaataagcccactaataagaaaccctaggggcaggtgtgtcacaagcattgacgcatcgtttcatccccatccatcgtggagcggtgttgtcccaactcccgtctccatcccatccacatcctccttcgctccatcgccgggcgcagcttccgcctccagccggcgcgccgcctccaccgccgggcgtcgcctccagccggcgcgccttcgcctccaccgcctggcgccacctccagctggcccggcgccgcctccactaattgttgatttgctttgcttttgctgtttttacagatagttttgttgatttgctttgtttttgctgtttttaaggttagttcggtctatgaccgagaccgaactgaactaaccgaagaccgatttgctcggtcctgagatttgttggagaccgatcggtcttgagattataaagaccgaattttcaaaaagaccgatgtaccgaaccgaatttttcggttagaccgaatgcccacccctaccggctgcttcgagccgctccgctgccgattgggctgctcggtgccggcgtcgtgtcggttctgcccgactctctgcggtggggaaaggaagagacgggataggggaaagtgtaaagtgaaaaggtggtattggtgggacccactatacgctacttgtgtattgtggtctcgtggagtttgcactgtgtaacatgtggctaatattgtttttggtctagttgacataggaggtccaccaaaatttggggacgcactctgaacgaccataaaccgcaaagagtacgatgtcttaagtcagttgcctggtatgtaaaatagtaaaaagctaaaagctaaataataaaagtgactaagcctctcatcgtttcttctatggctaattaataagctacgaaaaaaatgaccgaagcataaaaacataatatatgatttaacttttcttatacatgttctttccgatttaaaaatcaatgttggaaaatacaccacgatgaatacctttaaaataagctctaaaaattagattcaaaactcaaattaaatttcgttgcaactgataagccaacaaccaaagtaaaataagtttcaaaattcaaaattagctagtatgccttataaaaagcctgaaagaggaatacaagaaagctgcaaggctcgatcaatctctcatggatagagacacataacaaattatcaatcttgcctccggcgccggtgatgcgtatggcttctcgatctcggctgtggtgacatcgtcgtcgcgttcacctcatgggtgttcccacagatcgatgtctcatgttaagagcttggattgacctcgcggagcaactgggagccaaataaggacaggccgtacatgagtagaaataaacaattaatataacacatcgtacattcatattcccttcgtcttaaaatatacgtaagggactttaagggtctgtttggttgccctcaccaaggttggcccgcaccagtccatgcaaattcctgatgtttggttgcctgcttgggcctcccagcctgtccacgcgaatgcaaaaaaaagcccctcagccaggcccgacagaaacggccgattcccacttcgctgctcggcctggctcgactgatgtacaccgctgcacccgcgcctgcacccgcgcgtgcaactcacggaggatggggtcactgttgcttcccagaatcgctccctccccgcctcacttctccctctcgcgaaaaaactagggtttaccctagctctgacgacggcgaggcgcggcgcggcactgctctcgtcgtcactccggtcgcgagcggcggccctctcctccgactccggctcttctccatcagttcctcccccggcgtcggtcatcctccctctcgtttgccggctctctccgtcgtgcccccctgttccaccatcactctccgttgagcaccagggtaagttcatggatggttgttcgtcgcccattgcaaggttgggcatcctcttccctgtccgtccttccccagttttttctcc

SEQ ID NO: 39122 - DNA, 4099 bp, Oryza sativa
attttttgaaggctatgttcctagtcataacaatcattttatacttccatttgtatagtgtacaaaaaatcagtgctcagatttctctcaaggatccagttcctttgccaattctctggctgcattagtgaattttgtgctccaacgatatgttttaaaaagtaggcaaaaacagagttttgcacacggggatttgtagtttatgcttatgcacaaaccaaaaaaacagagttttgcacacggggatttgtacattatactccctccgtacgggagtagattctaatccctcgaagggatatcctctcgtatacctttttcttctaaattcgatgtaaatagttatgaaaaattctgaaaaaaattaacaatgtagagtataatgatacctactagtccaccaaaattgaagtccaaagattttgtggatatgtatatatgtgttgtatgaatgttgtcaaattttttcagaattttttataaccgtttagatggtttttaagcaaatgagagaacatcccctagagggattataatagtttcctcctccgtactcgtaaagaaagtcgtttaggacaatgtttaagtcaaacattgggaatataaatcatgaataactttgaaaatgtaaaaattatataaatagatttatcttgaaaaatacttttataaaagtgtgtgtgtgtctataaaaatagaaacaagaagtcaaagttatattttgaagagcatgtcgctgtcctaaacgactttctttacgagcgcagcaagagtactttacaattttattagagtatgacattgcgtattagagtatgaaaatgcgttcattttttctcctgatttcaatcttcaacacaaacccagctccacggttcatcgcatcagcgttcatttttttttttcgatcttgtttgtgacggggcagaagaccatgatatggtctactatttcttttgggggtttgcaatatagagcggaacacttttcaaaggtctccacaatctaaacaagtttgaaatcatgcacatagtacaggtttgaatcatgtcaaaagtaccaacttcagatagaacaatgataaaaatggctccaaaaatgcttcaaactaagttctccatttgtatggtactcaggacaactgatggtgcaaaattttcttccaaaaaagggtctggataaataacattagatttttgatctagaagataatatcagctctggaaatgggagcatctaccgcttccaccaccaccaccgagctttgggcctttcccaggcttgggagcattgcctttaccagaagccttctgcgattttgccacctctgccttcttcgctttcttctcgtcctttgtcttcttgatgcgctccttgatctcactgttatggaaataacattgataagtgtataatcctagaagggaaaaaggtagcatgcatagacacaataatgtgccgatcatcactagatttagagttcataaactaagacaagctaaaatgattttaataaatctttgcacagcaataatttcttactaccaggaaacgcaagctacacatttcaatacttgaaaacaaagagagccaatagcctgacactgctagcatggtaagatgagaatgtggttgaaatgcattggcttcttcaaatccatacatgaatggtgttaaaagaatccataaaccagagatggcatagaatagcataccgaagagcggattcccttgctgcatcacgaacctctggcttctcagctctcttcttctggatgacttcaagggtagcaccaactatagaccgggagtacggtttcttggtggtgcggcgcctcttcttgactgcctcggcgtgaatatcctgtaaaacattgaattacaaaagtaaacatttgaaggacaatgcattacatcacaaatttaaataaacaatagattaactaagataggtcactggtaccacaacattcagcatgacataaagttaacagttcacaacagccaaaaagtagttacataacatcctgaaccaaacagcactgttccaacaagtttgtctcagcacattcacaggcaacagaccatcggtacaagaaaccttccaagtgaaatatggatgacaaggaattgtcactcataccttcttgtgctgctttctgtacatggctgtccatgtaagcttggctggcttcagacggttgtggaagtagcgcttgcacttcgagtttgaaaacaggaacacctgatatagtttaccaaagaaattgatcagaaataggttagcttttgtcctacacatgtgtatccatcttgccaaagtactcacctgggagtctgcacggatgaatctgatacccttccctgggtaaatcttggcgccgctgaaacggcacagctctgtcctgtacatcagaattcccaaattatgtaagaaactttctatttgcaacattccagcctcgaaaatgcagcacagaatataatgaaattgaattgtgcagggtgcaaaatacatacttgagaaccatcttcgctgcctcaccaaaccttcaatgcctccttacctgcaaattacaacgtcaggaatcatcgctagagcagaatataaatgcattgcaatgtacagaccacaaagatctctcctcttcagcccaacactaccagaccccaatatatagcaatctaaattaacaaaattctagcatttctctatccatcaaacgagtacaagaaatgacgcataaagcaaatgcgattccactaagttgccattccaaatcagtgcccaaaaactaatcaaaggaaatctaaaacacatttgcagcattcggatgcacggacaacgccaccaccacaactccaatccagctgaaacccccattccccatcacagcatcacctcaaccaccaaaacaacaagccccacatctaatcaaacgcctcgatccaatcatacgcgtcgagaacgcgaacaaacctagccgccgcgccgccatcacacaacagcccgcaaaacctaccaagaaacaagcgcgggactcgaaacagcgaatacgctacatacacgagacggcgcagcaacgccatggcagcgagcagcgaagcaaatccatggggggaagaggagctcgactcacctgtgggagcagcaaaaccctagcgcctccgcgtccgcctccgctgcggcgcgcgtgggaggtggtgctcccttttatagtagggcaagcgcgcggcgggatggatcggagccgtccgatgcggtggggggacggaatggacggggtggatgagttggtgtgatgataatgggccgggctggtttgtcgggccttggtcaaagtgggccgtcggcttttcttctgtactcggaataagttcacttcataaccctcaaaagtgactcgaatctaattcatgaccctaaaccgcaaaaccggatatcttcacccccaaactattgaaaccggtgcaatttaactcccttggtggttttggatggcagttttgctgacgtggcagtattgactcggtcttctttccgcgtggcgttgacgtggcgcttaggtggcattaaaaaaaatatgcatgggacccattagtcattcacacacaaaataaaaaattgtgggggccactgacatgtggggcccatatgtcatcctctctctccctttcttcttcctcccttctctctttctttctctttctcttctctcccctttggctggccgcgggggagcacgggcggctggagctggagcggcagcggcggtagccttgccatcagccttgccaagtggagagaggagaggagaggagagcaggtgagggaggaacggaggtggtgggttacacgacaggcggggcggcgcgtgagggccggaagggagaggggagaagcggtgccgccgagctcatgttgtcgccgccggtgcctcctcccgcactcgcgctcgcccgcacgccgccggagccaccgctcgacccgctcgatgcctccgccgtcgacgtcccgcgcccaccgccgccgtcgacatcccgcgcgatgtgaggatggatgcggggagatggtggaggacggcgacgaggagctctg

SEQ ID NO: 39123 - DNA, 4543 bp, Oryza sativa
aatcttgtgtgtgtgaatgacaaatgggtcccacatatatgtttttaattgaaatgccacctcagcgccacgtcagcacacagactaggtcaacaccgcccacgtcagcgccacgtcagcgaacccgccatccaaaaccaccaagggagtcaaattgcaccggtttcaatagtttgggggtgaagatatccggttttgcggtttagggtcatggattagattcgggtctcttttgagggtcatgaagtgaacttattcctctgtactctgtgtctttgtgcgtttctttttctgttcttttaggctattttctgtgctttatgcgtttgtttgtgtgtgtgtgtgttaaaagaaaattttgtgtgctttgtgttgaaaatttaaaacagtttcagaagaaaagagaagaaatcgctaggacgttgacatttgtcttaagatgaccgaaaaattgttgttgcactccatcccaaataagtgtagttttatagtggccctctgtatatctttatattttacttcaacttttccatccagattgtagctattgaaccaatagtaatctctacttacctccccccccccccaaaacacaatcccaccctcttattttcttcatattagtgaaggacgtaatcctatatatttatatagtccatccacactcagtgtagttaatgctatttctctcttctttcatgaaaccatatcatttcaattattttttattctttggatgatagatctatagtacaaatagtcatttctttcctctctcgtaaaaccacacaatctcaattattttttattcaaaattcataagtatcaattacataaaatatgttcaccttgcattatatttgcaatcatgtgttgattatataaaacatatgaagtcattttattttggtttacaaaatataatatagcttatttgtacatacgatacaacttaatttcccgcaacaacgcggcagggtattcatctagttatcttcgttattacctccgtctcatataaattgtaattctaggttatttaatatatattaaggtttgagaataaagactataattttcttattaaatggtgcataggtaagagcgaaagggtagttgaaggtaaaatatgaagaaatttgaatgaggagtgattaataggaccattagtactttattgcgacaattattttgggacaaatttaaaccctataaatacaattattatgggacagaagtagtatcttttaagctcttgcttaatactatgtctttaactctagctatttgaaatgtggttgcgttgatttagggtgtgtttagttcgcgaaaagaaaatttttgggtgtcacatcgaacatctgaccggatgtcggaaggagttttcagacacgaatgaaaaaactaatttcataaatcgcctggaaaccgcaagacgaatttattaagcctaattaatccatcattagcacatgtgggttattgtagcacttatggctaattatggactaattatgctcaaaagattcgtctcgcgatttccatgcaaactgtgcaattatttttttatatctatatttaatgctccatacatgtgtccaaagattcgatgttatgtttttgggtaaagttttttttggaagctttagtgtactgaccggccgttgtgtgtgttcttgacaaggaaaagtatcaattagcacttgtgttagtgacagagtgacaatgacaagttaacgtcagcatccatggcattgatatagaacagagatttttatttttgttaattttactcttttagtttctgacatgaagcaaattgtccactcgtgccacgtttccacgccatcgttctagtgaaattacatgagcaatgccgttcacgtatagttgtcatcacaaattcacgattaattaggaacactgatgctgatgtgtataacaaaattaaccgcctaaccagccatctgcttaaccaaagaatgattaattaaccaagtagtcgctcccttctagaatgatgacgttttagaatgcaatgtattttgatcccaaaatcttagattaataaataaacaaataaatgtcaaaaaaataaataaatatttactatgtgaaagtgatactaagtagatttttggtaccaaaataatttcattgtcattatttttaatatgttattagaaataacaatgattaaatatgtatatcagagactacttacatgtcctaaacatcataagaacgaaaaatgttaattaattggtagaatcggtgggcgcaaatgcatgctaattgattataccatatatctcccctgcactttactcatccataaaattaatatgacatgtgtgcatgagtgcatcgttgttttttttctttcttctatttttctaaaagcacagtagaaatgcaaactatcacagcgtgcgtatgcttatacttatgaatacacgtatgcacctctaattcaatgagtatcttataaaaactgaaccgtaccgttatatgttaagattcacgagatcaccatagacgcatcgttgtcgagttatgtcatctactattgaaagaataattttggtgactcgtattaaacaacaagtaactttgggatgaacgcattgcgtgcatttatatacagtcattgagtctaccagtttttccttaaaaaaaagggaaatttacgcacatatataattcgatcacgattaaccgtgataaagctagcccctcaagctttactttagatgataaagctagcccctcatgtttagtttaattacctgatgtcggttaacctaaccgtcatcgacatgtcaaccatagaaaaaaaagggagaatttgaatcacatccagaggacagacctgttgacaaaatgaccaatactccctcgattccaaaatataaggcacaaccatccttaacccaaagaccaaaaaataattattatcatcttatagtttagatcatcctaataaatataatgcatgcatccaatagaattagatagcatgagagtggaggatttaaaaaagtaataatttaggccctgtttgattcagcttaggattattataatttagcttattaggagtaagctgaaacaaacaagtagattattatagcatattattataatctaataagctgctctagaggagcttttttcagattattgagtggctaaagacccactacccctacatacttgagaaaaattaaccacctatgccatcaaccgaacagatagctgagggcattatagactttatcctttcaaacccaataatccatgcctccaataatccagacaaacaaacaactcacagcttattataatctagtttatagtaatctggcttaataatctagattataataatcataagctgaaacaaataggaccttaatagataagatgtcatagttaattaattgcatgcttgcatgtatgccttaatattacggaacatctaagaaaaatggtcgtttcttgtattatggtattatggaatggagggagtaatcgcacgtaatgcctgccgactcaccgtaatatgaggctgagaagttgattgcagaccatctagtgcaatcaatggcgctcgctttcggtgattgttccaaattaattacggagtaattagcacaacacggctcgccgcccttgccatcccatttaggcacatggacagagttgaaatgtgttgagagctaggctagctagctgattttttcggttatcaaattgagatattcaatctagtctctgaattgactgatatcaaagtttaaaatctttaactatagataaattttaaaatgtttgtattagaaatattggtctcaaaaggtacttcaaaaatcacatttttattgataacaataatcctatatatatattataataaaaaatagtgatcagagttattttttaggccgtgtctttatttaaaacgataagtattattaacccggaaggagtgtatctgatggtattccaaactgattaagactatcgaattagttaccatggtattggttagaaaaaggaacatgcatcgaaaaactaaaaaccaagataccgctatcactttttggggaaaatgtgtaggagcgtccattttcagattcaactttattttcaagttttcattacatacatgattttcactacgtattttcttcatttaaggttcatacaacagtgatagtggcaacaataatgctggtcgagaaaactggttaagcatattccctgagctgagttgaatcggcttttccagcgatcgttttctgtaacatactttttaaaccactttttatatagatttttctcaaaaaagataaattattttttttaattataaatagtcattttcaattaatcgtatactaattgctcatctgttttgcatgcctggaaaagtgtaaccatactgcccaatcgaatgaagtctttagctttgttgtttattcttttatgctcgacagattaaaaaagctacgcacctacatatcatgtattcatgtgt

SEQ ID NO: 39124 - DNA, 39424 bp, Oryza sativa
  unsure (1)..(39424): unsure at all n locations
ctaaataaccttccaatcttattacttaccgaaatcacatctatgatcaatggtcccagtaccaacatcatgagggatgacaccaggggaattaggatgttgtgatccatcatcatcacccactatatatctttgtgtgaaatgcagcaaattgaacagcaatgaaatccagtgtaccttattgaagtgcttactcaaaggaacatctcaacttacatgcaaatagcctgtatatatagctgacatagatccttcaagatatccataaggtgagtctttgcatcatttcggagaaattcagaggaagatggatatgctattattgcctatctttattttttttctatctgtgtagatattggagatgacttcagacttaataaaaggttatggctgcaagctgtcgatgaaacttcctggaaattactcaaaacagctaggacacaaatggttttcgtaactatcaccaagaaggacaaggagatatatgaatattaatgccaaacaataaatggccacatcttttctagccttctagctgatatcaacctcccctctcccccctaggtaccattcgacagaaacccttgcgaaatttcggaagtaatcgcttattgatactcctttctgttataaaataggcttaaaatcaccatcaaaaaccaaacgcgaaaaaaattataggaaattcaaactaatgataacaccgagacacgatattttataacgaagttcatccgggacactgataacaggcgttcctccccgatctaggtttcgatcaaagtgacaacgaccctctacatgttgctgctggcagccgctccctctcgctatgctaagtcgacatgcggttacaacaggtgtgcctctctatttaaaagagatccgaggacataatctgactcttactctatttatagtatacaactccaagtcctaaactgtaaccgactacgtgcacatatttgtcacaaattaaactctaacactttctatcacgacaacatgttgtcttagacatgtatcaagttaaagttcaaaaacatcaaaatgaatattttttttgaaatatttaaattggataatttcttatgggtagatttaactcaaaagcacttttataatattacattaaatcatgtttttcaaatgttttagaaaataaattagcaatcaaagttgcatgttggagacttcttcaatatatagaacgacatgtggccccatcgtttcgctttcgtggaagaaaccaaacggcatgcttgcaaacaaaaagtaatttgtgaataaaacttttatatacgtgttcttagcattctaaaagtaaatgccgaaaaataaacttcgatgaaaaaaccacaagatcagttccaaatttaaggttgaaaattcaaattttggctgataagcttaagagaaaagatgaggccccttcttatgaccagcgcaaagtaacacacccgccaatggtgaacgtgactctgtgagcgatgacaactagattctatacatatatactactatattgaaacatatccgtggaaataacccttgtcttttcaatagaagtaacaatatcatgtttgtctatccaaaactaaagttgtagcacacatattatcttatcattgttgatcctttggccattaatagaagttgtatatccaacaattttcattttgataatataggtcatgccgtgcaaacagactgttttcggttcattgtcaccaaatggaacattaggaagaccactgaacttattttcagaatgaagacaagttcaacgaatagtgtttctttgaatttagaatatgtgtcatctagtaatactagtacactttattctgaatttctgatgccttgaacaagagcgcacacaccagctacatcgtgaaaagcaattagaatgtgatacggtcttagttaatcttccaagactagacacatgcaactcttagttactgttaaataggaaaaatgaaaaggtatgccatggtttatacaacctttttttagttaagaacttcttttcaagaaaatgactaacggctctctgtcattaacaacccgggtggttatagacattacagagaacctccacatgtcaacattgtgcttattaaacatgccagcatacaaattttccttacaactcctttttgaggatgaaatataggttagcatttttttatcataatcactctccaatgaagtccatttcattcaaacatacaatgccaccctttttttttttcctaaaaagtagtgtgcaatacaacttggcaaagcccaatgcttatatggctgttgagtgcacgtaaggttgatatatgccagcactcatcgcactgcctcttcgatgtgatcaatccttgctaggttaacactaataccacttttcaatttactagtcacagtcccctgcattacaaacaggagggtatttgatgaagatggttcaattttttctcttctcccatatttttctctcggttcggtagttttttggtataccagtttttaagagcggttgttttatacatgagattagggtgatgacaaccactattaaaatttaaaaatagtataccagtacagcaacaaccatttgcttaccgtttcagatctaatgttaccgacagttttgctactctacacctgtatggttttttgtcaattttttatccctacactagtgtaagaactacaggaaaggagaagaaatcccttgcatagttgtaatgttattactcggaaatgggccggccatcgatcagacttggtccaagtctttagcccaattccaacacccatatgtggttgtctcttcccaagttccaaacgtccagatagcccacaggatctggcaggttcagactttgacagttgacaaagttctgagacacttcattcgtcgacatcatcaatcaataactcctctaacctcaccgttttttttttgcctaccttgctgatttacacgtccctgtttactgtggtctgctcctcggctgagtctgtgaatttttgtgttgccggtgcgccggtcatgtaattagttaggctggttaattgggtaattagttgctgtgtttggggtttggatgccggtcactgtgatgcttgttcccggttggatggcgctttgtatggcgcgcggcatgtggccatttcttgttttggtccatttgtttcttctgttatttcagtttagcctctctgtcctgtactttgtgccatcgtgcttttctgtttagccccttacgctttttacaaattgaatgtgaagaagacaaaattctgttttgggggtgtgtttgtggttggtagttatgctgggtatgtacatgtgcttttgccctgttgacttttttgggtctttcttgttctctttggattggtgttgtctccccgtcgctggtggcttgctcgtgccggtggccgttgctgcttgtcatcttctgttcctgaatcggtcgaggttagtccatcttgcggatgtgctgttttcattctttgttgttgtactttgggggtgggggtgtgttgttcccctcccggtagtctcttcttcccctttgttgttcctgattctctgttggaggtgactcgatttggtggatttggggagagctgtttctcccccggttcagttactttttcctctgttgtgactgcttctttcggtttcttcttcaatgtgttcctttccagtgtgttcgctgaccggaggaggagccgacgatgatgggtgggatttgcgcgctggtggtcggggatgccgaggaggatgagacggagctctgcgcgatctgcgtccacgtcatggtgcccggacggccggacggccagtgcgcgtcctccccggatgtacccgcgccttccaccacgactacgtccaccggtggcgaaccatctcgccgcgctgcctcgtctgcaatgcgtgggtgacgcagcggtcgcagggacctaaccgtcgccgtcgcccgcccagcctgatctgagttcttggcatgtcggcgttcctactttccttataatggctcagctcttggctcttggtgaggtatagttctattcccgctgattgtcgtagtcggtttctaggctctgcacagtgctccttgccgatttcttgttttttttcttgcgattcttctatgggtctgcatgtaaattgacttgttcttgtatttggtggtagcaagcagtatggtatgcaggttttagcccttttctcaattttttgctgtttacttttttcctacatgtattttgtgcttgcaaattttcccaatgcgtcttgcttaccctttccatgtgttgggtcttgtaaaaaatttcccttttcatgaggcccttgtgtaggaaaaattgccctctttgctgttgtgtgcgatattttattttattttttaaacattgttctagtgttacagttttacatagttagtaaaaagggtaccgttgttcggaaggggtaaaaataactatgggtcaacacacatatggtcatatttatgggacctgcccaattcccgtttgtaagcggcatccccccctctttgggtgatgtaggttgctgtgattgctggtaacttttcaagtgtatttgtcaagtggtcttaatttgttattactgctaccgtatgtatttatgcggttgtcattaccctgccttttttgttgattgagctgatgtttcttgtcgaccttgctgtccggttgtcctgcctgtgggctgattcgttgctgcgtgcgttgtcttctttgaaggcagggtatttactgggggtgattcatgtgcgtgtcgacctcctgtggtatttactgtcctcacaggttgtgctggcgagttaattcactgtttattggtgtaggtgtcggcttgcatgtctattgtttgttgtatgcgtgtccatgcccttgcttgctgtcccttcttgcccctctcctttatatggttactctgtgcatcagtgcttgctcttctgttttcctttctacgaccggttcgttatttgtttcttctttgttcttttttttccctcccgacgcttgctctgttctttcatttatattgtgttaatgttgtactgatcgtacgcctccttgtttctgtaaaattatgatatccatgttcttacttgtgaaatcttattaggcactgggtatacttacttggtcgtattggtttatgctgtctgtatcatctgctagagctcgtcgtgccgcaatccttcgtggtaggagttcttcctcacggccagcatgtgaatcaacacgatcaacaggtaattgccttttccttcgttactatattcatttttactccccttttgcccgaaatgtaaacgtcacttctctagatttgaatttgtctttgtcctttgcttttggaaagtttgattatgttaccttttttttagctacctcgttcaattctggcccttcgtaccagtctttggtcattcggaggaaaaggaaattggcaatcttgcgtcgccggttgtttgcttcaccaggttggttctttagccgtgtttagttgcaaaatttttcttcaaacttccaacttttccatcacatcaaaactttcctacacacaaacttccaacttttccgtcacatcgtttcaatttcaaacaaacttctaattttggcgtgaactaaacacaccctaagggtccaggcaatgaattgcttaagacccctgtactgtagctctatttatccgtacacagtactgcacatgaatagatgattgcctctgttttttttttggtcgaatgctcaggaggccagtaatacaatatgcttttagatttttttctggaaaatattctcattgtttgcgataagtcttataagctgacaaataaatgaagcaatcaaaattgatattagggtaagttcttatacttctataaagattaaggccagaaaatagagagggatcttagattttgtcacagatgatatgatacttcaccctgtgtgacattttcaactgaggagttgtaaagaatatctgcaacaataatttggaagtgaatcatgacaagtattcttcatataatttactagcatgattctatttctttttgcaagagatcaatgctgctattaaattcagtcaagagtgtatcattacctttctaacattaatattgcccttggatcataaggccacaccatgaatgcctgcacttttggtctttgaaaatatatttgtattgttttgagggtgaagctagctatggagcaacatgcacagattagaaaaaatgtaaaagtgcttgggaagacatgttgaatactgagcatgcagatgcaggtaatcgaaagaaaagttgaaatggatatattatgcttcctaaggtattaagaaaacatctgttttgttctaacccatgtatgccctatgtcagtgacattctgaaagagcatttggctatatacgattcaaaaaaaaaaagatgctaccgaatttttttggtgcaaacatgcttacatgcttgaagagcgaaccatttgcatcttgcagctgcgctgaagtggtttgaacatgtttgcagacaaaattgtggtttgtaatgagctcttcccacttgtaatcctttatggtggagaagaatgccaatcagagcatccacctaaatgaacacccatttgaaagtgtttgtcctttttgttaataaaaattatagcccaattcacttttttatcgttcatctttgttggtgtattgtcttctattaagccacttaatgacttaatggattcgcaaggacgacttatacttcattgtactctgtttattaaacaaatgtagaccatatttatcaaaatatgtatctactatctaatcattttatgtagaactatttgccatcgcgcgcggcgtggcgccgcgctctcctttctagtaaaagatcaaggaccatttctttctttcctccaacgacttcaacaatggaatatgttctggcttctacaccacataagagcaggtataatagcatgctgtaagtcagctgtaaacatattttaaagagataaataaggagagagaagagcagcgggctatagatttgtagccagctatagcacggacttcaagacgcagtgtgtgtatgacagatgggaccagatattaatagtatagtatataactattgtatgaataagcttttagattgactataaatgaattggagctagtagttggctacgctattgaacttgctctgagtttctggcaagacggtcaatctgggaagaggaaaagaactgcagcttacctacaaaacatgcctttctctgaagaatcatagcttcctgaactttctctgaaagcaattgctcttttcatttcatcactctttgcaaattagtaattgctcggtgcaggaggaattaccatatgccagcctgacagaaagggcctttatgaccaggacatctaaagaaatcaatcctgcaatggttcagctgctgcatacaactgattcacctgatgaagagatagatatcaggtatcctttgctgcaaaacaaacgatatactactagtataaggccgagtttagtccctttgaattaaggatttatattagaatttcataggattcaaatcctataggaatttttttctatttggccatttgatttaaaggattgaagttttcaaatcctatgaaattcttatggaatgacacattgcatatgggttttggaggaaatttagcaagagctcaaacctcttggaaaatttcctttgagtttatttctctcatccgattcctgtatttttcacgcgctctaatcaaacgaccattcctgtgttttgcaatcctctgttttacacttcaattcctatcagaatcctatgtttttcctattcctccattatttcaatcatgcgattcaaaggggcccttagttgcaaattttttcttcaaacttccaacttttccatcacatcaaaactttcctacacacacaaacttccaacttttccgtctcattgtttcaatttcaaccaaacttttaattttgacgtgaactaaacacaccctaagctatcatgtgacctgctggttcactgaggcagatatcagctgacagcataaggcctctcacagtgcaagctatggggcccgtacccctagtccaaaaatttggcccaaagacatctatcccacagtgtaagcacccttagttgtgttgtttaattggatgaaggtactgtgtaaataaaccgagcccacagtggggcgttaccctgccgcgtggtcacgggagaggaacgaaattaatttactcacctacccttccagcgacttctcctcgcgctcccctccatcgcccttcgccgccttgtagtccgccgcacccgccgctcctccttcccttccaccaccaggctccgctccagccgctcgtactccccgtcagccgcggcgctctgctctctctctctctctctctctctctctctctctctctctctctctcacctgttccaccggcgctggcgtcgggcccctcctctctcggcggcgacgaggaggtggagcgaggaggacggcggtggtggcgcggatctggagcggcccgagcttcgcccgtcccgggcgccgccttgctcgccccggctgccgcgtcgtcgaggactaggagctccgtggtgatggcgctcatctccaccttctagaagaaccggcggcgcgaatctggagccccgaggacgcagccacctcctctctctgccgacgacgaggagacggagcgtggtggtggtggtcgccgccacgatctgttattttgcttcttttttctttttcatcttgtggtggcaacaatagtgtttcttgaatccatattcttgagttcttccaatccccaagatcctctgccacatttttgcttgctgaatttgaggattatgcttgggcgggagaggatttaggagggtgaatcgggtatttcgctaggaggattgagtgcgaggtcacgggtcggcgaagcaacgctacccacagcgcgcgttccttccgttttctcctccgcccgtggactcgcgagagcgaggtttcacgcgtctctgcttgggggcgaggagctcagttggggcgcgcttcctcgctccacgcaagtgcacatccgagctggcgaggtggagcaccggtccacgtaggtgcactgtgagaggccttaaccaccatatgcaacaggtctctatcatttcaacctcagcagatgactggagctactgccatgatgattacaggatgcattatgtagccattaatattacggaaaagcaaacggcagagtgcaggactggtatgcgaagcccaggaagatcatgcaatgcaaccatatgcacggcattctacatttggtaaagttctcttaagagtaaattgcacccacggtgtaacaacttggcaggtgggtgtaatttaatgtaataacttgaaaaataagcgttctagcgcaacaacttggcaagaaggtgcaatttagtatcagaactttataagtgatcatataaatgcaacaacttgcaaggtaggtacgattttgatacaataaattaagaagttgtgacaacttaattatttggagcatttttatataaattcaaatttttaagtacttgacaatatactagcgtggatttgtataaacatatttatatttttatcctaataactaataactctaataactaataactgaaagtcaattaaactagatgtagaaattattatatttcggttgatatttgagaagatgaagaaaacaaaaaattcttaaaggtaactgaatgtaaattgtaagtgcaatataattcttaaagattaaattcagtattataaggtaatatccataggattactgtgtattggcatattgatatcgtgaaaaacctcacttagcatatgcttagccaaattgattcaccgaaatactaaattgtcaagttcttgtactaaaacgcacccacttgtcaagttgttgcactcggacgttcaattctcatgttcttgcactatatctcacccatctgccaagttgttgtaccgtgggtgcaatttattcttttcttaaacaggagaaacaactacactacaagaacatactaaggccgtgtttagttccattcccaaaatttttttacgtatacggacacacatttgaagtattaaacgcagtctaatacaaaacaatttacataatccgcctgtaaactgcgagacgaatttattaagtctaattaatccgtcattagcaaatgttactgtagcaccacattgtcaaatcatgacgtaattaggcttaaaagattcgtctcgcaatttacatgcaaactgtgcaattgtttttttcgtccacgtttaatgctccatgcatgtgtccaaatatttgatatgacggaatttttagaagtttgaagggaactaaacacatctaacacgggtccagccttctcgtaattcagatgctacgctaaatactagttattccaataaagtttggtacaatgccaacgatttttgcaataagtaccctcttttgcattctcatcctgactagtttggttcagacttgacaattgacaaaaccggatcactattcacctttctaatctaacacagcctatagggttcatttcgtcctaaccctttttgttcgtttccattcacctaaattcatctgtttacagttttcacgcccgacaaatttggaccaagtttgagaagtttcacaacttaggtagcaaacgactctttggtgttacttattagtgtcgataagaagacgaacaaaacattgcatcgcctgaattggatcggttgggagaagtaaccggccttaacgacgatcacaaggatgcattgctctcaacccaaatgtatagcactgattaaattcagttcaattcaaccacagttaaaaatttactcatgaacatttcgacaaaaaaaaactcaagaacaaacgaaatttacaattcgcttttctcctttaccgattcagagatgagcagcttgtcaaaaataacaatgtgaagttataaacatttaccgattcagagatgagcaacttgtaaaaaataacaatatgaagttataaacagtgaccaaaacgccacatggcgaagaagatgtcaacctagtgctaaaactgccttgatagattgtagtaagagaccaagtgactacagaactagagtagtagctgcatcctcatagcagccgaggaaacaagcaattcgcaggactgaaaactggactgccccgtgcggaagaacacctcaaatgtcagaacatctcaaatgtgtaaaccaatctgagaaaccgaaaggttcgaccgcttcttcaaccacccagctcaagtggctgaccaaaaaaaatgctcaaatggcaccaagaatcccgcagaagttcaagaatgcactgcaacaactgcgatcattaccacagtattttgctgaatgcccctactaagaaaaccctccagtctgcgacataagttctgtacaaatgattatgattcaactataacgatggcctgcagaaggttcccggtattcttatgctggcaacataagttctgtctataacttgagtcagattaagagttcaggggtcttcttagcccagcttccacctgtgaaaaggaaaatgtcaaaataatgtcccaagagtaaatgtgattgcaataatcttttgcataaatacatcaacatagcattcatgaagtactactaagtacactgatgccaattggtagaaagttattccgtcaacatgattcagcaaggattactgaagtgtcagccatgaattaagtatgatacccattccacattctgacagatttatcaactaaaatccgagaactggaaagtgtggtcctccaactgcacatgaccagatatccaaaatcaactaaaatcaatagaggcatcagggacccatatcatcataggccataattatggcttcgtaccaacataatgggtgctcatgataaattgtatttaagacatgtagaaccttcatcaatttgcagaatcaaacccaacttaaatgagacagaaaatgttcttcctaaggacattagaaagccagggttttcgacataaatgatgggattgtagaagtctaagaatgtgttaattacattatgattaaaaatcagacatagacttacatcattggccacaaaagatctactggcaaaagatttaagtcgtggagattgacccgcagatgttgatccactatcattactaccactttgtttatcaccctgcagacagagaagtcgacatgaatctaaatatggtagacttcaagaattgatgacacagacaaagacatatacttgaagcactgaaacttttaaaacatttaattttgtggtatgaaactaatatatttgtggtatgaaaattttatcgctagacatgatagaaattctctcatgatattataattcgaagttgtatatcaaagactgacaaataaaatatgtcaagtaaaaaagcagagtagtgcatatttaaacacctacacacaggaaaatattttaagaaaaaattaggagggaatacctgatgagtgcatgtgttgtttcggacatccgcgaaaagagaagaatagtaggcaggatcataaatagaaccacccaatatatcatcagccatggaatttcgtctaactgaacttgatcttgggctcaagaaactatttcttccatcatagtttacttcatgatatgttggggtgcttgatgaaacccccagcctatacatctggatccatatgaaggaagacaaaaaccttactgaaaacccaataatttgcatccacaacgctagtttgagtgataaaacgaaaagttgaccatacttctcttcaggagtaatattcctgtataaatataatattagattaaaactctgtacaatatcaaaatattctccctgtatcttaaaaaagaagtgtattggcaaatatttccatgtccatccaatagcaagcataacaacaaacttatgttttcaggttataagttgatgcaaggcatggaatactagaagcaaccaagcgccatcacacataaatccaaacaggtttcatcatacaaaggtacttccataacacacttaattccataacaaaataatgcaaaatctacactggcaagtggcctgataccagtgcaattgtcacaaaatgggaaaaagaaaatttgaaggattcccttaacttccaaaagaatttgaaactatttctcagcacaaataaatgacagaaacaagggaatcaagattggcacaacttgaactagaatgagctccaaaggatggtattaggatgtgtgtagcatggtttgcattttactacttttgccccatcacacaaaaattaaaacaggttatgaactataaaatatagtggttgattcattgcagaagacataccatatagcatgtgagaagagaataaaccaagcaacatcaagaacaatagcgaagaacagaaggactgcatatgtccgaccaagtgtctggctgctactctcaattgcaacaacagcaaagagcccaattaccaggttgatcacaagaacgccattgaacaatgctccaagtgacccaatcagcgcacaaccaatctgagaaaatactgagaaattaattatgcagatgaaaacttcagtcttcagtaattcagttttggtgtgcaaacccctatttcagcatgataagcattaaagcagcatgatagtagaaggaaccaaatgtaaaagcaatcagtgaagataagcatttagaatgttaaaccatgatgaccttggaaagaagatagtttttgcttggaatgagagattcagtgcagcatctacaggattaagtcgtattcggtcaaaagtaacttgctgctaacactgtaagcatcaagaagatgactgccgcaattaaaaaaaaaggaggcaaaacaaggacataatacaattatggaagtaacattaaataactcctagattgaagcagaaaattatatgttcattatttcctaaaatgctacctctaacatagaccaaaaatttactcaaatgctaaagttcgctttacatcataaactcataatagagcaaaactaattgctttgcaagacagccatgaagtcgtcagaatctactcaaacatagaaatattgcactagttcacatcaaaataaggtatatctcctctttttcaccatatttgccaaagcccacaatgtacaataccaaaatggaacaaactacaaaatctaagaaaaataatcattgatattggacccttcaaaccctattgtcaagtacaaaagctctctgatatcatttaggccttgtttggtttggaagggattggaggggtttgaggggggcataataggtgtggtacaaaccgaatatctcccttggggattaaccgaacatggccttagttggtcagagtaaagagtgcaaatataacaactataatctccacaagcattttgagagaagaaaaatcccaaaacgcggactaaaaatattgagtgagaagcaggtgagtaggtgatgcttttcctgaaacattggggattgaatctaacgagtggcaaggcccataatctgacaagcaggctacctcaccagaattggggaaattcgcagtcctagcaaaatgacggcattgaacttcacacttcaccccaaaatcagatcgaactgaaactacacacttctcctctctttcttcgtttgattcacgcagaagaacgaaagcctaaacctcattgaaccaaacaccccaattcgccaacacaatccagacgccgcgagcaccaaccacaaatacaaattcggcgctgccattacgccctaacgccgcccgcggcagttgcctctaatagataggtgccacaaaacctagggcacgcgctcaaactctctcgcctctcggttcgcaaaaacaacaagcgatctcgtcccgggggaggcgccgatccggtagatgagggggggaatgcgcgcacctggaggtagatgagggcgagggcgagcgactggagcgcgtcgtagtcgcggaggaaggagcgcagccgcggcccgatcccgatcccgagcgccgccgggcaggggcagcagcagcagcaggagcgcatcccggcaccacgccgagcccggacatgcaaaacctcgcgggcggtggtgcgtttggggggtggcgcggctgcttcctcctcctcctcctcctcctcctccggcggtggcgagcggcgagcggcgtgatcggcggggaggattcgcggcgagggggaagggaggcgaggagatttcgcctgcttcggcttgccctccggcggccgatggttttttttattattattttttgggtgctttaattaattaattcggtgacggcgaaggaggggcaagaagacgtttgcgttgcgttgccagatttgtttgggaactaagggtgtgtttagggggtgtttagttggggaaaagtaaatttttgggtgtcacatcgaaagtttgaccagatgtcggaaggggttttcggacacgaatgaaaaaaataattttagaactcgcctggaaaccgtgagacgaatcttttgagactaattaagccgtcattagcacatgtaggaggttactgtagcacttatggctaatcacggactaattagttttaaaagattcgtctcgcgatttcctccataactgtgcaattagttttgctttttatctatatttaatgattcatgcatgtgtctaaaaattcgatgtgatgtttttgggaaaaaaattttgggaactaaacgggcccttagttggggaaaaggaaatttttgggtgtcacatcgaacgtttgaccggatgtcggaaggggtttttggacacaaatgaaaaaactaatttcagaactcacatgtaaaccgcgagacgaatcttttgagactaattaagccgtcattagcacatgtgggttactgtagcacttatggctaatcacggactaattaggcttaaaagattcatctctcgatttcccccataactgtgtaattagtttttctttttatttatatttaatgcttcatgcatgtgtccaaagattcgatgtgatgtttttggaaaaaagttttggggaactaaacgggccctaattcggtttgccttcgctttattagtggtttccaactgagagactgttggtgaaatgaaaatttttgggtgtcacattagacgtttgaccagatgttagaaaggatttttggacacgaatgaaaaaaactaatttcgtaactcgcctagaaaccgcgagacaaatcttttgagcctaattaagccatcattagcacatgtgggttactgtagcacttatggctcatcatagactaattaggctcaaaagattcgtctcacgatttacatgcaaactgtgcaattagtttttctttttatctatatttaatgctccatatatgtgtccaaatattcgatgtgatatttttgcgaaaagtttttaggtaactaaacaaggcctaactaaactggatgaatacccccttgctgcagaaaattaagttactgtacataatatatataaataatatgtaatttgattatcaaaaataaaacaatttgatataattttaagcctaaaaataattgagattgcatgtttttaagagagagaaagaagagacaatttagaccatagatatatcatctaaaggttagaaataattgagttgatgtgacttaataagagaagagagaaataacattaactatacttagtgaggatgaactatataagtatatataagtatataagtatatagaattagggtttgcgaagccatggttccgatgcatcactacatcacctcatcgagtgctacctccgtttttttaaatatatgatgttgttgaatttttgtaaatgttttcattttattcaaaatattttacaaatataaaaatattatttaagttatacttaaacaatatttgatgataaattaagtcataataaaataaatgataattacatataatttatgaataaaaaaatggtcaaacgtgtcttaaaaatcaatggcaccatatattaaataaatagagggagtaatacatatgaaccagggctaaaaccagcggccccatcgtttggcacgaggaaaaagcgaaacgatatacttgcaaattaaaaaaaaatatgaataaaatttttatatacgtgttcttatatcgatataaaagtaaaggctgaaaaataaactacaataaaaaaatcctaaaattaacttcaaatttatgtttgaaaattcaaattttggctgataagcccaaacaaaaagacgaggctacaatacattcatatactactagccaggataaatgtcgacttggaggtagcgatgatgttatatagcgcgatcgctagtacgcgcgcactcgccggcggcgtgcgtttcaggcccacaaggcctagcgccggcacgcacgcgcctccttccacgctttttttttcgttttctttaccgattttttttgttttttcccacttttttatgattattttttaatctttagcatgctttgagtttgaaagttttaaatttttgagttgaaaatttttaaatctgaacttgaaagttttcaaatttttcaaatctggattttaaagttttcgaatcttgagttgaaagttttcgaatcttaagttgaaagttttcgaatctgagttgaaagttttcaaagtttaactttaaaatttaaatattaaatcaaattttttcaaatctgacttaaaaatttttaatctgttagtaaaaaaatctcccgaaaaaagaaacaaaatcttgagaatcttccctaattagttattagtgttaagtgttaactaatactatagagtagttatagtattagtagttatagggaagtgctcgctgctggcgcgcgcgcgccagctagtagcccccgttatataggaatacactggtcctacctctttttctttttactcttgtcccactcaaaatggtttcatcatagattctatgatcatccaaagaactgattttacttagagggcaatgcacaattgataataagtagtaactcagttaggcagaataactagaagtaggaatcaaggttttttttttatttatatacgatactaaggcaacgggcaatatgttgtaaaaccttcctagtggtaatcttatcagcagagaaatgtgccaactctttattaaaattagggtgcataatttattttgtgtacaataaagtcattgtcgtctaattcccattataactcaattatacaatttatggtagtatttctatatatactgtatatctacgggcctaattggcgacagaagtatgtacacgcgtaagcactaaataaagccgtattgccaatggtcctgctggcagcttaacacgcattacagcgtgactaatctgacgctagctagtccaacttctcgaaccttgattaaaaaaacacttaacttctcaactaattcacttgcaggattcgacaataatattcaatctaatcgaacagcacagctgtgtgaccatgtcatcatcatcgataaaagttgcctaaggatggttagtgactagctaggcaactttgtagttatagtggttataataagagttgtttagaacaatagactatcttagaaaggaatttagtaggattagacagagaaatggctgtaggcaggggtcattgagcctagagaattttagagaatttttagagaatttttaactaaatattagtggcttttcgttgtaattttctgtcatatgtgggactcaagcttaagctgccctgtacactgcgtgcatctttagttggtgtagagatcaaaacttataatttctttgtaaaagagaagatatattagatacgaggttatttttctctatgagcgcctttggatatcgtacaaatgctcattataaattgaattttcattacggataaagttcattggaggaaactaaaacatcattgcccccaccccatcccaccccaaaagaagaaacattatgtcaaatctcatggggaagttttctcaaaagttcaaggcagtctcgctctctctatatggcaagtctagtgagccatacttaaattagtttatcaacctatatgttttagttttctttcttttgtttagattcactaatatttatacacgcatatgaaacacatagatgagtccatatatggctctatttaataccaaaaacaccttaaagaatgtacagtgaaattttttggaatacccaacagacattcaaaggagcaaatgcaccaatgatatcatccactaaaagacatgagacctaccctgtaggcagggccagccctgggcctaggccggttgtgcaactgcctagccccagggccgtgctagggagagcgaggcgctgctttgtctccgcgagatcgaatgccctgtctgagtcgccctaactccaactccacgtctccacctcgcctaaccacctccacgagaccgcgataggccgacagcatcacaacggcacgtcgagtcgcccactcgccttgcctgcctagcgcctgaaccctgaagcctgaagggtgaaccgctgattcctgaagctgaagtactgaactgctgaaggtggtgctaatcaattagttcaatatatatcaattttcatcatttcaattaatggttattgttgtataatttactagaatttcactatttcagatgttacaatgttacctaacaaatatttgtcgggtgctcagtaaagaaacaaaagaaagtgagaagatcaattaattgatctcttattaaggtatttatagtactttgtttccatggtgttttttaattatcaattatattatcgttattatttatcgagaataaattactatattgcaacttgcaaactgattgatttatgagcaattttatagtctttgaggaggtaccaaactttacactaaatttttgatacctcatggtacctcctcaagaattatataattgctcttgatttattatttatcatattagaaatgtttatttctgttatagtatatgtgtttcataaagtatatattagaagtaaaaaaatagccttaacttgtcaagggcccatgctaccaacctcgtatagggccctcgaaattgttgaaccggccctacctgtaggagtaaacccatcacgaatttttcactttcttgtcagtttccctagaagaacaatttctatgggtatttttctgagggtcgaacataaaaaaaaatccactgtcgtcaggtttttttcaccaaaattctgacgtggaactgcaaacgtgaatggtggttgcaaaataatgttagataccagttttagaaaaaaaaagtaattaacaggccagttattatggcactcccaacccataacactagacatggttttcataaactccacatcatcaagaaactagtactagacgctactcttccaatgcaaacaccactattacatacttcaatttaatgctacttatctcacatgatgtcttggatgttgtgtagaacccatgtctcatgcaagatatggtttccttccctttcctcatttattcacttgccacatcattttttatcctatgtagcaacttatttaatgctatggacaccatcctagtcattgggtttgaaatgcccttagtggttaccgggcaaatgtttgaatccgaaatcttaaacctatatttttttttctgtgcaaaatgcatgcatttgggtaggaggaatccttcacgacaattaaaacaggtgattttattaagcacaaaccaaaaacaactcttttccatccactagattaggatcactctatatgcccccaatcccccgttaggtttcttgccgtgggatctattcacttaggttcaagtctatcacactgcacgatgctcatatctatgcctatttattcttttagtagagactatgttcttaatactccatccgttttaaaatatttaacaccgttaactttttagtacatatttgaccgttcgtcttattcaaaaaatttgtgaaatatgtaaaattatatgtgtacatgaaagtatatttaacaataaattaaattgtatgaaaagaataaataattacttaatttttttaataagacgaatagtcaaacacgtaataaaaagtcaacggtgtcaaacattttgaaacggagggagtatataccaagcaaaagtcttttagagatgtttacaagaataagatgtgtgtttgagtgtatcttcatacggatgagtgtacttccaagatcggttttgcaatctcccaaggaaatattactcccaataacaaattgcagaccagagatgaaaaacattttcccattatctaacattatacataattgcaacaaaactctaatagttaaaactagagctgttaaattaagtttcaaccattctaaaggtaggaagtaagagtaagtttcaaatcaaatacggaaattgaacagtttctcagataatctcttgagtatatattctagctttgatccgagccattcgtctcagatcggacggtcaggaaacgtccatgcagtttctcttcaaatatagtagccgccaaaaaagctgggaatctccagctcgtccagcccgcgaagcacctcgtcgtagtcaaaccagtcaacatcttccggcgccgcgccggagacctcgccggagaagccaccatgctgccggtggtgatcatgatcctcgccgccgtgttgctcgagcaatggcggcaccggcgagtcctccgtcttctgcccttctccctcgacagtggcgccattgccgtcgcccaccagctgttcgagctccggcccggtagtgacggtatcctcgccggagacggagaagtcgacggcggtttggtcggcgctctcaggctcaaggcctgcgtgcgccgccgcgctctcggcggagtgcgcgtgctgtggcggcggcggcggcggcggcggcagcaagatgaacgacggcatcacgacgtagcggcgctcgcgctcgccgcggagcgcgctctcccatatggaggactcgagctcggtcagccttgagcggccggccgcggcggcgagccggccgaagtcccgcgcgacgtgcctcacgacggcgacgagcacggccaccttctcggccttcgcgaggcggcgcgggctcgcgaacggcacgggcgtcgccatccgcctcccgcgcaggtgcgccgccacctcggtgccccaccacggctcctccgccgtcggccaccacggcggcggcggcggcggcgtggcgccgctcttcctgtcccgccgcgccaccagcggcggcgtgcactcctgcgccatctccctcatcatgcgctccagcgtgccgttgcggagcctgcagagcgcggcggcgagcgggacgccgccgccggccaccggcgccattggcatcgccacgtagcagagaagctgcgcttgcatggtcaccggcgacagcatcaacggcgcgacgccaaccatgggcatggccgccaccgcattgcgcgccacgccgtgggtctgggagagctcgtcgccgggagcgcgtcgccggcgcttggcatgctgctggtggctcgaggtcgaggaggaagaaaccctcttgccgctcgaactgctggccattggtacagtgcttgattaatcctgaatggacacatgatttaagtttcaattattaataataatttgctttattaccagagcaaattaacaagcaatattgatggaaaaaacttgccctgtcaaaataaaatgatcaaaatgtaagaaagggtgaggcatagtatattttgatgtctgaaatgatctccttttaatagaatccgttcagcattttggaaaactaattcaattctcttcctcttagagtttctcgatatgataagaatgtttgatcttatcatatattttgatgtaatctggcacaatccgtactttcttctgcatagagttcttttcagcaactcgtaataacaattttatcatttttcgtcagggtatgcttttttatcatttttcgtcagggtatgcttttcgaacgtttaaacaatttatcaacatggaaactgaaatttttgtcaataatctcataaagaaaataaatagctggtttcctgccaaaaataacaggagggagaactttacaggctaattaactaagggtctatttgggagctttggcattaggctatattcttcgtcaagggttgggaacccttcccgaaaatgaagcaacagattagcatgtgattaattaagtattaacttaaaatttttttaaaaatagattaatttgatttttaaggaaacttttgtatagattttttttaaaaaaaaacataccgtttagtagttcataaagtatgcacatgaaaaacgaggaagtagaggttgggataagagacttttgaataaagccttacgattctaagaagtcgtttgagggcctaagacatatatagatagatgccaacagttttttttttttgaaattttcgcaggggggagagattccccacgtgaatttcattaaactggaaggggacaggaagaagttcgaattacaaatttagagatcacagggaggaagagaacaattctttccacgaggaaattacaattctttcgcagttatcatgtatacaacttttatcgccaactgtaagcatctggtgcagtcatagaaaaaaaatgtgtagtttcctacccaaaatacaaattattacttcatccgtttcacaatgtaagtcattctagcatttcccatattcatattaatgttaatgaatctagacatatatctatctagattaattaacatcaatataaacgtgaaaaatgctagaatgacttacattgtgaaacggagggagtatcagctatgggacattctatttccagagccagcgcgtccaatgtgaaatggtttggttggacaggtccgatgccacaaaaggatatgtgtttttagaccgagcgtgtgtattgcaagccacacaccatgttgtcatcacaagataacttttacgcacaattatattgtaatcataacctgactcctaaaacatgtttgcgatgactgatgaacatgaaaattatttgttcaaaacttctcttgaaagggttattttatatggttttgcatagtttagagatatctggtcttttatttcggtaaagtcgaccaacagcatagtctaccatatcttttctagcatctaacatttgagaagctcatataaagcaacatatatatagttcattttcttagtgttttaaatcatgtttttgcactccgtgtttttctacattcatggtttctatgtaaaagaatatgtacttgctgaaaaggcttgaaactgtacataaggtcccaatgataggattaactagcaaacaaagttaaaaaatcggcagattttaggagaaaagccattttcaaatgtaaccaaaatcttaacttcatcatagacaaacactactcaaatctttagacaacctcatacctaattacctagaatgcatgaactatttactcgaagtgaaaatcttaacacaaaagatgaataaattgtgtaccttcaagatgatcactcagctgccatcttttcattagagaccaacagccgctttgttagtcttgaagacatagcactcggcatctggaaaacttgtagtcaggtgaacgatggtaatggtcactgtagtcctatatatagggaagagggatgcaatatgagttggaaacagaaaccatggattggtacagttcttccatatatagaagatgaccacgaatgccactatatgcaataattacttgcgaaaacgtatttgatatttccaattttaaatatcccaaagttttacatttgataatgccatggtggcaacatttagagagagggtaggcacatcggtgtcggcttgcaaggggaatgttgaatagttccacattggttgtcaaagggcaagtgacactactggaaaactgatctttgctaggtcgtcccaaaaccacaatagtcccagttataaaaagaatcgggatctttagtcccggtttaaaaccccatagccattctacgatctttagtcccagttggtaacaccaaccagttcatcccctgtcagtcccttgtcagaggggcggggatctttagtcccggttggtgtcacaaaccgggactaaagatcaccattttatcccggttggtaagtaaagatcctagatatttactcccggttggtattaccaaccgtgactaaaatcacgcatagtatataatccttattccctatcctctccgccacaaccggcctcaatctcctcaacaaccggcctctcctctcctcagatccatctccctctcctcctccccctcctcccatcccggccctctcctccccctcctcccttcccatccgatgcccagcgagggccgcctcctccccctcctgccttcccgcacgcgtcaggcggggccacgcccggcggggccgcacgcaggccgcgcacgggccgagtagcgagcggcggcaggaggcactaccagcatccattcttttttttctttttttttacaatttgtgattcactgagatgtataattttgtaatttgttgtatggatctgagatgtataatatgtgatgtatttgatttgtgtgtaatttttttaaaatttgtgatgtatttgatttgtgtgtacaagtaacttaagatttgtgatgtgaatgttttgggatgttactttgatttggggtttgatttgggaatatgcatcccactcgatttgggagaaaatatagggattaaactctggctaaaaaataatgaaaaaaaaagaaaaggagacctaatgggactgccgctaccctctctttagtcccggttggtgttaccaaccgggactaaagatcgatctttagtcccggttatttcacccaggactaaagatagcgatttttagtcccggattcgtagtcccggttggataaccgggactaaaggggggttatgaaccgggagtacaaagggtttctccaccagtgtgacctaatatataagtggtgggtggccctcacctcattggctatctttaggtgtggaaaaaaccctttaacatcctacaatttgtatcagagtcaagctagttcaacatctctagtccgatggacaagagtgtcaaggcctgatagaccgtgggtgcttgcagggctcgtataccagaaggaccattggtgtatggtgaaggaggtgaacggctgagagacaccaatgtgtaaaggggaagattgttgaatagtcccacatagggtatctctcgcctcattggtagcttttagggtgggaaaaacccattatgatcctgtacgtccactcgcggtccgaccgttagcctaaaaatagcttgataaagcttgtataagaaaaagatgttttcttcaaaaccaaccgttgaatcgagctcaaatctttacaaataaactagacaaactaaggaacaagttcgccgcatggattagcaaactaataaacggtttaagagaaaacactctcaagccaatcgtctcagaaatttcagcaaatctaaacaaaacataaaacgtaagcaaattcaaatctagcaagaaccaataaacgaaaccaccaatcgtcggtctggtcgttggaatttagaaaaacacgtctcgatgaaacagatgtgtttacaaagtgcatctaaagcactcatctcttaactcatgaactagaatcaaagcctcaaagcaaaccctaatttttctttccccaaaatcaatgtatcggctactaacctttacaggtactttggacccaagatgaagttactttggaagctaccaatccccctaaacaaacacatttcctgtggttagctataagagataggattcaaaccacaaaacatctaaaacaaaaaaaaaactgggagggatgtgagttttgtgagctctgagccactcaaaatgcacatgttattttagctgccctatggcatattttgtttggtgttttgctagagacagttttggttgggattttgttccaccatctttttatcatttttttctgtattgatgaaagttgatgatagctctaataatagtttgagatatattgatgtttctggcggcggtaatctggtagctatggctgaccagaaacgatatgatctttagagataagttgtttggcacgcctctaactataatctaccgtgtgatctctctaatgcaacagtggaagattctggggagataaaaggacggagtatttgacctcatcgttgcttgaggggacaaaagtttccacccgcaagaagtgggatgatttttttttcttcaaaagttgttgtcatttttattcccgctagtctagttgtttagaccctttgagatgtgttgtttatggttttaacatctttccttctctatttggcatgcgtaccttttatactgaaacaaagctaaaactataaagctggtctccccagcgaactaattatttttgctttctataaaagcagcgtaatgccttctatcaaaaaaaaagttgaaaagatgatgatgagaaacagcataaactttcaactaggtgaagtcagaaacttagaatcaaaataatgtcaataatcctgacacatagacttgttccgtaagagtgtgaatatagataaaaaaaacacccccttgtactcacgaccaataatgccattggaaactgtaagagatctcaaactgtagatagcacatgtggaatggctccatcgaatgaatttgagcagcttaccgggcagagatgaagatgacccaaggcgacatccatctccaggctgcaggcgctcttgatggtgaggcaagtatcgcggggccagcgacgactggagaatgcgcgtggatggccacgaggagctgcgccgcactcacagctctggtgaggtcttggggatgaaacgatggggacgagagtgaaagtataatatcgaagaccgtgtagaaaacttgcgtgcttcataatttgggatggagggagtattaactatgatctaaaatagcacactagctcttgatggtgaggcaaggtgttgatgcgaaaaacacacactggcctgggagatctgcttagctccagtgcaggtccaaaggttggtaagatgcgggcgtgccagtcagtttgatcctgcaactgataagatatacaaacagcagatcaataagccgatcggctgtcaagccgatggagcaattccagccgatgctgataccagccgatagcgatagggttttaagctatcggctatatgtttgatgtagagtcttaacacttgatataaataaaggcgatcggcttataatgataactaacaaaaatatagcaatataatccagtagagaccaatcggctaataatatgatataatagaacacaagtattgatccgaaggtcaaaatatacatcggctggagatccgatgtcataaaatccacaagattagatagatcaatgaaacatttgttgtcatcggctaaatccaacttatatgtttatgcaatccttataagccaatgcaacatccagataacttatcagctagcaccccgataaaacattagcatgaacctattggcttaacaagacttatattatcaacaacaatctagtggtcgaacctaaccgatgcagcacgagattgtatatgataatctaatactcgatgagccgatagatctgtctaacgtgatggatataacaaatctatttagagcaacattgtgattgtagagatatatcggctaagatagaagatcggacctaaccgagacagtcccaactaaaccgatgtgtctctaaacacaatgcaattaaagatagaattgagatatcaggtaggcaaatatatcaaccaaaccagagcgatccaagagatcgaagcgatgcagccttgaacaacaccaacgtaaccggtagattcaccagggccggcggaacgtaggacttaccccttcgccggagatcgaactgaatcgatgcagccccgcgtcaggtgccaaattccgccggttgataagtaaaacctcaggaatgagggtggcgatgcgccgagagtagttgtattgatcgagagattgattagaatgaccctgggtatacatatttatacccatagggagatactagtccttgtaagacaagaaagaaactttcctaaagataaaaggaaaacataaagtccttattggacactaaacacactttcctaaagataaaaggaaactaacaaactattcctaattaatagataacttgtcataccgcatcctcattgaactcggattcttctggataaattttctttaattgatccgactccaccaagaacacaactgctggcgatttaacgactcccatcggccgattctaaaactctaaaaccgatactgactctaggccaatgatgacttcgggcttaccaaattttggcgttaacacaaggatcccggggccagcgacgactggagaacacacgtggatgccgacgaggagccgtgccgcactcacagctctggtgaggtcttggcctcttggggatgaaacgatggggatgagaatgtaagtataatatcgaagaccgtgtagaaaacatgcgtgcttcataatttaggatggatggagtattaattatgatctaaaatagcacactgatttgcatttgcctcgtcaaatgtttcttgattttgaatagaaacaatgtagtattaagtactcactctgtttcagattatattgactttagttaaagtcaaactgcttcgagtttatctaaatttatagataaatatagtaatatttacattaccaaaattagttttattaaattaataattaaatgtatttttataataaatttatcttagatcgaatatattattatttttttataaacttaatcaaacttaaaacagtttgactttgaccaaagtcaaaatatcttataacttgaaacgaagagagtattagtttaatgcttgtaaccagttcaaagaggtaatcacaaagtacatcatgtttagtccaaagattttgcatacaaattaacttctttacaccattcatttacatccattttggtcaaatgattacataatttaagtatacttaaaacaataaaatgtgtatttttttaaaaaaatatgtattcctaaaacaatggaatgtgctttttaaaattgattcggctcatatcgatgggagaggtttaggccctatttggggagctttagattctaagaagaaactgtttgagcttccgagaatctggaaaagctctgaaacccagcttctccagctttttagttcatttttcagaatcctttgaaaccctctgaaacccagcttctgaaacccagcttctctagcttctggcttcttggtttatttttcagaatctgaagctgtggactgtttggagcagcttctagcagaagcagcagcttttgggaaaagatgcagctgggaaaagctcccccaaacagggccttagcctcacatcgctcagaggtttagcattacaccacaagcatgtcctttcatgtcaattttgataccacttgggattccaaaataccaacttcaataatttttccctcaagctaaatactactccctccgtttcatccgtttcagattataagactttctagcattacccatattcatatagatgttattgaatctagacattatctatatgaatatgggtaatgctattatctatatgaatatagataatgctagaaagtcttacattgtgaaacggaggataattgacaagttccaagtaacatgtcgcggaaacatccatcatgctgtaaatccttgtgcaaaatgaacaggtacaaataatatccaaaagtacggaacattcaagtgaggtatcattacaaaaatattggactcgccgaagccacatgccttacaaaaacagattgaaacagtgcttcgtcctacatatgaatgagatacatgccatagctcctagtcagctccatgtcttaaaggtccacgtatcaagcatcaagcctacaagagcagaacagcgaagttgaaaaaaaaaagagtatacatagaactttgaaaaggcactatctgtgcaagcacagtaccagaataaagtctagtataacaattgaactgagaatgaatagttttgtaccttgctagcaatgttgctggacagccaatccaggccctcatacaaaccctcgccagttgtggcacaagtgctctggatgtacctgtcagaaagaagaccaggttgagatccagagtaccatgggaaaaagtgaagcagtgagtaacatgaataatggcaacatgatgtgttacaatcgaaacaaaggatagaaggaatttcccctagtctataatcagttatcattgagcatcacactatatctacagaaaggactaaaaagaaaagagcaaggatccaccagtaattcgtatttaccagtgacgctgacgaagggaatgtaatccaagcttatcagtaatctcagcagcattcatagcgtttggaagatcttgcttgttggcaaacacaagcaacacagcatcacgcaactcatcctgccataaatccaattaaatttcatcagatagggttgcagaaagttgttagcttatcaattggaatatgatattttcacagttgctttgttaattattatgtacatcgatcaaaccagaggcataattgatcaaataagccatatggtacagcgatagcaaaaaaaagtgacagagaacaatttacctcattcagcatcctgtgcagctcatctctagcttccacaacacggtcgcgatcattgctatccacaacaaagataagaccctgtgtgttctggaagtaatgcctccaaagaggtctgatctgtttttgcaagcatttacaaagatcaatcataaggtgagataacatatgtcaacattttaaatattaaaacaaatcaagacataggacagcttaatgtaaacaacataaataactaggaaaccagatgctaataatgacaaagataaatttaattgaaggcatcaaataaaaatattggtcaaaatatggctgcagttcttaccttgtcttgaccccccacatcccagacagtgaagctaatgttcttgtactcaacagtttcaacattgaaccctataattcaaagaaaatcagttagcttgaaagatacaaataaataaatagaaaaggagataataccatagcacaaggagtcaagaacataaaaggatccaaatgttgaatagtttaaaatttaaaacctaaatagatgcctaataaagttcactccgacaatttaagattcaatcgatatcctacatgtaaagttgaagtcttaaatttcataagaaacagctcccagcgttatgcaatagttcaaatagcttttcaagtaaaacaaatgacaagcagacatctctgcctatcaagtgtgctagtaaaaacttagcattcccatggtcatggaataggacatttcgtctttccatccaattaggaaatttgacgtcaatacagccaagaaaacctagcgacaacaactctgcagaactaaagtccattctggaaatgaactctaacagcacgcaacaaggctaaagaaattggcatatacaatgtacagaaagtcagaaatggaaatttgatgtttatacaaccatgaaaatagcagcacgaactaaattacattctggaggcctcatcgtttacccattggctcatatgccactgcaaaagaattgaattttaaaacatgattttgaagttgattttgacgctttttcaatgtacctttttcctcagtaatggcttttaagttgctaagaacatataagtaaatatctacatacaaattattttctaatcactaataagacattacggcttataataagtcataggcaacggatggggtcctggatagaacacaaacagcaagcggcaaggccaaagaaattggcatattcctatactactttaaatgatgctagtggtggcatccgagtccgcctccaatgctacgagctgacatgtggtgtctaatcaattaactctatgctataaacttgtaattacatgcctttttcttttggatatagcattatatgcctaatcaattaacaatgctacaaacttgtcattttttgcttttgcttttgattttatttcttacaatatccgtcgcatcgcacgggcatttagctagtaatataacaatgtacatacagaaagagaaacgcatgtggctgaccaatggtggggatggtggtgacgatctcgccgagcttgagcttgtagaggatggtggtctttccggcggcgtcgagccccaccatcaggatccgcatctccttcttcgcgaacagccggctgaacagcttcccgaacgccaaccccatcttcccccctcctctctcctcttttttcacctgcaaatccatacgatcccatccgttaaaatccaaatccgccacgagatccaacctccctccccccacgccctaacgcctcgaaaaccagatcaaatctcgaaacaaatggcgccggatcttcgcccccacgcatcaaccaacgaaatcgaacgcggagaaacggcggatccagtagaatcatcgggcggcggatggatcgccggagaagggaggggcgggagagctcacctgatctgatctgcgatggaattcgggggctggggggtggaagcggatggatttgggggggagggaagggaagagaaggggtggtggagaggagcggagaataatataaggatggtgggcatgggatggagggcgtccgatcttgggatggacggctgagatcggtctccagggaaatttggtggcacgcacatggagagcggagaggcaggaagcttctgaaaacgtgcgaatttctctatacggactaaaaaattttctctccgtccaataaaaaaacaaaattattactggatacaatgggattcttatttcacacgcgctagacgagtaactagtgttcggaagatcggttttgtaggaccgtgatcgtgaggatcacggtacctcctccttctgtttcctcgttaatgtagtgggcttataccaaatatatatgtatgtatccatatacgacatcctattgtgggtataaatacaatagtgaggttgagggcaaagtaatacttgtaacagagagagaaacatcgataaagttaattgccctccactttcgaacttgccctccactttcgtgtccgtgtgttcgtgtgtgcttgttcgattgttgacaacgtgaattctaacacgttatcagcatgaggtgctcttcagacaaggtatattgtcaacatcgatatgttctaatctcgttctatagggataatgataaacttactagatcgttttctattattttttttctccgctaatcgttcgatcgatgggttgtactacgtggatttgtcccttatggcgcacgtagcaggagagtttgcggctctccaccccatgcacgacaggcgtatggggttatcccttatacaaccgatctatcgaatgagaagcagttatcgctatagtccgattagatctgttcccagcctttgcgctgggtttcttttcttgcaaacaaagacacgtatatcgtacgccctagatgcgcgaacggatcagacaagccgctgcaagaacgacggtttagaactagtgatacctcgaagggcgacgctacgttcagggtgtaatcgcgatgcacatgagaagaatcgtgtacctggctaacatgatcaccgattccgaacgagtcggcccaaatcctcatgctagtgccgccgtcgtcctgaagttgacgacgacgaaaccgagtcaatgacgccagcatgcgccgtcgtgcccttgccgccgccaacacgcgttgccggtcacccccttcaccgatggccgcagaatcgtgccatcggctttccatcgtcggttcgcccttgaaaagccagccgacgggtcttcaatcgaccgcctgcactcgccgttgacggccgccgcccgcagagacgctgaggagaccgcgtccgcatcccccgccgccggcacgcacggcacacctcccgcgctaccgcacgcgactgggatgggggtcgaagccgccgtggcctcccgctgccgatagctctccgcctcgccagcccgcatgccgaaccaaactccaccggcgcacagcaaggagctgcgctagccgaacgccggatatgcccgtagccaaccacgccggcgtcggtgctgcttgtagcctcaccgccgctccgcctctatcgtcgaccccgccgcgctgacgagctccgtcgaccccgccgtgacgacgagccaccgccgcctcgctcgcatgagtcaccgggaaatccgccgccgccgccgaattggggattttggggctagggattcaaccctagccatccgaatcggataaggtgtggctcccctttgttgggctgcaccgtgggccaaggccattagcaggccaacggccctgacgggccggctactaattccttgaatggccggttcatggaggtgggccgaaaaagattttggcctataaaaggagtcgggctcgaatcgaaatttgccccgaaaaacggcaaacttccgaatattttctgatttcatgcggatttggaattttagcggaataatccctcgggattatagaaattacggggaacactataattttggttattctgcattattttatgccgaaacagagaagatgtttaatgctttttctttgtcttagccctcgattttctatgtattaagtgttcattagttaatttttgaatcaaccatagaatcctagagacatggtttttaggaaatgagctctcataatttgaaatttagtacacaccagagagcatcatatttatggtttattttccaagctgttttattttttcaggatactatttaatgggttagtaattcagtaattactttggtacctaaataaataatagtacagcaattctgagaaatgttgggagaattatgggaatatattgacacagtactaaatttagataaccagacaatttactatttgcacacttgtcatgctcttacttgcagtacttattgaattttgcatgactaatgtaggaaaatgactgatattgctaagagagattttgctgaactagcagtcagcggcaagaattacctgacatgggcactagatgccaaaatcatgcttggtgctaagaaactcctgaactgcattcaggacccaactattgcaacatcagctggaggagttaataatttaccaacttcagccgagaaaaatcaggcactgcattacctgaggcaccatttgaatactactctcaagaatgagtatatgactgaggaagatccgaaggtcctttgggactcactgaaggatcgctatggccatcaagtaaaggctttgctcccaaaagcaaaacgtgagtggcttcacttacgtttccaagattacaaatctatggagcaatataactcagttcttcaccgcattgtcacttgtcttaagctatgtggagagaaaatcactgatgctgacatgatagacaaaactttgtccaccttccatgccaatcatgtgaatattcagaggcaataccaccaggctaaatacgagaagtattctgaactggtctccgtgctcatggaagcgcaaggagaagatgagacacttgttgaaaatcatacgtctcgccccactggaagttcagcagcacccgaagcaaatgctagctcctttaagaaggggaaaaaccagaataaccagaacaaagggaagaatttctggaaaaatggtggcaaagttaacaagacatctttcaagaagaaaggaaatcagaacagtaagtctaagaagggctctactagtggtgaatatggaaagcaagatcaggtatgcttcaagtgtggcactaggggacattggtctcgcatttgccgcacccctaagcatctcattgagctttatcaatagaagcacgggaagaagaagtcagagcatgagtcacacttcactgttgagatctagaactcagaggagaagatggctgccatgcatatcgacaagaaggtcgacgagaaggcagtggttgcaatgcacatcgatgataagatggaacataatgcagcagacacagagctgaagctctcagatgatctcatggactctgatcagttatatggggacatttaagtcttccaatttgtatcttagcttcctgcattacaagttactttaaattttagactatgtaatagactaaagttaggtgatttttcaagtgtgcatttagtttgtgttcctagcagaactatagtttctgtaagctccttcagagcatggttatcttaataatttagttaactcttttagtttaatatattctccagatttttatttttctatcttaaagtgttatttttactatatggtcatgaattgattatatttaaatgctttatgatagaacagtgttacgtactatggcaatggaagaggagatgtgtctagtagactgctgtaccaccaatactatctttcgagataccacgtatttccagactttaaagaaaaagactggtcaaatcgctaccattaccgaaagcaatgcacacatcgtcggagtgggacgagcaacagtagttctcccacatggtaccaagatcattataaatgatgctctattatatccagagtccagtcgtactctactaagctttaaagatatccgtgctaatggttatcatgtagaaaccaaagatgagaataaactcgaatttcttctcataacgaaattagacggaaatcgtaatactgttgttgaaaaactccattccttgaaatctggcctgtactacactcatataaaacccgaaaatgttgcactgaaaacaatatttaaaaatcctgagtcatacagaatatggtatgacaggttaggacatctaggtctagggatgatgagaagaatcatctcaacttcaaatggccataatttacgaagtaacgatttcccaaaccaagaagattttgtttgcactgattgtgcaacagggaaattaatcgttagaccctctaatttaaaggtgaatgccgaatcaccagtattcttgcaacgaatacaaggagacatatgtggaccaattaatccaatgtccggatcattctagtattttatggtattaattgatgcatcaactcgatggagcattgtttgtttactttctacaagaaaccacgcttttgcgcggcttatttccaaataatccagttgagagccagtttcccggataaccggatacaatcatttagatggacaatgccggggagttnaccntctaggnnatttaatgaatanttgcatgggctttgggaaattaaagtggnnacatctcgtaccacacgtccacacttagaatggtctcgccgaatcattaattaagaggattaagcttatcgcacctaccaactacatgttggggacacgctgttttgcatgcagcggcgttatttcaaatcagacctactgcataaatgctgtatcccctatgcagcttacacgtggatatgcaccaaatatttcccatctgcgcaaatttggatgtgctgcatacgtccctataccgccacctaagcgtacgtcaatgggtcctcatagaaaattgggaatctatgtaggatttgaatctccgtctatcattaaatttttagaaccattgacaggagacctacatatgggtcgatacgctgattgtatatttaatgaagatcatttcccggcattagggggaggaaagtacctacagaaggtcgaatgccgcgaaattgagtgggaaactaaaaatctcctacatttagatccacgtactaaggaatctgaccaggaagttcagaccataattgatttgcaaagaattgcaaataatctgccagaagccttcactaacccaaaggggatcatgaaatctcatatacctgctgtgaatgcaccggaaagagtagaaatacctcatgacgcagaggaaaccggttttcaaattaatttctacatctaccccaacttttaggaagagggggagaccaccagttg

SEQ ID NO: 39125 - DNA, 4063 bp, Oryza sativa
  unsure (1)..(4063): unsure at all n locations
atgagagatgtgcccaaatcagggggagcacttccctgactgtattccgttgatattgatcatgcagatcagtacatcattcttgaagaatgatagagttatccagtagattagcttatggttgtactctttttcccttaagtgagatttctttgaagtttctcacatttaggtttttaatgaggcaacagtgcaatataagtagcatgtactatgtactctttctcctattccttttctcccactgggtttttggaaggagttttgatgaggcatatatataacgcggtattcgcccaaatgggagtgttatgaaaccgatctcccgaaggagtcggatttgtaggaccgtgatcgtgaggatcacggtacctcctcctccttcttctgtttccttatgaataaagtgggcttataccaaatatatatgtatgtatccatatatgacatcctattgtgggtataaaaacaatagtgaggttgagggtaaagtaatacttgtaacagagagagaaacatcaataaagttaattgccctccactttcgtgtccgtgtgttcgtgtgtgcttgttcgattgttgacaacgtgaattctaacaactagcacaagcgcccccccaccccccaggccactaatgcgcacccctagtccactgttcactgatgtttctatatatacgtataaactttatatatatttatataaattttatatgtatgtatataaaggttatatatatgtatgtaaaatgttatataaagtggttttttaaatcataaacactttattaaaaaataagagtttagataaataatcctaggacatcgtcgaataaatcagtttaaagcattagaatcaaaagaacagcttacaaaactaacgaaacaaacctacaatgaaaccaaacaaacagtagatgagcaaattgacaggggatctgcggcgttgccacagagttacatccttggcctccttttgacatgcactccgcttgacaaatcgatgaccaccttctgctgccaccataggaacaaacatagctttgctgatgaacagtagattttcgtgtgagcttcactagactcagcaaaagcatatccatggagtttgccattgaatatgaggatctcagcctgcaatcctgccaaccaaagttacacatttgattcatactcaacccgaacgataaaccctctatggttactgctgctaggagacaaatagggctatgatttccaatagtgaactccaaaatgaaacaagcccgacactacataatggcatgagaagagaagaaattgaagaaactctaacataacctacttaggggtgggcaaaataagaccgaaccgaaaatcccgagactgagaaattcagtcagtagttaggtctcaaccaatgaaagactgaaatttattcggtcaattttgttagtgacctcggttaaacgaattgatcgatataaccgaattttgatatgtgatgtaatgcatgtcatgtgaaattgagaactaagtgcatgatgcttttggtttattcttgctacttgatcctatcttttgatatttgtttggtgtttggtgttgcctattatcttgtatttttggatatataactgtcaaaagttgtctaaaagaggttcagtgctgtcaaaatttatcattgcaaattttatctcctggaactggcacagttcggttaggactaagactgacaattttgcgttgttatttttcttcactttttaatgaccgaactgacaactttgcattggtatttggacttcacttttttatgaccgaccgtgaccaaaattttcgatcgaactgaatactcaccctaaacctactgacgaactatgcccaacccgaaaacctaatctagtgaggaaggtgttggcaacttttttgacaagtcgacaagcacgatcgcagcacctaaacgctttggggtgatatggagtcgccaaccacctcgatctagccaaaaggccaaatcaagatggggttttgtagaaaatagctaaaccggctatcggagccgattagagatcaaaatcagcctctaggccgatttagatcgatatgaggataaccacccgtctcgtgggaaaacagaaggttttcaggacaagcctacaaagaggtgtcacactctcgcagcggtggcggacgttttacgacgcaaaccgacaaagatggactaaaactagggtaaagtagaaaacatggctgaaaagtaatgataaaagaaaaggcgattcaagtagattgtatgtttggggtattacaattgaaccggtcttgtctcttaaatagggggtagtctctctctacatgcctttctccatgtccaactcaggatagaaaccaaaagaaaactcggaacatgccttcccaagcaaggaaacccgagacccaataaaaacagactcggagcagacccaaagaaacccaaaacatgcctttccaagcagacccaacgaaaacagactcagactcggaccctaacggtcagaccgcccacatacctgcggtcagaccggccacatacaagcctccgtctcagtaaccttactactttgctcttggttatctttggttatctgagtagatgtttgcttaaggcccaaagggtgtaacttgcagggaagttaaaaggtccagacgatttaggagaggttacattcggttaaatttcattatacgagagtacgagacaatcgccaaacagaatatatcttaatggctacacataaattgagccttacatgcaaagatcctcacgggaacacacgctcatcattctaagataacaaaaaaaaaatgactaatgcttgtataagcatacgcatgcatagtcctcagcaccatgtctcaggcacacagacaaaggccacaaaagagaaacagaacaactgttttcgtcgattccaggatccagagaatgcagtacgtattaggaaagaattgaactgctaaacatgaggcattcatcaaatcctatgagcagcaatatatgttttgtagcaaaaagctggtagaatgtgtagtaaggtattggacaggttcatcacaacatgcccacgggaacatcatactgcaaatccttgtgcaaaacgaccacaggttggggtaggtacaaataatacggagaagataacgatggagtgaggtatcattacaaaaatattgggcttgccgaagacacctaacaagattgaaacagtgttcgtcctacgtatgaatgagatacatgcatagctcctagtcagctcgaagttttacggtcggagttccaagcctcaagcctgtgcacaacagcaaagaaaaggccaaacaagtatatacattagaactttgaacaggaaacaattttactagcctattatcggaataatctccagaaatgacagaactaaaatgataatgaggtaccttgctagcaatgttgctggacagccaatccaggccctcgtacagaccctcaccagttgtggcacaagtgctctggatgtacctgtgaggaagaaaacagatttagatcaagaatataaaaccatgcgtcgcattctagtttctagatgcaggatataatgaatacaagagtatccaagggaaaagtgaggcagtgagttacatcaatggtaaaaaaaaactatgaatcacaatccagatgcaggatacaatgaatttaaaatagtattgtattcgcttattggagagcttcaagctatatccacagcaaaaacaatatataagggcaagaatccattggtggtccttatttaccagtgtcgctggcgaagggagtgcagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 39126 - DNA, 4231 bp, Oryza sativa
  unsure (1)..(4231): unsure at all n locations
cagtatatcatctacaaagaccaacacaaactttcttatcactgcagaaaatatagtattcataagtccttggaagggggctggagcattggtaaggccaaatggcatcaccttgaactcatagtgcccctgatgggttctaaatgcagtcttagccttatctgataacctgaccttaaatccagttttgtaaaccattgggcatcagccaactcatctaacaattcctccactactggcattggatatttgtttttcacagtgatctcattcaaccccctatagtcaatacaaaatctcatgtgccatctttctttttaactaacaaaactggtgatgcaaaaggactgacatttgattggattataccttgttggagcatttgagtcacttgtttctcaatctcattcttctgttgtggagaatatctatatggtttcttggtcactggctttgcattgggtagtagagggatattgtgatcaaactgtctatggggtggtaaaccctatggctcatcaaacctttctttgaattcagcaatcacttgatcaatctcagctgggtatgtctgccctgcatgtgctggaacctcagcctggcacaactgcacaatctgggcaatagcgccatccttgtagagcccttgcatctgttttgctataatcaacttgccagaatttatttgatctttgaccccaataaaagtcagtctctggttgtgatatgtgaaccttaacttcttcctcctccaatccacccacataggactaaaggtttccagccattccataccaagaatcatatcatagccactcagtgtcaatactttgaagtctgttacaaaggtttgaccctggcaccaccactcaactgcaggaacaattctgttgcataataatttgcccccatcagcaattgtcacctgagttccttccacttgctgacactgtaagcccaacttggtgaccacatgttcagctagaaaattacttgagctccctgagtccactaagataagcaactgttgtttttgtattacccatgaaacttgatggttttcctgcccatcgtgcctgcagctgcacattcagacaataccaattcctcctctgaactttctgcatccccttcttcagatttactatcctcctgaagctgaaatacatccaacaattcttctataatagaagctgcactgacttcggacacttatgcccaggcccatacttctccccacatttaaaacactcaccccttgcccttcttgctgcctttaaagagtcaaattgttcctcccattttgatttctcttcagctttcttgttatcctcaggagctgctcccaaaatccctttcccttgaaatggcatcttattaaccggcttgaaaacttccttgaatgagtgccgttgataactcttcttgtggatttccccaagtagttccacctgcgttttagccaaggacaacgcagcatcaactgttcgaggcttatgcagcttgattgctgcctttatttcagttttcaaaccaccgacaaatttggtaacaaaaaatgtctcatcaaaccccttgttgtaaactagcaacttatgcatgagttcctcaaatttactgtaataactctctacactagttacttgactcaaattttctaattcttccaaatactcctgatacttatccttcccaaatttactatgcactgccatgactaactctgcccaactctctatacaatgcaactcttcatatgtttgtaaccacaaggcagcattcccaatgaagtgaagtgtagcaaaggaagaccatgtgtcaaagggaacctgatacatgctaaaatacttctcacaattcattttccacaatttagggttctctccgtcaaacttaggaaaatcggttttaggtaaccttgttcccccatttctaccactactctatgaatggaaattccccttctctgaactctccccaatatcaaaagtaattggagaaatctggtggagtcgcttacccttgaccagggttcgctcctggatcgcagggatctcgtaagtgtcaccttggtagccatcgttcacgccgtgcccgaagggtggtggagttgccgttgccggcgactccgcgggcttcgtcttcaacgccgtcacacgcgaggaaatctcgtccacagcttgatggagagacttgatgcccgcatccacattcggaatccatttctccagtccttggagtgaccccaagatgttgttgaggctggaggtgagcttggtgacgcgagaccccagcgactcgatctctccctctgcaccaccatnctnnagtgtaggagtggctgattcttcttcttcgctagatcgcgcaaggaacgacagctctgataccagatttgtcacgaacacctcctcaatctggcgtggtgccagctttaggggtgatcggattggggtagaatcgagaggatttgggggtagttaggaggaagaagaagaccagagacagggagggtagttgttttgtttgatttctcattgcataaccctggcctgaatggcacccagagtatttaaatgtgtcgacctgtgtacaattgaaccaccgctagcccgacacgggatccacacatgcacccaggtcattacaagataatgtcgtgctcacatgagctgaactagtcacgtgagaaacagggtacagaaacagagtacatacagagtatccccaaatgctaacaacctacaattcaaatctaaagaggaaatgaattgcattctaattcctattgtgtagatcaaagagcagaccttcatctacagcattgtgatggagttgagatgagtaggaagatgaacaatcacgctctggcctgcgagagaatgatgagccaaggaacagctgtcccaaatgttggaaacttggaaattggaatgctcatgataagtagcacaccatcatttgcatccacataacgatgtatattcctaactcatattgaggaggagttcgagttctctacgcggttgtgaattacttggaaaaacaattgacatgttaatggcatagagggtttacctggccaatataagcagctgattcatggcacaaaataaagaccaaagaaaagaaaatcttcgagtataatgcataagagccaagaaaagtagcccaacaacagatatttgcaaccaacccaatggctttatatgttcatatatgggtagcacagacacagtaattgatttctaaactgagtaactcaaactgaatcagcttgacttctacagaacaaatcatggcaacaaatatcacttctgtgaaactttgatgatcatgctcaactcgtacgacacaacgtgagcgcatgccatgggggttctagctataggctatattggaccaagtaagtaaaaagagacttagctaccacacaaacatgaatagcagaactaccacaatcatggtttattgagaatttgaattcctagattcctcccaatcctatctgactctcttttactcgagtcataccggcgaagttccaacaaagaatgtgcttcttacatacttccttcgtttcacaatagcattttccacatttatattgatgctaatgaacataaatatgtatatatgtctagattcattagcattaatatgaatgtgggaaatgctagaatgacatacattgtgaaacggggagtacacatgaggtgatgagtagcttctctacatttatcttgtctaaccatctgattatttcctatcagaaaacaggaatgatcctacaagtcaccgaaatgatggtgtgttagggtcttcagttaagataattgtttgaccattcaccatacaaatcatccttgacagtgttcttccacggttcacaattttcgaccgaaattcccactatatcagttccacctgaaatgctttggctctcttttttgttttctgagagtgggcactctaaaatttgaaactctgttcttgataacttctcgttggacagctagcctacttgaaagtattaggataaatcaatgtagcagacaaatcaacaacaaataatacccttcgcaaaaaaaaaaaaccaatgctcacttgattttttgtgtttttacatatggtgggatctctatctatttaaaaattacttgctttctaagattatatatgatgttttatgctctgtatgtatctatgaatttgttgtggtgaattacat

SEQ ID NO: 39127 - DNA, 4004 bp, Oryza sativa
accggcgtgtatcgcgcggtcagaccggcgcagcccgcggtctgactggccgacgttgtgtcagtttcggtttcgggttgtttgtttggatatccgtgattgtttcatgaatatgacttctagatggatactatacgtatgtaatattgttgtttgctactaatgagtcaagttggggatagtttggtctcggaatatggtttctttgtttgttccatgtgtaggtgacatgagatgccgggagagtatttgcggtgatggaccgagagtcggcttggggataagacgatgtccgtggtggtcagagatcatgcaggatactaaggctagagttcaatgcacatggttggtgaagtttccatatggcatacgatggaggtattgtgtgcgtatgggatgcggagttgaatttgaaaggagtccaaatttggtagaattggttatgtaaagtttgtttcttgtacgagaaggtttcctatggggattaggacttctagtatgagtttggttcgtggctttaggttgcctacctcgggtataaatagagagggagcgtgaggcttctcggtattgcttttcagagcaattgagttgatagtttacttatggtttcgagtttactcgagatttttgtaaggagtgctgttggtgcactttgtaaacacagagataatcaataaagtcatcatcaactttaagagttcttcgatttgtattttctcgagtgcggcggtctaaccagcaactcactggcggtcagatcggcggcaaggcggcggtcggtagcacgcaggcggtcagaccagcagcagcgacaggcagcggcaggcgatttcggcggttcgaccaatcgatctacatcggtcagaccgacgttcttctggcggttagaccggtgcatacacttcggtcagaccgcgattagtcgaatttgagggtaacttttatttccgctaaaagttttggtttttgggtataccaaccattcactccccccctctggttggcttagtttttgtattcgatcctacagatggaagtggtccttcaggtcccttccaaatgtattctaatgaccgcgctaggtttatggctttggagagtagccttgctgttgcgagaagtcaatattgtccatctcgcacgggccttccactagtacagaatcgatttttccgtgcggtcaaaattgatctttccgtgcggaggtagcgcctgtctacagctaggtgtctgtgaaaatcaactttatcgcatgcaggcggcccaaccgtacggggtaatctattatcccatgcggtcgagtcaagtggactgcacgagataatctaccaaaaaacatctttcatgagtcgaattgtactacatttaacatatgaaaaaaagatacaacttaaacgaatattatattactattcatggtctagtggttccaataacattaaattaataacttaaaaattatttagaattactagatttgtaaacctaatatattcgtcgaattccattgaaaaagtttgaaataaacggagggaactaaacaaaaatttaattaaagatttacggagaatttaaacatgcatataatatttttaatcattaataaaaaattttccatttccaaaaatgaaaattttcttagcttttatctgatgacaaattaaattaatggaggcaaacctaaaaaggaatcggactactaaatactttgaaaatcatgtgatacaaataatatatattatctcaaaagttataaaaaaacataaaaagtgcctacactattccatttataaaagtgcaaatttcttcgcattgcacccgtaaaaactgacaaaaatagaagcaaatgaaagacgagaacaagcattacaccttttatatgaatcaaaatcaaagatttaaggtcgaaaacctcccctcttaatgtttgtaagtctaggagagagaaaacgtcggaataaatagggcatggttgggctggggtgtatatagaccaacatcatcacgtgcggttggattaaacagcccgcacgggaagatgcattatcctgtgcgggcatcttaacccaaccgcgctggataatcgcattatctcgtgcggttcggttaagacgcccacacgggataatgcatcttaccgtgcgggtgctggccctgcgtcggtcctccggtttccaggaaaatgttttgtgtagtagtgttcttttcttttattggacagtgatgggacaagaggccaacccaaaatataaggaaacacctctgatgttggcatggcattgttaggaaatcgcatggtctagaaactcatgcaaatggacacttcatcctcgcaaaattctcgtagacatggtgaaccgaaagtatctgttgctagtgttaccaatgttacactggtttaaaattaccgataaatatgctaatatctcgctctttcagaagtaccagacattctcctaccaatataataattaacatacacttcagagagtgcacagataataggatggactcaattcaggaggttgtatttctgcaaacagatattaagctccttttcaatatattgaaaaacacaagcttcagatgcatcaactgtaacatgagtatgtgtagctagcctctccagtgcccaagaaccagttcaatgattgtaagctgccgctgcaaaatgtgacagaccaaatgcatcgtacgtatcatcgttcatcatccctagacactgcttctctagagaaatcgatttcctagattcgtcccaagcctaatttggctgctgttttctttgagtcatagtggccaatcgccagtaagaatatataggcagcattgcatgcatgaggagcttatcacttgaattatatatttcgtatatacgtgaaccgagaatggaacctacaagctcccttctgtatcttctgacgctagctagggtcttcagtttataaatagaacaattttaccatcttacactcgggcctgtttagttggtgaaatgaaaatttttgggtgtcacttcgaacgtttgaccggatgtcgaaagtggttttcggacacaaatgaaaaaactaatttcataactcgcctggaaaccgcgacacgaatcttttgagcctaattacactgctggagaatcgctttttagtcctggttgggaacccccctatagtcctggtttcctaaccgggactacgaatccgggactaaaaatatctacttttagtcccggttgaaataaccggggctaaaaatagatctttagtcccggttcgtaataccaatcgggactaaagatactaaatctttagtcccagttggtattaccaactggtacaaaagtttttttcttttttttcttttcttgcgccaaatatcacagatttgtgttcacacatcactcatcacatatcgttcacacatctcaacatcccaaatcatccacagcaacaacccaatatctcaaacatcccaaatcatccaaaacaacaaatcacagatcaaatcaacaaacaattattcacattattcacacaacgaaaagaaaaaaaaagaaaaaaccagaaaaaaaaaatccatggaccctgccgccgcgcggccttccgcgccgggctgccgtcgctccggcacgggcccggccgccatcgctccgcacgggcccggtcgctgccgcccctccccggcacaggcccgaccgccgccacccccgcccggcatggccccgccgccgctgcccctcctcggcaccggtccggccgccgccgcccccgcccagcacgggcccggccgctgcctcggctgcttctcccgcagatctgaggaagagaagagaggaaaactcgatcagatgtggaagaggaaggggagaggaagagatgagagtgaaagaggaaggtgaggaagagataaggaagagataagggtgacgactgagggctctgcgcgtggagagaatgatggaagagagagatacgtgggaaacagatttgtagtcccggttggta

SEQ ID NO: 39128 - DNA, 25520 bp, Oryza sativa
  unsure (1)..(25520): unsure at all n locations
ccggttgtttataccaaccgggattaaaaatattaggagacctaccacgtcgtgccaatgaataaaccgggacaaaagatgatctttagtcccagttggtaacactaaccgggactaaatatcattgcacttttaaaccgggactaaaaatgctttttagtcccagttttttaagcaatcgggactattgttgtttttggcaaccgaccaaagatggtttctctagtagtgttaatctgtcattagcacattcaggttactacagcacttatggttaatcatggcctaattaggctcaaaatattcatctcgcgatttacatataaactatacaattagtttttatttttatttatatttaatgctccatatttgtgtctaaagattcgatgtgatgtttttgggaaaagttttttgggaactaaacaggccctcggtacctcaaagttacacaaattttttgtaccacgaggtattttctagtgtaaaatttggtagcttgagttacttcgtatcttgaggaactaaaatttgtgtataaaatatggtacctcgaggtaccaaatgatggatggtaaaattgctcggatccacaataattttggtccgaatttatcgaaaattctggttccccctcaaatactctggctctctgaaatttgaaatgctgctcttggtagcttcatgttagacagctagcctacatggaaatgttagaacaaaggggcagataaaccagaaacagatatatcaccagttcttgatccattgaaatttgtgttttgacagtgtgatctctatatgtttaaattactttcttattaggatcacatgtatatatttactctcatatatatatatatatatatatatatatatatatatatatatatatatatatatatatatatatatgatggtttaggctccttttcaatctcagaattagctgggttgaattgaactggtcgttgatgaaattcagtcgcaatatggttgagattagtaggaagaagcatacgaggtcgctctggccagccgtagagagatgatcgaagtgaacagccgttgcaaagacggtgaatgctaatgagcggcacaccaaagctcgaatctccgaaatgatgcgcaataataagtcagatgcataatcccgacgcatcccaatccatacgcatgatcaccttgtaaaatcaaaggtgttttttattattattctgtgatgaacaattggcattggagattattggttttgttatttggaatttattcatgaagtggttttggagatgattggatttacaggtgaatcacaggttcattattttatgtgaccggtcagaccgggctctggtagccagtcagaccggcgatatgcgaacggtcagaccggctagcccgcggtctgaccgaccaacactatgtcggtttcggtttcgggtagtttatttggatatccgagtttatttcatgattatgacttctagatggatactatacgtatgtaatactattgtttactgctaatgagtcaagttggagatagcttggtctcggaatatggtttctttgtttgttccatgtgtaggtgactcgatgtctcgggagagtatttgcggtgatagaccgggaatcggcttggggatacggcgacgtccgtggtggtcagagatcatgcgggatacttaggctagagttaatgcacgtggttgatggagattccatatggcatacgatggaggtattgtgtgtgtatgggatgcggagtcgaatttggaaggagtccaaatttggtatgattggttatgtagagtttcattcttgtactagagggtttcctaaggtgtttaggactcttagtatgagtttggttcgtggctttaggctgcctacctcatgtataaatagaggggaagcgtcaggcttcccgggatcgcttttgagaacaattgagttgagttttgagttagggtttcgagtttagtcaaaatttttgtaaggagtgctgttggtgcactttgtaaacacaaagagaatcaataaagtcgtcatctactttaagagtttttcgatttgtgttaccaggtttcggcggtctaaccggcgatctaccggcggtcagaccggcggtaagcggcggtcagaccagcgggagcatggcggtcagaccggcggcggcgacagcgagcagtagctgatctcggcggtcggaccagagatataatctcggtcagaccgacggcaaccaggcggtcagaccagtaggacaacttcggtcagaccgcgatccgtcgaattcgagggtaacttttctttccgctaatagttttcggtttttgggtataccaaccattcacccccctctggttggcttagttcttgtgattcgatcctacacacctcacattgagtaattcaacttctttgtggctgtgacgtatgggtaaaacaatgaacctgttactggcatagagaatcatgtgatgatttattttatagagtaactacaagtattttgcacaatttatcataaaactacaggcttgtttcataaaaatacagatttttatcacaaaactacaggtactttgtataatctatcacaaaactacagatttaagaacttgtttcacaaaactatagatttagtgtattcgtttatcacagaactacacatttagtgtcttcatttatcacgatttagtgtcaccattatcacaaaactacatgctaaaatatgtagttttgtgataatgaagacattacacttgtagtttgtgataaatgaagatactaaatctatagttttgtgaaatattgtgcaaagtatatgtagttttgtgataaacggagacactgaatctgtagttttgtgaaacaagttcttaaatatgtagttttgtaatagatcatgcaaagtatatacagttttatgaaatttactctattttatatgatgaactattgccaaaggtgagtgtttgtgaaaatacggtgaataatgtttttatatggtgaatagtgtggttggcactggatcaccggttagaccggtcaggagggtgctggtcagatcagaggtatgtagccagtctgaccatgcggtccacccgatcagactgggttgacttagggtttgagtcagtgtcaagttgttttcgtggattttctagattactttatctatatgacttctagatgggttttatatgtatgtgacattgttgtgtgctgatgtgagttaagttggtgcgaacttgtactcagatatagaatatttttttgttgttcatgtggaagtgttgcttgaggccatgggagtattactagtgatggatcggaactagatttggaagaagttgagatgtagacagtcaagcagatcacatgggatacccaggctagagaacaattcacatggatgcatggaaaggtttccttatggtatacatgtggtgttgtgtgtgtatggaaaaaataatcaaatttgaatcaagaagattggagtttagagttgtatgtcgatgttgtttccctgctttggtaggttccctatatgattagaagtcctagttctagttggatttggggctaggggtagccatgttttgggtaggggtgggcagaaaaagaccaaaccaaaatgaccgagaccgaaaccgaacttactgagaccgaaaaattcggtcacaaattcggtcagcactttctacttaaccgaatttaggtcgggcgattcggttttaggcctcggttaaccgaattgaccgaaaaaaccgaaatatagaattggcccattaggcccaatacctccttagcaaaaccaaccttatccacccacaaccttatccaaccaaccaccagcaccatcctcccatccaccgagcccttcccatccccatcccctcctccccgtgctattgacaccgacagcgatgccgcctccagcgtcggcgccgccttcacctttgccctccgccgcctccgcctccggctctagcgccctccaagctccaacgcctctgccttcctcctccagcgtcgtcgccattgcctccgtctccactctctagcggctgtgaaaaaaaatcggtcagaccgagaccgagaccaaaaaaacgagaccgaatttgttggtcctaagattttttgaatgaaatccggtcttgagtttctaaagaccgaactaaccgaaaaaccgaagaccgagaccgaatttttcagtctgaccgaatgcccacccctagttttgggtacaaaaagaaaatggattgaggcttgaagtatatcgacgttttgttgtgaaaaaatatggtttgtttttgcttcaattctaattcgtgagttgagagaggattgcattggatgcacttggtaaacacatcttgattaatgtggatcggccaatgcagttgacacataatctgattgtgacacatccatgcaaggtaaagctatgcttaactctgaatattgttattttcaaaagacaaggttactagttgtcttttataattgtaggttaaaacatatcgatgcgcctaaagagagatatttgacttggattatttactcaaccaataccaccactatacaaaggcgaagtaactgtgcactaaccttgctatcatatgaacgtaaaccatcatttggactagtgccacaatctcgaggaccgactatgctaagccatgttgtgactccatctccaagggattgtgccaagcaaggatggagtgcgcaacatcattcaataaaagtacgacaaaaggttgactcttttctcgctgaatttaactttaatattaacgagaattatgtactacctaaatcatctactttgcttttacttagattcacacgtgcacaagacttgcagggcattgatgatgagctagaagatcaaattgatgatgggttatgtgaatacgacgaccatttacgccatgctgatttcgaattcggagtccacgtctcctaacatttgctccaattttcaaattatgtgagacccatctagtcaacttcttccttgcatattatatatggatggaaagataatcaagtctagtttcaactccaacaaacggcccatcattttgatttttcaataaggagtaatggacaaatcattgaagactgcgtgagtattcttgggaattcacttattaagacctttgagctagtctatgtccaataaactctcaagaattttcattcccaactaggagggttattcctaatataaatattccctttgttttaccatttgaaagacttttgacaataagaatatgaacccctttgtttagttgtgtgctaacaaatttagagagatccctaccccttttctcttgtgatttccttgtgggattacagaagtagtgttcgacgctccccaattgcaattggcgcttctacttccttcgagatttctcttgtttgattgtaggttgtgttggttggtaacttagagtgtggttgggctaaccctcagtacaggttgccgtaatggagatgacggtttaggttgcactactattttggttgcttgcatctagttatcttggactctttgaggctagttatcggctttgctaggcactcagtaattgttgtagaatcaacctaaaaagcacaattcaaacttgtgtgccatctgtcccgcatcctcctctatttggtgctgtgcttcgatgatcctatcatctatcctctctcccaatttcttgcaatctcaaggaggatagaatgtgagcacaggcttgcagaggagcacgtaacgaaataggcccttggctacttcgaacttgagttggagagaaactgaattcctagataccttccaatcctatttgactctctcttttcttgagtcatatatagtggccaagtagcaacaagattatacagcttgcatagacaaagagctcgtacattgttctagtcttacttacccttttggttctttcttatgagaaaaggaggaatggatctatcagtcactgatatgatagtctctccgtcgcacactataataatttttacaagaaacggaggaatatacctataagtcactgatatgaaatactcactctgtcccacaatataataatttttaggctgttttgcaaagcttaagcttaatgaaaaagattccctttcggtcatctcagtcatcaaattttgaattttgaattgcttaaattcccctcccacgcacccactttgcttaaaatgtatgaattttgcattagtatcaattctcataactcgataaattttgaatcctagaaatatttatattttattaagaagcgagtatatggctatgctatagttgggacctgtctgttcgtagttgagtttatgtagtgatcatttgcaattcagtaattgttgtagcatcaacctaaaaagcacaattcaaacttgtgtgccatctgttccgcatcatcctctatttggtgctgctttgatgatcctatcatctatcctctctcccaatttcttgcaatctcaaggaagatacaatgtgagcacaggcttgcagaggagcacgtaatgaaataggcccttggctacttcgaacttgagttggagagaaatcgaattcctagataccttccaatcctatttgactctctcttttctggagtcatatatagtggccaagtagcaacaagactatacagctttcatagacggagagcccgtacattgttctagtcttactttcccttttggttctttcttataagaaaaggaggaatggatctatcagtcagtactgatatgatatagtatctctgtcgcacactataatattttttataagaaatggaggaataaacctataagtcactgatatgatatactctatctgtctcacaatataataattttcaggttgttttgcaaagtttaagcttaatgaaaaagattccctttcggtcatctcagtcatcaaattttgaattttgaattgcttaaattcccctcccacgcacccactttgcttaaaatgtacgaatttcgcattactatcggttctccataaattgacaaattttgaattctagaaatatttatattttaataagaagcgagtatatggctatgctatagttgggacctgtcttttcgtagttgagtttatttagtgatcatgtgcaaattaagctccggacctgctgcgcatcaatatcacattatagtcacaaggacaaatatgtaagtacctaggtatatacatagatgtagaatgaaaaggcgctctacactactacaaaaacctcgtagggaccggcttatagtgtcgaagcaatatttcggcaatactaaaggggtggctatcaagcaggaaaagtggatgggttaggagacaaaagttttatacaggttcagaccttctcgataagaagtaataccctactcctgtccggggaataattcgctgagtgtattattcatcgtatgatccgggagaaaaattatgccccaagagacaccgaacctctccatatggggagaagcccgtattacaagatacaatccatgttcctaacggaatagacaagtaaagataaattacagtcgtatccgactaggaccatcaggtgtttccgtggtacacaagttaacataacaacccaattgagtcctgtactaaatatattctatctgtatatggtacccctatacccggtcgaataaacatgccgtgtgggtatggggtatccataatctccacatataggtgcacctattgacctttttccacctcccatgggataaaaaatagaaaaccaacacctttaaacaaatataagtattggttctaaagaaaaccggtaccaatactaatggtaccggtttttaaaaaagaacgaacacctataatatattataggtggctattaattaaaaactagcacctatgttatgtgttatattataggtacctgagaatttaccgagcaggcatgagctgagctggcaggctccatcacgaggaacgaggagataaggccctcggatcaatccagatccatcgactccatcgatctcttttctctctgtcgctcttctctctctctctcgctctccattgatcctgttgggaggaggcggcggtgacaccctcccctcttctagattcgggcaggaggggaggcggcagggcccggcgtaggaggaggcaatgccaacgcggcgacggcgagcccgcggagaaggtgatgtgtactagggttcctaatctttcgaaaggttctgataaacaacgatttaggcggagtcgcgacacaaatcgatccagcttcttgaacgcgcacgctcttgagccccgcaatcgcagcaccacgtctcctctggttatcacccatgtcaaaacgcggataacctcaccgagaaggctaatccctatttgacagtcgaagaacacaaacaagaacgagatagaaaacaaccaaaattgcggatgaatgattaagctcacgagttggggtcttacaaaacgatctagtggcgaaactgttctcgacagattaatctaagcaaaacccaaaaacctaaagatggcggcgggtactgatatatagagtttagggtcgtgcaaacccctctcgacgtaaccctaatgggttccaacacgatacacgggccaaaggcccaaatacggtgatgcagcaccaggacagattctagacgtcaacttgttcggtcaatttccattgacttagaaagaatttggacgtgggaccaaaaccattggaaaagttatcttcttagctttccatccatataaagaacgccccaatccgagcacgtatgcgacctgggtgcccgttttagtgcagactggtcctggactccgaattacacccgacgtcgacttggtttgggcctccaccttgacttggacgtcctcgatgatcctccatggctctaagtccttctccaagtgtctccttgtcccctccattgttcctaatcataatataatcattaggtagcaatctattctcgaattcatacaaagaagaacataggaacgaactcacctctaaatttaattgtcgcgcacgagctcttgttatcggtccttgaatgaccgttggaggattgttgtgtgtatccgaggtagtgatgtccgcatcaaaaggtggtcaacgaggagaaccgccggctttcgagctcattcaaggcggtgtcggcgtcggcgctggcgttcacagtgggcgcatagctaccgctgctggctagcgggttcgtccgccctagggcccccgttgggtaggcctaagaggcggtggttttaccttgtggccgtgttagcggttcgagtccgcttatctccagcccgtcaacttagcaaatactatgatagcccgcctgtcactgccgtgtgcgcccccacttcggccgccctgggccgggttcggggtgcttggtatggcgctcggcagcatttgcccagccaggtcggcagccagggtgcctctcggcgggtgggccagcccaaaggtcaatactcctctcccctctccctcgccctctcctttctcgttgatctcgccgtcgctgatctcctcctatgaatgtattcactgatctcctcttgtgaatgtatttgtgaatgcatctgtgaatgtatttgtaaatgtttgatgtgaatgtatctatgaatgtttctgtgaatgaatttgtgattatctgataacttgcctcattttattttatatttttcgatttcttttggctttgaggcatccgctcgaattgagtcgagccaagccatccttttttttttgtgatccatacacctcaaaggtgtcggttcttgaaccgacaccattaacaatactcataggtgctggaaactgggtgccgcttgccaaatccggcacctatgtggggtttgcaaccggcaccaaaagggttttgtgtagtagtgatagttacgcttacaaaattaagtcagctataataagtggcagtggcagcaaacacatcccaaactgtgataattcaccaccagaaaatagattgatgtttgacagggaacaaagtctggagtctaacaaatggttggccctatataccacccatatatttactagcatgataataagaatctcaatcaactagtgcgacatggctatattaggtttgtactccctccattcctctttatttgacgtttatgacatgtttgagaaaattaaggtttacgcgaaatgtctcttttcccctcctgtcgcaagcgagcgatggcggcgggccgaacatccgcgactcatgatctcgatctcaactgtccctacgcaatcgccgttgcccccgatgagccgcgccatctcaatcgcacgatggcatagagctttgtgcggtggcgccagacaatatcacgagtttgtatatgaactttaaatagcgtacacggtcagctagctttgcaatcgtataaaagctaattcagtgcttataattaagttgccgttgctaaattagacagacgatatgtgacagagctggccccagacacattaacttcctaggttaattcctcatcatctcccttgaaggatttaattagggcattaccaacccaatgactaggatggtgtccatagcattagttaagctgccacgtaggatgaaaaatgatgtgacaagtgaataaatgagaaaaggagaaggaaaccatgtcttgcatgagacatgatttctacacaacatccaagacatcatgtgagataagtagcattaaattgaattatggaatagtggtgtttgcatggaaagaatagtgtgtactagtgtctagtgtcattggttggaaatggccttatcctgtaggtttggaagcggtccatcgggtcccttcccaacgtattctagtgtgcgagaagtcaatattgttcactacctcacatgggccttctattcttttataggacattggtgggacacgtggccggtccaaaatatgtggaaacgccgctgatcatggcatggaattattgttaggaaagtgcatggttaatttggaaactcatgtgaatgtattgggcgggtgcacggtggacttcatcctcgcacaattaattctcgtagcaccaagatcaaccaataggtctgtgtttcaaagtgttagaaatcttacactggtttttaagcttccgataaatatgttttgaccactctctttcagaagtactccactagagtctaggcacatgtaagaggacggaccccattcaggaggctgttttctgcaaacagatattaagctcctgctagccctgcaagtgtgcaagaaccagttcaatggttgttgtaagctgtcactgcagaacgagccaaacaatacgcagcagatcatcactcagcatctcttaatgtttccagaggcattgatttcctagattcctcccaagcctatctgattaccagtaagaatatataggcagtgcatgcatgaggagcttaccattttgtttacatatttcgtatatatgagaagtactgaattgtcttcagtttatatagttgatatgtatatcctatcggtagtagttgatctccttcagtgagcatgtgcaagttccagatagctgctaaagatcaacatcacatgataagtgcaagaacaaatttacaactaatcttaacatggatataaaacatgcaaagatttatcgatcagtccttacaagtcacagtgacaacgcattgtattgattcaaacctgccaccagtcagcaagtagattgacatctaacacagaactaaagcatcaagcctataaatctggcagatggttggctctatgtcaccgttatttacaagcttgataataagagccttgatcaagtacatacttttgaatgttaactacataagaaaattgatcattatgttgcaatgtagttacatagactggccaagttttgttcttcattaatcatccttgattgtgttcttgcagggcccacaataattttggactgaaatactttggcgctctgaaatttaaaatcctgctcttgatagcttcatgttggacaactagccaacttggaagtgttacaacaaaaggagcagataaaccagcaacagataccaccagttctcccttgaatttcgtgtttttgacgttgtgatctctatctgtttaaattactttcttattaagatcacatatatgatggttttggcaccttctaaatctcagaattagctgggaaggtgtcaaacagcccaccttccatggaagaaattgcaatctggttgagattagttggaagaagaacgatcttgctctggccaatcaccgagcgatgatcaaagcgagcagctgttgcaagatgtggaatgctcatgtgcagcattccaacacttgcatccctgaaactatttacaaaagtaagtcagatgcataatcccgacgcatcccagtccatgcatgatcacctcacattgaggaattcgagttctttgcggttgtgaagtattggtaaaacaatggacatgttactccgatagagggttcaccgggccaatatatagagcagattcatggcacatattgaagaccaaagcaaagaaatctctgttttaattcatacgaatcaagaaactgaatagatttgggaaaatgaatccttttactcttgattttctagggaaatctgtacatatctaaaacaaatccaagagctatatttatataggtgggtagcacttatgacgtaattgatttctaaactgagtaaatcgaattgaatcagcagcagcagtaacacaagaacttccaagtaaaagtgtaaaataaagttggtttgattcttattctgtgatgaataattggcatctgagattattagttttgatatttggagattattgtcgaagtggttttggagataattgatttgcaggtgatgaacagggattgctaactaagtagaaccggtcagatcgggcagtggttgccggttagaccagcgtgtatcaagcggtcagactggccagcttgcgatttgaccgtccgactctgtgttggttttggttttgggttgtttctcaatatatctggggattattcatgtttatgacttctagatggatactatgcgtatataatattgttgtttgctaagaataagtcaagttgttgagaacttgtgctcggatatggtttcttagttgatgcatgtgtaggtggtcttgatgtctcgggagagtgttgccggtgatggatcgggagtcaacatgggagaagatgatgtctgaacgatcaagatatcatgcggtatgcttaggctaaagatcaatgacgatcaggatatcatgcggtgtcataacttggtgaagattccaaatggcatacgatggagatattgtgtacgtatgggatgtggagtcgaatttggaaggagtccaaatttagtacaattgaagtttgtaaagtttgttttttgtacgggaaggtttcctaggggattaggatttttgtacaaggttggttcgtagctttaggctgcctatctcgggtatatatagagagggagggtgtgtcctcccggtaatgtttttgagagagttgagttgagagaaaagttagggtttcgagtttagtcgagaatttcatgctgttgttgcactttgtaaacacagagagaaatattaaagttccaatctacattgagtgatcttctatttgtgtttgttcgggtttggtggtcagaccgatggcatcgcatcggtcaaaccggtggggacaaggtggtcagaccggcagcggcgacaggaggcagagacgatcgcagggtggtttgacctggaaatcaacgtcgatcagacaggtggatcaactctggtcacaccgatctacatcgaattcgagggtaacttttaattccgctaaaagtttcacgttttaggtactacaactattccccccctccccggttggcttagttcttgctattcgatcctaagaaaaaactaccaaaaactcaatgatcgtagaattaacagcaagaagcagcagaaataagttgtttataagagatgcaaacgaactgtagataacctatcaacaggctcacgatcgatcagaaatttgggaattcagggaacgctcagcagtagggttggaaagtgattcggataatttccatccgaccggaccatttttcggattcggatagttttggtcggatatatccgaaaattttcgaattcggaaacgaattcaaatatttttttttggatataaaaacgatatggtctaggtgatatccgtcggatattatctggtattttccatcggatatccgacttatacataagacccataagccagcccaacccaaagaggaggcaaatcagacttcttgaaaaaaattaaacttcgaattgaattttatggtactaaataaactcatataaaaaaatgtagaactcattgagatctaccaattttattttggtcatttctccatccgagtttaatcggactatataaaatttaaattttaaaatataagaaattcaaataattttttcgggtagtaaatgatttcaaatggaaaaattatcaaaaacaaagttgtataacttatcaagatctataacttttattttggtaatttttctatatgtctttgtttgaatagtttgaatttgaatttgaaaatatgacaacttcaaacaatattttcgaatactaaatgatttcaactgaaaagtcatcaacaagagatgtataactcaccacatgactctttccagtgttcgattacttttctttcaagagatgaggttcaaaagtaatgccacgtctattttatgatgcttcgatgatcctattatctatcctctctttcatttcttgcctcccagtgtaaggcaatgtgatcagcacatgccatggggatcccagcttcgttgctgacgagtgcgcaggtaaccaaataggcaattagctactgtggatttgagaaggagagatattgaattcctagattcctcccaatcctatttgacactcctttgctttaaaaggcagattgcgtagatgaggagcttgtatagtgtcctagtcttaaccttttggttgtttcttatgagaaaagaggagtgaacctgctcactgatacgatgctccagtgttctctaacagtttaattatactaccattatttttagggctaaattagtaatctattaataccatgattaggagtaactatcatttatgttctttttccttggctaaatcgacctataatatccattgagctggcatcgctcatatttcattgaaaaagcaaaaaaaaaaggagaaaaaaatgtttagttactgctatataatgattatgccccttcacacctttttctataataatgccccttcatatttctactaccgcttacttggggtaatagtattaatagatatgagatgagatcaacggttcagattaatttttactactagtaaatactagcaccttactgaggctcatatgctatgctagggtctacctgactttgtgatggtaaatatatgagatcttttacggtgcttggaaggtaccccaggtacctccttaacgaattgttatccaccattaatcttcaaagggtaatttaggaacacaattttttattaacaagggtagcttagtaattgctcaaatcccacccgtcacccaatcaaccaagccatcgcaccgttgattcaagattaaccctaatcaaccaagccagcgcgtgcgacggcggcgactggctggcgcgacgggctcgtgcagcggcggtgacagcgatgttctgctgcgtacgtcagctgtgaccggcgggcgctacgggcgcgtgcgtcggcggcgacggtgtccagctgctgctttcgtaggcgcgtacggcaacagcgagcggcgggcgtgtgcggcctcggcaagcggcagccttttacggcagcgacgaccagcaggttatgtaggttcctctcgcacgcgagcgttctaattcttcctctcattttttttcttcctcatgctgaaacgtttgttgcttctctcaaaagttctgaatttgtaaaaatacgcttttgccctttaccgaaaaaatttaatgaaaaacaattaccattttaccctcccaccttccatacctgactcacccttttaatacctttttccaggcaccttctctttctgtccgttagattattgcagatcaatggtcctaattaattttaagtattgaagaagatctctaaatgtattattgtattttcatatgtttgcatcgctttggagctctgcacatgctccctgaatacactcaactactttgatacggtcattatgtttgcaactgattattgtcttttttttctaatgcaaacgacgagcatgtaaatgcctagtttcaggctctccacaaatcagccttaacgtcatgttcgattaacccttgtgaggaagggattagaggagatttattccacacctatttggtggggaattattcttaatcccctctaatacttttcaatccctctctaaaccgaataaggcctaacagtgttcgtgcacagttcacaattcaatactgaaatttcagtgcccctgaaatgcttttgcgctgagagagagagagagttggcactctaaaatttaaaactctgttcttgataatttcgaattggacagctagcatacttgcaagtgtgagaaagaattaatgtagtatataaatctgcaacaaatattacaaatgctcccttaatttttagtgtttttacctacagtgcgatctctgtctgtttggattgcttggttattaagattatatatgatgctttatactctgcttggatctcttaatcgcttgaggacgaattacattggacattcaattcgaatctaaaagggtgagtttccattggtgaaaatgaatgaaagagctagagcgcagcttccactacagcactgcgtgacctcgttgagatcaacaggaaaatgaaaaatccatgccctgtgatatagagtgattataacttgtgatggcccgcggctggagacttcacctctcacaggctgtggatggaccggtcaaaggtgaggtcatccatgacgagttcttcggtgctgtcagagatgagcgtttcctgcgtagtgttaggtggatgtgcaattctctcaaatgttgaaatgctggtgagcagaacaaaatcgcttgcaccctgagatgactggaaagcaaaagaaagatgcaaattcctgacgcatcccagtcgtgcatatgattgcttcaaactgaggacaaatttgagaacttcgcggttgtgaagaagtgttggaagaaaaatggacattttattgacgagtcacgctccagtgctttctactggtagtattctactacaagtagaatgatctgagccgttgatttctaagggtatattagtattttgctacctgtatagttaattaggggtaattttgatatttatttttccgttaatagttgaatctgttgttagtgtcgccgcttatatcgttttctctcgctgtatctctacgcacctacaccggcggcggtgccaactcgattcggcaactgaccttcgccagtaaccatccatccaatatctatcgaattctctttaagtagatattcttttcaagtatccatctctttacggattatgaagattaaattacaaagacatcaacacaaattttacaaccttcaaaattttctctgtacaattgaagtcagaggaaatacgggacaaacaatcgttgggccttgcatctggtcattctcctctgtctatgaagaattacaaacactcgcctagatggacatgttggcgatgagtgtccacacgcagattagccgccgtcgccgatagcagcgaccgcggtagccgcctctgccccctcctgtagcgccaccaccatcgatctcatcccaaagtttccaattcgtatttacaaatttatccatcaatgtttatttttcaatggacgaatttgccctcccacgtttctactactcttaataaggtggtagtataaataaatctaatcccttggataaaaacgaattagcggtttagattgatttctactctaagtaaaaagcaccggagacgcactctttattgacatataggatagagggttcacctgtccattttatacaacagattcatggcaaatataaaagaccacaactaagaaaatcttgaatttaatgaatatgaatcaaggaccatatagttttgggaaactagttttggaactctcatgatttgcaaaactaataccttacaccacatggtcttggatttcaaatgaaatttgagtatgtcggtggcaaaatgggaaacactgtgtgtgttttgattgattacatcgaaatttttgatcctagctagacatgtactcctctgtccacaaatacaataacttttaaattctattgagacattaaggatgaagggaaaagaatatggtgccattcattaaacgataggtagttgtgttggaaagtagtacaataaaatcattatatttgtgaacaaatttcaaatactagaagtattttgtacggactatgtacggagggagtatagtaggagaagtacttgttctcctcttgctagtacacatataaatcaaggttaatcaatcccatttccccaagaaaattcataaggattccaatttatagtctgcgaaaattctaatccatcttaaatatacactgttgaaacaacatcgtattattgtttaatcctttgtatgttctgatagtaaataggcaaaatagtccacacttccaccggacaaccaagtgtcaagtctaattaactaatctctaagactctaacaggtctgtgagaaaccattcaagacttgcaaacctacacaacgatttttccaaacggccaaaacatatttttccatgcacttaggtgtgtgcaaaatcgtcatttttttccatgcggtagcataaccacatgcaaaaataggatttctcgctttctttcacctatgacgaccgcacgtgaaaatagtttcagcgaaaaaaattaaaaatcccaaagaaacaaaatcgctcgaaaccctagtcgctaccttcatcgtcgttgtagtcgtcaccgccggtgccgtcgtcgtcgggccgctgcgcccgccgccgtcattcccgaaagcagcggcggcggatctgcgccatcattcctgctgagggcggggtggcggatccacccgctcccaccgccaccgctctcgaggtcttgggcgactgatctgcccgctcccgctgccgccgctcctgagggcagggttgacggactcattgctcttgagggcggggatggcagatccgctagctggccgctggcacccactggagaagagaaggggggagggaagaagaagagattggaagaggggagagggagaggaggagttagctaggaggagtgggaagagaagagagagaataaggtgtggtggagagaaagaggggagttaaaaaaatggtgcgggaaaaagcgtggggcatgcatgcgaatatctatttttgcttgtggtcacttaagagatccgcatgtcaaaatagactcattttttgcatacgggtgtgttaagaggttcaccagcgaaaattgatatttgcacgcaggtctttaaagagttgtatgtgaaaatgcaggtcgatttttagacgcgatcagttattgtttgcctgcaaactatagggatgctcgtacagagaaatcgtctatgtagtagtgaattataaaccgtgaatgatttgtgctgatatctagccattaattggcatagactatattaaagattaatcgatttcaaaaggtttttaataacgaagcagtgtgaatgttcatgttcatgttcatgaaattggcaataagatcgatttgtattaaaaacatcaccaagtatatctgtatttagtttattcacaatggtgttattcacccaaattcacaatggtgtaattcacctaaacatacacctgatcaaatctctagctgcatacaaaacctagttgcggcattttctggacaaagtttatgctatcacacaaaagccaattgaaaccggctcatcatatcactgctggttcacagatatattcctgcctaactgaataaaaccgtcactggtacgggttattcctaaataggagttgatcacggactcatcgtcttagcagtttccatgaactgcataaagagaagagaatatagattgcctggttcaatggtgctatccacaagtgctccaatgtagcactttctaccgatgacgcgagggctaatttgccgatgcatctcaatcctgctgacatccaattatggtagatatgagcaaatgactgaagctgcaattttgctgtatgcaggtttttgacagtcttgattgcttacagttgactatatgagagtttccaacgaaatataaatatgcatgctactgagaaaaactagcatcagtggttatatataatacatatacttgttagaataactaggaaggtagcccgcgcatatgcgcgggcatcttatttaactgtgttagaaattttattaggaatttttatgattactctattgtaaacatgtttaatttttcaataatttgtgtggtgtttctctgaatgctagtaaccatcgctggtgtataaattctaaactaaaattacttaaaactgtgcaaatttggttttataagaaatatatatatatgaaactatatatcacttctacataatgcatttgtacataatgcatttatttttttaatatttagcatatctttttttttgcactatatatgtttttttgaattttaggatatatcaattgaagatattttctattaaaaatatggctaatacgattacatgatctaattaaatgagctgaatatgttgaaataatgatttaattgtaattatatagtattgcagtataaaactatggtttagcagtaaaagtttttctaaatcagaaaatatattaaaaatgagacttttattgctcccaagttgtagtttagggttgtatacttcgaactgaaattatgttagattttgtttccaacataatgccaaaaagtccaattttctattatattttatttaaaattttagttattttcattgtatcagtactcctaaaatatttgaacattgctatttagaatgggtttcaaattcaaaaaaagttaaatttagaagaaaaaaaagttcagtcttcaattatttttatcatgttatttttctattttttttctagatttccattccatcaagcatcccttaaatgttttgatctctgcaatttggtatggaaatataagtgggttaaggccatacaacttggcatgggataaaagtatccattgattgttttcaatctattgtctatgacaaatagatcctagacagggtacatgttatgacaagaaaaaagatataattaaaagcttttactctaatctattagtgacatcagatataatatgtataatttagatgttatgatgatcttaggaacgtctatttatctctaaaaagatcatttattcataaaagcgcatctaagtataagtaaatagcccctatttaaatgttaagagaaattaactacttctattgttgacgaaaaatatatcaatatttacaacaccaaattatttttattgaattcaaaattgaatatgttttttataatataattgttttgtgttgaaaatgttactatgtttttataaactaattcaagtaatttgacatagacaaaatttaaaatgacttataatctgaaacagaaggagttgggaggaaggcaattagctatttagcatggtataaataatgggttgactgctattaaaaacttaaggtgggatattttaatttttaattagaaattttagtattttattttatttattggaggcttcaagttggatagacgggtccacaatgtattaaattattgatttaattgaaacttacaatagtttagaaatgtcataaattgaatataagatttaaaaatttacgattattttaaagtctaatttaggttgtttttataagtactagcttgaggagaaagagaagagaagcacatgacaaaggaaaagctggctagacttgttaggcggagtccatttgtgggtgttttttttctcgtaaagataattttggatttagttgccatggagataaaaagaacagataatgaatggtagggagagaggaacgggacaaacggttgggacttttgggatttccttttaaagatagatctaaccatataagatagtggatccattgattcaagtggaaactaatggttagatgttttgttttcatttgtcacacttatagatttttttttaatttaatagagtgtcatgtggcaaatgacttagaagtgtttatgggcgtaccattaggcctagacatttgtagttagaatggttgcatgatctaatatttagataacaaaatatgagcaatatggattttgaattttatatttaattataaataacagaacaattaacaaaaaatgagaataaaattgtaacttgagggttatttagatgtttgaattatttttttatatattgagtgttaattataaaataggataagttagctagaaaataggagaggaggggagattcggagggtggaaagagtacgtactgcttttttttacctcatgtatgtaaggtgttagttgtggggataccagatttatttcctttgagatggagatctaatggttaaaatgaacgggtccaccaatttaaaagaaaattgacggtgttattatagaatgccacgtgacgatgtaggagtgtttatatgaggccatgtggcaacctgagagcgtctatagaaagtttaattggcttttagtatatataaatccattgaactttccatgaacgcttttaagccgccacgtggcgctcgtataaatgctcataggtcactacatgtcatatctctaaattaaaataaatattaaaaattatgagaaaaaaaaatcaaaccatcggttttcacttaaatcggtaacatgtgattttatatctattaacacttccccctaaactcccgtacgtgtacgtatcgtatgcgtagtaatagtactgtttgccgaatgtgtaaagcaaaaaatattgtttgctaaaaaaaaaggctaaaaaaaactaacgtagtaacgtatgtatgccaccaggaaaaaaaaatagaacgtatgacaccagaaaataaaagaacgtatgtaccctgcccgatcctcactggctggcctcttgtcctattatggtattctcctttttttttctatctattagttaaagcaaatacggtaatttttctcaaaaatagtggggatgatttttctctaagggagatctaacgcttaaaattaacggctccaccaatttaaaagaaaatcgacggtgagattataaaatgccacgtggcgacataggagtgtttgtaggaggccatgtggcggcttgagagcgtttgaaggaagtttaatggacttttagtatataatagatagatagattgggctaggcccaatttattctattaaatctcaaatgcccataataagtgttaaggataacaatatcacctcaggaattaagcgaggagtacctcaacttaaatagggagttattggaggctctctgttgaccggttgaggtgggaatcggaaagccacgcgcgtgtgcctggccgggccggggcggggcgtgcgtcacgtcagtctctgtccttttgctaccacgattgcctccgtaacggcgcatgcacgatcccacgacgcgcgtgcggcaactggcggatatctctcctcctatataaggaagccgctagtccgatcagaacgattcgcagatatctctcctcctatataaggaggccgctaaactggcagatatctctcctgctatataaggaggccgctagtccgatcggaacgattcgcagatatctctcctcctatataaggaggccgctaaactggcagatatctctcctactatataaggaggcggctagtcctccgccctcctatataaggaggccgctagtccgatcagaacgattcgcggatatctctcctcctatataaggaggccgctaaactggcagatatctctcctcctatataaggaggccgctagtccctgtgctgcctctatttcgcttcctcgtttctgatcgcaatcgcttgtgcgcacgagagatcggaaggagcagggcctccggaaccacaccttcgcctgagatctgcaccgggtaggcgggtgaccaagttattggggagtgcttcccgcacgactgctctacacgactgctctgttcgtcgttgtctcgtcgtccaccatgtctgcacctggagccggagccgccgctgccgccgtctctggagatggagctctgggagccagagcttttgcgaacttcaacatcgacagaggcagttctgccttacaatccagcggagggccattctcggggtatgtctctctcctactgtcgttcatacctctgtttgttctgttggtcgcattgcgttcttggtatgttcatgatgcttatggtactgtaagcatgcttctggttatgctaaatgttgtcactagatcaccccacattgttcatgccataattattgtcttaacattttggattaaaatatacaccatatttccaacaatactgtacatgctcccgccgtgtcatgctcttcgatattctgatctttactgaatgcgacctctctttaaaatgcagctgtaccaacctttgtagtgtaacacaccctaggagagagttccaaagcctcatgctagacaaagctagactatttggaaattagaaaaaaaaacttggagatattttctgcaagtattatcaatgttaactggtttttagttctgataaaacctctttttcataagctagcactagccattattgtaccaatataccatagatttcagagaatggacacatgtaagagagtggccaccttaagaaggttgtatagagcaaatagattacggtagaggccttgcgatccaattctgcatatatattaagctacttgtcaacaaattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 39129 - DNA, 980 bp, Oryza sativa
aaaacagagtacatacagagtacccccaaatgctacaattccccctcccttaaggaccagcttgaccccaagctggtgcatgaggaaaccgagatttcaattggcacaaattctcccaggtagccaattcagttggcattccagtccacttgatcagcacatatggaacaactgtcttacctcttttgatcaaattgcgccgaagaatcaactcaggtaggacaccaactgcaacttcagcttcttgaagaggtaattctggactgacctcaacatcaggtttgacagccactttcaagagtgacacatgaactacaggatgaatatgactagaagcaggtaaaaccaaacgatatgccactttcccaatttgttccagaatagtaaaaggaccaaaatagcggaaacttaacttctgacatgaacaccgtgccacagacatttgagcaaatggctgtaacttgagatagacagagtctcccactgcaaattgacgttctgatctcctcttgtcaacctggtgtttcatcctttgctgagctcgagtgagctgctgatgcaacacctcattcatctgtgcacgctcttgtaaccaaatctgaacatcaggcacagtgatactaccagtgtccactaagccaaaatgagttggcttccttgcaaatagtacttcataaggggatttgcccaacacactgtgaaacaaagtgttgtaccaatgctgagcttgtgatagccatccagaccatttgcttggtatagcatgaacagtacaccgaagaaatgcttccaaacattggttgagtcgctccgtttgaccattggtttggggatgataagaagagctcatgtttacttcacatcagccaaccgaaacaattcttgccataaagcgctagtgaatatcctatccctgtcagagataatcacttggggcatgccaaacacatcataaacatgttgaatgaaagccaaggcta

SEQ ID NO: 39130 - DNA, 5269 bp, Oryza sativa
tgacaagaatgaccgatttgtgaccggtctgacattggtcatgtcgtcagcagacagccatgttcccacgtcgcgcctgcttccggcggaagtggaggtaggtatgggccgtcccatcagaaggtcattcagacggcaaccatacaagtctccgtctgtttatgaaaatataggataagtccccacaaaaaagagagagatggtgcatgtggtatccccttgaggtataaaaggaggaccttgcccacttagaagggggatattttttggggggggggatccagaacgatcagagagggagagagtaagagctctctggttctccagctcttttgtagcttcttcatacatagatccaccaaaacacaggagtagggtattacgcttctcagcggcccgaacctgtatacatcgcccgtgtcttgtgtgtttccattctcgcgaaccttccacacaccgagagcttagaatctcacccagggcccccggccgaaccggcaaaggggggcctgcgcggtctcccggtgaggagccccacgctccgtcatctggcgcgccaggtagggggttctgcgtgtgttcttctaagctctcgcactctttcgtgtgcgccaagcttttcctgttcagcccaatggccgaacaagcaaaggcgcacagcctctctccgagtgttagcggtgacgacggggagccgaacccacgccgtcgagctcgtactccaccgccccttccacgccaaagtcctaggcgggaggaggcgctcgagagggtcgaaggatccgcgacttcgacatccacgggtgatggggaagggcggcgagatggggagcgtcgcctcctcgtctacggcgacggcagcacgccccagggcgcgctccaagctgcgggcgcgctcctacgtcacccgcccattgtccctgacccggagtctccagcccaacgttggctggacgacgtggccaacttggtcatgacggcacggcagcgcctaggtgctggtgggcggtcctccgccaccaagacctctggcgctgctaccaccggctccgtgtcgtcaaggcggagggcgtggcgagcggcggctgttgctcgccattcggccgccactccttcgtcagcgcctccgacccaggaagatctgcgtggggggccggatgcccgcatcagtatcgagcgccggcgtaatggccgacgtgctgcccacgcaacggagggcgcctcctcgtccggagtgtcacatcaacacggacgcggggatcagccctccgtgcccccggttggtggtgtcggctgtagagcctttgtggcgagccttcggaacgtccgttggcccccaaggttccggcccaccatcgccgaaaaatacgacgggagcgtcaaccccgccgagtttctccaggtctacacgaccgggatcgaggccgccgggggtgacgacagggtcatggcgaatttctttcccatggccctgaagggacaggcacggggttggctaatgaacttgccacccgcgtccgtccactcttgggaggatttgtgccaacagttcaccatgaactttcaaggcacatatccgcgcccaggtgaagaagcggacttacatgcagtccagcgaagggatgatgagtcacttcgctcatacattcagcggttctgtcaagtccgcaacaccataccatgcatccctgcacacgcggtgatctacgcgttcagggggggtgtgcggcacaaccgcatgctcgaaaagatcgcctccaaagagccccagactaccgcggagctttttcagctcgcggaccgagtgactcgtaaggaagaggcatggacctggaacccctccggttccggtgtggcagcttcggccgcccccggatccgctgctcggacagggcggcgtgacaggaggaggaagaagaggtcagcccattccgacgacgagggtcatgtcctcgccgtcgagggcgcttcgcgggccacccgaaaggggaggcctgcgagcgacaaaaagaaggaggccggcgctcccagtagggagcgcccaaccggcaagtggtgcatcgtccacaacacctcccttcacgacctcgcggactgccgcgcagtcaaaagtttggctgagcggacgaggaagtgggaggaggagaggaggcaggagcgccgagagggcaagtccccggcggttccttccggcaatcggcgaagtgaggccaagcagaaggcccccgccgaggacatcgatgacggcgatgatgacctaggtttccaagagcctggggccaccattgccactgtcgatgggggagcgtgtgctcacgtttctcgccggagcctcaaggccatgaagcgagagcttctggccgcgacccctactcatgaggcaacgcgccgggcgcggtggtcggaggttgccctcacctttgaccagaccgaccacccaccgtgcgttgcccggggaggatagatcgcaatggtggtttcccccactgtttgcaacgtgaagctggggcgtgtcctcattgatgggggagcagccctcaacatcctttcccccacagcccttgacgctatcaaggccccggggatggtgctccggccgtcccagccgattatcggtgtgacgtcgggtcacacttggccgctaggtcatatcgacctcccggtcaccttcggtggatccgccaacttccgcacggagcgggtgaactttgatgtggcggacctcagtctgccctacaacgctgtcctagggaggcccgcgttggtgaagttcatggcggcggtccattacgcctacctccagatgaagatgccgggccccggtggccccatctctgtccatggcgacctcaaagtcgcgctcgcttgtatggagcagcgcgcggaccacctcgccgctgcgtccaagcccgagggtggcgacgagaggcttggcacctccgtccccgccgtcccgaggcagcggatagtcacgtgcgacgaggtcccggtcaaggaggttgctgatgcgaacccgctagggtttgtggcccgatctttcgatgagaggtaagggataactcgattagatgaagacgacgttcacggcccgactacaactgtccaaagacgctgcgccttagcaaccgatacaccgtctccaatggtcgccgcgaacttgtggtgcgcgtcaacccggccacgagggcactcgtcctgcaagcaatcgaagaacaagcaagaacaagtaggacaagcactgaaattgctagataaagatgaaagtttcactatcaaactcaatatggtggggttccgattacaggcagacgggcggtttagccaacacgcgcgctgcgagctggtagcaagaagctatctctatcatcaaaacccgtctgttcttggcgacgactagaggtataaaaagaggggaagaactaccatagggtcgtgctccaaccctaggacgcgcccctaatgggcccaacttggatacacagcccattgggccaaaagaggtgacgcaacaccatggacagaaaatagtcgggagtaaaatgacaattgcggccgctccagaacagatatggacatgtggctggatccatttgaaagtagacttgataagctttccatgaagtacttgcacgcccaaatcggagttcgcatgaagtcgtggcggccgtcagaagttggcgctgccctgcagtccgaatccaccccgcgcgaatcctcttccctttggatcatctccatcgttcctgagtaaaacacgagtgcacgcgtctccggggtataaagacgaggaatatgaactcaagaaagaactcacctgataatttagttgacgtgcacgagcgcgggtaataggaccatcatgctgtacatgggggacgtggatgtatcgatggtgttgatgtcctcatcagttgccctgggcgacggcccgtccaagaccacacgaatcggtggtcttctggatggcaaatagaaagacgcgctcgtctctttcctgcgggcaaacgctgacgtcttcgcatggagaccggcggatatgcccggggtccccagggaggtgattgagcaccgtctcgccgtgcggtcgggcgcaaggccggtccggcagaaagtacggcggcaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaacaaggcatgtcctaaggacccttaccccctgcctcgcatagatcagattgtcgactccacagcggggtgcgaccttttgtgttttctagatgcatactctggttaccatcagatttgcatggctagggaggatgaggaaaaaactgcgttcattacccccataggaacttattgttatacgacaatgcccttcgggttaaagaatgcaggtcctacttttcaacgtactacttgaatttctttgggtagccaaataggacgtaatgttgaggcttatgtcgatgacttggttgtaaagacgcgcaaccaagagaccttactctcggatctagcggaaacttttgagagtctccgctccgcccgcataaaactgaaccccgataagtgcgtgttcggtgtacctgcgggcaagcttctcgggtttttggtctctgcccgaggcatcgaggccaaccccgagaagatacgagctatagagcggatgcgcccccccagcaagcttagggatgtgcaatgcgtcaccggttgcaaggccgccctaagtcggttcatatcgaggctgggagataaggcgctacccttatttaagcttctcaaacgctccgggccgtttacttggacggaggaagctgaacgtgccctcactcagttgaaggcgtatctcagctctcccccagttctggtcgccccggagccaaatgaacctttgctactctacttagcggcgaccccgcaagtggttagtacggcgttggttgtggagcgcgatgaggacaatcctcattccgcgcacccccaccctgtgctggcttggcccgggagagagcagggaggagaggccctcgagccgaacggtggcccaaggcccccgacgaccggagcaggccctctgcccgcttgtcaggcggtgccaggtgcccccgacccccaggatggcccgagggccactgcgggaaggccgcacctatcgccctctgaccccgaggct

SEQ ID NO: 39131 - DNA, 6648 bp, Oryza sativa
ggatccccgaagaggatcggccccaccgaaaggtgcagcggcccgtctactttgttagtgaggccctccgggacgccaagacccgataccctcaggcccagaagatgctttacgctattctgatggcttcgaggaaactgcgccattatttccaggcgcatcgggtcacggtggttacgtcttaccccctcggccaaatcttgcataatcgagagggtactggacgggtggtgaaatggacaatcgaactttctgagtttgatttgcactttgaaccacgccacgctatcaagagccaggccctcgccgattttgtggcagagtggaccccagctcccgagcccgtctcagtccacgaggccagctcgggcccctcgcagctgcctcacaccgcccactgggtgatgcagttcgacggctccctgtctcttcagggcgccggtgcgggggtcacgttgacctcgccgagcggagacgtcctcagatatttggttcgccttgacttttgggcgaccaataatatggcagagtacgagggactccttgcgggactcagggtggcagctggactggggatccgccgcctcctggtgttaggcgactcccagctggtcgttaaccatgtctgtaaggagtaccggtgctctgacccgcagatggacgcttacgtgcgccaagtatggcgtatgagcgccattttgacgggatagagcttcggcacgtgcccagacgggataacacggttgctgacgaactctcacggctcgctttctcgcgagcccagaccccacctggcgcctttgaagaaaggcttgcccagccgtcggcgcgacccgaccccttaggggagacggacgcgcctgacaggcccccgaggcccgtcggagtccaggcctcgggacccgaggggagtgctcccagctcccttagattgattgcttggatcgctgagatccaagcatacctcacagataagactctacccgaggactgcgaagggagtgaacgcgtccagcgcatctccaaacactacgtgctggtagaagggaccctctatcggcgcgcggctaacggaatcctcctgaagtgcattcctcgggaacaaggcgtcgagcttcttgccgatatccatgaaggcgaatgcggagcccactccgcctcgcgcaccttggttggcaaagcctttcgtcaaggtttctattggccaacagctctcaatgatgcggtcgacctggtccggcaatgcagagcgtgtcaattccacgccaagcaaatccatcagccggcccaggccctgtagatcataccactttcatggccatttgctgtctaggggctcgatatcctgggaccgtttaggcgggccccgggcgggtttgagtatctgtatgtcgcgatcgacaagttcactaagtggcccgaggcttatccggtcgtcaagatcgataagcactccgcacttaaattcattaagggcatcacagcccggtttggagtgcctaaccgtattattacggataacggcacccaattcactagtaaacttttcggcgattactgcgaagacatgggcatcaagctctgcttcgcctcacctgcccaccccagaagcaacggccaagtggagcgcgccaatgcggaaatcctcagaggccttaaaaccaagaccttcaacatcctcaagaagcacggcgattcgtggatcgaggagttgccagcggtgctctgggcgaaccgaaccatgccaagccgagcaaccggggaaacgcctttcttcctcgtctacggcgcggaagcggttctcccatccgagctcaccctgaggtcccctcgggccaccatgtactgcgaggctgatcaagatcagcttcgcagagatgacctcgactacttggaagagtgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccctaaagggggatcgggtgtcaggtttcgggctcgggccaaccccgcacccccctcgggcgtgcagggttggccgggggctaccacatatgcatattcttatttctcttatatctgtatttcaataaaagcattttcgatttcctaaaggctgtatctgtgctgttgtttccttttgaaggatcttgacttgaaataggtcactcgtgttcaatcctgccctcgggggctcgggtcggctaaaatcgccaaacggggcccagaaccgagccgtgccccggggcgtagtgaactccgggggggaatcggcaaaaacccacaatcgggtcacccataaccctcggtcaccacgctcccggcctggccagtctcgacatgtggatctccccaggcactagccccgacccgagccatttgaggactaggacctgggcacgagcccttgttcaaagccaagacacaaaaggaccgcggcacagacatcctcgtctcatacacacaacaaatagaattgacacaaaaaatttcctctttatttgattgcagattaaattagtctatacaagaagggggcccgaaggcctcggaagaagaaaagaagaaactatttaaagattggcgggggcctgggggctcactccgatgcactcgggtcgccagcctcgtcgccactgtcgcccactccgccgtcatcgtcctcctcgtcggagttgagggcgaacgcgagccgaggggccgaaccctcgaagctgtggacgatatggtcggcggcgtcccggacctgcgcgcgcgcgccgtcctcggtcccgggagggaactcgtccagcgccgtccatggggagaagtcgggatccctggcttggtaactcgccagtacgagctccaccgctcctcgggcgaggtccctagaggatgacttagtcgtcctctcgagccccccggggagccggtggagaagcccggctatcttcgagaggcgctgggtgaggcccccctggttggcggcgtacttcgcagtccgcccgccccaaaggcccgcttgccggccggcgcggtctagacgggagacggcgtcccgaagcatgccgggccctacctcgcctgccaagcggagggcctcgacctccccggcggacgagtctagcgcgccctgcagatcggcgatggtgtgttcggcagctgcgaggcgggcggttaagtcgctttcgcccgcggccgccccgctgctgcgcgccctcgcgttcaactccttctcccgcgcctcgagctcagcggcccgctggttcagcgcggccctctcggcgcgggcaccttccagattatggcgcgcctgctcctcccgcgctgcctcgcggagggacaggctgtccgccagccgttgcgccgcggcctcggcctcctcgagagctcgctcccgctcggtgagcgcgtcctcgcggaggcggagcgcggactcctcttcggcgcaggcggcctcgtgcgcagtcagcgttgcctcccggatggcaacggcggcctcgcgatccgccaggtccctctccacggcgcaggcacgctcttccagcgccatggcacgggcctcaagggcttcttcgcgccgccgggatgccacctcggtctccgctgcccgccgttctcgggcagcggcagcgtcaaggaccccccgggcggcgtcgagcttcttccctagctccgcctcccagctcccgtattgaaggcggagggtgtcctgcgcctcgttcatcacggtggtggcgatgagggcagccccccgctcctcctccacctccttggcgatctcccccagcaccttccgacgggtttcgagctctgagacgtgccggcggtgtgccttgcggcccacctccaccatggcctccaccgagcgtcgcccctcttcgacacgcgcccatgcggcgtcgagctccgcccgctctgcttgcagggcctccacctgggcacttaacccgtccaacaccgtggtgtttgcgacggccaaggcctgcagaaggggttctgcgctcagtggagcaacggaaggcgtggggaagagccgcctcgaagaggatgccgcgcggcttggcccgccgatggacgtgccggactcggggatgtcccccggacctggtttgtcctgagcgtcgcacgagggagtgggcccaagcgatgcgcccgcggcctcgtcgtgagttgcctcggaagtcgtcgtcgcctcggcctggcgaagtctggcctcctcccgagcggcttcttcagcttggcgagctcggacggccacctgggcagcttcctcggcttctcgaaggcgatctgcggcctcttgccggtcagtttcacgggtcgcctcggaggatgtcgtcgcctcggcctggcggagtccggcctcctcccgagcggcttcctcggtctggcgagcccgggcggcctcccgagcggcctcctcggcttcccgaaggcgatccgcggcttctcgccggtcagattcccgcctccgggcctttgtggtcgccgggtcctcggcctcagactggccggacttggaatggcgggagggacgcgacgggatctcgctgaaacagaagaaagaccagaagacaaacaagatggatgagtgaaaactcgcgttgagggaatgaatacggccacgatgggcgtgggacgaacctgcgagggggtcggttaaacgaccaccttggaggggaaataaggtttccccgggatggttctgtcccccccatcttgcggagccgtttttttttccgctccccctcgggctgcgacgtcggcgtgggcccccttccgggccggcctgcttgttggcacggcgcccgccccgcccctctcggggaggaagatggggggaggggtttccttctctgcttcactctttcccccgggcaatcggcagggcgggccgctcccccaggccccctgtcgcggggcccaaaagcacgaccccctcccggggtagattgttcccccctgcggctcccgcccgcgccatcgtggccttgaggagcccgctccttcgacgccccgaccgcctgcatgatggtcaggatggaggcgcggtctggatcgctgcagagggggaggactccttgaggaatgagggatgcctccacggagctgagattcagcacccgttggaccactatcttgaagtcctcaggagcccagtcccatttgaccccctggtgggtcctcatgtagtcttcggacccggtgtactcccaggcgccccgggcgcgctgttgaagcggcgcaatccgccgacgaaggtagtcgccgtacaccatggcccctgtgagcccctgggatcgcaggcccgccaaccggtcaagaacggcgtcatagccatctcccagatctaccggcgcccgccagctgaaggcctgcgctggaggctggctcggaagtcgaaggcgcgctttgtcggcgaggggggtgtagaaccagtcgctcttccagtcatcccacttcttgcggaggacgcagggaatgtagcggttcagcaccggcccccgcggctggaagtagcaaccaccaaccaccgacggcggcgacaccggctgtacggtgaagaaccaccggaacagccgaagggatgggcgcaccccgatgaacatctcgcacaggtgcgtgaagatggccaatgtcattaccgcgttgggggtgaggtgcgccatctggagatcgtaaaactccagaacatccatgaagaaagaagaaaatggcggaaccagccctgccattgcaaaagggaggaagaagacggaccgccccgggtagcgtggcgctgggcatccctcgcccagcgagactatctcccggccggtggcagattccggcatgaagcggcgcggcagcccggcctgtctctcgctcacgatgcgggaaggcgcaagcacgctaccgtcaagcggagcggagccccgtgccatgatgccgaaagaagagatgtttaaaccgagcgcgtgtggcaaaggtagggcacaagaaacaaggagttagggcgcaagcggcgaagacaaggggaataatggcgagaggaaggaagcaaatctcttcctcggcgactttatacccttgccaacgctgtgcccggctcctcgtttctcgcgcccactatcttgccccctcgtttctcgcgcccacgcttccactaatcctattcgcccgtttgcggtgcatgaggtggataagcggctgtggcagtcgagatggaacatctcgtgcgcgcattaattacgctcgccgaccgaagcgccatcaccatatctccaggaaaaacgaaccggcttgtcccgatttttagaccggccccacctgtcaccaggccttaggaagtggcgtcacgcccgaccgcttccctcgaggagggcgatcgccctggcataacgccgggggctactgtcggtgacatgggacggggagtatcatgacttagagacttgaggcagacatgatcacccacg

SEQ ID NO: 39132 - DNA, 3447 bp, Oryza sativa
cccaaaggaggatgctaaatttagggaaaagataaaatcaaactacccataaggtcaacttgatacagcaacagcttgtaatagtttttcagggacattaccagtttggcacaatttccacatatacaaagttttgatctaacacattatattgctctagacattttaatattttttttttgaatacgcaagagaagtgcatatcatttcattaagagaaggagagaataggaagggagcaatgcccaaaaacccgattggaaacaggctgaaaccttcacaacacacgcaaaaacctcacctccccagtgttatcgacctataaaggaactccttaagcctagatgccctggctagcaagcacatgcctcaaaccatgaagagtgtgtttgtaatatgaagttcatgcaccatatacagtgtaagacaggactaccattctaaacatgcattgagtatcctactggcctacattcagaattaacatgatccagaatttagcataacatactagctataattctgaggtagatgcaactaggactaatgcttctttctcatatgaaccgagagcttcacacaatttcctggttctaccgttagttgtattcattgatatcatatttattattgtctacaagttctggtatctttgttcagacctagcctggagatagctttagtccagtctattgcaaagaatcttggcaatgttcttttctataattagcacaacttttaacattatactgagaatttgaattaaatcatgtgttatgtatttatgaggtacgtggagttgtcgattactgtctgtagctttaaatcccctaagcccagcatctaggaagaaccttaaatcatttcctttatgcgttctacattctgctgtgatatgtaacagtaaggtggaactagcatatccaatctagagagaatctagcattccacacacactttaggtagatgcaacagtgcacctcactttacaggatgcatacaatataacatgtacccagttcctttcagaagctccctatgcaccaaaatagagaagggaataaaaacaaaaatgcttaaatgatgaattcttcaaaagtagaaggcacctgtgtaacaaacttctgccatttcttagctttgtccttgaaagaatttttaatatctccatcgcaattcttatttgcatctcctagaccattatttttgtcactttccaatagacgctctgcctcaataacagccctcctctgctgcccatttccatagattatgaattcagatgtgcggcctagcctttaaaggatttattagaacatcagaatcatacaataaaacaataaataagataagattccaatcatctaaaatgattcctacacttgctaagatgtaggaaataagagcgcactgaaagcagggaaaatgtgctcatcatactagcaaatatgatacaccataacaaattgtcagtcggtgaatttagagacattaaactacaattgaagatgatgactgctttgatgtactaaatcagattaagcagggaaaatgtgctcatcctactagcaaatatgatacaccataacaaattgtcagtcagtgaatttagaaacattaaactacaattgaagatgatgactgatttgatgtactaaatcagattgtgctggtatctctatgtaatgggtattttaatgcatttctgacttttatcacaatgaatagcgtgatcataaaaatcataagttaaaatagaaaacaagaatttattttcagcttcattcttttccaggctgcatcttattcagatattactttctcagaaccaaatggtctacaacactaagttcattgatatgcacttcaaagataaatgtgcaagtgtagtatgctgagcagaagcatgtcgatatccattgttgcattgtattttaagtattatccaccaacagaaaagacatacttttcagcatgggtcctgcaaagctgcaagcagaatgagtgaaatgtgcttattacaatctccttggcaactgccttccccaccactgtcccaattcgatcccgcatttcagaagcagcagcagttgtgaatgtcatagcaagaatgtttgatggtggaaattcctaatcatcaggcaaggagatatgtgaatatgtgagcttcaagaaaaaaaaaatccatacaatttcactctgattatatcaaccagtgaaccttacctctttgagcagtgtgagcacccgaccaaccattgttgatgtcttgaatcatgccaattatgggaaggaaattttcagtatatacaccagcatggaatttaatatggcatgacaggacctttgatatgttcaataaagctcaaatagacattattttttagtacaattaacttttttcaatcacaacaaagtttatggaatctgcaatattgttatgtgtgaccgatatgaaaaatacgataaaatggatggcacttgcaccgtttaacgtttgaaaggatataatctacggaatatatttggcttgaatggtcagatggatttcattcagaaacaatcattaactgtatcagctacaagaacaaaagctacaaaattaatgcatatcgataaatgactattatttttattagtcaaacaggctaaatcatgcatgatgttggtctaaaaggacctgagcatctgacgaaattggtctcagttggtttcacatcgaagctggggccaataatttatgacagcggttaactcaacaacatatgtccataatactgaagattaagacattgaaacaaaacacactggttatatatgcaattcgcagagaaaggatgtttgtacatacctttccacttcctggaccagcaactatcattagtggaatagtcacatcactacatgcagcttccctctgcctgtcattcagggactgcaaatattcgtagtacttctttggaacacacccttcattttcctcaatttctagttccgtttcctgtggctcctcctggcccttggtagcatcaccctgatggatagcatcaagatcctccaagaatgcatcgacaagctaaatattccccaagagaaaaggaattaaacacatttttcttgattccaaagcaaacctagtaattcaatttttagtttcccagttcaccttccgagaatgaggaaacatgaattagccaccaccgaacaactgttcatcatttatttgtcgaaagttaagaaatgaagcaaataagccatacctctccttcccgctcttcatggcaaattactgagggaactgaaggaccatcgctattttttccgtcaatatcctcctggcacttggcagaagagcctgtatggtgcacctcctcagtaatgtcactgatgttccagaatgcatccctaaactgcccgccaaagcaaaacaaaacattcctaagttcc

SEQ ID NO: 39133 - DNA, 1606 bp, Oryza sativa
  unsure (1)..(1606): unsure at all n locations
tcatccgcatcctccattttttcttggctcgtggctaaaggctgatcatcaccctcctcaccaatggcattctcctccttccggaatgcatctccagactggattccccacaaagaaagaacaatcaaaattagttccctattaaaagtagccacttcaggatctggtacagcacatttcatttctgatatatcgaaatggcggaagttttgctttcctagttcaaaaagaaaaaaaatcgccagtatacagttgaactgccagcagtcacagattcataataatatcacactgataaactaattctgccccccaaatccttctcgatcctaaagcaatcccatttcatgaaacaacaagtttcagaatcccttaggcctcgccacttccctcccaattacaagattcctaaatccacaaatgcgcccttagatccctaaaccccagtttagaatgaaacgagagagcagcaaaaaaaaaaataccactccgctctccggttcggaggggatcgatggcggcgcttcgccggcctccttatccttcctggccgaggaccgctcgtgctcctcgcaaatggcgtccacctcccgcaggaacgcctcgtccatgccttcgtcgtcgtcgagaaggaacctgcaggagggcctgggcgccttcggggcgggggtgctgtacccgtacccgcatcctccccctccggatccccgctcccgcagggcgttgccggtgacgtcggcgagcgggcggcgcggcgacgggcacgggggctgcgaagggggcgggaatggggaagggcgcttcggggnnaggagggaggaggagccgccggggtgaagggggagaggggaggcgttctccttccagcgcgacattgccccccagcgaccgccgcggcgatcgacgacggtgcggcgagggtttgggggggttttttgggtgaaggttggtgcgtgtgggcgggaggagaaaatgggggcttcgctgaaatgccatcctacaattgggattcgcccaaataccactttcaactgagcccaacccgctgaaatgccatcccaaatcattttcatcaaaaataaaagattttactctatttttcacatgatttgacgaaattacccctcagtcaatttcatcgttagaaataaatcggctgggaaagcgagacgcatagggttagggtttccgtccgccacgccgatctgggcgccgccgcgcgaccttcctagcgccgccgcgccgccctacccttccctcccctcgcgccaccgcctcccctagcgacgacgcggcgcgcctcccctcgcgccgccgcgccgcgttgcggccgtcccgtggcgccgacctttccctcgcgccgccacgccgggttgcgggcgtccctggcgccgacgaggtctccccgacgaggtctccccgagcgccgcgtctcggccggcgccctcccctcgcgccgacgctcgaccggcgccctcccctagcgctgccgttcgggcggcggcctcccctcacgccaccctgcgctcggccgtagttgcggccctctccacgtcggtgtgtcgccgtcccggatctacttgcaggagtgatgcagatggattgc

SEQ ID NO: 39134 - DNA, 8358 bp, Oryza sativa
ttcagcgaagccctgttttgaggatggtataatccccattttctcgggcggtaggggagggaaggcttaaccaaagcgttgtgttttttacacgaaggaaaaaatagaccgatttacgaaaaaggaaaatttatgtgtgtcggtatttttttaagaagaaatactcagcgtgttttcttgaaacaatacaccccttattactacactattaatcaagggcatctctctttgtttgtaaaaaaaaagtgcatctcttttctcttcaacctcaatgataaaaaaaccaaattttgatatgcctcctcccccgctgcaatgacaacggattcgttgtcatgtatagaaaacgaatataccaaaatgataatccgttttctaaaaagtgtacctcaatgataatccgttttctaaaaagtgtacctctaaatatttactaggctgcaatgacaaccaaaatttgttgcatatcaaaatttattatattatatcatatcgggtagaagggtgttatagtatgtaatggagggagtacgtttcgatcaatactccctccgtcccataaaaaaccaacctagtactggatgtgacacattctagtactacgaatctgaacatacatttgtcatgtgtcacatcccgtcctatattcactttttttgacggaaggagtatgtaccaaccagttgcgtgaattacaattgatgggcttttaactttctttcgtataatataagggatataatatccaatatgttgctacaagaatttaagcgtaagaggatatgggggatgtgcacattgagaatgttaaaaggttaatattgagagtgttgaaaaatatgaacaaagttattgaactgataaaaacacgtttttagtatgcatccatgcaaaagaacggtacaacatataagtgaattctgcatgtggacatcacctcaaccgataccactctgaataggagtcacttttcaccagtttcaacagttagatgattctttataccttgtttcatagttaagcgatatgaatcagatccgatttatatttactttaagagaactagcctagagctcgtaaaactagaatattagagaaggacctaatatcaaataattaggaggggtgaggctttgaacccaagtcgtctagcccaccaccttgtggagctagtcggaagacccctgggcatttctcaagctagcctagagctcgtacgttacaacggaaaacaaactgaaattcttacttattattaaatcaattaataaacacttatttagtctaagtaatgttatgattattcttattgaacaaataagttattttgaattttgggggagtcaatagtgatataggagaaaacttgttgaaaaatgatgtaatagtatagattgtggtcattagatatcagctgtaagggtgatgtggaagaacaccacccctactattaacattttaagtactctatatgtttcatattataaggtgttttgattttttttccaagttaaacttttatatgtttgactgagtttataaaaaaagtagaagtattttaaacaccaaattagtttcatgaaatatagtatgaaatatattttgataatatgtgttgttttgtgatgaaatgatactcgataaaattagtcaaatgtaaagaagtttaaatagaaaaaaaaattgtcaaaatgacttactccctcgtccctccgtcctaaaatataaatatttttagctatgaatatcagatttatagctaaaaatacttatattttaagacggatggagtaacttataatacggagagagtagtatagattaaattggacttttttttcgattttgctatatctcactcgaaagattttttcttatctcttactcgattttctcactcaaatttacagtgcattttcttataagttacaatgtaatttatggaacttacactgtaaattttgtaagttacattgtaatttttgaatcttcgcatgtaaattttaaattttgtattggatttggtctttttcttaaggatatggtaatttagtgtccattatggtgtttcttaattgttttttgttttttattatatctatcggattttaattcaaagattaaaaatctgtgtgatacaatcataaaaatctttcgagagatgtataggtactcttttttttttttctgacggcggagaggcgaggcaatggggtggtctttaacggatgggttgaaaatgggttgggctttaacggacggcccacatgtcatctggtccatcagaaccagcgacgcggagagactggagaactagggctccgcctccctataaggagcgttgccactagtggagacccgagtcccgaccacgacgtccgccgcggtcgctgccactgcactgcactgcactctaccccggcgagcaccacgaccggcggcgagagatgcagatcttcgtgaggacgctggacgagtgcatcacgctggaggtcgagggcagcgacaccatcggcgacgtcaaggtcaagatccacgacaagaacggtatataattgattaactcgcttagctgagctcctccccttcgccctgctcgtcggtggccggcaaagccaactgcatttcctctcgcgcttatcggaatagtccagctccgccttttctttaaccgtcccgattcgaggatttcagggtatgaaaatcatagctttcctttcttttaaaaaaaaaattatccgattgggtagtgaacgatcgataaggttattggattagtttgcttccacttgtgtttcttcagagcaagaattgtatggggggattggtgtatttcttgccaaatcgctggacattccaatttgattaccatttaccagtttgtaccatgaatttgggggttaatttggtttgagttgtacggcaggcatcccggcggacgaccagcggctgatgcacgccgggaggcagctggatgatcgacggacgctggccgactacggcatccagacggagcacacgcttcgcctcgccattcgtctccgccgccgcggccaacctcctcacactcgcgctcaagcacaatgagaagaagatgatctgtcgcaggtacgtcctttaatttgcgcatttccatccaaaaacccaattagggcaagtacaataatctactattagcctgtccacctcagcgtgatttgacgtggaggcgcgctatgcgaggagaagggtgtgagccggcgcttgcatgagcgcccgttttgcacaggctaccatgcaatcagtgggacccacatggcctaagcgcagcatgcatatggcccggtatgcttgatgggccaggcaaaaccaatttcattggttggccaagcctggattgttgagccttgtagagactattattgtatacatcaactgtaaaacaagttctaaatgagttggataagaattagagtaagcaatcggctcttctattgcccttgcccttaggggagtcactctccttgatttgagaatctgcggcggccccattgtttcgttttttcggggaataatccaaacggcatatttacaaattaaaaataatttgtgaacaaaatttttataaatgtgttcttaccgatctaaaagttaagcttggaaaataagcttgataaaaaaaacttcaaaatcaacttcaaatttaagattgaaaattcaaattttggttgataagtataagtataagcgaaaagatggggccgtagttcgccgcgtgcaaacgaaagtagcagcttttggttgcaaattaactaatttcttggttgcagatttgcggtggtatgaaatgcgaaatagagcttacttggtgcatcaccttttcagctgaggcgtaagaaaaagctagtactccttagtaaataggtactctctccgtttctctccgtttcaggttataagacgttttgactttcgttcaagtcaaactgcttcaaatttgattaagtttattgataaatatagtaatatttataataccaaattagtttcattaaatcaataattgaatatattttcataataaatttatctttggttgaaaatattattattttattctacaaacttaatcaaatttgaaacagtttgactttgaccaaagttaaaatatcttgtaacctaaaacggaaaagtgggatggagaagtgaacaaaacgtattgattccaccattctttgataggtactccagatgaaccgtggggatggaaaagcgaacgaaacggttcatcagtttttttttttgagatgtcttagcatcatagaactgcagttattatcacatcgaagttttaacttcagccctagctattagtttaatgttttcctgttggattacgaactttgaatctttgatcaccctttttctccatgctaatggtagttttgaagaagcatggctgtgacatgctcaagaaaccactgctgaaagttactttcttggggatgaacttttatcactctctatgaatatatacgtcgtgatggttcggatggaaatgctagttactggtgaacattgcaatgtgttctctggcgatctagcctcacccatcatatttgttcttctcttttcaccatctattgcaactgtttttggcatgctctgtgttattggatggctgtggatgtacaattggccagattgatggctatcatcaggccatgctgttctcgtctctttacaaagtaggagctgatgccttctgattctggatccctgatgttatatgtgtgcacgcgttgtggcttgctaggaaggcaaagcaggtcctccgaccgctgcccagtgttttgctgatatcctgctggatgctgatgtctcacggagatttttcgacaaactatttacatttgcaataaactttcagcaaatttcacggattccaatcaaatttggacccgccaaatgcactcggagatcgtggtagagagagaatcaggggcagatctacccattaggcagggtgggtcgaccgtcccagctatgacatatgttgcctcacaccccccaagaagcccagaccatcttagagtccccctccgcggctagcattgccgcattggacacttgctgtggctagcgccgacaaggaggtggcacctctctagtggtgctcgtcggagacgggagacccagatgtgggagattaggccattcacagcacctcatttgcgttacctcgtatgccacataggatagatacacaacgaatccacacatcttacagtgcagggtactacgggtgatcccaaaacaactaccccaacctattctctcttccactttcccctttctctcctttcccctttccctctcctactttcactcccacccacccgacacagccggagcgcgcggcggcacaggtcgccgtcgtcgccaccgacgcggcgtcgtcgtcgtcgcccacggcggcgcgcgtcgtccccgcgaatctctcggcggcaatgagaaagcggagcgaggaggacggcggtggcgcgaatctggagcggcggcgtgggaggacaacggcggcggcgcgagaggaccacggcggcggcgcggattctggagtggagcggcgtgcgcgtcctcgtgctcgtgctcgtggtcgtcgtcctcggagcggtcatggcgggcggcggtggcgcatcctcgccccgccctcctcaccgacggcgctctcctcaccgcctgccccaacgccgagtggcggcggcatcctcgggacctggcgaagaagcggcggcggcgcggatcccaaacatggaagctggaatcaaggacctgaacgatcctggagaccaagccaccggcgacgccaccgcgcgcgcagcgatcactgcgtcgctgagagccatcgccgtcacctccggtctctccacgcgccccgacttcgccgccaatctcttccccgcctactcctccgccgggcgcccagtccttgccgccgcggagctccgagctcggccccctacctagctataggctgcaggagcctccgtccacgcggggattccacttcaagttcgtcatcctggagggtgctggttccctcgcggtggcgtcgtcgctggtcttcatgtacgccaggcaccgcagcgtccgcgacgcgccgtgaggctgttcgacgaaatgcccgagaggctgttgaatgtgataccaacagtttgttttccataatttcttcttgttaaggtttgggcagactacgattaggtcaaccagcacattgttatttaaccgaacacttaatcggtgaaaattcatcagatgcaaatgcattaatcatcatgtacggaaagagtggaaattatgatcttgcaccgaaaatatttggttcggtcaaaacaaaaacatatgttgtcacactcacaactttggtactgtatgaccagaagctcactgaaggtattttaaacccaactcagcaattttggtcactgtcatttcagcttctgcaaattaagcccaatagcctcacttttcttgccattctgtctgcttgttgcgatgaaggacttgttgatgagggttgatgagggtaagaagttgttcactagaatggaggaatactcccttgagcctaacctgaagcactatgcctgtatggtgaatcggctagggagagcatcttcaaggggcagaagatatgatctctataatgccaatagaacctgatggtgaaatatggggaactgaacttggtgcatgcaaaatgcatgacaattttgaaacttgcaattgtagaacaagttcttttattgtaaataagttcatgcttttgcttttggtactccctccgtttcaggttacaagatgctttgacttttgactttggttaaagtcaaactgttttaagtttaatcaaatttatagaaaaaaatagtaatatctttgacccaagataaatttcttataaaaatatatttcatcattagtttaataaaaactaatttggtatattactatatttgtttataaacttagtcaaatttgaaacattttgattttgaccaaagctaaaacatcctgggcatgctatggttattatgtgatttctcttgtgagcaagtggcatttcagcggtttagaatcggttgtaccaggatgtgaaatatgtgtgatcaagtggggtgatcagtatgtcagagtgatccctgaaaatcaacagaacgataactcaacagacatggtctgaaataaaaccgcagatggtctgaaatttcaacaagtagcacagattcctacatcagattcacaagcacaaatcacagtttcataaatatgttctcacagattcatcaacacattgacacaaattttcagcaataactaagagattcttaaatatctcacaatcacacatctctccaggctagcaacatcgggcgaccacatggcctcattctcagcccaaattttaccattcatcgatacaacacacattaaactgaaggtttagttttatgtctagccaacatcatacagtgcatttccactagcaacatcacttcagggctatggcaacatgcacacggcatcatttactcacagcatacaaccccaagctgcatcccgtagatcagcagcaacaactggaacccagggcatcacaaagcaacatcacccaataatagcaccacatccacttgacctgcacatgtaaaaaaaaaagttttagcatcattcacaaaagcatttttgtaagaggcaatcagatgaactccacacctgcatgctgtgactttctcaccctcaactagcacaggccatccaaaagatgttggtgccccataatgattaatgacaaaatgaccagcacttgggtgatcaaccaaaccaccaaagttgatcacaaaatgtgttcatgttgctagccgcaaggaataatatgattcacatattagacaacacgacccatgtatatagttcacagaccatccaaaaggaagaactaacttactagggagaagtcaagctagatgagaacctatccactcctccacaaatctgatcagagaggagtgcaacagccctgatatgcacatccttagcccatggctccattttaggagtgtaacagcctgatatgcgcttccttagcccatggctccattttttatgtgtctacctgtaacatttgtgcaaacatgtccatagccttgctcttgtggagcagctgatgaggtaattcttgggcagtaccaggtttcttatatgaactgaaaacaaaaatcgaaagacatgtctacctgttaaattagaaggtcattgttcagtttcaattttaaccaaataactaagaatgcttacacatataagccatcatgt

SEQ ID NO: 39135 - DNA, 6423 bp, Oryza sativa
ctccactccagactcaactcctggagttaattttaggagttggagctgtaccaaacaggcccttccattgatctgcgcctgaagctgctctttgtgcatatccttgagcacctgcctcttgctttttgcccagaactacctatgtgtgatccgcaggtgcttcggcttccatgccaaaggttcatctaggcctcagtataccaagtaattactaaaaacatccatgggctcgacatcagttaaaaggatactatgaagtagaagaaattatatgttttgtttgtatttccatgatctctgtgtcactaatgagaacaaggctgctaatatagaataatttaatcaagatggaaaactgtatatgtacaattttaaaaggtacatatagttacatggttgaagaaaaaacaatataacattgtcatgtgattaccctttttatatcctgtttcatatttttgtgtctacacttctgatatttgttcttttagtatgtataccaaaccatgttttttgttttggtgctgtacaggacaggttcaattatttggttttcctattagtcctgcacaatgtttcacagcacattggtgtgggcaattttggtagccttgccttctaatctttctctggagtaggagtactgttgcagcttgagtaatagttgaacaatgttttttctgacatcttgtgagctagggatcatatttaatagacaaacaatattaaaggtttaataagtactaagtacctcaaggtaccaaaaattttagtgtaaaatttagataccttaaggtgctttcttctctatgctaataggttgaatcatcaatcaaacattcaaaagtaacatgttgcattgcattgcataccttattttgcttgattactgtctttcctgttgccgcttgcccagatggccggaccgccagatgctcacaagccaggggcagcctgccagggatacagcccctcatggaagcacaggcactgcagcatgttgatcatattagaattgccaatgtacagaattgcccccctgggactcacccctcgtctctcctcagctgcccaagaagacttagcagtagtgcagaatatcatccaacaactggagctctcagatggtatggatcagcggatctactccccaaatggccattcagagatcttgtcctccagctccctatatcaattcctttcctcctccgatctacctaactgtgccaactgggatttcatctggaacaatgcagctccgccaagagtgcagttcttcacctggctcatgggaaaaaacaggctgcccacatgtgcaaacctctacaagaaaacaatattgtcaactgctacatgcgagctgtgcctctgctaggatgaagacgaagatcacctcttcttacactgtccttttgcttcaactttctggtctgcggtccgaattcaaccaaatatcccctcagcacaactcttatttcagctcaagccgcctccgataatcccaatggtagaattcaagtgcttctacctcctttgcttttggtgtttgtggaatcaccggcacgatgtggtattcagaaaagaacccccctccctccagcggatccttcgccgatgtattcaagatgcgtccctctggtcagaacgaatgaaaagcgatgtatgtcccatagtttcacagtggaagcgttgcttcgcttctgccctttcatccctgtaactgcttttattcttcttactcccatgtaactttaacaatccctttcaatgaaaattcaggtggggaaactctcccccctggtgaaaattaaaaaaaaaaagaaggatggggcgctactaagtaaaccagactagaggaagtcagtttctttcaatgatacaggcaaacagtaaaccagttctttacaaagcacatgatttttgaaacacatcaggtcatctatctgaacatttctgaagattacaacatccgtatgcacattctcatagccataaagatttttcactgcacatgtatcaaacaattcaagagaacagatgactggacagattgattatgaagctaagaacctttgaaaagagagtgtgtgtcatactgtcctgtgcaccgtgaaacatgaaaactaacaacagtaaagcttatattataaacttaagcataatctagagaagtggatcgaaattaagcaaaaacgagtcggctataacctactgcatttgctacctttcaatcccatctatgtgatttcatcgaaaatccaccataatcaacttaaacttcctgtaatttcagccataaaggtcagaactttctaaggctgtacaaaatttaataattcatacatttcctgactatgtgattcccagttaccccctcaaattgaatacagcaagcacacccgagacgagggtttacgattcgcgaacctgttgtcacttctaggcctgatgcctctggagcgtcggttgctgttgaacgcgattccggcgatgcacattgcacgcgcctccagtcttggccgtcatccggccgccgaccgccctccatcttcggcatcatccgaccactcctgcccgccgccacgacggcgagcaatggcgtggtggagagcgggatctcaggcggcgccgctgttgaggacggaagaaggcaggagactccggcgagggaacgagggatcaaatcaatgtagctggcggcgggaggggtctttactcgtaaaacctagtcaaataccccatctgactaaaatcccagctggctgcctctcaattcagtgcaactaacagctcccatctcgaagaaaattacaagtgactcaaggacctatttgtttcagattaagattattataatctaaattataaaattagattattataaactgtattataataagacaatataaaataagctgctagctatttgtttctctatattattatctgtttgttagttgttagccacccaataatctaaaaaagcacctttatagtaatctagcttatagattataataatctaaagctatctgtttgtttcagtttactcctaataatctagattataataatcctaagttgaatcaaacagtaccctagtccttcctatatcaaaaagacttcgctccctatctgacgcgtgtataacaccaatctcaatgcaagtacttcatctccttcgtctggccaaattttcctctctcctcttctacgaggttgccgccaaagctccacgggggactgtccgccatgaatccctcttcttacgattaatggatcattgggctatacatcttggattgcatttgattcgatttgatttgaaggggaatcaatctgggcatttgattcgattcgatttgggccatgaagttcgctgacgagggacggttcttgaacggcataacctgcttatcaacaaccagaagcccaaaagccaaggccactgagttggcttgtacaccggccggcggccgtgctttccatctcaaagcacagcaattaattggctggttcaatcttatgccatggacatgatcaattgcaagaactaagagctggatctgctggaaatcgaggacgacactgtggcgcacaagattgattcccacagaacttccacagccacgtgcaatgtgcttatctaagccgactgcgcggcgcgttggggttgcctgtgcatcgccccggccagagcacgccggcttgccgctgttccctggcttagcagccaagagcgagaaatttagcctgagagtctgagacgaaaggagtcggaggttggctgcttgtgttatacacgtgtcatatagagaagcaaagtctttctaatctcggaaggacctaggtcctacctaattttcttccatctcgtcttgtaccgttggacctgagatatccaaaatgcaaaagctttgaaagtttgagtccatattccacgagttacctaccatagtgataccgatagtgataactgatatctcccgctgataagtccaggtaccttcactcgattacttctttctgacatggatcactgatatgctgggcgggcccagatgatccaatacgtcagagacctacactaaaggagggaaagtaagtgagagaaactcaccttcaatgcacaaaaacctaaagccaggctaaaaaacccaaagctaaggttttctcccaatataagccacaattcggtgctcttcttcactttcttcactggagacgattctgcgatcccatcggctcctacaacttcctcaagtcaggtatggcatcaacattgtgatcttctcttacgcctcgcgctgccgcctccgctgagccgatcgggcgccattcccgtagtagctctgttgttattatgggacaggctataagggttgggatattttgcgcctcgatccgtgtcaagtgggaggccattatcttcctcgtcatcctggagtttggcttccgaaactggcaccgcaggccaacgcctctgcttgatcacggcagagacaacggaaacaacctcctcctcctcctcctccttggtgttattgtcgaggtaaacttagctttccctccttattcttggcaccaaatgcatagcccccaatccaaactgatgcctaatttcatgttacttctccagatctgagaccctctattatcatagcaatataagacaaagctctgttgttcgaatacttctttctcaacaagctgcaggaaatatcctgatcatcagcatcgtagatcctccacacccacttataagtaatgcctcattagtgttgatgatgcccaaacatccaaattccttatccttaggtcatcataacatgtcatctgcaatgagaaattacccctttatcagacctccttgtttagctttatccatcatataagcaagacaatctgcagccaaatcaaacaacagcaggaattagcacccccatttcaaacccctattatccccccgcctccctctcgctgatgttgatacaaaagttcccctgctgatagttttcattacccattatctcactcttctagcaaatcttttcctgcacagtggttcctccacattaatcatctccatgtccatgaactcagtgtgcttcttttgatttcctaaacatctgggttgcattccgacagatagttcggggggggttgctccagcgaggcaggaaacccgtggcatttgccagcgcaatctatactaggtccatttcgcggaatacatcccgattggtgttggagcagcccatcgttccagtgacgcagcaggagaggtgcgaagcttatctgggccggcccatggggcagacagcgccaggtatcgccattgcagtatgcctgttagcctgtatactccctccctttctttcttttttttctttttcttttgtctcttccgtctttaacatcagcacgtactacttaagttgctctcatcaagtcagtttttctttccaaatctatattacctcctttccaaaatatagtaatgtagaatcagatgtaacatatgctaattcaaatgaacaaaaacaaactgtaaaataggataacagataacccatttcgcttttttttttgggctggcacgatatcaccccttaaaggaataagttcatttaacttgtcaacgaatccgattttcgtcccttaacctgaaaaccagacacaacgagtcttttaactatcaaaaccagtgcagattaggtccctcggcggttttggctgacgtggcgcctacgtggctaatttgactcggtcttcatctgacgtggcattgacgtggcgcttatgtggcaattcaattcgaaaaaataataaaaccagtgggacccacatgtcagtctcacatagaaaataataaaaaatgtgggacccacgtgggacccgcatgtcagtctcacacataaaataataaaaaaaaatagtgggacccacgtgggccccacatgtcagtccaactcaccctcctctctccccatctcccctcttcatctatctctcctctcctctctcccggcgacggagaggcagcggcacgcggtggccggctgccggcgggagaggagggagcggcacagccaggcgcggcgtacggaggcagtttggcgcggcgacgtggcaccggcaatgaaggggaggaaggcgaagggagctccatgggcggcggtgggtttggggaagggctggcggcggcggggagctcggtggtggcggggatggaggtgagatcagcgcggggtggaacggagaggtcggcgcggcgtcaacagcatcggccgggcgcggtggctcggcagtgcgcggccaggaagtggcgtatgggggaggaatcgggggcggcgccgggcagaggagggacggaaggggagcttcacggggcggcggtggattggaaggccggcgcagcgg

SEQ ID NO: 39136 - DNA, 23805 bp, Oryza sativa
tacataagcgccacgtcaatgccacgttagattaagacccgagttaaattagctacgtgggcgccacgtcagccaaaaccgccgagagacctaatctgcactggttttgatagttgagggactcgttgtgtctggttttcaggttgagggacgaaaatcggattcgttgacaagttaagggacctcaaatgaacttattccccccttaaatactgacccattttgctttcttgtgggctggcatgatgtcatggcgtgcaggtacatgcgctcctgtggacacggagcggagcagatgggaaggcaacatccatgcgtggccttggcccactgcgttgttgttctctaaaaataaatgcgtgtggccgaacacattccgactcgattttgctatatatttgtcgacaaatttttcccccaaaatttgacagatgtaattacagtacaatcgtagtgtaattacactgtaacttgcatgtagttacactgtaactatagtgtaacttgtatgtaactttcaaaaatctctccgttacatgttatttcggtaaaatggaggtcgtgggaacaaattctttcacatatgtgtgtgctatgatttgttttcttcctcaccaaaacaaatcttgtaatagatccaacgattcaaaattatgtgaaacttacatataagttacactgtagttacatgcaagttacagtgtaattacatataagttacagtgtaattacactacgattgtactataattacatctgtcaaatttttggggaaaaatttgtcgacaaatgtataggtagtcccttccgactggattgggagtcgcgggggcagcagcctgccggcccagtgaggtcgaacagctgggggagttgtctgcggcccatgaagcagacgacgagcggtgagtgagacactcgcactgcacatattgcatgaaaagtccatcccctcccccccctcctcccgcgtggggtgtgcacttttaattttgaaatcggacacccaatcttctaaactttacaatccattcatattttcatattacccctaaagtgatatttttggatggttgttttgcgtagatgtttaaataagcggttttgatagctaatataacatattatattacatgtcgttaatttctagacctcaggttatactctatagtaatgctataatagtattattatgttggtacttagtaagtgaaatactgagagaaaaaaagattgttagaggatatatttaactgaagatttcaacatatatttcaatgtgtataccacatagtcaagcccatgcaacatacttcctctataaaaaaaagattaactcctgaagatgagtatggacaattatctaagttcattatcagaaattggttttttctataatggagggtgtatatgcaaattagatgaaaaccaccataacgggttatatgaacagtattgtaaattttagttgttagatgaactttcaaccaaagtttagcggggtgacatggactttttcatataatctaatactccccctgtttcataacataatactttctagcattacccatattcatataaatgttaataaatctagacatatatatatatatatatatatatatatatatatatatatatatatatatatatatatatatatatatatatatatatatatatatatatatatatgtttagattcatcactctctatctctctatctatctatctatctatctgtctgtctgttatatttttaaaacagccttgaaaggaggcaacacgttcactgtagaggctagaaattccaacattaatcggagaaaaagaaaaaaaaatacacgccattagattatagtgggtccaaattataacggtcgagatgtttcttgacagatatagaaagatatatcttgctctttgtttccgactctagttgtcataccgaagcaaatagattgttattaataccactggtcatatgccagccaaaaaaagagctttattaaggtacgttccggccggtcaacgactattggctggcaaaaaaaaaccacccatcgtccggtaatccataaaacacagctcttaatctttaaggatgcatatgactaaaactattaaaaaaatccatataaattagtagtaatataatttaaaaataactgaaattcaaaaattagaataagtaatattgaaagagaagtccatataagacccaatacgagatcaattaaaattcaaaataaaaaataaaataaaataaaaagagttcaagtaggaatacaattttgaaacaactgaagttggaaaaagaataaaaaatattaaaagaatagtgcatatagaacacaatacgagattaattaaaattcaaaataaaaataaaataaattttgaaattagaaaaagaaaaatagaatttcaactaggaatacaatgtataaataactaaaatttgtaataacaaagactattgaaagaagggaccatctagaacccatgatgagattaattaaaattatgaaaatttaaaaataataataagagtttaagtaggaatataatttataaataaaatacatcggaatgaaaaatatgaaattttcaaactcaacgatgataaatgacaataaagatgggagaagccataagcctgtaaagaagtaaagtgatgacggttgaaggggcatctaaaaactattaacaaaaccctaaagagaattcaatgatgattaaaaagatggatgacggacaggcagttaagaagcacgatctcggcggttggcgagacatctaaaaagtaaaaagtaaaccccaatgataatcatattcaattttaaaatcacaatgccaataaaaaggggaagcaacaggcgagccgtagagaagtccagtggtaaacccgtcacccctgacggtttggcgggacttctagaaagtaaaaaatgaacccaaatgccaattatgtttgatttttgaaattccgatgacaataaagagaaagtagcgaccgggccgtagagtagtatagtggtagcgtttgatgggacttataagcaacatgtctgaaaaagagtagagtggtgacagttgatggggcatctaaaaactattaaaaaaacccccaaatagaatttcaacgacgattaaaagcaggaatgatggacaacatggtcgcaacggttggcgggacttctaaaaattaaaaaaaaaaaaaccccaatggtaatcatgttcaattttaaaatctcaatgacaataaagaggggaggcaatgagcgagccatataggagtacagcgacaaagccgctgacggtttggcgggacttctagaaattaaaaaaaaatgaactcaaacgataattgtgttcaacttttaaaatcccgatgataataaagagatgagacagcgaacgggccatggaggagtacagtaacagcgtttgacgggacttctaagcaacatgcctgtaaatgagtagagtgatgacggttgatgggacatctaaaaacaattaataaaaacccttagtagaattccaatgacgattaatttttactcaaccttatcctctacgattaatttttttatcgtagaggagtatagtggcagcgtttgacatgacttctaggaaaattataaagacgaaatccaacaagaaaataaactctaaaaactataagatcctacttttaaaggttctaaggagaatgaatagaaagtggtagatcgaacaagcaaataaataaggagatgacagaagtaaggggtagcaactggtgtaacttttaaaaactataaaattaaaaacacggggatgataaagtttagtctttcaaagttttaagacaacgagatagctatttaataaatttttaagtaaaattatattaaaaatatataattttgtacgggtgctagccgtgcaattgcgcgggccacccagctagataacatctatatgaatgtggacaatgctatatatgaatgtggacaatgctagaaagacttatattatgaaatggaggaagtatttactattctatcggatggcactgtaatcacctctctcataggctttttgatttgttcgtgctaagggaattactattattgtttcttgtgctgccatgcatgcatggtgatggcgtgcagatacctgtgcgattgtggcctgcaccgtggccctggaggggatgcaccgaaaggtgtacgaggagtccaacggcgttgggacgttccctgtcgcttggcaggccgcggggagttggaacgagcagctgcggctcgcgtgcgagcgcaaaggcgtctggaaggcgcgcgagggagccaatgtgggcgatgtgctaatcaagattcaggagcttgcgggcgtggtgaccagtgtccccggattgttgatgccactgctcagttgggagaagcacagcgccgggcttacccgggagcgcgtggctgagctcatagacctcggcccctgcattgggagactgtgggtttgtccctggtaccattacttcgataccgataatggctgggtttatcttgggtgcggccgggacaaacttgatagggacgatagcaaagagcgctacagaaatcaggtgggctcgcacgctgtcgtctgcttcgcatatcgattctgcgaaaatggtgagatgcatgtgctcgtgttggacaaccatgatgatgacggcccacaacggtggatcgacgttgaagagctggatgcgatcttcaccctgaccgtggagtgcctaaccaacggaggcgcttctcccccaaggaggtgaattttccttcgggacacacacatatatcaaatactatatatcaaagatttctttatcaaatatatggtctgactagagttgttctcctggttggttcctggcaggcagctcgccgcctaaggaagcatcgccagccgcaagcttccgaaatcgaaccaaacatgccctccgagttcgagttggactttaaaaccttatgtctcataaaacatatgaggcctcgagacgattgtataacctccctgcttcttccggccgtagcatgaagcatcttgagctcctgcttctcttgtctccaaataactactagggaaaattcaccgtgtatccctaaaaaattgtccaatctctcatgtatttttctcattttcttcaatactcctgaatttatccttttcataaccttctcgttagttgaccgttaaattcttaaaaaagagagttgtccttttgtatgaagaaacacataaatttatagagtatatcattgaaatatagaaatttgttgtacggaacttatatatttactagcaaaatacccatgctttgatatgggtaaaataataataataatatatcatatatagaatatagcttttatcaaatatgatagtattatttattttcttgtttttatgtatgatatccacttgattcaaataaatattaaactattatataatataaaaaaattatggactagctaatttataaaattgtaaaagtagtaccgaggatggcagaaccaccaaagaccgataaggctaaggaggccgaggcccccctttgctccgccacatccatcgcgccacttcacaaacaagcaccatcactcctctttctctctgcttccctcgattccgtgaaccgaaggaattcctcaacggagggaaggcgaacatgaagcgtggtgagggcggcctgcgccgcgacgtgttgggtgaaggggagcgccgcatcatcagcgaaaagctagtcatggtggctggtaaggttcttgacgtgctcacagttgcgtaagaaaggagacgacaaggaggcgttgtggtcgatgtaggggaaaggggaagcgaggaccgctgtaaccctaagcaaccgccggctgcggcatgaccgtggtggcgcgagctcgctggagtcactggatcgggggtgtacaagaaagggagcgaggacgtcagggcgatgaatgctaagcaccatgtcgatttgcataattatatagggagccaatttgcactggttttaaagatgtgtagcaagagacgaaagatttaaagatgtgagagatgtcatacctggttttacggtgaggggagacgattcaacgtggagcaagagatgaaagaatgcaaaatatactgcgtggggtttacatggcgcttggccaagttgaatccgaccactccacttggaagaagttggaaccgagtcgagagcaaattaaagcgtggcctgcaggagcagagcgcggccgctggactgcgacatggcgtggcggaaactgatatgcgctaccctgccgctctctactctacccagactaaactgtccgtggggaacaacagcaacatagcctacgctaatgcggcggggcacacgcttgagtgcgaactcgagttcgttctcgtgcaagaaactaaggcagtggctgggagtctagataaccagaacagcgaggaagaagggcagcggtgcctcaccgacggtggcagtgccgcggcggccggaagtagaattaatgtgggccggcgatggaacatcttcggacggctctgtggataacgaacaatggtgggttagcgcactggacaagaacagaagaactagctgaggggagcgggggaggaaagctcaccagggcctccctgcaggtggcgtggcgagaactcgatcggcctatatgcgttcgcttcaacgcccattctgtcaggagagtaaggcaagggattcagacagcacacacggtgctggactgctgggagggtgagcagctattggtagagccgtagactcgtagaggttgcgaaccctgcgacgaatggtcgacggtgggtgtgcaggatcaggcggccggcgatgcaagatagcaccaacaccaaactgtcaacttcctccagaaccagatagccagttagccacagggtggttgacagtacttcctccagaagtagatagccacagtatttcctccagaaccagatagcattctcgtttcgtgtaaaatggttaatccggaagtggttatggttagaggaataaacccttataagttagttttactcttgctaaactagcaagttggtactaaacatgcgcacccaactctcatgggccacacatgcctcatcttaattgtgtcaggatgttaccgtggcccaaccggcaaggtgtgctttttcaaactaataaactgtgtgttttgtgtgaaatttttttaataaaaaatgctttaaaaatcaaataaatttatttttcaattttttaatgatcaatatttaattaatcatatgttaattgtgtttctagttttacgtgtagctaatcatccaaattcaatagcccaaaagaacatagcgtaatttctcattttgcatagcaggactttgtcgttacttggtgattgctgaaggttacgaatttgctatattggaaaataccatcattacaattcgtgaaatttgtcacgtgtcaatggaagtttgcaaaattccaaccataacattgccctaaaaaaaatgtttgcacctccatctaaacgtagaaattgtcgaaattaccttttttttttcacattctcctttctctctctgcagttcttctccgacgtggacagctacaccttcttggacgtacgccacctagaccccgccaccgctcgctggcctctgttcggggtcaatatctatacgcggagggagatggccaagtttttccacgccaagagcaggttccacaagagtcaagaccatggaattccactgtagggaaagtttattgatcgctcgagggatatcctcttatttatacatatatctaaatagttataaacaaatttaaaataaattgacaagatagataaggatgaaatatatcacttcacaaacatgcaagttagaatttaatttctacaagttgtaaaaaaaacaaatataattgcgaatgtactataactatttttagttaatttgttctttttattgcaactagtagaaattaaatttggccttgtattttttagagtaatatacactacaacggtcatccacatctcaatcaggcggcaaaccccatatgtgtcgggtatggcgcccgtcacgacgtaaaggttactgatgtgagaagttatctctattgagcatacagccgtcacggatgaagttatctcaatcgggccccaactaaagcctgtcatcgatagctttgacccagacgaccagtcaaataagggctcgtcacggatgaccttatttcaattgggcctcaattaatgcccgtcacggatgaccacaatctcaaacgggctttagttgaggcccgttacggatgagtcatccgtgacgggtttaagttaaagcccgtcaccgatgagtatttcctcccaaaaaataaattctgttttttcgctagcctcaggcctttactagccatgcccgttgtaaaatgaagaaacaaatatatttcacaatatcccagcatccccaatcatatacaatcattcacatacacatatgctattcacatatttcatatatccattattcacatatttcacacatccattggaatacacatccattattcacatatttcacaataacatcttcaagtgctaagcatcaaaacctgcaaaacagagttgtaaattagaacaaatttctaactggcgaaggaagaggttgaggcggcgggcgtgctcggggacagcgggggacggcgtggaggaggttagtggaggacggcggccggctcgaggacggcgtggaggaggtcggtggaggacgacggccggctttgggatggcgtggaggaggttggtgtaggacggcgggcttgggcatggcagtggacgtcgatgcgacggcggcaaggacagcgtggaggaggtcgacaccggctgatgtgggctcggggacggcgccaggctcggtggatgacaacgctgggctcccagacagcggcggcagcacgagggctcggggacggcagctgacagcggcgacgctaggacgtgcagttagaaaaatttttgatctagatatgagcaaaagtgaaaccctagtcaaagcattatctcaatcggggtaatttatactgtgcaataaatatctgtaacggtctaatagttatctcaatcgggcctcaagttggagcccgtcacagatgacattcatctgtgacgggcctaatagttatctcaatcgggtctcaagttggagtccgtcacggatgatggatatcggtgacgggtttctgttagggcccgacaaaaatatcatcggttatctttatcgggcttcaagttgggctcgtcaccgataggtgtcatccgtgacgggctcgatttttatgcacatctaacatgtcagtgtgagtatatctttgccggcctctttttgggcccgtttgatgacttcgttgtgacggcccgcaaaatctaggcatgtgaggggccgtctatgagaggatctgtaatagtgatatttcgtactaatctatattgttaaatttttttaaaaaattataattatatttagatgatatgtaaacaataagtggacaatccctttaagggatgaaaatctatatctgcatatgttttttttagagaagggtatttttacccggcctggatatatacggccattgaaatagggaacttagccccgcaaacaacccaatctgaaattcgctactatagagatttgaactcaagaccttgaagtactatatatacggccattgaaatagggaacttagccccgtaaacaatccaatctgaaattcgttcctatgaagatttgaactctaagaccttgaagtactactcaggtcactgcaaccactaggctacgtgccctttcgtatatttgcatatgtgtgggatagagaaaaagaaaaaggctaaagaaaactagaaaaagaaaaaggaaaagcgcgcggcgtgtgtttctcgcgcgtatgcacgaattcgagctcgacggggcttctccggcatctcatggcttggataaggattgtgaatggatggcgaaggtcagagcagcaagccagcaacagcgtcagtacagcaaatcggaaggctaagaacacgctaatttaccgttatactgtaccagaaccgtagcgggactttatcataaaaaaaggccggcacttgatgacctttgtcgttacatacatttcctttattagaaaaaaatggctattttaatcttattatcgttatatgtttagttaaaatgaaattcattataaaaattcgttttgatatataactttttagaaaattatgaactgcaattaagagtccgatcatctcaagttagtatttaagtttttttaaagatatttcttatacgacttcttctgtatttcaaaagcgaacaaacttaaaactaactcaaatacggatatggatatgtatttctagaaacgaacgaacttaaaaataaaccgactcatacataaatgacgtaccaaattattggtaaaaatatcttcaatttttataatagtagagatacagagtactcacgcactcccacctacacttaccatgtggatgcaaacacgtacccctccgtaaaaaaaaataatcaaatcatacgtgtccagattcgtagctaaagtttatcattttttggacaaagtaatacattttatttcgaagaaacttgatagatttttgaagtggacgaaccattattatagacacctcgctatcaaggttatatcatctagcacgaaataaaaatgctgttaaatcctaaaataaatctagcaaaatatgagtgttgtgtcacattaacaacttaaatatcttactcgttccgtttcaaaatacaagagaattttagtactgtaaatttgaacatgatattttagtactataaatctggatatgatcgtattagtaatatgataaatatatgtatttttgaacttcaatatagtcttcgagatgctaatttaaccaataatatatataaaactaagatttttttaaataaaaagagttacatattatgataactagaaaaatgcatgtgcgttgcaacgggtgattgttattttaatcttattattgttattgtcggtgacatgggaccgggagtatcatgacttagagacttgaggcagacatgatcacccacgtggtctaaccccctcgggggggggggggggggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccatatttattgcggtttggacgagcgcgtcacgccgcatgtaacgcagtgcagcgcactcgtttatccggtctgtgaccagtcacagaccgatcagatcgtgggttaggtggcgacaggcggtctgacgtacgcctcgccccatcccgtcaggatgagagcctccaagcactcatccctagccggagccggcgtgttagctcctggagatggcacgttggtcccggtcagatatataccaggcttcatcctaaccattacaagcaagacattgtatgaagaggggcgaacatgcagattgataaactgacgcgtggtggacaagaatgaccgatttgtgaccggtctgacactggtcatgtcgtcagcagacagccatgttcccacgtcgcgcctgcttccggcggaagtggaggtaggtatgggccgtcccatcagaaggtcattcggacggcaaccatacaagtctccgtctgtttatgaaaagataggataagtccccacaaaaaagagagagatggtgcatgtggtatccccttgaggtataaaaggaggaccttgcccacttagaagggggattgatttttttggggggggggtccagaacgatcagagagggagagagtaagagctctctggttctccagctcttttgtagcttcttcatacatagatccaccaaaacacaggagtagggtattacgcttctcagcggcccgaacctgtatacatcgcccgtgtcttgtgtgtttccattctcgcgaaccttctacataccgagagcttagaatctcacccagggcccccggccgaaccggcaaaggggggcctgcgcggtctcccggtgaggagccccacgctccgtcagttatacagtttaattaaggtgaaattcactgtgtgaatttgcttggatatatatattttttagaaagtcataattaagctgtaattaggagtccgatcatgtcaagttagcatgcaagtttttttttaaaaaaagacttcttacatgactccttctgtgtttccaaaagcgaccgaacttaaaaactaactcaaatatgtaaatgtatttccaaaagtgaacgaagttaaaaaccgactcatacacgaatgacgtacgaatgtaccggcaaaaacatcttcaattttataatagtagagatttgtttaatgataaatttagtaactttaattttacatgattaagcttttttctaattaatagtcaaagttaaaaatatttggcttaatactatattaaaaatgcttatattttagaacgggcagagtatatttcattcaacaaaaatttctttaggacggatggagcagtaaatactcagccctactggataagatatgctcagtcgctgtcgttggtatacaaggcagagggccaggttaagcacaattgcactaatgtcccattccaattatttcagtaaggtgtcccatcaaaaaaagaatatttcagtacgtgtttttaatagaaaaggcgtctcctcgtaagcacccggaaattctgctcgtggaaataggcgctgctcgtggaaaggcctcactttcacagtagtaataaaaatgaaccagcaattccgtaataaaaattctgatggcgtcactttcgccgtcccggccagaaaatacgaagtaaaaaagaaccagtgatttaagcgcgtcgatcgatcgacgagggactatgtatttaccgacttactgagaattccaggcatcactgatcaaccgtactaacaataagccatagctagtgatcgatcgatggccggcgtcgtagaaaccgccgacgaagctacccaagcaccagctgttgcttccataagtaccgcagcagcatatgcacggccggtgggcacactgcttgatccgaagctgttcatggctgctcgccgcggtgacatcaacgggcttaaggaacttcttaggccagacgacgacgacgacgacgacgacgacgaggtagtcatcgtggacgtcgaccctgtgcctgctgctccctcctcctcctcggcctcggggtcgtcgcatcatcagctccaacaacttgatgatcatggggtgaccagcaacgagggtgactccctactccatgtggtcgccacccgcagcggcggcggcgacggcgaccggttcgtcgcctgcgccaacacgatctactaacacggcagcagcaacggcgccctcctcgccgcgcgcaaccacaagggcgacacgcccctgcactgcgccgcccgcgctgggggtgcccgcatggtcgcctgcctcgtcgctctcaagacggctgaggtggtggccgcgcccgcgggagacgggccaggtgtggaggagttcctcaggatgcggaaccagtgcggggagaccgcgctgcaccaggcggtccgcgctgcctgcacggcctgcatagacgagctgctgctggtggatccgatgctggccaccgttccacaggagggggagggtggcgcttcccccttctacctggcattttcactgggtaaactggatatcgcacgccatctgttggacaaaactaatggccagttgtcctactctggactcgacggacaaaacgtgttgcatgcggctatttctcgtggtcaaggtacgtgaaaatgatactaagggcctgtataaatcttctggcaaaatttttcaccctgccacttcgaatgtttggacgcatgtatagagtattaaatataaacgaaaaaaataactaattatgcatattgcgtataaattgcgagacaaatcttttaagcctaactagcatgatggcccgcgcagattgcgcggctaacatcattatattttctctcatataatagcatatatatttttttattatattattaaaatatattataatgacaatataattttaaattttacaataactttacgaaactactaatgtataatattcatattatattttatatacgtattagttattaattatttttaatatcaaattttagttatttgtaaattatatatatttctatatggactctagacttgtcttttaatatattttttaattctgaatttttattatttctaattgtatttctatgtggactctaaactcatctttcaatattctttaatttttaatttcaaattttatttacttctaaattgtattcctatattgactttaaactcttcttcctatgtttttcttaatttcgaattttagttatttgttaattgtatttttatacggctaaacactacttttcattttattatgtttcttctaaattttacctagttttaaatttctatatagactctatactctacttctaatattccttattttttaattcttaatttctattttttttcttaattgtatttctatatggactctatactctacttctaattttccttatttttaattccgaatttctattacttcctaattgtatttctatatgaactatatactctaattctaatattttttatttttaattccaaatttcaggtattttctaattgtatttctatatggactctagtctcctcttctaatattccttattttttaattccgaatttcaactatttctaaattgtatttctatatggactctagactcctcttctaatatttcttattttttaattctgaatttcagctatttcaaaattgtatttctatatggactctgcttttttatatggactctatactctacttctaatattccttatttttaattccgaatttcagttatttcctaattgtatttctattggactctagtctcctcttctaatattccttattttttaattccgaatttcaactatttcctaattgtatttctatatggactctagtatcctcttctaatattccttattttttaattccgaatttcagctatttctaaattgtatttctatatggactctaccttttctttttctccgattaatttgagaatttataggctatgagagcgaacgtggaggctcctttttctattcctttaataatataatagattgctccatgattcgacaatgtggtgctacagtaaacatttgctaatgacagattaattaggcttaataaattcatctcgcagtttatatgcgaaatctgtaatttgttttgttatagtctatgtttaatacttcaaatatgtgtccatatatttgatgtgacacgttaaaatttttcacccctgatctaaacacagcctaacactacgctagatcggctcacatgtgatgggtcaaaagtacttgtcacggatggcctcatctttaatggattaataagggcataataggtgaggccatcggccgaggcctgtcatatttatttggttacctgtgatgggccaaaatttacacctgactgaggtctacctttgccgggtgcaaattctggccctttatcggtataaatttcagcccaacacaagtaaccatatacatgtgatgggtctcactattttagccaatgattgcaatttcggttgaagttggtcaaagtttatttaaattcagttaaaatttcggtcaaaaaagtgcaaaaaaatcccgaaattttggtcctaccgaaatcaccaaaatttctgccggaatcaaaagtgtaaaccttgtgttctaacctgtcaaaggtgagtttaactcatctctgatgggctcaaacactgacccgttagaggtgttggaaccctatatatacccttaccgtcaattgctttccatctcaatcctgcacacttttcacttttcgggtggtaaggtaggaggcgaatttttgctggatgcatgcatcttattttgcgggctaattaagagtgatcgagattatcacaattaattaaatacaaactgcaactgcatatatacataatacatgcatgcagcgctgcctgtgcttttggagtggctgaaggacgtgacggtggacgtgcaacaaggcgaccgtgctatcagggtgcctcttgtatcgcatctggcgcagcaaagggaccatcagacggggagcacgcctcttcacctggctgcatcgctggaagggtggccatacgtgggcattctttctaaatggttcccagatgtttggccgcggccgaaatcagcagtcgcgctgctgctagaagccaacacatgtgcagcgtatcaaccggacgctgaaggattataccccatacatgtggctgccttggctgacagcctcgacgtagtcaggaccatgctgcagaaatgcccggactgcgccactttgcgagatgccaaagggaggacgttcctccattccgcggttgaggcggagggatacagagtagttgaatatgtctgccgccgaatgccaaaagaattttcgtccgttctgaacatgcaggataacaatggggacaccgccctacaccgagctgtccatctagggaatctgccggtttttaactgcctaactcggaatccgcatgtacatctgaacataccgaacaagtatgagttgacgcctcttgatctttcatggattacagtcccttcatcgttttattatgattcggtaagttactagtgctattgttcttatttcaagaggcagttccctccacccaaactttataagttatccctccatccaaaagtttaatacctatttcattttaccatcaaaactaaagagtaattaactcatccactacgtaacaaaaccattaaattatacacaaacaaataagtaataagatggtttctcggattctggtcaacaatttaatttagggactatctatacaacattcaactgaaaattagcctaaaaatctatcaaatgtaactgtaacataattacaatgtaattttcataattacactatatttatactataattacatatgtaatttttataattacactatatttgtactataattacatatgtaacttgcatgtaactcacgtgtaattatagtataagtaagatataagttcaagctagatcataaaaatatagtagcccaatggggcagtcacgccttcatcccatgaggtcaaagatcgacccctaaatatggttttgtttttcttcctaaaagcacatatcttgatgcgtattaaactgttatagcatgaatctaggacacattcaacggtttagaaagtgaaagatttagccataaaaaatctgtcaacaaatatttagcaattccatttaatttagtatatagagattacaaatacggtttaaacttttggaaaaaccaaaaggtgaaatagattttagacttttgaatggagggagtaatatttttatacaagatcattgcttaaatgatactagtatattaactgttcattctcgcagaatccaaggggtctcatacaattatcattgcaatttgtgggagctccatgcggtgcaagtcgaccggacctcttatcccaaaaacacatcccaaagatagacaacggcaaggtctcggcgcatctaacaaatgcatcgcaaatgctgggcattgtgtccgtacttgtcgcgaccgtgacattcgcgtcagcattcacgttgcccggaggttaccaaaccgggtcggataacgcggcaggcacaccactgcttgctgggagctatgcctttgacgccttcattttatctgacacgctggcattcatttgctcgtgtatggcgaccttcagcctgatcttcgctggggtccctgcaatggacatctctatacgctgcaggtacttcgaaatttctgccctcttgctgcggagttcgggaagaagctttgtggtcgccttcgcgttggggctatacctggtgctggctccagttgctcacacgatcgcgactgcggtctgtgtgattatctttgtgtcttcgctctacgggaattcggaagcctggcagatccttcgtgtcgcagacatggcccgtgctagattgggaactcgaatgcatgtagcatggactttaggactcacgttctataacgtctttgttaatttgtttttgaacttctggtccttcattataatctttggcctcccagcagtaattcggaaggttcatgcaagggagtagttttcgctacctttccatttccttcgttagcattcggttaaaactaaatctccatgtgatcaattagcaagggacgcatgggctatatacatgtatgtaatcatcccatgtacaagattcatgccccttcatgggctatatatatgtatgtaatcatcccacactactgaaaaaattatctttgttggttcactcaaaaatcacattagtcctggtttgagtaaaaaccaggattaaaaatatctttagtcccggtttgaaaacacacaggtattttttgatcattactccaggttagtaacaccaaccggaactaaatattacttttactcctagttcaaaaacatatcagagccctgttatttttagtcccggttggtgtccatctttagtcccgattgtttataccaaccgggtctaaagttaaaaaaagttgcgaaaatccttgcaccgagccacgcgcgctgcctcgtccttatcccctcctcttctcctcctcccctctcattttctcgatctcctccacctcctccccctccccctctcctcccccttcccctctcctcccctctcccctccctcctctgacgatgacgacggcgacagcgggtggcggcccggcggcgcacgatacggtaggcgggcggcagaggtcgggtcgccaaagcggcagcagcacacggccgacggcctaccctccgccagatccggtggaagggaagcccgggtggcgccgaacgggcaaaggcggcctggcggatacggccgggcggcggaggccgagaggcggcacacggccggacggcgtgttttgtgaaaattttatttttggaatgatatgtaatttttgttgtagattattttagattttggaatgattttgtgaatgactcgtgaatgtggatgattttgtggatgggctaagaactgtggatgatttgttgtgcatgatttggtgatgatttgtgtggtttggggatgatttgtggggatgagggtgacaataaatgcaagaagcaaaaaaaaataaaggaaagaaaaaaggctaaccaaccggactaaaatgggactaaaaatccattaagtatctttagtcccggattggtcgtcccggtttacaacctgggactaaaaggggttataaaccgagactaaagagcccttccccagtaatgccatgtacaagtgaaaagtaaatacaagaatcattcatctctagagttctttacttctaacatgttatcacgcacgttagttgttccacttaacgatagaaggccaagaatacgttcttcgtcaacaggagattggtcgatttcttccaaggtaagaacatgaatcaatttcattcttctacctttgccatcggcatcgagtggctcttccccaaaacctttcgcaagatgccgcaatggtgttgccatgccatggtcactgctaaaaaaaatactcattggtgctggctccaaaggtcttataggtgccagatttggaaccggcacctataccaccgttgccgccaccttcaccaccacacgcgtgcgacgtgaagtaggcgggtgccaggggaggaggggccaccgccgccggcacgcggaggaaaaggggggaggaggggtggcggatgaagaggacggtggagaggaggagaccagtgtgagagagatggagaggagacagtctcgaaaatataaggacggagaggaagaatgatggcctattttttttaataggtgccggtacctatagttatattataggtgttggtttttttaaaagtccaacacctgtagtattggtacctgtttttctctaaaattgatacctgtaatgtaagtgtaggtgtcgattcttctaaaaaaccgacacatgtagtattggtaccagttttttccctaaaactgacacctatgtgtttaaaggtgccggttctatatttttttcattgtggcagaggtgagaaaaggggtataggtatcggttttaaataaactggtacctatgggccagtcgtagtagtgggtctttggtccgatattgcacggagaaatttggtgccgcccatgcttgcatcttcgttggcaaccccgacggcaccggccttgctagctccggcagcatcggcgccaccaccacagccgacccattttgactggccacggcaaaggcgctggccatccactcaaatgatggcatcaccttacagggggaggatttttttttgaacttttttatttttaaattataaaaacagaccattctaaaacttattacagaatctaaacctttggccatatcaactagtctggcgtggcaaaacaatactgacaccccacacatagcgagcataataattttgtcctactacactagcgagaatagtgtgaccaaataacgttgccacgccagccagaccgacgtgaccaaataacgctgccatactagccagaccaatgtgatagtattattttaccacgccaatctaactggtgtagccaaaaggttcatatcttgaaaataagttttgaaagagtttgttttaaaattaaaaatttaaaaagttcaaaaaataaaataaaaatttgagggagagaacggccgcctgccgaaccccactccattctctccaccgcgtggtgccggaccagacccccctcccccgggtgtgattggtcggtgaccagccgcgcggggctgcacccgcacggtcagttttgcccgccttagtccattagtataactactgctgctacaaatactacaactactactaatactaccacattaccactaccagtaatagtagtaatagtagttctattaatactagtactactactataattatatatatatatatatatatatatatatatatatatatatatatatatatatatgcgcgcgcgcaaagtttatatactacgtattaaaaaatttaaaatactaaaaaatatatcatgtatacaaactttgtatatacatatacaaactttatacacacgcatataaagtttgtatatgagcatataaagtttatatacatgtatgtatataaagtttgtatccacacgtataaaaaaccaaaaaaccaaaaaaaaagaaaaagaaaaccagagaaaactattttttttaaaaagaaaaccaaccaaaaaaacccacccacgtgggcttcccacgcgcgagcgactgccccccctctccgcgtgccacgcgttcatccacgcagggggaggggcgcgccccgcgtcccacgcgtctatccacgcaggggaagggcgcgcggatatccactttttagcggatctgcccccaaaccacgacatatgtcctacttccctgcccacttctacatggatgtgcagccactgggggatggggatgaaagcgatggagtatgtgtagctgtggctgatggcagaatcgcggtatccctcctacgtcgtggccccgggccaatgctcctccctcctcgcgcaatgtgtccacgccccgcccgtctctgacaaagtgaaaaggtggactctgaagaaaatggcagaacagtttcagagcttcaagggagatctgtaccagaaatatatcctgaaggggcagacaccgaacttcgacacattcccaaagctaagggatcactgggacgagttcgttgcatataagacaggtgaacaagggcaggcgatgatggaaagaaacaaagaaaatgctaccaagaagaagtaccatcaccacttggggtcaggcggctatagcgtcacgatgccgaagtgggaggagatagaggctagcttgcttgagaggggtatcgaaccggccaccgctaattggccggaatgatcgaagttctggtactatgctcacggtggaacgctcaacccagctgatggctccctgatcttcggcgatcagatacgcgaggctgcgcgttgactaacagacgtagtggaagcctcttctcagggcacgttccgaccggacagagagaaggacgagctgttactcgccctgcagactccagagcatccaggacgaacacgagggaaaggagtgattccttggaagattgggttcaaggaggacatccacacgtataggagttggatgagagcaagagagataccgaggcgaagattgcagattttgagttcagggtatcgagctacgagctcagcatgcaagaggaggtggcaaggaaggttgatgaatgtcacgcccagaaattcccgaatagaattccaagcagaatgtgcattaaaatccccgtccaggaccggcgggggtacacaaacgacaatgttgacattcagatccacgtcttacaaatatcataaaagtcttacataaatgcagcggaaagaaagaaagacaacaggagctaagccttgactagaactgcagcgggaacaccactccacaggcatcctcgacggcacgggcaaagcctattcctcggagaaaccttcatctgacacatactcgtactctggggttgggaaaagtagagcaagactgagtactacccactgtactcagcaagtcataccggaatagaggcatgatgcagggaatcatcaaagaagagctaaagtggatcatttgcataaagcgagcatttataaacagaagttgaaagattaaacagttgtaataattaattagtattaactatccactgtccaacgctatcccacgttgcaacaggcccaaccatccacctaaactatccaaattctaaagattacactagggtgatactaatcacggtgaatctggttgaccgcccataaccgcgggcacggctattcgaatagttttactctgatcagaggtgtacaactgtacccacaagacacagccccacaacacgtttccatgcgccgacatgccaccacgacatatcggaaagaggccgtgacaggacccttcgcataaccccctctagccaagcacaccacacctcaggtttcacccccgtccccagcgggcaacgggcagtcccctctcgtgcctaggtgaatccggaagcgacagaggccgtcgcagggcccgccccgctccatcacgcccacccttgcctggatgcgttgactagaggagagctacactacaagcccagccgttgcccacgctggcttgtggtaagtacgataagttcttccagggcatcccgcgaacaggtccttaattgccatgggtgcgaccagcaaaaccatgcacccacaacccaccatgtgatttattttaattaaccaacaccaaagcggtgtcactaatccaacaaaaccattagaaccaacagtctaaacattaataggattttccccattgtgcactagttg

SEQ ID NO: 39137 - DNA, 15761 bp, Oryza sativa
agggggaggaaaggagagaatgggccagcggcccattcgaaaaaaaaggaggaaaagggaggaaaaagagaaagaaaaaggaaaaaggattttccctggaattaaaatattgcttgctcaattttaattggttaaaattatttctagagctctgaaaattccactaaaaatcctgttagtgaatttcgacatgtagaactcaagcaaaattctacatgccaaatccgattattatttgcattactttcttagggttttctcttgatttgcacctgcattttcttggggggtcgtttataaattaaatttttggcttgggaggaaaacttcggggtgtgacaatgaacgcatggccgcacatcggtccaatgatccccagccgaccattcctcctgcaatggtgagcccatcaggaaatcgtagcagctgcgcctcaacggggcaagtaggatcacagagcatggacgccatgcaaacccaggacgaaaccacctgccccgttgatgacatcactcagcggacaccatgtgagctgcatatccccttcaagaacttatcaataaaggtaaactcgtagtttatagattttagatttggccattccgctagttgctgcttatatatgttgattactaataaataacctctcaccacatgaaggtggcgtcgggcatggccatcttaacggacccttcaggtacttaccactacaggccgattccagcaggatactccaaggtcgaagttgagttggtcgaaggcgcgtacgaggacctcgagctggattaccctggaggagacggtgagacgcatctacaagacacaagccacgccattattctatggcgcaagcggtacatcatcctccctgggcgacaagcggcgtctcgtgcactatctcctccggctccgccatctcctcctcaggctcctacaccgtctcctcctcatgctccagcaccgtctccacctcaggctcctgcaccgactcctcctcaggctcctgcaccgactcctccgcaagctcctcttccggcaccttctaagtcaagggccccccaagctccaccacctgcccccacaagggcaacgaagaaggcgaaaattgacgccgccaagaacaaggacccagggtacgattgcacgcaagaggagcttgacgcttacgtggcatcagaagtcaggagacaattcaagcctcgaagtccagaaaagaagattcctatagacccgagtgtcaagaacttcttcaggggtatgtctacacctgccaaggaggccataaagctattggactatgagcgaacactcaagaaagcatcttctggaaagtccaaaccagtccctcagcttggagagcaaccaaactaggagatcgagccgttggtgaccggtgaagattttggaatacaagactttattaatgacaccgggctaactacggatcaattgctaggagacgcaccaatcgaaaaggcggaagtgaaatacatgtacgaactcggtaaaccgcttgtcaagcctgagctgttgcagtccctacccacacaaatgtacaagttccatcagctgtatatggagatgagcgccaccggtagagagatgatcggagcgaggatcagggacacggacttcttgcaaggagatgacattctctggatcaatttcaagggaatctacgaactataccagctggacgccctcgacgtctctattatgagttgctggattttgtaagtatattgttcggttagacttcttactacatctcctttaattaattaggtccttctatataagtagactatatataatatatactcccttttatcgttgtagaatggagattcaaagggcccgatggcgggggttttcgatactggattcattgacccccggaaagtaaacgtcgcaatgctcgaccaatatccgcaagccacagaggacaatctcgtccatctcctgaaggcgcagcattacaagacgttcatactgttgccgtacaacacagagttagtttaattttactgtcttcctataccaaatttcattcccgtacgaacatgctaagtgtttcatatgtaatgcatcccacgcacattgcagattccactgggtgcttttactcttcgacttggaggcctgcaccgtcaacgtatatgactcaatggataaaaaagagtctacgtttgataaggttttcgaacttatagacaggtactgtcataagttcctatgttaattaagaatcttgttatagttaattgctactacgaatcatagctttaaactccatatagggcttggtatcggttccgtcatttggtccgcggcaaatggagagaaagacttaggcggaagttcaaatttcctgtgattacacatgctctacatttatatttctccgattcaaatacatacaagtgtatattaattagatctctcgtcatttatttatagtgcgtaaagcaaaagcagggaactaacttgtgcggctactacgtgtgcgagtattgccactgccttgcagaccaaatcatcaccacaagagagctcgatgtacgtacaaataaattcaaaatttcattacgtatcgatttgttgtttaattactaatcaatttcatacattcatatagtttattcgcatgagggataacctgatcacacacaaggaatttatcgcggtggttcaagaacaacttatgggattcatcaacgaacaaatccttgatcccaagggtgaattctactacgacggaaacacaattcataggtccttagcttctgagatagcgactactactacgtcgaaatcgtagctagctaggacatataatgaattataattaatacatgactatgtttctatatgcatgtgtacacattttctataatgtaaatatatattttagtcatatatatatatatatgcatttgcataacatatatatgtataaatacatatatattatgcatgtacatatgtattgaaacatatataaatataatataatatatatatacatatatatgtattgaaacatatatatatatatgtatggtttatatatatatatataaaccatgcagcaacagggccatgcaaacaaaaaaaagttagctcgatctaacaccaaccggtactaaagatggctcagtcgggcactggatgatcgccggacactggtcgattacgacatccaggagtccacgctccacctcgccgtccgcctccgcggcggcagccgcggccactatccctgcctcgctcccggcctcctcgccctcgcgcgcaagtacatcgagatgaagatgatctgccgcaagtatgcacacgcttccgatccgatcgatccaaaactcaagtggggttaattttgggagtacccctggttaatttgaacatgcatctatctagttcgctccgttcaaacaagacgcagtagctttgtgttgcaaattaagtaaactttgtctttgcatgattgcatcaacggtatgaaatgcgaaaggaaggaatctcaattggtgtgcatctcagctttctgatgattttgattcacagccgccttgtttgcatagttaattagtttcttgattagttgggtggattcttgatgggcataaatgatgaattaattagacgtgtacagttacattattattgagctagaagcctataacccttttgcggcaaatgtattatctgtctgtccttttaatcaacttgtttaactgtttgcctctatgagttttgaaagttttgtcatttgctagccatttacttaagcttgctttactgcttaacttagcaaatcagtcataatggactaaaatctttaggcacaaacttctgactttgccattcatggatgtgctgtctctttctttccctgaagaagctagataagttgttccgctactaacattttcttttcttgcaggtgctatgcacgccttccccccaggtctacaaactgccgcaagaagaagtgtggtcacagcaacaaggtgagccttgttatcaagctatcgaagtgttctttgtgtgggctttcgctgattgtcttattggccatggccgtcttaactgtatccatattcttggcttgagtcatcagtaatcctggcagcatccatgcatgttcttaattagcagcatttcaaccaatgtcttaatttatgcttgtttcagaactgtcattgcttggtatctataaatattcttattaagccatttaggcatcaatacttgcactttgacattatgttgtgtttttcacagttttgaacagtctgtatatagtaagtgtacacttggattcactaggtagatgatagtggatttaaggtgacaaacatgaattccttcattctttgatctgatgtattttacaacattcctgttttctttttcagctaaggcgtaagaaaaagttaaaggactactgaaccatgggaatggaaaagcgaacgaaacgatgatatatatacagctgctgtcagttgaatacttgaatgggatgtctttaagtcttaacatgatagaactaccgctgcggttagttgaatgagatgtcttagcatgatggaactgctgttattagtatcatactggagtttaacttcagccctagctagtttaacatttcctgctgggttatgaaccttgattacccgtttccatatgctaatggtggtttaattttgaagcatggcagttacatgctccagaaaccccggctgaaagttgctgaactttttttttatcacactatggatattactgcatcgtgatggttcggatagaaatgctagttgcagatgaacattgcaaatattaatcttctggatgcaatgttccctagctgtctactgtgtatcgactagaagtgatttttgagaagataccgagaggtgcgtaaaatttgatatattttggtaccactaatagaaggtatcaaatctacgctaaattaaaaaaattaatatctttttatgtgaatgaattttagtatattttatatttcgtcgtaggttgtttatgagtaattcaggacgaaggaagtaggtaagtgtgtatttagttcgcgaaaagaaaattgttgggtgtcacatcggacgtttgaccggatgtcggaaggggttttcggacatgaacgaaaaaactaatttcataactcgcctggaaattaccgtgagatgaatttattaagcctaattaatccatccttagcagatgtgggttaccgtagcacttatggctaatcatggactaattagtctcaaaagatttgtctcgcgattttcatacataattagttttttatctatatttaatactccatatatgtgtcaaagattcgatgtgacgtttttggaaaaaaaattgggaactaaacaaggacaagcatcacacgtttttgaaaattttttttggaactaaacaaggacgagcatcaccaacagtctacctatcttattcccaaaactgatttggagggattttagccaaaaaaaaaacagcttcaacggatcccctactatcctacccgagttttagagttcccttctcccgattccttgttcagtttgtatacggacactaaagttgctcccaatctcgccctcccgcctctctcctcccgttcccacgcgtgggagatagcgatctttctgagcgtgaaagaaaaaaaacggaattttctcctcccgttcctgcgcgtgggagatagcgatctttcggcgcatgaaagaaaaaaaatggaattttccgttggtagtttaacagaagggcccacttttaagttttggggattgaatttagactatctgttagaggaggagttttttcactttctattcttctatctactttatagttcaacaaatgctttcactcattctttcattcatcactcaactattcaaatcatctggtgaaaatccaacggtccaaatagatcactagcctcccacctccatcgaacgcgtcatcgcgctgcccctaatcgcctccctcaatcccgcgccgcatcctcctcccttcctctctctctctcgcctatcgcctcgcctcccccagacgccgccgccaccgtcgcctcccccagacgctgtcgcctcgcctcgcccgccctatcgagcccaccccctcccttcctcactctcgcgcctcgccggggggcgggactggcatcctcaccggcaatggcgatggctactcggccgccttctcctggtgaacagtgggggcccacctcgcgtttaggaagcccgtggtggtgctggtggtggtaccatcggcaggccctggaagcgttgtagaagcggtggtcgcttgccatgcctccggccgagctccacggcggtgcccatcatcccttcaatcgtgcccactctccagcatcaaagctccatcatcgcccccatcctcgccgcgttctccgcatcttttgctagacgcggcatgctctccacgaatccaccaatggcatgccttgcctcactggctcacttctgagtcatcgtcctgactatgccggctttgccctccatcttgttgagattttacaggttggttggcgaccttggaccttggtcatttcttttcttgattcttccctcatgttacatgtatatgtggttattcatgctttctgcacaacttttcttgattcttctatcatgttacatgtatctgtggttattcatgctttctgcagtctgcagatctctgatatccaaatacgatatgtccgcttcccacgatactaccaaatgttgctaatagtgatcagatttacatagtatgttatgcctggaaataaatagagaatgcactgatcaacttaaattcccggttttttgttacagaaaatatcttcttcatttgaatggagatgtgaccctgtatgctcttgcttcatgctagcagtgcatggcatgcatttgacattttttttaaagcgggcaattaatatatggatcctctaatctttagtaattttattggtttcttttcgagaataaaagagattgggcacactccaggactgattcacgcacatacggatttatgtggttgtctgtcctcgtaatggtaattctgtgcattgcactatcgcagttcttctttttcgaagccttttctaggtttccgttatcaaaagatatctaatttgcagaatatatactaggtggtggagattttatttccttcaggacatagatgttgcaagctattgcaaaagcttatgcctctaaacaatcatattcttgcagagtggaaatttaatctgggggtaaatcttgcatatttctttgtttcagcagcagttattacgctcacattttttctagcaatgttggttccatgtgcacaacttactattaactttcaatgtgacagttttaacatattcgatggcgctgaacgtaacatcccaaatcatgaattgctggtggccaggtgaagccacctaatggttctcaaatcttagttgtgatgtggcggtgatgagcaagcttggacaagagcccaaataagatatgacttaaagtggtgcaagttaatcaggacagcaaagacgcttagtcttatgaagaaatgtcacatatacaggaaaggatgagattggccaaaatgtttttttagtcttctgatttgcagatgcttgattggagttatcctgctcctgccacaaacaggaaatggtaagaactaagtagagtgtatactcacatgcatatatatcattgagttgggtgattctaaattaatatttggcacattgtagaaaatattggtttcaagctattttttttatcaagcatacatgacctaaaaggcatatggtttctatcgtaacggttgataactccatattgatctgttctttagaaattcatgaaatagacatttgcatgacatctggaatggttatcttctttgttgaatgttctttcaagaacttgcacctttttgtttaatcttgtaaatttgatgtgtaattgagcttgtagggtgagagaatcaagtgtgattgagcagatctatactctatgtactgagattgtgtagagtaaagacgatgtagtatttccttttataatacaatttgtcacgcttcatttatttttcttatggagcacatgttgatttcaatcattggaatttgttctacccttttggtatgaaatttctcttactgattaaatgatcttggtatgaaatttcccttttggtatggaatttgttatacctgtcctgatgtgatgtccactgctagagtcctactatttagcagaaaatcagtgagataattgatagtcccccttgaccataatggtgtatcaaatctgttctgggacaaggtaggcaacatggcatcaagccactccaaaggacaaaatgttgctttgtgacaagtgaataatacagccactttctggtatcgagtctaggttgcccattttttatttttcttgattttttttcatgttcttaaaaaaatgcttcaacagaaggatcatttgagattaagaaatgatcctttgaagatttttgtttttttgctgttaaagcctcatcatatatcttgctaattatgctatatgagcaatcatacaatcaattatttatgcaaagatgattaagtggaacattcaagattcaaagtggtatataatcaagtattcttgctgccattgcaagtatattaattagatcactgctggcaattggatgttgaaaatgcaataaaaatgttgaggcatggagatttatggtatttgacattatggcccatttgttttattggtcaatggcatgtgtcttgcccatcagcactgtaaatttgtaggttgcgaaaccaataaactaattagttgggctattttattagttactgaagtgtggaaaatgaactgcagatcacttttttttttcaggagagctgaacatcattttatagataagcataaatcttttttatgaaacaacactgaactattttatgttatgtgcaagtgcaacccccacaaagtgatttttttttaaaaaaatattttggttccaatatattaggtttaatttgtatgttgatcataacgtgcatcggtgtgcagaggctatactgctcaaaatggattttcttatcttccaaagaagcgcttaagctcaaaatgataagtcggtgaagtgcatattgtgttgttcaagaaacctggagcgtttgatctgcatatgtagctgttgagctcttttttttttgtcgaacctattgagcgcatatttcactctaaatggttttgggaactcatatgtgtggcatgactgttctgttatttccttcaattaagcctagcaagtacatgattaaaaagattgttcatattattcactgcatatttatttcatcaattcttttgtgctgtttctcctcaggagagaatgagttggtgtagatgcttctttcccttgtcattatgttttcttccctgaattcttttatctgctcttccatttcatgccatgttgatatcatccccatgtgatatggtgacaatgttttcagtattctgccattcacttgttaagatctagaagattaaggtatttttcgaatatctattcattggttgccttgtcccttgaacctcatagatgggaatcattatcaatctatcatcctaaatataaactactccttactgcgcatgatagccattctattttgagttttatagagccatgatacaatgtctgtaagagataagcgacggatacaccaccgccgccatctgtcaaggccttgagaggccgagaatattctctctcggtattacgaaccagctcagaaacatactctataatgtccattcaaaaacatactctgtaatttcagagaggagtaagtgccaatatagtggttttaattaacatccaaacaatatagatagaatgcgagcatgtgatacttctttgtttataacaattttgtgtatcaatcttttttgcgaatttatctcattctagacttggcaaaatatgttttctttcttacggttgttcgatatatatcattaaacattgccgtagcgttagcacgagcggattactagttttcagtttagaaaaaaatatttttttagagagagataatagataatctgttgctgatgctctaaatattgaaggagtctaacgagtctgacgggcgacggtcgacggcccagctccgtttcattcggtggagtcttcgccgtttggcgatagacggctgggccctctccggctctccgccaacctcgcttctccccgcgatgcgaccccgaatcccgccgccggccggggctcttgctccgctcccccctcgaccaggggcctcctcttaccttccgaggccgtgtgcatcccatcagatcccgacctcccgtgctccgcctgccgacgccggccagagtgctccaggagcaaaccaaccagaggccagagccactggcctgccagggaatggtaatacgccggctccggcctgagaagcgcatcctgttgatgaagaagaagaagaataggaagaatacaaggcaggtagtatgggtattgtcccatcttaaattttatattcagcctgcaacctagcattttgatctgtttcgcctccaaatgagacgattatcagcagtggtaggtagaggattattgtattacttgtgggaaaaccataatattaatggatgctactgttggtactggggagtgagaactcgcccagttggaactgcccacgatttcggcttcgtttcatgacaagagtaatcaaattgaccaaatgcaggccttccaggaatttgaagatgcagatatagttgaccttcacacggacgaccttgcaaccgcttctacctacctgaaatatgattgatgatagtagtttcttcctcagctgcacttcttccacctcctccaatctgcacttgtgcagcctgtgacgcctgagaatacatcaagtgaggctccatttcgtaactgctcgtcgctcgtccgtgcaggagcctattaacctacaggtaccaaaatcgaatttcttgtcagttctaatttcctcctctatttctactttacttttgccaaaacatgatatagtagagtgcccgacatgggatgcgtaggaaacgctcattcttgaagttgaaccgattttgaaacttaaaaggggactgttgctatttgaagaccctattatacatagcatagcgacaaccttctccaaacttgttactaacagactagcctcttaattctattcagaaatagcatatcaagatcatagaaaggagaagataaaaaaacgaagtccctttttttacatcaggaacctttctagtgttccattggcatccccatcactccgccaaaaagaactttatcaaatactagttccttgcagctagcagtatagagcactagtacgttatgagtaactataataaaattgtcatcctccaaactgtcacccttcaattattatcgttgattcagttttctggcagattcaagttccactagccccattcctgtgatgattgatcagattttgcacctccctctgcgtataattggttatttccttcatcttaatggccaatgtagttggtgttagggatcgttcttacacctttttccaaaagcaagaaaatttggttttaaaaaaacatggaaaatatttgccatgcacatacatataacatagggagaagaataaaaggggtaaaatcctaaaacataggccaactgggtgagcaatgtttatgcatataaagccttcattctttcatataaaatatttttctagatctgtactgctataaataatatttatcatatatatttatgtgacaactgctaaaattagctctgtcttgccacatttgtttcttcaaattaaaattgtctcatcttctattcgcaataaaactaaccagaaattttacacatgacttcctcagaaatcagaaaagtattccatgttttctttttttttggctttgcacattataaactacagaaaaaagatatatagtgatttcagtaatgcaccatcttcatgaatttgcaggcacaatataactatatcttctgttcactcttatgggagattggtatgaacaattttcacaatcttttaaggatgctgctaaggaaatgttggcaaaaacagatattgatccaaacgttaagtgcttcacaagaaagcagatgaagcgcatttcaaacaactacagaactatccttgggaaagggggcttttctgtggtgtacaagggtaggctcaatgatggccgtgcagtggcagtcaaaaaatataattggaaaacacagaaaaaggagttcacaaaagaggtaatcatacagtctcagtttagccataagaacattgttaggctattggggtgttgtgttgaggcagatgctccaatgttggtcactgagtttgtccccaatggtaacctttccaaccttctgcacagcaacagtagccagtttcctgtttcattagggacacgcttacagattgcactggatgtagcagaagcacttgtatatatgcattcctcccaaaatcatccaatccttcatggagatgtcaagccttcaaacattcttctgggtgacaaggatgtggcaaaactctgtgactttggaatatcaaggctgttatgtatggatagtgacgaatacacgggatttgttataggaagtagaggctatgtagatcctgtgttctgccagactgggcggttaagtctaaaaagcgatgtctacagttttggggttgttcttttagaactcatcaccaaaaagaaaggaattgatgacaagaaagtgtgccttgcagaaacttttgctcgcatcagtagaaaaggtaatggacacgaactatttgacatggacgttgtaacaaatgagaatatggagtttcttcaaggaattggcaggcttgcacttgaatgtataaagtttgaagtagaggagcggccagaaatgaaagaagttttagagcgcctttggagtctcaaaagatcccgagataggagaatccgtgagatgcaggttatggtacggagcgagattgaagtactttggagaagatgtggctttggtaggtttatgatctcgaaagagagaatggacgatatgacatactacttcaaaactgttctcaaggaatgtgcatcaggcaaggcttacatagggagattttgcaacgcacaactgctggtaataaagatgtcgatttcagttttagatcaatggaaaaacatagtctggaacgaattgaatgtccaatctagaattaagcactggaatgacgccaagcttctcggttactgcttagatctttgggaaggtctagtgcttgtatacgagtatggtgcgatgagcttgtatgatgttctttttcatgatgcaaggaaggtatctcccttcatttgtggcctgcgcctgaagattgcggttggcgctgcagagggccttgctcacttgcactcacttggcattgtgcatggcaatgtcagcactgtcaatatattgctggatgatctttcggtactcaaagtgattagccgcaattacccagtaaagattgcaggctatggaacatcagggctccctgacattgacaaggcacagcacacaggattcttcatggaggattcgcttgtaaccagtcatgggaaggagcatgacgtatactgtttcggtcttgttctcctaacgctcttcacatggaagaaggtgtcactgcaagaggcggataccgtgtttgagcagctctgggacattggaccgccacatgatgtgaattccgagcctgagaaacctgggcaacagctcaaggaagccatccttagatgccgtcatcttgaggaggttaagagcctggtttcacggtgtctgacgtccgaggtgacgaagagaccatccatggtggaagtagcaaaacatctcaagaacataaatgatttacatgatagcacagcttgccatgagctggcgatttatcaatctcgaatgctttcgggctaggctaggctgcaagtagcagtcgtacatggttcttctttgagtaaattaaggtgccgtagtagatgctataatgcaagcgccaagcaacatattacatatgtgtattttatatcccgacaaagaaaaaaagacatgtgtattgcatatattttgtaacagcaacggatgtttgtcatgttgattctcgtggcgctgctgccatataatgttgattgacagatccttggggaaccaacggatgaactaatggacctctcggcatcctttgccaatgactcttgcttcttctgaggtttggtggctctttcttgtttctaattcttattcagtgcatttgcctacatctggccctttggcctttctttcttgtggccgattttgctcgatctttattttttgtgtaacagaagaaatttactacggctcatttgctccagtgcatgcaggtccttgtggccctttggatggtactgtttcttgtatttatgtatttgtgaaaatttccagttttaacctctcttgtggccttgtgggctccaggtggaagtgtgtctggggtaaaaaaatcttttgaaaggttttgccttaaaagagtttccaaagttcatttccatatgtggagggatgatggtcctgattgtaaatttgtaattatacacataataatttgctatccttacgatgacaccattgctagggccggtcctgacattttggaggccctaggcgaactgcgaacttacactatgagcccttaagaaattaatgattttttttacttctaatatatatactctatataaagcacattgatttatcatagagtgacacagataaacatttctaacatgataaattataaataaagcagtttgcaaattgcaacagagcaatttattctcgatagataatatcgatagtataattgacaactaaaaaaacaccatagaaataaattaatatgaataccttaataggagaccacaaatatctcatgtcccttataaaaaaaaaagagctttttcacacattttttgaagcgaaatcatcgatgacacaatgctacatatagccaagccattcaaactttcctgtgacatagttgaccaaaaattgatattctcgttttcttttgttttttttctaaacacccaacaaatatttcctaggtaacattattataacacctgaaatagtgaaattgcaaagtaaattatataacaataactatgaattgaaatgatagaggcatagccgtatagagccagttgggcagttggttcttgcactggtggagaaaggggctttactcccggttggggaccccctgtagtcccggttatacaaccgggactacgaatccgggactaaagatgggtatctttactcccgggtgaaatcttttttcttaaatcgatttgctccctaaatatccccgatcacattcccaaatcatccccaaatcaaagtagcatcacagatctaaaaagaaatacatcacatattgaaaagaaatgcatcacagatcataatacatcacatcacagaatcttaaacaaaaaatacatcacaaatcctaaaagaaatacatcacaactcccagatcagatccaatatcacgtacatcacagatcaaatccaatgaatcacaaattcaaaaaaaa

SEQ ID NO: 39138 - DNA, 26317 bp, Oryza sativa
  unsure (1)..(26317): unsure at all n locations
tataccaaccgggagtaaaaataattggggtctgtcttgaaccccatgacttattgaaccgggattaaaaatgatctaacaccaaccgggactaaagatcaaaaagtacccctcaacttttaaaccgggactaaagatgctttttagtcccggtttttattagaaccgggactattgtggaatttggctgaccgaccaaagatggtttctccaccagtattggttgacttctagttctgcgacataccttcagttcaggagcgcctgagaggagaggcgatgacgatcagtcgatcacaggaatcaaaatcaggcgggcggcaggcagccaggcaccaccgcacccaccatgggccaccagccaccaggcaggcaagcagccatgccgcctccttaggcgggtcggcgatggcaatcagctgattaggcgcactggcgctagagcctagaggtggcaactgcggcatggcgcactctcggctttcgcggtcgcggattagggcattggcgattcggcgacgaaccgacacggctcgatcttgggtctcgcgagtcatggtgtggacgacagacaaagcgacgcgcctctggctcctgctgatgatcgatcgcacgcgcgactgggttactaggctacggctgggctaggagaaaggaggggggggtactccatcctctttagccgatgtcgtatgtcgacatctgcgcgacgacgaggatgacctggagccatcagcggcgcggattggggctgcggtggtgcggagcgtcggcgatgtatggagcaggcaggatgagacgacggcagggggcggcggtcgaggggggcgcgggtataggggaaggctctatgagggaggagggggagtcggtggcggcgggtgacggattggggtggcgccgtttttttttgttgcggaggaatcgtgtgcgcttttttttcggaagaggagttcgtcgctctcaacgtgtcgatgtacgtcgcatgtctaccttggcttcaccatcaccacgtagtagagataactgtgccatgtgtaattgtattgtaaacatatgaaatttccggtgtattaaattagagcccacagctgttcattattttctgatgaaattacacccgtactgggccgagtcgcgcatcccccgagtcccgagtcgcggtcgcgcatcgcctctacgcgagggtgcaaagacagaaggagggatgactgaggcagcggcggtggcagtggtgccggctgcctcctctctcgcgactagggcgccaggcggaggtttgggcggcgccggctggaggtttggacggctgagggctcacggcggcacttggcagtgggagcggctccccacagccacggaggcgcacggcggcgccgcatagaagatctggtgcaaggtaacccaaaccctagactctctccctcaaaccctagacatctcaaatctggttcattttttgggattgattgcctggatgctggttaaaatttccgatatctgtgtctattattgcttgattttttctgtatacttcaaccacattatcactgtacttgccaacttagatttctagaaagatttggtcagcaaaatttagtaccaacttagattggatacttgtactatcgatccatagatatagtttacatgagatgtacaccaaaccaacttgtgaaacaacaaagaaaaccaactgtaacatcgaggaaaaaaatactattcaacacctttgagacgacagagggtgaggtgcacacctttaataaggcaatgcacctcatgtgtaagcctgccagtggggcgggtttgatttggtgaaatgggctggatgctgatttggatggtagtggttggattaattttgaattggagcgggttggcctgtgaagaattgtggtttggactggagtggatgcgggatggcctgtgaggacaatccatggactcagcccatgggttagccagtgcacctgtgcactgcgtgccgccacgcgcggcgcagagcgctgtcaccgccgagcgccaccaccgctgagcaccgttcaccgccaccgccgagcgccgtcaccgccgttcgccgccaccatcgccggactcactccccggtctgcgaggaggcagccgagaggaaggtcgttttaggcctcgtcaagaagagggatcgggcaggcacagtcgcttggcatcccgctctccaccctcgacgaccacctgcgcatcgacctcgccatcgacagcgctgaggttttgaccttttctttcacttctttttgattaattcagttccatgctgattgtttgtcctgcaatcccttctacctttgctaacttccctcgcgagaaaaaaaaagttgtagctttatggagaaagtaggacaaaaaaaaagaaaacttatatggttgtggctaaggaacttaaattggcagctcatgcaggaggtcacgttccagattatgaaggagagaacagtcttagttgtcagttcttgattatgctgttagtggcatgaacttcagtggtagtcaaccatgcaaaaaatttgcccccattgtactcctggatggttggaggacaatctgtcttttttttttttgtcatgcagattagctagtagcattcgagagggtctatctttgtcattttctttttctgctgtgtagatttgcatctgaaaagtggataatttagcaatatgtctctctgttgtaaaggggtggataggaactagtaccaagtaaataatttaatatgatgctttaattgtaatgataaatccagcaagattataccatgatttgcaaatattaatcattcccatctgtaatatatgtcattagtaaaaggaaacttaggcgtatgttggtccaaagtgtcatatattgataactagagctttatgttggatctgaatgactatctcctaaatcattgccaggtctggtagtatgagtgttaatttcatatatgcaaagaaccatattgccagaagcaaaattgttcccgccaacactccgaccacataaaaattcatgaagtatttttgtggaacagtaaacttctgcagattggaaaagatcaattcgagattatcagaaaaatacagaagttgaatatgagatgaactacaccattagggatcctcaattttctggaatggtatcttagcatggatgaaatattttatcatcagctcttcagttttttttaggatcaaacatgaaattttccacgggttgtttcctaactgttgctacctatttctaacttcacaatcaactagtggacaagattcacaaaatatggtttatgagatggctggttcctgattttctagttgatgataacattaatccacaatatttacactgtgctttttgaagaccatctatcatgataagcttttgctcaaaatgttccctcacttttgctattttacatgtttgagatttgtgaagacaattcatggctagagctattagcagatgaagtttcagaattatgcatagacatgcttacatttactacttgtgctaaaaactagtgaaatgataagcacaatgcaaccatgacaatatcatgtagtacagtataaacagagataagtgtgaaaagtaataagattagtgataatcaacagagttaatagaccaaatggtgtagatgaacttgcataataatccaaatatccagtaatagctttgataatccaataatcaacagagatttgaattatttatatttttattagcaactttcaaactgtaagtgttgattttagtcgaattgtgatgctatgagatataatctattatattattaaaggaatagaaaaaggagcctccacgttcgctctcatagcctagaaattctcacattagtcggagaaaaagaaaaacagagtccatatagaaatacaatttagaaatagctaaattcggaattaaaaaataaggaatattaaaagaggagactagagtccatatagaaatacaatttagaaatagttgaaattcggaattaaaaaataaggaatattagaagaggagactagagtccatatagaaatacaattagaaaataactgaaattcagaattaaaaataaggaatattagaagtagagtataaaaataaggaatattagaagtagagtatagagttcatatagaaatacaattaggaaataatagaaatttagaattaaaaataaggaatattagaagaggagactagagtccatatagaaatacaatttagaaatagttgaaattcgaaattaaaaataaggaatattagaagaggagattagagtccatatagaaatacaattaggaaataactgaaattcggaattaaaaataaggaatataagaagtagagtatagaatccatatagaaatacaattaggaaataatagaaattcggaattaaaaataaggaatattagaagtagagtatagagtccatatagaaatacaatttggaaataattgaaattcggaattaaaaataaggaatattagaattagagtatagagtccatatagaaatacaatttagaaataatagaaatttagaattaaaaataaggaatattaaaagtagagtatagagtttatatagaaatataattaggaaatagttgaaattcggaattaaaaataaggaatattaggagtagagtatagagtccatataggaatttaaaactaactaaaattcggaataaacataataaaattaaaagtagagtttagagtccgtataaaaatacaatttacaaataactaaaatttgaaattaagaaaaacatgggaagaagagtttaaagtcaatataggaatacaatttagaagtaactaaaattcaaaattaaaaattaaagaatattgaaagatgagtttagagtccacatagaaatataattagaaataataaaaatttagaaataaaaataaataatattggaaaaagagcctagagtctatatagaaatacaatttacagaaaattcgaaattaaaaaaaaattaaagacgagtctagagtccatataggaatatatataatttacaaataactaaaatttgatattaaaaataattaataaataacacgtatataaaatacaatatcaatattacacattggtagtattggtagttttgtaatgttattgtgaaatttaaagttatgttgtcaatttaatatattttagtaatataatgagaaaacatatatgctactatatgagataaaatataatgatgttagccgcacaatctgcgcgggccaccatgctagttgctttattatgtcataatccgagcaaattttgtgggctcacggtgttataaaatttttgaacatgaagtaggaacacccaacaagaaattcgttataaaatttttgaacatgaagtaggaacacccaaaaagaaattcctggagttgccattgcggcgtcgccttccatggagagcgagggctggcctgccctccagcctctgctgtgcttcgcctggatcgccgccacactccccatcattgccgctgcgctgccaatccccacggccgttggaggtcacctccttcgccggctgctctcggccttctcctcccgcggcaagaccgtgaggccctcccccgcctcatcctctggttcctcctcttctaaggcggtaagatcggttcaaggtgccgcaacacctatttgctgcttcgccttttctgttctcattggactatcgcatggagttcgtatgattccttggtaaacgtaacttggttagaccttcttaagttaaacggaacttgttcaaagcaaatataagtttgggttgtttaagtccaaagtagctagctactgttttgtagtgtttagttgatgcaaatctgaaatactatcgattgatcttgagaagatgataacattttgaagaaattcgttcttaatcgttggggaaccactcccgagttctggacttaaaacaaattttttaattggtgtttgtcgacatgatacagtcagtttttctgtcaacttgaacattcagttatgctaacttagctatacaaaaaatacataccaagccagttttgtgagtagaaactaacattatatagtaggatcgaattgattcctcatcggtttttcttgagcaattgttcatccaattgatgatcaattgcacatgagaacactcaccaaatctgtagttcatctcatattcaacttatgtataattctgataatctcaaattgatcttttccaatctgcagaagttcactgttccacaaaaatacttcatgcatttttatgtggtcggagtgctggcgacaacaattttgcttctggcaatatggttctatgcatatatgaaattgacaccattattgcttgagtcatcaagttattccacaattttcagtcatcttgtaggctcaaattcattctcttttggtcgtgttcgctcgcgcaccatgggacacaagtatcgtgtctggcgaacagtatttgcacttctattgatggaagttcaagtgctgagacgactatatgagactgaacatgtgttccactacagtcctgctcggatgcatattgtaggatatttgacaggtctattgtaagctccatcttgttttatatcttttatgttctagatctccatggcacatttgttgtgaaaaatagcccacttgagtagttatcatgtcctttactttattctgttgttatgttacatgattatgcttaaaggtttataaataattcttgtatgcagtttctgcagctcatacatgtaggttgtccacaaaatatacacccgtctaatgagttaatttactgcatgatttttcattgacctgaactaataaaaagaaataccacttcgttagaaaatagcccaagtgatgctgataactacactgttcaattcttgacattttatttgctttcttctgccacagtgcttatattaggaagaggatatgcattcatgctaccgatgataattttttcatattattgttgttgtacttttgttttcatgtataacattttcagattgacttatagtttggtttttcttcatgccagctactatgtagctgcaccattatctctcgctagctcttgtattcctgaagcagcagagtattttcaaggtcaagtacctgagttcgtagtaaagggtcgtgcgagaatgccagatctagtaattgattcatcatctctactacagcctcttctaaagttggggtggacccagtggataggtgctgttatattcatttggggttccctccatcagatccgttgccatgcaattcttgtaagtatctgctctctaatgtccctagatatactagcaagtttttttttacatatatcggcagcatcagaaatcttcctaaggaagaaaaagaaaagaatgaaataaatccacccatatgctgtaagttggaactgtcaaactgcaactgcaaccataacttgttagtgtaaagctgaaggtatggcttgctggaactgttctattttttgagagggtggagcccatcaggcttaaggaaccccatttacacaaattgcttggtcaatcaacatcaggaatcttccatgaaatgccaatcatatttaatgggttatgcatgtttttctgtttctgtatgtcagaaactgtggtattattcatcgttgtcttggaaacttctaggctgcggttaatattttgaatttcatggtttattttttattgcttttacagggatcgttgcgtgaacacaaagattatgatgaatatgtaattccttgtggtgactgctttaatcgggtctcttgtcctcattaccttgctgaactagtgagtgtttttcctatgtcctcattttcagtatgtggcatatactgttttgcaaaatatggcaggtcttgttactctgcttatttaacaacgtcaagttagattaggcctatcaatattttcttgggtttgtcaataaaaatcatcttgggaaagtttggacggattccaattggtggaagcactggactgagtgtctgagtagcttctggtccagcttcaactcctggctggaataggttgggggagaagcagagaacttgtatgttgcttttgctgggatttagagttttacacggaagctgaattccagtgcagacttctcatcaaatttgttctgttacccatttcatcaccgtagttctctgagtgcagtaccatctgagagtgaatatgtccttttagtatcacccgtactgacatatgcgaacattctttgcatggcttaaagatgataaaactggataatatcttttgagttttcatattatctcacttgtgtgaagtaactagatgattctaacatgacagcacatatgtttccgtgtagcagaattggtgctttttgacttgacagttgatgcagtagggcactgagctactaaaagagctcctgtggttttaaattattatggcattaacatttacagttactttggcttgtaggtaatatattttggcatgttggttgctagtggtgcagaagacattccagtgtggttcctgttcatatttgtggtacgccgtacagtaactttttgaacaaagatactcagaatccaactaacgtgcaattatcatctacatttagtttcttttgtttttgttccagtagattgaactatcttttttcttttttcatttttgcagatcacgaacctgtcatttgcagcagtagaaacttacaattggtatcttcaaaagtttgaagactatcctcgctctcgctatgctatcattccatttgtatgctagtgtctacgaaatggctacattatgtaaagcttatgtatttgcacacaattacgacatgtaacttagcttgatgtaaatgtgataacaatcatacaacgtactaccgtagaggctggaagtttaatatcagagcacctatgtacgttgccagtagtaatctttgtgcttctacagatttaaattacatgccaattatgtcatcgatgaaacatgtttggcattttaaacttaaatgttctgcaactcaaagtgatctagggtatgttgtgctcgtcctttgtataaggaaaaaagtgccgtcatgtttagagacccaaatacctgatctggtctggaaaacggaagacttctggatttatcagagcgataccatttgaactttaagctttaggcagatgagttgctataattttctcaaccaaccacaagtttaatacagtgacaaggtcatcatcctctaaagtagcacgccgtcaaagcaaattaacagaaggatagcctactaaaagaagaagctgagctgatgaaagtgagcaagaggtgccagccaccaaccctcacacctggccggtatatgggggtgagaggcgtttagttagaaagcacatccactgatccgcgagaggggacatgctccttgtcttttctcggctaatcctccctcgtggacatgtattcaatcacattgccgactcggatcttcttttgaagggagagcgctacggtcggacatacggcgtgagacgaaaaatcggacgcaccatgagccgtctgatccgcacacacgctatcaagnccacccgacgtcatcaagcattcatacatgcaaaactattttaaactattattttaaaaaatatttatccaaatcatgattcgattgcactattaaattcgttgcaattaaatctttaaaataagaccacacatggatatattccgatgaaaaaaatagcttattattgattttttttttaaatgttgcatgttattccaccaagtatattggaattttttcactagttagatcgaaaatgtttcaatcgtttaaatcgagcattgtttcaccttatatgaaaacaatgttttagaaaatagcgaaagaatgtttcaagtcaccacaacatttgatccatataaagtaaaacattataagtacactaggtgaaatattttttgtggaacaaagaatgaaatgaattatcttaatagagagattccataatatgtggttgatttattgcaaaagaatttttcaattcgctgcaacattagatctatacatagtgaaacattgtaagtacactaggtgaaacatttttagtggaacattgtaaatacttattgaaacacttaaccaatacatatgcaacatttacaaataaactagtgaaacacaataaactacttactgaaacatacaaatagcaccatgagatacattaaagaaaagatatatacattgtgacaataataaatatgtgcaacataatagaattttagctgaaacatctgattctcacatatgaaacattaagtttaattggttgaaacatatgtgtgtgtttttattataatatagttatgtgagatcttgttgtaaagatttaattataacgaatacaatggtgtaatcggattgtagattggatgagtaatctagaagaaaaatcgttttcaaatttgctaaaagggtgttatgtacatgcaaataacctcgtgtcatctctcctttatgcatattaatgctcagaaaggaagcatatgtaacagatagaggatctgacaaaggctgtatgcggcaaaatcataataagaggtgtccgatttttttctcaagatcgaacgatcggattgaagcattttccttcttttaagtgttgtttactacagctcttactagtataatccttgttcttttgcacggctaaaacactagctcagactactcaacgacagacaccatcagagctgaactttccctggttcaggtgttgggatatggaattagaatctatccgtggaactcagaaaaagaaatttgcaattgccactgttttatcagcgagttgctagtgcttgttcgtttgctcgctgcactatttactttataggagcgtggtgacgttgcaggagttggtgccggaaatccgttaactgaaactaatgagataaactcagaactgatagtgaaatgccgatacagtagagtaggcgcctgaaaactgacgaacataaggcataattggaatccgacgtttctcaaggttcgttcgtcaaaattttcagcttcgatttccaacgtcactgaattggatgccaccgtgtgtatagcctaaacatctcatttttaatgagagaagagatcaaattcggcatcgatcaattcgatggtttcttgatggtcctacgatgagaagttgagaacgatgtgtgtgtgatgtgagagccagtccaacctctgccgttttggacggctttgccacgggcagcggacaataagcgaaaacgcgacccaaaccttctttcggcagctgcctctcgtcgtcgttttcccgctcattttctgcatttcggctgggacttggagtcgttttcttctacccatgaggacacgcgaggtctccgctcggagtgtgtgacagtgtgagactcatccaagagcaacaatggtgtgatttctcttacgctttgtacatccacaagttgacatttattgttttttttcgctctccatatttcttcacgattcaatcaatctgccatggtgaggtcatggactaactcaccaaccatgagtccatgacctcaccgccattattcagtttctgtgtattgggcttcttgtttaagaatttgagatgcgtccttgatgctttgtgatgaatagtggaaacttggatctaggaatgcttaattattttcagattattcacctgattatttgcacaatgttggaaaaaataacattttggggacaaaaaaacattcttctattgtatacttagaccacttattttaaattatttattaatgttgtcgaatgacaactgtgtccgtcgaagaacgtggttcgctcttggtggaaataaagcagaaaattaatatttttattgaaattgttgggatcctcccattacatgccctatggggcctatttttaggcttagtacatgcccctgcacgctagggttactaagtagagagaaatttatatggctacccttatgatagtaacatttatgagggtaattatagacaatatgaccttgggcccttatatgggccactaaatgggcctcatagggccattcggcctgcttggttattgaggctacagcttcgggggcgaaagggctcggccctgtggtgaaggcctcaggcttcgcctagcgcttcaccctgaagtccttgtctttgcgatcctcggatctctaccgcatgtggtacgccttggtggttgtggatggcgtttcggtgacatggtcgaaggtcctcatggcatgcctgcaacaagcccttcacgggtaaggatgagtagtgagcttcggtcgagaccgtgtaaagccccgggtatggcatgaggcgccccctttcggccaatattcccgtcgaaacctatctacttttgagaaaaaaaaagtcataagtgaaaaaatctatttccttttgtcgacgtttgatgtcgcgattccggtatttgcatagtatggggatcgttggtactaggatatacacgagactggggtaaaagagatggagacagcgatttttatacaggttcgggcccctgcattgtcaggtaataaccctatatcctgttggtcgaagccggttgttgctcttattcatcataatcacaccagtacaatatttggggtagcctatctaactgttgtcgacatggcggtctgaaggtctgactcgtagtcgacaacagggtagctttcctcctcgagtccgcatccggcgagatcagagacaacgctatatctctcctgacggtatccgtaggcaccgtaggggactagctatgcctatctctgaagtcgatatctggcgtcttgtcttggcgtatgttggcttgtatgttgtggcttctgttgttccgtgtcccctctcctcctagggagccttatatttatacccataggtgtccccttgtccaagtagaactagggaaaccaatatagatacaatccgagtagtccttgtcgtttccatgtagaactctattcatccttccttatgcagaactcttcctatatccgaaagttgtttccgtataagatatggtatgtggtgagtcctgccgagatttagtcaactactattaggtatgtggtatccataaccctgacacctttccatttatgggctctttggtggtccatttttgccttgggagctaacggttcgcattcggccttttactgtgtcatttgcccctttttattgtgcggcccacgggctatcttcgcgcagatagccgttggttcaagggatgcatgccacacatcgcacatccatcggtttggcactcaacggtcgcgagggcggaggagtataaatccaacctccccctttcccccggaggcttacctcagttttttaccgcagcacttttctcctcaattcctgcttcttgcgctcacgcgttccaggaagacagctattcacccagttcccctttcacctttgtagcttcgccacttctcaagccgaaatggctcctaggaagactgcttcggccgcgacaaccgggcccgatctcggagcgatgccggatgacttgtccagcttcttgggcaagttgtttgtcaaggagggtgatctgggcgaacttgtcgcctctggggcagtcgtcgaagggcaagctttccttagcgcgagaaaaatataattatgaatagtgtacattgttattagaagatggttgttccactaaaatgctacatgagacaattttcactgtgcgcgtgatcgacagtttagcaccgttgttatgagaagacagttccactaaaatgagacgtggcatttttcactgtgctcgcgatcgacagtttagcaccgtcacgtacccctatttgaggggtggctcggctctttctcctccatatagctaattcagccttagacacatggtctgaccgcagtgtattgtcctgtctgaccggccacacaatggcggtcagactggcctttgcggtaaatgtcctcccaacggtgacacaccttctcagacaaacagagatggcttgttttccttcaactatctgccatgcatgtatgtctctaggatcatagaaatcaaaaggatgctcaccggagaggaaggaatcggccacggcggcatttagccggagttggagaagacgaaggcaatctccatctccggtggacgaatattgggaaatcttgaggtattttggagaggacctcgaggggaagctggtggcgcgacgactcatcttggcgtggtccagatccacggcgctcggtgcatgcactggagctcccgtgggcatggcggcgttcccgtcgttgcagtggatgaaatgaggtggtgtcaaaagggaacttgttcggcatgaagggtagaatatggaatgggaaagagttggtgatggagatggctcgacgacgggtggctgcctccttcttcttcacggccggcaacgaagaagagatggaagtgggaagctagagctacatatatctcttggtttttcagcttagagatggagaatgaagtgtggcgacgtgatctggaggagtagagcgaaaagtctaatgggcgatcgatcgcctcgaacgatcacccccctcctccacatggtttcctttttaggcaccgcattactttcctattttagtaaatttatgcgcctaaagtttgtacacctcaagtttacatatctaaagtttatacacctaaagtttagagacccaaagtttataagtcaaaagtttatatatccgattcaaatttaaatttgaattcaaatattttttatatatagtattttctatacatccaaagtttatagacccaaagtttataagtcaaaagtttatatacccaattcaaatttgaatttgaattcaaatatttttttatatagtatttctatacacctaaagtttagagacccaaagtttataagtcaaaagtttatatatccgattcaaagttgaatttgaattcaaatatttttttatatatagtattttctacacatctaaagtctatagacccaaagtttataagtcaaaagtttatataaccgattcaaatttgaatttgaattcaaatattttttatatatagtgtttctacacataaatttttctaactttgttttttatttttttaaatttatggtgtagtaataagagaagaaggggaggaggaagggggagaggagcgaaaagtctaatgggcgatcgatcgccccgagcgatcacccccctcctccacgtggttttccttttttggcaccgcattactttcctattttagtaaatttatgcacctaaagtttgtacacctcaaatttacacatctaaagtttatacacctaaagtttagagacccaaagtttatatatccgattcaaatttgaatttgaattcaaatattttttatatatagtattttatatacatctaaagtttatagacccaaagtttattattcaaaagtttatatacccaattcaaatttgaatttgaattcaaatattttttataatagaaaaaatgcccatgcgttgcaacgggtgaaggttattttaactttattattgttatacgatttagttaaggtgaaattcattgtgagaattcgcttggatatatatattttcccacgaaattatgagctataattaggagtccgatcatcttgtcgacggtgagtaaccgtagaccggatatagagggtattggggtacgctggtacgaggatctacgtagtacgacatcaaggaaacaagagagaaagattataatggtttaggccccttagtaggtaatagccctaatctagttgatatgggattatatggaaataaccacagattacaaagggaatagtagaactcggtggtaccgacgagattgtagtcgagttaattagactagaccacccggcgacttggctcctatagtcttcggcttcgtaggctgtggtcgtcgtgtagcctatgagattcgatcccttaggtccccgcggggggtcccttttatatcgcaggtcaggcggtctccaagtaggactcggaggcatcggaccctgcacaatatagtaacgacccagtcctatacgggtaggaacctttccattgacagactttgtgatggacttccttagcgtattcagaggacgtccgtatatgcaccgacataccgtattgccgtatagcatacgtccaagggtagagggtataccttatccgtaaccctgacaatagcccccgacttctacttaaatgaactcatgtaaccaatcgcgacttctgatgtcggaattgttgtcgttctcaactggtcgatctcggtgtgaggaccgtagagacaaagagtgttcgacaacaccatgcgaagtccaacggttatgagtaaatttaaattaaagtccaagaaaccgcctgacgcaacggacccagaaatttccggtggccatctctctcctttccttggaattcgcaccgtcggtagtgcgcctatttaagggagttttgggaatccattttggagtccggctgttgcgagaaactttcaagccttcaggagctcttcgtcttctccgcttctgcacaaaccctagcttgttcctctcagccccttctccggtgatcttcgacggggatggagctcgacaagtccacttctaccagcgcgtcgctgaagaagttgcaggaggaaggcgctctccccggtcgcaggaccatggagagggaaccaggaggtattgaacctaaacctgtcctgggccgcatggttgcagttgaggactatattctctgtggtttccttcctcctccctctgagtttcttcttttggtcttgaatttctacggtctttctctgctccatttgaaccccagctctatcgccttcctcagtatcttttctcatctttgtgaggcctatattggggttgacggagctcgtggctcctcaccgggagaccgcgcaggcccccctttgccagttcggccgggggcttagggtgaaatctcaagctctcgctctctctgtatgtggaaatatcgtatgcccgccagaaaacacgagacaccgacgatctatacaggttcgggccgctgagaagcgtaataccctactcctgtgttttggtggatctgcgtatgaatgagctacaagtgtgagctgacttctcccccgttctaagctcatcatctgggaaagaatcaaccaaccccctctctatgggcaaggtcctccttttatacttcaaggggataccacatgcacccttctctttccaaactggactgttctttttctcttgaatgggcggagatcagcacggttgctgtccgaatgacgctccgatgggacagcccacacctacctccacttccgccgggggtgagcgcgtcgtgggaacatggctgtgcgctgacgatatggtcagtgtcagaccggtcacaaatcggtcattcttgtccaccgcgtgtaaacttggcaacgtgcatgtttgcccttcttcacacaacatcttgcctgtaatggttaagatgaagcctggcatatatcgaccgggtctaacgtgtcatctctaagggataacacgcttaacgccggcttgagacgagtgactagaggctttcgtcttgacgggatggggcatggcgtgcgtcagaccgccagtcgccacctaacccgtgatctgaccggtctgtgactggtcacagaccggataaagggacgcgccgtgctgcactgcatgcagcgtgacacgcttgaccagactgcaataaatgctgttaggtgagcacagctgtgctcacttatcccatatacgtggcgcagacttcctaaaggggtcggggtgcctcggccctcggggccggggcaagcgcaacccgacccccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacaggggtagagccgtttcttgacctctttcgcttctactatgagttgcgttggatggaatccaacagggtgtcaggatgcgttggttttcgacttagggatggcctgaagtcgcgctatatccccttccagtgcccctcttctcgtagtaaatggcgggtgaggtggttagaaaattcggatccggtcttggttgttcccgaggagcaaccgaacaatatttcgtcttggactgccaagcccgccttgaccccctcccttcagtctttcatcgatgtcatcgatgacctccgagtgcgagggttgtcggggtatgaagtcgctgctgacttcatcggtagacggatccagccgctctaggctcgagcccatctagcctttgactactcagggccggaggatgcgacccgggtttctcctcagggtatttttctcgtattctgggttccattccttaagtatatgttccccctgacttatcaattttggttctcgatctataggtttgaacagcgaaactgtagagcgccgcgttggtcaagtgatgatcagcggccctacaacggcgagcaacgtccctgttgctctttgcgagaagggggcagccgaacgcgaagccaccatcaatgtaagtgtactcagcggcccttttgcatttttctttcgggatcgcattgtgacttcatgaagcgtatgctctccctctgactgatattatcgggccactcgtggaccatcaggcggcggcgtggctgaaggagaacgtcgccaaggaggtgtctgatgttgctgctgctgctgccacaacgagtggcggcaacatcccgagaagggggaggaaattctcctccgtgatcggaaatcgtcggaaaacgcccaccccctcgataagctctcctggtcgttcatcgcgtagtcggaaagcttccacctcacatcatgcccgttatactccaggcctcggatgcgtctccccgcctccgcgacggcagcggcttgtgacgcttggcgagaagtaagtggatgaacttgaggttttgtcgcttcgttgagctcttgcagcctgtctcaattgcagcctttcacagggcggcgcgggcgaaggcggcataagacggatctggagggacttccagcgcgtctcctgccgtgtcctcgactgatgtcgtggtcgtgcccaggagccgcgaggcgacgcccagcggcccagtcagcgatctcgcggctggtcggggtccgccggctgtcgtcctcacctaggaggagctccaggtcaagatggggcgcctcctcgaggctggtgctcgcggcattagccacgagatcgtaaaggcgagggcggcggcggcgtcgtcggcgaacgagcgcgccgaccggctgacgcatgatttggcggaggtttgcaaggacctccagaagatgagggaattggtggccggcaacgagcgacaacggcaggggctcgagcaccgtatgtcggagctcgagaacaacttgttggaaatctgtggctcgctgcgggtcacctacactggtctgcaccagctcgccggggagtgcggtgtcaagaccaccatccctgcgaatcccaatgaattctcgctgatgacttcgcttgcggaactggcgacggcgatggaggcgatcccctccaagcacgcggccaggatcgaagaggagatgtctaacgggatttataccggggcgtgccatgtccttgcgtgtgtgaggctggcgcatcctgaactcgatcttcggaagatcctggatcagggggtggctagcgacgcgcgcaaggatgtgatggaggaagtcagagacctgggggagtctgtcctccccctttttgaagagtaggaccgccgcttgtttgtaccccttaaccaatcgtgctttgtaaaacttttcgttggttccaactgcttttgtgtgtgcaattgttgccttagttttctttggcattttgattccaggtactttgtctgttgtttgtagagatgtcggtgtcgagaatgtccagcagcgcgggcagcctgaattgcttgaggttgcttcgacacttgagctcgagccgtacatgccgcgggatggcatagaccaggatctgcccaaggagacggacgtggtgtcgacttctttaggttggctcttgtcggttccctttcctttacctcgtctgtcttgattgggttgacttagatgtttgcatgttgagcagacctcgagagtgtgcttgctgatcacgaccgtcgcatccagtattggaggacgaagtttgaggtcgccgaacttgagaggactatattggaggtgaagagggatcgggctgtggaggcgctccgaggtcgcgaggtatggttcaactcgtacctcaggagttgttgcataaccatggccgttgtctgcagagagctccgagtacctcgcggggatcccgaggagtcagcggctggctacatctcgtggctgaacggggcttgcgctcagcttgaaggcatcggcgggtgtatcgacgaggccctaaaacaggaatgtcgtccatcgagtcgatacgccggagggcacatactggcgtgtatacgagatcatcgtccgcagttgcacctcgagttccttcacgaagggttttcccgttctcggaggaaccctacggagatagacaacctagcgaagttgatggctccgctagctgagaaaatcttccattcaatggattggcattggccttcttggtagtgcctatatatctgtgacaaacatcttaagaaaaaagtaatgtattctggaattctttgcgatctgtaagaaatgcttgtgaaatagaaaggaaatctatctaactaagctttcttatgctgggtacggtgtgcacgagtgtcttctcacttcacgacttcgatcagtcacttgagttatacactctccctagcccccagccttgtcgtcggagaactcttctcggaagataaggctcttggactctcgaccatccttagttgaataagcactgatccttgcccccggccgtgaagttggaaaaatccatttccgattacacggcttggttaatacgcatggcgagaacacttacacgaccagatcttacatggtctttcgtctctgaaggatccgacaaggccttatcagctctgggcgtccccagccgaagttcccttaggttctttggaggccttgtcaagatggcgtaaagggacatgaggataggtttcaacgctaggtgtcgtctgggtaagggatcatcgggaaggggcactgtgattgaaatctgtgccttaaaacagactttattgaagttgtaagatgtcttacaaatgtggacactattgacttatacataaaatttatgcaattggtcaatgttccatgaatttgctagctcacgaccatcgccgtccgcaatcttgaatgagcctggccgcaagacttgtgtgatcgtgtacggtccttcccatttgggtgagagtttgtttcgccctgcctggctttgaactcgtcggaggacgtaatcgccgatcgaaagtatgcgtgctcggatgcgcttctcgtgacatcggcgtagggcctgttggtagctagctgctctgacggcgacccgttcttgatgttcttcgagtaggttcatgtcgtcgtttcgctgttcctcctgatcctcgtcggagtacttctgtagtcgtgtactctgatgacataacttggtagggagcatggccttcgagccgtacacgaggaagaagggtttctctttgttggacgttgtcggtgtggtgcgcacgacccatagtaccgaggggagctcttcgacccacttcttgtcatgtgacatgagcctatcgtagacacgggtcttgatcccttgtagtactataccgttagccctctctagccctctcgacctgtccgttactctgagggtgagaaaccgaagcgaagcatatcttgactcctagtccgatgcagttgtcttggaaatcagcgctgatgaattgggagccgttatccgttatgatgcggtgaggcaatccatatcggcaaaatatccccttaatgaacttgatggcgttgtcggccttgatttcccccgtgggtgttgcctcgatccatttagtgaatttgtcgatcggcacggacaggaatgtgttgcttcgatccatttggtgaatttgtcgatcgccacgaacaggaatttgtagccgccctgtcctcatgggaatggaccgagtatgtcgagcccccagcacgagaacggccaagtgagagggatggtttgtagtgcttgcgttggtagctttgtgtgtttgctatgaaattgacaagcttcacactgttgtaccatatcgcaagcgtctttgagggcggttggctagaaaaatccttgtcgaaaggcttttccgaccaatgtacgaccggcggcatgtgacctgcagaccccttcgtggatgtcgacgaggaagtgtttgccgtcgtcagacgaaacatattttagaagtactccgtttggcgccttcttgtatagatcgttcccgatcatacagtagatttttgcttgacgggttattttctcgacttctgcgtcgtcctcgggcaactcattgctgcttatgaatttaatgagtggggtccaccagtcatccctggtctcgatgtcggcaacggcacaatctgcctctgtagcccccgagccgatgtcgggggtgactgggctatcttcgtcatttgcctctttcactgatggttttgtcaggatatctagaaaggtgccgggttcgagtagctctcgtctggacgcacgccgtgctagatttgatgggacctcgatcccatcaaatcttttttccagcttcttgacttctgcaagatatttggatagctcagggctagagcatttgtaatctttgtgcacctggtttgcgactagttcggagtcccctttcacgatcaatcgcttgactccaagtgcagctgcagctctcatcccagcgagtagtccttcgtactcggctgtgttgttggtcgccctgaagttgaggtgaattgcatgcttgaactgatctcccgaaggtgatgtcaagatgaaccccgcacctgctccttggctgttgagcgcgccatcgaatgccattgtccatgtttcgttgtcggtctggctatctaacctgttttcaggcatagttcaatcggctacgaaatcggcaagaacctgggacttgatggctgttcgtgtataaagtggatgtcaaactggcttagctcgactacccatttcgtaatgcggccgacaacgtctttgtttctcacgacctcgccaagagggaaggcggagacaaatgtgactctgtgggcttggaagtagtggcgtagctttcttgacgtcatgattactgcggagagcagtttttggatctgtgggtaccttgtctttgcgtcgtgtagagcttcgttgacgtaatagattggtctctgcaccttttctctttcgacaacaatgacagtactcacagagtagggcgtagtggcaatatagaggaacaattcttcattaggttggggagcaacaagtacaaggggatttgacaagtagcgcttgagtgcgatgaacgcctcttcagcttcctgtgtccatacaaatttgtcttgcttttttagtagtgcgaagaagggctgtcctcgttctcccatcctagcgacgaacctacttagcgccgccatgcatccggttagcttctgtacgtccttgagccttgtgggcgacttcatgttctcgattgccttgatcttctcgggatttgcttctattcctctgccagagacgaggaatccgagcaaattgcccgacggtaccccgaacgtgcacttctcaggattgagcatgaggcgatatcgtctgaggttgtcgaaggtttcccgtagatcgtcaaccaatgagtcgcctgtcttggttttgacaacaatgtcatcgacgtaggcctcaacattgttacccagctgatcgctaagtgccccttggaccgtatgctggagtccaaatggtattttgacgtaacagaatacaccgaacggtgtgatgaatgttgtcttctcgtcctcttttgccatgctgatttggtggtagccggagtaagcatcaaggaagcttaacagcttgcaaccagttgttgagtccaccagttggtctattcgaggaagaggaaagtgatccttggggcacgccttgttgaggttggtgaagtcgacgcacatcctccacttctcgttggcctttcgcaccatgactgggttggctagccactctggatggagtacctctctgatgaaaccagccttaagaagtttatcgagctcttctcgtatggcctgtttccgatctgatgtaaatctccgcagtttttgctttactggcttggcatcgggtcgcaccatacgtttgtgctcaatgacctccctggggacccccggcatgtcggacagctgccaagcgaatacgtccacattgtcgcggaggaaggtgatgagcgcgagttcctatttctcgttcagtgatgccccgatcttgaccgtcttgtcggggttgacactggagagtgggacgattttgattgcgccgtctggtttcggcgtcttagtcgttttgatcactttcttgggtggctcggctgtggcgggtgggctgggagtgtactcgaccatgtcgaggcttcgcttgtcgcattggaccgccagcttcgcattcccttggatagtgattgttccctttggccagggcatcttgagtacctgatacgcgtagtgagatgcggccatgaacttcgtgagtgccgttctttcgatgacggcgttgtatgctgtgtcgaactcagtaacatcatatgttatctgctccgttcggaagttgctcgcttggccgaaagtcaccggaagcatgatcttgcccaatggcttggacgaagattgaggggtgattccatggaagggttgatcggtaggtgtcaactcgcctcatggaaatcccattgcgtccaaagtgttggcgaagaagattgatggagctgccgccatcgacgaggactcgcgctaccttgatattccgaatagtgggtttgaccacgatcggatatcgtcatggtataacagcagccttggggtggtcttcatctgagaactcgatcttctgttcagaccacttcatcttgggtgcagccccctgccatgtcgaacaaacctcacgctctacttttttgtattctcgctttgaagagtatgttgtggaacctccgaagatgtgtgagacatgaagatcagaatctgggtacgcggagtccgagtcctgagtggttgcctcagttgccttctcgactacacgtactcgcttacccttctctaaagccagcttcctttccgatgattttttgaagatgaggcattcctccagagaatgtctgtccgacttgtgtatggggcaccatattctctttgtatcactgccctgtgggtctgggtgtttgggcgggcgttcgtattcagatgcaaggacttctgtttaagctttcctcttcccattcttgccgcttttcttcttgcttgattcgggcgcgtccttggctagcttcttctctcctcccgcctttggtttgtcgtttttgcgtctcaatgcgtcgtctgcatgggcacatcgatcgacaacctcgaataaccttcgagtagtagtgattcaccttgttgccaactcctgggtagtatagcgatctctgacaccggttttgaaagcgcggatcacagaagcatcggtgatatcggggatcgtatttctccactcattaaagtgccgaacatagtccctcaaagattcaccctgattctgtgttaacacgtgtaaatcgtcttcgatcgcgtgacgcttgtaagttccctggaagttcgcgacgaattgttgccataaatctgcccatgaagagatcgagtaaggtgggaggtgcatcagccacgaatgcgcagaacctttcaacgccgtcggcagataatttactaacgcgttgtcgtctgtcccaacggcgtatagtaccgtggagtagacctggaggaattcttcagggtcagaacttccatcgcccttctctattgctccgggtcgnnnnnnnnnnnnnnnnnnnnnnnnnnnnnnnnnnnnnnnnnnnnnnnnnnnnnnnnnnnnn

SEQ ID NO: 39139 - DNA, 1007 bp, Oryza sativa
  unsure (1)..(1007): unsure at all n locations
gtatggcttgttttcggtctggtgcaaatctccgcagtctttgctttactggcttggcatcgggtcgcaccatgagtttgtactcaatcacctccctggggacccccggcatgtcgaacggctgtcaagcgaacacgtcagcattatcgctgaggaaggtgatgagcgcgagttcctatttctcgtttagtgtcgccccgatcttgacagtcttgtcggggttggcactggaaagtggaacgatcttgatggcgccatctggtttcggcgtcttgtttgtcttgctcactttcttgggtggctcagtcgtggcgggtgggttgggcgtttgctcgactatgtcgaggctccgcttgttgcactgcaccgccagttttgcgttcccttgaatagtgattgttcccttcggtccgcgcatcttgagcacttgatacgcttagtaagatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcactttcacatggttttttattttgggcttttcccaaccccccccaaagggnaaaaaaaaaaaccccgggcccccttttggggggggttttgggggaaaaaaaaaaaagggggtttttaatcaaaacaaaaaaaaaggggnaaaaatttgggggccctttttggggaaaaaaaagggnaaaatattttccccaaaaggggggtttttttttggggggggggggggggtttttttggggggctcccccaaaaaaccccccgggggaaaaaaaaagagggtttttttggggggggggggggggtttttttttttt

SEQ ID NO: 39140 - DNA, 722 bp, Oryza sativa
  unsure (1)..(722): unsure at all n locations
gggacaagcgaagaagctgctcttgatcttatcagtaatgctcaaaatgcagctgacaagattgcaagtgatgttgtagagcaatttcgcaacaacgaccttcagccgagcaataataactctgatgatgaaaagactgattctgactgagtgtaaatgtagcaaatggaggcttaatttgtacaatgctggtgtatttatgctgtgcttgatagttctaaccaagtctttgatttcttaaaagcttttatcaagctttgttgagcctaaaacccaaagaagctattaaaaactttcagtcctcgcagacttagtngaaaaaatcaaacaaggttatgatagaccaagtaagcaaattaaattgataaaaaatcacactccattattatgatgatagcccccgactgacaacggcaagaagaaaacttgatgttgacagtcaagatagggaagtgcaatgataaacttaagcgtagaaacgacgaagatgttcaatgttccaagagttgtcgacaagagtaccgtcttcgcgcttgagtcgataagaacctggccgggtgacttcaaagataataaatgtcccttcccatagaggagataacttgtgccgatctcgtgtagtttgaattttcctcaaaaccaggtcaccgactaaaaaggcacgagaccgaacattgcgattatgatagcgccgcaacccttgtaaatatcgagccgaccga

SEQ ID NO: 39141 - DNA, 902 bp, Oryza sativa
atcatttaagccccgaatttcaatcaagtcccaagcgttagctgattttgtcgccgaatggaccgagtgccaggaggatacccccgcgaagaacatggagcactggaccatgcattttgacggatccaaacgactttcgggcactggagcaggagtggttttgatttccccaactggagaaagattgagctatgtgctttggatacatttttcggcgtcccacaacgttgccgagtatgaggccctccttcatggactacggattgcaatttccttagggataaagcgtctgattgttcgaggcgattcacagttggttgtcaatcaagttatgaaagagtggtcctgtattgacgacaatatgatggcatatcgacaagaggtgcgcaaattggaagacaagttcgaaggactcgagctcagtcacgttcttcgacacaacaatgaagccgccgacagacttgccaattttggatccaagcgcgaggcggcgccctcagatgttttcgtcgaacacctttatacaccgaccgtacctcataaagatactactcaagatgcggacactcatgacgtagctatggttgaagccgactggcgagagcccttcatacgatttttaacttctcaagagctccctcaagataaaaatgaagccgagcggatttcaaggcggagcaaactttatgttatgcatgaatctgagttatacaagaaaagcccttcaggaattctgcaacgctgcgtatctttagaggaagggagacaattgctgaaagacatacattctgggatatgcggaaaccatgctgctgcacgcaccattgtcggcaaagcttaccggcagggttttttcttgcctactgcagtgtccgacgccgacaaaattgtgcgcacatgtg

SEQ ID NO: 39142 - DNA, 1826 bp, Oryza sativa
  unsure (1)..(1826): unsure at all n locations
nnnnnnnnnnnnnnnnnnnnnnnnnnnnnnnnnnnnnnnnnnnnnnnnnnnnnnnnnnnnnnatactcctttttgttagttttattaggctacaaaagctgtctgggttaatttggaatgacttgtttttatcatagtcacttccttggtatgttatatacctattttcattatggtaaatagtcatagcctaggctattagacttattcattaccataatttttataatacttggtgggtaatctttagagttttaaattcggatgcctgtccagtgtgttcattcgtgaacctttttagagtgtaaactactcggactcttttcattatggctaaaaagcggtcggctagcatgcctatttaggcgctgtgtgtgcttttgtcatatgatgcacgatcgtgctattatttggtctctcaactatatgtttagttcgttaactaatcacatagttgggggctacacctaattaggtgcatctattcgatgcaccatatttttatcttttcgccctttacagtctttgtcttcgctactcggcaggccttggcacgaaaagtttgaagcactcggattattatttttgagaaggctacgacgattgactgcaaaggtctcgggggctactgtggagattatggatatcccatatctatacggcgatgatatttggattgaatataggataccgagtatagatagaatatcttatgtgtatcctgggtttgtttcctaacttgtatatcaaggaaacaccttgagacttagtcggtcacgactgtattcagttagggacatagattatcttttgtaatccggactccttcctatatataaggggggtccgggtgcctttaggggcagatgttgattttctctaaatcatacaatcaataatacactcggcggattcatccccggacaggagtagggtattacttcttttataagaaggcctgaacctgtataaatcctttgtctccaaacccatacacttttccagcttgatagccacccccttttattatgcccgaaatctagtttcgacaatactcatgtatgggtatagtgtaggaaacggacaacaggtaccaaaccaatcgtaattagattcatacatggaattagcatccatgtgggtattagtttatacgcttctgaattatacacgattcatatagtaataaatagatcgatactcttagcaatgaaagcaaaacacaaagcacaaatatccagccatacatcttttagccacaatcagctttgccaccaaattagcaagacagaagttttgccgccagaatccacttcattaacaaattggcacccgagaatgtcggaatcttatagcaaaggatcgtctaacaaataaatttgtgtgtagcaaattaacatattagattggtaataaaaggaacctccatgttcgttcaaattatctaggaaaacaaacattaattaaaaaaaataaaagatagaaatatgtctattgatttattaaagtaataagaaaaaaaggctccacaatcactctcacgacctacaaattctcatattaatcaattcgaaattaaaaattaagacatattaaaagaaaagtctagagtctatattgaactaattaaaattccgaataaaaattaaaaataaggaatattggaagaagagtctagagtctatatatgaatttagagctaattgaaagacgaatttgaaaaataagaaaaattaaaagtaacgtttagagtccatataaaaatatatttagaaatagctgaaattcataaaaaaattaaaaaaaagaagattgaaaaagagtct

SEQ ID NO: 39143 - DNA, 1029 bp, Oryza sativa
  unsure (1)..(1029): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttcaccaccgacgacatgatcctcggcaagaagctcgtcagcgtctgagctcgccgccgtcctttccggacagcggacggattgcttgctgcgcgacgcgagcggctgaccggccgggccgccatggccggtgggcaggagcaagcggagacggtttcagttttgttatcaacgctggtttggtacaatatggatagttggatacacgcgtacaggcgtaagctgcaatgtattgggattgggaaactgtaagatgtgatacaagggagactaaacttcatctaatatatatgatataactagcaaaatgcgtgtgcttcactacgagtgaaaagaacgttgaatgctaaaaggcacaactaaacatgagcataaaacccaatgatattcacggctgatataaacagcagtattgcaaactgatagactcgtatatatgtagtagattttatatgactccataataccatagtatgtacaagaattcatctagctactagttccttcttggtctgcccaaccccggcggaacgagatgaagatggggattttccatatgcagcgaagaggccacgtgtgcctcaagagtagagcagaaaacaggtagtgccaaatcagacaatgtgtcttcctttgcaggtgtcaatgcctccggttttgattcccaaggctcctccggaggacctgtccgactggctgcttcgagaaacccgagggtaggattccaaccccgagggattgatgaggggcggaagcagggggaccgatagggctgccaggggccatggcaaggggacgggccaatggcttaagggagagatct

SEQ ID NO: 39144 - DNA, 1338 bp, Oryza sativa
aaaaagaggtgctgggactgttttggcttgtgtggatggggcagccctatcctgtgatggatcctctcctctcattctttcttctgtccacttggcagcattctgatcaaatgatggggacatctaactcttttttttattgcttttgtacataaaccctgtaaatattatatttattaatataatacagtagtagcctctcctattgtttcccggaaaaaaaaagtacacaaagtgaagctatggtgtccacaggcattttcatcaatatatacttttttttaattggtaaaatagataaagaactagaagtttgttatacttaagaatgtaatcttattgcaatgggtataaaagttatctaatcatcttgtaactgatactctagtatcaacctgtattgtagttctttttcacctaagagatcgatgggtttccgtatggcatcaaattcattctgaacatttaaaaaggttgcaacttggttttcctcatcactgtacactccatttggttaaaaaaaaatcctagaatctttaatagttcttttaagaacatatctatgttggtggatgatatcaaagaccgcatgtactcaatcgaggctggggggagcaaagtgcattggctagatctttagatagcctcccaggatgttgttttctttaaccattattagatcattttaatgtttgtaaaagcttgaccagttaaggggcaatggattttttttcttctattcaagtgggacacagagctcctgtgtgttaaaaaaaactgtagttctttccaaagtttaaaatttgaagttaaaaaacattggaaaacacaaatatgggcaattcaagccaaaaattgaaatctgcctctcttatcaccagtatatatagatgtcctgaatctattaaactaaaatcatccttgcttgcaaaatctgaagtacaaaaagtagaatactagaagtacaaaatctgaagaagttctcaactagtacaagacatcttattattcatacaaccaaaactagcataacaaaaaagcactccagcagctgccaacagtgataataatccaactcaaacctcactttttatcatcttcctgaaccaacgtgttgagtctttagggtaccgtgtgaaagtgctccggtctacatagacgattccgaattttgaagtgaacccgagccgccactcgaagttgtcaagcagggaccaagcaaaatacccagtgacccttgcaccatccttgatcgccctcttaagctcatggaggtactgatcaaaatattgtatcctgaagaagtcatacagtgcaccaggtagggtctcattgcct

SEQ ID NO: 39145 - DNA, 888 bp, Oryza sativa
  unsure (1)..(888): unsure at all n locations
catgctacattaatcgatataacctttcacgttgattttagtctactcaattacaaattaaattttatatatatatatatatatatatanttgtatagcattttatagtgtagtgcgttatttatcttaaattagatcttcgtcttaggtgaaaaaaaaaaatattctatgaatccccgccacgtgtgatttacttcgtaatactctgacgaggttatgtgaaccgagtttgatgttggtgagtacagtcgaatagctnctggttctctgtgtcattttgttctcgaagtactcctaccggtttagttttaaaaaaaactgttgttgattctcgcccttgcaaattaactaatataattacaacaaactgattaattatcattgttaaaactttttctttccattttaaattatctgcaaagtaagaaagtaacactcccaagttacaacagcacaccatccatatatccatgcaggcagcctgtttgtgcccttgtgcagatgcatttcatttatacaagtagaaggcactcaaatcagccaccacatgaacacacacatgttccatcatcgatcgatctacacatgcatcacccggtcatgcacttacaaacaaaagatctacttgaagaagtacgggaggtcgagcacgtagaggaggaagtaggcccagaggacgccggagatgccgccgaagaagaagccgccggtgaacttggcccagccgtcgcggtctgcagcttgtcggcctccttcttgcggccggtgagcgtcagcgtcggcgccgtggacggctcgccctcgccgaaggaggcgacgccgtacatggtgaggcagacgctgaggatggcgacgaggcctgcggcgccgagggcgccggcctggccg

SEQ ID NO: 39146 - DNA, 1902 bp, Oryza sativa
ggctgccatgtggggcccggccgtcagccgcccgtgccctcgggtgcggctgacgcgtgggacccacggcgccggccggcgtaagccgggtgcacccggtccaccgtggaccgtgaggctgccacgtgggccccactcccgtggacccggtccgcgcgcccctcccctcggctgacgcaataaaccctttttaaattaaaatttaaatgaagaaattcgcaaatattcatttaaagagcatataaacttcaaatgaccataacttggccatttgaactcggaattggaccgttcaagtctctaatttttccttaagaagtcaagaacccatttttgtgctttgttcctgcttgttatatggagtttattagagtaaaagccttttcttttccgttggtcgtgtagacgctgcagcttcggaagatccgctcttcgtggaggttgaagccgacgtttgggaaagcgagcaaggcaagtcacatcatctttgaacatattgaatcccagtttataaaattatgttgatttaacttattgcgttatcgctttatttaaatttccgcgttatcactgttttatttagccatgcctatttacctttgttatgaccttattattattgttattattattattaccttgttcaccctagaataaacaaaaccccaactagtggaccctctactcatggtaccactagtataattttaggtagatgcttcgcttttaattaggtaacattaggcggttttacaactctagactttgggaatattcatatcacctggacactatggaatggtttggttattgtggaattggctgggctcggggtgcatggttttgatagtagcacctcggccatataaggaccggtcttcgggcctctgttgaaaagcactaccgtacttccacatgtctagtgggtaaggcttagtttgtggctcagtctagttataaacaaaagtacacggatggagatggaagaagtcgggggtcgatggacatctccagggcaaatgaaggctacacgagctgcggcccggtagtcgagatgtcatggcacagggccggtgtcctgctgttaggggctcagtcctgcctgcctgtcccgggggttccggccgtaggtgggattgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgtttaataatattgtatagcactagaatcgtctttacaaaatagctttgagtacctaagtgtcttttaatgctgtttactgcaaaccctaaccctttatattataacgcccttgtactcccttgcatttatcctgcacttgtgggtgtgtcttgttgagtacggtggttgtactcagtcttgctcaatttttcccaaacccagaagtggagttcctggaagatgaaggctttggtgtctagctcgtgtctgccgtcaagcgcctgtggtcgtcgccctagtcttcctctgtttcccgtttgtctttgtgtgtgctgggccttcgccgcccatgtaataaattatctatttacgcttccgcttgataaactctgaaatgtatcaacttttggtgtaccttgcctcct

SEQ ID NO: 39147 - DNA, 3125 bp, Oryza sativa
ggatcccctatcttcaaatgaggttgattgattattgcaagaatgagcatatgacatactcaacaagccacacagcaaatatgcaagtgcacaagaataccaaaggatggcataatataggctcatttgcgaaagcgcatttagcaaagagttaagagtagtaaaacagtagagtaattaattaaaaattttaatcaacactgaacagcacacccatgctgtacaggcccaaccatcctgaacaaccatacccggctgtacagatctaactccaaaccaggagctaagcaaattattatcaggtattaacatccataattattgtgagaggtgtgagactaatcacgaaaaacattgctcaacccgcccataaccgcgggcacggctattcgaatagttttactctggccagaggtgtaccactgtacccacaagacacaaccccacatcatgtcaccatgtgcctcaataccaccacggtacctcggaaaggagttgtgacaataccccatgcacaacataatccattacagcgcacctttcctggatcataatcaccccctcaaaaactagaggcatggactccccagcgacccccgtggacttctcgccacttctcagtctggcgcactataatgaatcacgctatacaaaagataaagccgttgcccacgctggcttgtggttggcacgataaatgtttcacaacagtagctcgcgaaccggtccttaattgtcatgagcacgactctcaaaaccatgtgctcacaacccaccattatcaagttttagttggcaagtaattaattaaccaatcacgattaaccatcgtgaactatcattaagccatccttaaataatagtgagtcataagtcatcccaatagtgtgctaatgtttctaagcatggctaagcaatcataactaatatctagctgaaccaatatataaagcccaactagtcaagttataataacccaaggtatcaaggaataaagtaatcaatgcaaattggccataacaaaggaataagttcacaccacccggtgacattcgaaaataaatgcacagatgaaataaatagagaatttaaatataggatcaatatgctcaaaggattgtgtttaggatctgtgtgacttgccttgcaataatcggtcttcaagtaatcttcttgatcacttccgacgcactcacgaaccttcgcaacgacggaaacgacaagctaacacgcaaatcgaagaaaaagactaataaaaaccaaataaacagtacatataaagtaaacaaacatgtagatcatgattttagatgaatttagcaacttgaccactcaaaaccgagttacgatgatttagttatgaatttccgaagatttaatctattagaaaaaactggaaaaggagaagatgatgacgtcatgatgacatcatcaatggccggaccaagatggcgacctcgccggagatagagcgaccggctgcggatttggaggacatgaacacgtagaggacgacgagacgaacccaacgatactcaccctcgtgccaaacaacgaccgacgacggccggcgacgaggaggcgacggcggcggctcgggttgcacggggcggcggagctccgatgaccagcgacggaaaaggaagggtggccgagcttcccctcaccacggcgcacccaacggtggtgacggcgaccggcgacgacgatggagacggcggcgcggcggcaccggagatggccggcggcggcggtttgcttggcggcggtggcgacggagctacggagcacggaagaggacgggagagggggcaaacgaaagaggaggactagggggtcctatttatagccttggattgaagagatcggactcctcccgcaagaaatcgatccgggaaatcaaaaactcggttttggagataaactcaaaaacgagttcgattcggataaaatactcaacggtttgctccgattcttgggggtaaagatagaggaggataagaggaatatttcccctcaacaaaattggagaaaaagagcaacggggaggcgagatttggaaggaagaggcggcggcactgtgcacggcacggctggctcgggctctgcctgagttggaagatgaacagtagcgcagggaaagaaaatagacttttctggctaggctgagaagagaggaggcggctcaagttgggccggcggaagagagaggaaggaaaggaaggaatgggctgaaaatggcccaagctgaggaggaggattttattactttcccaattaaaataatcacttaaatgatctttgaattattaaaaatacttccaatgctcaaataatttcaagaaaaatcctgaaaatacttggacactcaaagtacttaaaaaaattacaattagaccatttaatgattaatttaatatgtgggtaattactgaaatgctctttgtatgattaaaaattaggaattgagctccgaaaaatctgagaaaattccagagagtataattaaccatgaagaatttaataaaaattaaatccttccatgctttatatttaggaaattttatttcccacatttaacttcactagtaaattaatgaacgtttaatataaattctattaataatttattaaataatttataaatcctgaaacgaaaatcaggatgtgacaaatctaccccccttacaaagaatctcgtcccgagattcggaacggctagaaagaaaaaggcataggtaaactacagtctatcttttattccacaactccaataattattctaaggttttaaagaaagctactgctgctttggaactgatggctgagctgtatcccttgagacgcaaccggcactgcatttgctcctgtgaggacaatgttgttgacttggccttgtggctgttgacgcttcggcttcggacactcttttacgaagtgacctggctcataacaattgaaacacacccgatgctcccttccattactgttatcttcttgagactgatcctgctgaaatgacactgattgagtagcttgctcatcattgtcttcattgcttgcattagtatctgagttgatctcaccactgatgcccaactgttgtgactgttcttgacctgcag

SEQ ID NO: 39148 - DNA, 1212 bp, Oryza sativa
  unsure (1)..(1212): unsure at all n locations
ttacacactcagcactgaactacaacaatgttgggaatgcaaccatacctacacacaaagcaaacacgaagcgttctaccctactactatttcttcaaagacactttggcggcataggttctaagataggttccaancttcactctatctgaacacttaagattcgactatcatcttcttattcctcgatccacttgacttgcagaagttgacaacatcgacgtcttcgagtttctccatcaagattaacgactactcaagttgaaagaggaagggggaagaacgacaaaacgatttgcaaagaattctagataagaaagaaaggaaaattttcacaaattatgttttcggaagatttgtccttaaggtttgaccatttggcttatcctacagtatgaaagctatcagatgtaagcgggcccggcctgggggaaggcgggacgttacagccctgatcatgttgttcaaattatcactgacaatgggtctaactataagaaggcgtgcagactacttcggcaagaataccaaagaattgtgtggcaaccttgtgtggcacacacagtcaacttgatgcttaaggatgttgggaaaatgccaaaccacgaaatggtgattgcaagtggtagaaaaatttgcagatggctatacaatcataacaagttgcatgctatgatggtcacagctataggtggtgaactggttaagtggaatgttacaaggttcgggacgaactacatgttcctccagagtttccttaggaagcgagatcttttcatgcaatggatggcttcctctgacttcatgcaaagcaaattcagcgggacaacggaaggtagatatgcacacgcatgtctatctagcatatcttggtgggagaacttagaggcagtagtgaattctgtccaacctatgtactcattccttcggtttgctgacgaggacaagaaccccaatttgagtgaggtacttctgagatatcagttgctcaaaatggagtacggcagtatttttgcgaatcaaagggacaagtttgaagcatacatggagattgttaacagaaggatgcacgacctaaccaatgaaactctgatcaatgccagtaagtattggtcataacataatccacatgtcgtattgtgtaactcgtacttaacctatgacatgttttgtagctggcgcattgaaccctaggacgcactatgcgtacta

SEQ ID NO: 39149 - DNA, 1649 bp, Oryza sativa
  unsure (1)..(1649): unsure at all n locations
nnnnnnnnnnnnnnnnnnnnnnnnnnnnnnnnnnntggaagagcacctgcattttcttgtcgatcagtagtcactcccttcactttgatgtttgctcattatacctttccactgttgttagttgtgtcttactacaggtgaagaagtaagttttttttagttctgtcagacactccaatagacattgtcgtgattcaccaagtgcttgtgcttgttactctgttctatcattgcttttggataaaataacccttgatgtttgcttgtttcttcattcttgattacatatatgaagaagttcagtatctcttaaatgtttgcatctgcaggaccctaacgtgtccattcctgtggatgccatcatgggggctcttagggtcatacttggtactgaattaggcttcttctgtcctgtttatctttgctgtatactaaaactctctgatgaccatcaagctaataattttgacttactagtactgattcttggtttcagatgtaaggaatcacccagttctaatccattgcaaaagaggaaaggtaccaaaaagcactcatctgttcaaaatccataattgtttttgtccacaccacatgttcttgatattttatctgtttcgaccgcagcaccgtactggatgtcttgtgggctgcttcagaaagctgcagaattggtgtctctcatcagtctttgaagagtaccatcggtatgctgctggaaagtcacggttgtcagatctgaagtttatcgaatcatttgatgtcaactgcatgacggattgcctgctcaggctcatctaccactaccatggttgccttcagaaaagcaagcgcctggcatacagcgagagataaactactgtggaaactatctcctgtgtcatgagtatatccctgagaagaattggtcggactatttttcctttttggaggggaattggtcggagttgtaacacaaagactcgagttaccgggcatctgttgattctttttttatatcttcatgccttggttctttttataatatatatatatattctttgagcatggtctttgacgttaatttcaccaccctaaatataagtctaagcaagtttatgattattaagtgtggtgtattgctatggtagtgcgcatcctcatataacaaccaaacacctgtttgccagtccttacattcttcgagaagtagatccctggcaattaattaatcacgcggtcttaatatatactcccgtttcaaaatatttgacaccgttaactttttagcacatgtgtgaccgtttgtcttattaaaaaaatttataaaatatgtaaaattatatgtgtacatgaaagtatatttaacaatgaatcaaatgatatgaaaagaataaataattacttaaattttttaaataagacaaatggttaaacacgtactaaaaagtcgacggtgtcaaacattttgaaacggagggagtactttctcgtgatactctccccgcggatcacattagatgttgtgatagtcctcccgcggatcactagagaagttgagaacctataaattgccagttcgtttgctctgctctttcttatgcaagatgtgtttaattgtactgatgagattccggtgaaacacatgcccatgaaatttactaattttt

SEQ ID NO: 39150 - DNA, 1508 bp, Oryza sativa
acaagaatgaatggatgagaaatataaaagataatatcggcttacctgtagtgagaggacaatgtcactgctgtcccagctggtgcagattcatacttttggacaataagttgatctagggcaagcagcagaagctctaaaatggatcagtagttgtcgaggcaagaagacaacgatttcaaccatcagaataaaaaagggcagcctcaaactccactcctgacttggccatgtccaaaatcaatgtataaaggaaaatggtacacatcggccttctttttgcggattgaagatcaacaggagtagcgcaacatacagaagaagctgtagatacggaatcaccaactaccattctatacatatgaaataggtggcgagtgctagtagggatcgtagttacatctttgtcatgctccatgtaaaatccaggcttcagttctatcttcttgtctctgtggattttgatacactggtggagaaaccatctttcgtcggtcggccgatttccacaatagtcccggatgcaataaaaaccagggctaaagatgatctttagtcccggttcaaaagggtaacgggcatatttgatctttagtcccggtttgtgttaccaaccgggactaaagatcatctttagtcccggttcgaatgctgttaggtcatgtcaggccccccccccgggatctttagtcctggttggtagcaccaaccggggctaaagatgaccgggatctttagtcccggttggtaataccaaccgggactaaagtcccacccctatatatatatgtcttctccagttcttcctcctccagctgcccgaacaagctttaaaatttcttcaaaaaaagggaggtcatgccaaaatttctattgaatttattttggtgattacatataaatcgaaggtgcctaaaaggtttgcaacttcatcctccaatgtttttttttgtcatactacatttgcacctatgttttgcacacttttttttgtctccaaaattgagttgtaagttgatgagagagaaaatgtgtgtggggaagaaagaatatatagaaatttagttcatttgctaaacaaggttttataaaatagttgagaaggaaaactctagttaaataatagaaaccaaactaaaatgaaaattaaaagaagtaaaacacattaaaattagtttaaaactttacaaatagtttttaagaattatttggtgtaatattttatgattttggtatgaataaagatatcttataattattgtatgcccgtcattattgtaagaataattatttgtgtacggtttttttgactcatgtagatggatcggcaatgaatgtacgctgaccggcggtccaaagagtttattgacggcgtgcactattttttgagagtggccgaagctcacaggcaaaggggttttatttgttgtccatgcaataagtgtaagaatcagaaggagtattctgcatccaggactattcattgggtaccgagctcgaattcgccc

SEQ ID NO: 39151 - DNA, 2706 bp, Oryza sativa
ctcaagatcatgcatagcaacaatactgaagaatgtgcgaattgaactatgctttacaactggagagaacacatcattataatcaacaccaacaatttgactgaaaccttttgctactaaccttgccttaaacctcggaggctcgctaggagataaaccctcctttctcttgaagatccatttacaacgaacaggcttcttctgttttggcaagtgcacaagctcccatgtgccattcttctcaagagactgcatctcctcctgcatagctgagatccacttctcacggtctccagaaacaacagcttcagtgtatgtggctggctcaagagtattctccacctgttcagcacaactaaaagcataataaaccatatcacattcctcaataagacggactggagctccacaactcctctttgttctgcgatgggcaataggttcatcttgtggctgcaaaacaggaggtgagtgctgaacagtatcattaacatcattaccaacaatttcagtttcctgatcatccacgtgctctacctgcacgctaacatattgctgctcctcatctgaaccacctggtatgacatctgtgggcaagctgtcattaaacataacagattcattgaaaacaacactcctgctcatgaaggtcttgttagtttcaggattccataacttatatccttttactcctaaaccataaccaagaaatagacacttaatagctctaggctctaatttttcattatcaacatgagcataagcagtgcatccaaaaactctcaactgtgaataatcagcaggcataccagaccatatctcaatgggagttttcttattaagtgggatagaaggcgacctgttgatcaagtagcaggcggtgttagcagcctctgcccaaaaacgcttgttcatgcgagcgttggacagcatgcaacgagccttggagatgatggttctattcatgcgctcagctacaccattctgctgtggagtgtacgggatggtgtgatgcctaacgatgccttccttcctgcagtaatcatcaaaagcatccgaacaaaattcaccagcattgtcagtgcgaagtacttttacctccttttcagtttgcctttctatcataactttccactccttaaaagcagcaaatgtatcatctttatgtttcagaaaataaggccacacttttctagagtaatcatcaataatggtaagcatataacgagcacccccgagagagggcttacgagaaggcccccacaaatcagcatgtacataatcaagtatacctttggtgcgatgaactgaggtattgaattttaccctcttgtgcttaccaaaaacacagcgctcacagaacttcatgttaccgtgagtgcagccatccagcaggttccttttcatcaattctcctgtacttaactaggtatttccccgcgttttgctatgaaaattactaagtaagttttaatatgtttttttaataattgagctaagagtgaaaagtatattggttgttaacaataaataaaactgatttgtcaaactatgttcgatgagaaataaatttagtagactctgtaggagattatacatgaaatatgatatcctgcattttgattatatgaaaattcaaatgcaaaaataagatcaaattgtgattctaagatgcattcctaataaaacaaaacatgtgttttctccaaatggcagcaagcacgctcggctgagcaaaaaaaaaaaagaaaaaacgagtgatgactaagcagaaaaaaaggtctggacgacgcagcataggattaatagagaaaaaaagaatccaattctcatgaaattcacgcaaacctgcagctcctcagtaattaaattagagatacatattgttagaaaaatagagaataaaaagtaagttattattcacatgaataataccgatgaaactatagctcttcatcatcaatcacacatttatcccagttttcggacccttaacttattcctacccacgaatcaccatccatagcacacactaattgagctaatccctctttctatatagttgagacccaaagctgatctgtgattaagccacgtcaccactaaaacctcagccgttcgatctgatctggacggtcgcacacaggtgaagcccagcccacttctttccaggatttttcggtttctcctaacccatccgcatcgcgcagaggctatgccgccgccggatgcggagcttcctctcccttttccttcaccctcgagccgcttctcctcccccgtgcgcgcgcgcgcgagctgctccgcgggcccgcctctgatgcggtcgcttcccatctccgcgtcgcactgcctccccccatccccaagggtcagccacgccacgcgcctgtagccctaggcaggacgaccgtcgcgtcccgcaaaagctccttccaccgcctcccctcccctaggtgcttcctgtccattacttaatgccagaagggagcacgcccatcgtgctgaccacccagcggcgcctccccagccatgctcacacccgtcgtgccgccgacgccgcgggcgccggcgcggtcccggtggccaagctggaggacgccgccacgctcatcgactccgtcgagacgttcatatttgactgcgacggtgagatggcacgctggtcgctcgatggttgattggttgtgattttgttatgaattg

SEQ ID NO: 39152 - DNA, 1084 bp, Oryza sativa
cattgggcaacactattgtgcgcataatattgccaaagcaaaatatgcctaagtccctaaggaacacaatgggccacgctgttaaaagtattgggccgaagtactgttcaggcctaggcccattcgcacctccgatacccttaacaagaaatcccgagatccaagcgacgcttcgtcttccccgccggaactctcgccattttccccactccttgctacagtgcagaactgcgccggcgaactagggttcaccactccactcaaatccaccttcgaaaaatgcatcaaaatccttcccgtgatccaccgccttaatccctcatttctccctagccatccctcgaatcaaatcagcgcattcggatagaatcgatggcggaagagaaggaaagcttcgaaggccaatgggcgccgtccgacgtaacggaagagaacctgaaggagatggtggcgcacggcgttctcccagccaaggagatcatcggatggcggccagcgtgcggtgaggcttttccgacccctgatacacatgagatcgtagtcttctcgcatttcttctatggcggcttcgctcttccgacctcgagatttttccgcgggatattaagcttctatggaatcagcttgcatcacctaaacccgaattctatagtccacattgccaatttcatccatgtctgtgaagccttcttaggaattaaacctcacttcgccctgttccgccgaatcttctttctcaaaccccaaccaaacaagagtaagccatgtgtagtcggaggggccggatttcagctgaggggaactctgagccagaaatacttctcaatgcccttcaagacttcaaacaaaggatggcatgcgaactggttttatgttcagaatcttgagcctgctcttcccgaatactcttgtcttcccccggtgtaccaagacacttggaactctcttccaatcggagatgaagctgcccaagccttggaattgttggatcgcatgttaaaactcaaagaacaaggcttgcaaggagagcagatcactcggcacttcatcaaatgccgactggcgccaattaaagaaagatccg

SEQ ID NO: 39153 - DNA, 1410 bp, Oryza sativa
gttccgccctgcttggctttgaacccgtcggaggacagagtcgccgatcgaaagtatgcgtgctcggatgcgcttctcgtggtaacggcggagggcctgttgatagctgactgctcgaacggcaactcgttcacgatgctcctcgagaagatttacatcgatgtctcgctgttcctcctggtcctcgtcggagtgcttctgtactcatgtactctaatgtcgtagctcgccggggagcatggccttagagccgtacacgaggaagaagggtgtttccttgttagacgttgtcggtgtggtgcgtacggcccatagtactgatgggagttcttcaacccattttttgtcgtgtgacatgagtctgtcgtagacgcgggtttttatcccttgtagtactatgccgtttgccctctcgacttgtccgttgcttggagggtgagagaccgaggcgaagcatattttgacccccaacccgatgcagtaatcctggaaatcggcgctgatgaactgggagccgttgtcggttatgatgcggtgcggtagtctgtatgtgcaaaatatccctttgatgaatttgatggcgttgtcggcccttgatttcccccatgggtactacttcgatccatttggtgaacttgtcgatagccacgaataagaacctgtagccgccctgtcctcgtgggaatggcccaagtatatctagcccccagcacgagaactgccaagtcagagggatagtctggagtgcttgcgcgggtagctttgtgtgtttactgtggaattgataggcttcacatcgctggaccatgtcgcatgcatttttaagggcggttggccagaaaaaaaccttgtcgaaaagctttcctgaccaatgtccgaccgacggcatgtgacccacaaatgccttcatgtatatcgaggaggaggtgtctgccgtcgtcggacgagacgcatttgagaggtaccccatttggcgctttcttgtatagatcgttgccgaccatacagtagatctttgctttacgggttattttctcggcctctgtatcgtcctctggcaactccttgctgatgatgaatttgattagtgggatgcgccagtcgtctgtggtctcgatatcggcaacagcgcgttctgcctttgtgacctccgagctgatgtcgggggtgtccgggctaacttcgccgctaacctctttcactgatggcttcgtcaggatatccagaaaagtgccgggctcgagcggttctcgtctagacgctcgtcgtgctaggtcatctggctcgatgttgtctttgcggtagatgtgtcggacttcgatcccatcgaatcttttctctagcttcctgacttctgcgagatacttggataactctgggttagagcatttataatctttgtgcacctgg

SEQ ID NO: 39154 - DNA, 1284 bp, Oryza sativa
ttttccatcacatcgttttaattttaaccaaacttccgattttagcgtgaactaaacacaacctatattggtttgctggtagcgttctgcaggctgctccagtcaatcccagcaatgccaatccgcaacatcctctcccaaacgatcttctttgacctccgtagttctgtagtttagagcataattaatattgtcaactcagatgtgttgcattctaaagtccaaaacctgaaacatacctgaaaacttacttttctctgttgatcttttatatgtttggagctagtactcaatgtgtcaaaggttgataactttttattgtaaaactaggatcgtggtgagcgtcagggtccaagaataacatcccagttgtgcgacatcatgcccccattgaacactagggccagaagaaaaaagatccaagtattactgcaatatagtaatagttataatgggtaaatttgatccatgtcattgagaaattgtcgtattgaaaaaaatggcattactatttgtgaaatgtaccgaatgcccctgaaatatcctaaaatttgaaccgtgccattatcaccaagattttccaaacccattccatcatgatctcaccgaagcatctcgttgtcttcttcgtcaagcctaacgagcagcaggccagcagccggagcatttcgtcatggataaactcgtcagcgaggcgcgggtgggcggcctcgacggcaaggcagcagcgaccaaacaacacgtgcattttgaaagtgaacaaacaattacacagttatgtgtttcacaatattttttggcttgattaatatgtagcaaaaattttaaattattttgtttattatggaattaaaaaaatgtaatttcataatatgtagcatattaaaaaaaaactctctggtgccctcgcgtcgccctcgcgcggcggctcgggggcgaaaccctagccaccgccgcccctccccctccctcctccttgcttcgccgccgccggagctcgtcgccggcaattccgggcgacgcgctgggatggcggcggcggggccatctctcttggctccatctcgccctggcgcgggcgtggcgacaatggcggctgggcggcgaggtcgcggcggcgggacggtgatgtcgcggcgacggcgtggtggtggggctctctgcggcatcggcggcgcggcggtggggctccgcgcggctccggcgatggcgtcgccagttccggtcgccccgccagatctggccggggtgactacgcgcggccagtgacgggctcggtcgatg

SEQ ID NO: 39155 - DNA, 3668 bp, Oryza sativa
ctgcttccagtcgatgccggggagctccttggtagaggtggcgtgcggattttcggtgtcctgttcgctggtcgtcggccgcgctgttagtttgctgcagctgggttcctgggtgtgaggtggtctctggtcgagctgcagggtgattggctgttgaggcggagtcggagctgcttgtcttgcaagctcggcaacgatgaccctcaatgaacgtcccggcaacgcggcgagggtttggaagtggagcattttgagagagcctcgggtgaaaaccttgcctagtgctatcctaggttgatgatatcgacgcttgcgggcgccgtttcctccttggaggtattgtcatgctggctctctcttccttcaggtgaaaaccgggttcctttcggaatgggcgttaacagcatccttgatgttgctcccttgttgaaggcttcgctcagaaggtttatgctcaactagaggatgtttggtggttctggagacctcgtttgcattatgttgttgaagctgcttgccttttggtaagcttggtaacgacgacttttgtgaggtctctttagttgtttcttttccttttctgtataggtttttgctggttttctgtttaattaaccgtgcttgtttggtcttcgggcccggtttctcttattaactgggccaatcctcttcttctataaattccagcaggagaaactcctgtcgtcggttccttaaaaaataatatgtagcatattgatcaagataatttcacttcaatttgccactacacctaaaacaaaattacaaatgggacgcacaaaactacatttttttgaaaaaaaaataaaagtgacaaaaacaaaatacaaaactacaaaatacaaaatatgaactacttcattaatatgtagcaaaatttggccatcactgcactggcaagcaaataactatagtagctttttgcagaaacaagaaagaggaacaccttgagccttggcacgacggtgcgcccctgctatcgaagagctcctacagcgtgactgcgacgtctcgctgccctccaaaaacgtcgcaccgtgctcgtcgaggtcccttgtcatccaaccatacagctccacccgccgcgacgacacggagccacctaaaacaaacaaacatgaccaaataaaaaacttcagcgtttgttgtaattttttaaaataaaatttaaaaaattgacaaaattaaaaaacaataataatttcacattaatttgccagtacacctaaaacaaaattacaaaatggacgcaaaaaaccactagttttgaaaaaaaaaattaaaaactgacaaaaacacacacaaatatgacaaaaacaaaaggaacaaactaaattacaaaaaatataaaaactaacaaaaaaacaaaatacagattacaaaaattttaaaactgattaatatatagcaaaattttaaaaactaacaaaaacaaatatgaaatacaatgacaaaatacaaaatcatagttgctatcaagaagatagcgcatcgacttgatatgtagtaaaattataaaactgacaaaaacacctaaaaattcgctaacaaaattacaaatgggacacataaaaatatttcttaataaaaattacaaaaactgatagaagaacaaacaccattttgctaatacccagtaaaatttcctgacaaaactagcctctgttgactgagaaaggtgaaaccattttgcaggcaaaacaaaactaatgcccacagctagaattctactcacaaaactaacctctattgactgataaggtggtaccattttgaagacaaaacaatactaagattagatacttgattgcaaaactaacaaaacataacatttatggattattgcaataaagctccagtgaactatttgtaaacaaaatagttaaacatatctgtaaacaaaataatgtccccaatatgctagtgattgcatcaatttttcaaaacagatattatagatttgttcatgtccaccagatttaataaaaaattccactaattttatcatctaaagcgacaaagattaattcccaaaaggataaaatgctgaaataaaagatgtgcatatacatcggtccaaaccatgggattgtaaaaaaaaaagataatttatatcaggtcgaactgtgcctagggagacaaagcagcatggggaaaaggtacgcacaatccctaattaaattccatttgcatatgaaaattgagagcacaggcattcaagaaatagaggatatactataggaaaaaaagtacaaattactccaccgaactatcgtggtccactaaattaccccctaaaccataaaaccggatattcttcacccctaactatataagccggacgaattacccctcgacccaatctgcggtggttttggtttacgtggcgtatgcgtggcagtctagtcatcattctatttataaaaagaatgtgggacccacctgtcatccactattcctctctctcactcttccctctctcactctctgtctcactctttctttctctcttacgcgcacggcgccacggcggcgaggacggcggcacgcacggcagagcacccgcagcacgcggcggtgcgcggcctcggcgcgggcgaaggcgcggctcacgagcctgcacgccttccggtcgcgcggctccctcacccggtcgagcacctggccaagcaaatctagcgacagcgccgatgtatcgaggaggctccgacgacgacgacgacgacgactccaccggctggcaatccttgcacgcggcggcgcacgatccacctcgtcgccgcactggcagatcggtgggagagacctgttgcagatggcgttgtcgcagcaatcttcccacggcctcggggtgcagaaggggcccgggtcggctccccagtagacgtcgctgcagatgagcaggcccgacggcgacgacgcctcctcgacgtcgttgcagcactcccacggcctcttcttcgtcggcatcttgggcgactttgctccgtcgctggggaggtgtatcgatttcattgtaaccactattggatattgcattgcattatagatcaggccgatcaaatgtcactcaaattacggcgccggatgataatcatgagaacaacccggtgctctatcgttggatcgctgcaatggatgggaaaatcgtttgtaccttggagatcggggatagactgggaatgccggaagagaagcaactgctagtcgtcggtggcggaggcggtggagcggaggaaaccgaggaggctgcggagcccccgcgcgcggaggaagaagaagtcggccttggcatcgcgcagccccgtgcgcagcgccagcgtcacctctgacctcccggtacagacgccgccgcgccagcgcctccgcgagctccccgccgccgccgctgcctcccgcagacgaagatccctccgctcccgatttcgcacccgtgctacctccagccgccgccgccgccaccaccatctccttccggctcatccccgctggagacaccgacgacgacgcggaactcggcgtggatggggcggcgcgtcgaggacaagagcgcgcgcggcggagggaggtcgaggccttgagcctgcgaccgcgtgcgtgccgccatcctcgccgccgcctccggcccttgtccgcgtgcgtgcgcg

SEQ ID NO: 39156 - DNA, 23839 bp, Oryza sativa
gcggattgggttgaggggggtaattcgtccggtttacatggttaggggtgaagaatgttcggttttgtggttcaggaggggtaattcgatcgaccacggtagttcgggggggtaattcgtactttttcctatattataaatcacatactgcatctccattctatgcgccaaataggatgtattataaaaccatcgatatagctaaatcacttatatcattgcacggaaccagtagaaaaaacacagatctaataacaaggtgcgataatcacatcaacggttctgtcaaaaaaggattcacaccaacggcagcggtggaggagaccttgcttgcctcgtccctgccattggaaaatgccttgcctacctctgttgctgctgtaatcttgctgcggcggcgaggctccagacgccgccgtcgatggcaccgcggcgacgccgacgataatcgccgtctctcttctctgcgtgagtgggggagaaaaatggggactccaattttgaacagttactgggtgtttggctttggacttggacccgcgcagcatcgcagcatgtcagtccgaggcctatcttggattcagatctaacaaaagaaaaccggttcaagtccggttgcctggcgggcccgaaaccccagcaccaatcttgaagattcctacattcctacgatctcaaattcggctgataaaacacaaaaaatcagcaggccgttatatagcaaattcgtaagtttgtttttttaagtatctctacatatgtacttatccggttgcaggttccatctctaccacgtccgcatccgtacacacaatcatcacgtagtttgtgacgatcgacagctcaccgacgcgtcactagttaacactaaatcatacgtgcacactaattagattttgtgcctccaaataccgggtcgacatatcttcagacggataaaattaccacaagtgtttctactgttgatggaataatacgtcgcctagcagttagaactcgggacttaatctagaccaggtcccagggccctccttaccatcctaggtcttatattcctccttgggaagagtgtagagacctacaaaatttacatcgccgacctatataagaagagtaggaagccctcagagggcataaccacaatcagatcaatagatcaatacaccaggaggatacaatccaccaaaataaaagtaaggtatttcctctaatcaatggggcttgaacctgtctaaacctttgtctctgcgcatgtattcacttttagatctcgtgcatagctctataaattaacattgatagttggcattctaggtaggggttgtgtcaaagtatctcgtcgacaagcgcaatggaatcaacttcaagagtcgctggatatttcttccctcgaggcaagcttttcgcttcagtgacttcgatttctttgccgatgactacgtacagcaagctttctctcgccgactcggatccaaaaggcgagttctatgaaccactaccatcttcaaacccaattctcacatttggttattgttgacagtcgttagcaatcagtttcgaccgtcaatattaccaaaatagaggagaactagtgatgcttgcaatgcatatatctattagaataataatattccactagtattgggtatactaaccttttgcagggaatgacaataaagtgaaggagaatcgacatcaactcaaacgataaatcaatcggacgatgtcgagaaccagacttatgcatgaatgggccaagaacttagaattgacacgataaactgggccaaaattcacaagtctgcgaagagaagcaacagaggaggccggcagccgaaatttggctggatcgggccggccccaggtttggccgaaccagggggttcggctgaaccctccttagcgccacccgatccagggcttcgcctggacggtgtggattagcccccaatgacggttggagggcatttccgaccattccaaccgccacaaccgtcattgggaggctataaaaggagttgccattctcacttcactcacacacctcaagcaatagctctttcatttctctcaagtttagtttagtagtatctagctggtggaatagaaatagaataggagtcaggagtccggaagccttcgggaagagttcgggtaaggctctagcagctttcctttcctcttttgtaagctttgtacttttattagaatactcttctttatacatttatggtattgaaatattttccgagtatatgagtacctactttacattatgttcatgttatactgaatatacggctagcttatctgggagatgctttggtgcgggtataatgtttgcttatgcaattactctatcatgacgatgatattagagtatggtgtctagattacgagataacattatttggggttatatattgcggatgagaggtgggccgctgatggtgacagctcagtacgggtattcctccgtgcctatatataatcctaagttaattcccttggaagggtattcctccgtatttagccccggttgtatggtcgtgatgggctgtcgtaagaaactcggcagtcaggggtggcttctcgaagtaccaggagggcatcggatagagggtattagctagtataccagttaactagaatgtatgtatactatgtataattgtagtataggaatagatttcctttctcttttctttccacttagtttagatgacatattatgaggatgagtagttatgcttgtgtgtcactctacccttggattatcttaacccctgctagaatatgattatcacaagtaatatataaattattagctgagttctctctacatgatcttcccacgggataaaataaatacgatacccttgtaatactctcaggtgaaatgttacaatggtatatccgtgcgcttgcggataatctctgtaatcataatatactagaagtatttctgcgccattgctgggaattatatttctagtaatgtcgttaagaaataccaacaattatgaactcctccctagctttatagccatggtttgggaccaatccttctccagacttgaccatgaaaaatctataccaccatctgcgagagtttgagcaaccgtgctcgtgcatgatgatttcaggcatgacacaagaaactctaaataggaagttgttcccgttctctcatagagcgcaaaacaatggtatattatttccatagttagtacaaatggtaattgggaggagctaagagacaaatttttatcttggttttttccctttgtcccatgtcttcccctagagaagagagattctttactttcgacaaaatgagaaggagtctattggtatagcttgggctaggttctcgcttttagtgcgatctaacctagacttgtccattcctgatcatgtgttgctacaacacttctgtttgggtttagacaaggagtttgaccattatcttgacattacggctgaaggatcttttgcccatgaaacactagctagccgaaggaagggaaaccttatatcacatcttagaaaacacttccttcgttgccatatatgagcccctccaagaggtaagcacgtccagcaatgaggtgtccaagcctatacaaattgcatattactctgcgcatccataatacattttgcacatttgcccgtttctagtctaaaattcccattcttgctccttccttttcccatctcctcaacaactccaaaccagagtccccattccatagttcccatttgctcccaatcctaaggttaatgtgagaagtgatgtgagtgagggtgagctagcttggggcttctagctacgtcgtcttccttgtcgcggagacggccacaacggcgacgcctcccatgacccatcaggggcggctgctgtgtcgctgtcggcaacagctgctacaccgccctcaaggttttcgacaagactcagctactgtcgcacgcactgggagctgtctgtgctctactgcctcgcatgcccacaagcacagctgcaggcttgcaatgaggaagaagaaatttgttggttgtttgacttgtttccttgaaataaggtacatacactactagaaaatcgatttttcatggcgtttggaaaatatttttcatggcggccatgtggaaaaaccgccagcgcagaaaatcgtgggggtggggggtcaagggccgccagcggaaacacatcttcgccagcggtctacttaagaaggccgccagcgaagattggatatcttctctggcgtctctcttaagctcatgccaatgaaggtattgtatcttcgctggcggtaaggggatgcggcccgccagcgaagatgtaggtgtctttgctggcggccctcttaacataacgccagcgaagataccatatctccgctggcggtgtggtgacgtggaccgccagcgaagatacctatatcttcgctggcggcgtccttaagcctccgccacctcaaatcattttcaatggcagttcaaacgaaccgacatatgatgaccgccagggaaaatgcgctgaactatatgaaccagctacagtaacctcgagcaccattaggagcatgattttctctctcttaagaacacatatataggggggaaggttttgatcttgaatcttttgaaagatttattgtaccagaggttagttataatttgtcctactctttttgtcaactttttttttcatttttattggttgtatgttgagatttttcatcgcaaaaaatacttgacatggagaaagaaaattattttatatttgttatttggagctcaaaatggcaaactttgcaagaaatattgtgtatgatcgatgttccatatatatatatatatatctagttttcgataggtttatttttagcagatttatatattagttaactgcaaaagaatgagctagctaggaagagaagaagagaaagaagggtagtttggtaattcgtccgagggatgtatgttttatatatgcagatttttggctagctttaattatcttgttcaaaatatttaaactaactaaagttgtattattttttctgcaattaattaattaatgcatagatggtggatagggcatggatgaataaagagagatatcgtgcgtcgtacattgaaggagtcgacatatttatgaaaacagctaagaagaatgctgcatctaagaagaccaaagatattagatgtccatgcgtgcactgcaaaaatcagaaaagttggaacgatccatctgtaattgagcaacacttggtgacgcatggatttgttgaaagctacacaaactggtcacatcatggagagatcccagcaagcaagtgccgaactaggctacagtacgcgacgaagtgttgagctgggacgaggatgtcattgtagtagctgaagaagaagaagaagaagaagtgcatgcagtagaacccgttgatgattatgatgaacttgttggtggcaatggtcagcacaatacagttgatgatgccgatgatggtaatgtcagcgtagatgatggtaattttgcagatttggaagagatgttacgtcatgttgaacctgaggttgttgctgggtccgctcgtgggttggataactttgatgcattgaaaaaggcagcgaatgatcttttgtacgatgagacaaagggctgtgagaaggatttcacattgttgcggacggtgcttgagcttatgagattgaaggccagaaatggttggtccgacagtagttttaatgacttgttggttctgttgaagaaactttttccgcaacccaactccctgccaacaagcacatatgaagcgaagaagcttatatgccctttgtcactgggtgtgcgaaagatacacgcgtgtgttaaccactgtatcctatttcgtaaagagtacgaggatttggatagatgcccaacatgcaagagtagtcgatacaaaacaagccgtagccagtccgagggtctggatgttgcccttgacgatgtagaagagtttgatccatgcaaagacagtaacaaaaagaagattccccagcttgtcatgtggtaccttctggtgaaagatcgtctaaagcgtttgttctcaaacccgagggatgccgaattgatgcgctggcatcacgaaaagcgaaaaaaaggatgggatgattcgacatcctgcagatgcaagacagtggaaggaatttgacagaaagtatcataagtttgcagaggatccaagaaacgtaaggtttgcattgagcaccgatggaatgaatccattcggtgacttgagcagctcacacagcacgtggccagtactcctaaccatgtacaacctcccaacatggctgtgtcagaaaaggaagtatatcttgttgaccatccttgtacagggaccacgacaacctggcaatgacatggatgtttttggagcctttgctggaggatatgcgcgatttgtgggaacacgagatccaagtttgggacgaattcctgcgggagtacttcacgctacatgcaattatctttgtcactgtcaacgacttgcccgcactattttccctattgggacagatcaagggaaagacgggttgcgttatttgtgtggatggtaccgtgtacaggtatcttaagggatcgaagaagctagtgtacatgcggcaccgccgtttcttgagaaagaatcactcgtaccgctcccaagcagaatattttgacggtattgttgaggaaggtgatgccccagaaccatggaagggtgataaagtgttcagaatgacaaaaaacctgaaggttgtttttgggaaggtaaaaaagagggaaacaaataagcggaagagaaatgatgccgaagtgccagcaagccctagcgtgccattcaagaagcactccattttctttaagtaccttccgtactggaaagatttagacatacgccattctatcgatatcatgcacctagagaaaaatgtcttcgatagcaccattgggactatactggacataccaactaagaccaaggatgggctgaaatcacgtaaggacctcgtggatatgcaaataaggaaagagcttcatcatgtggatgaaggtaataatggaaaagtgtaccttccgcctgcttgctacaccttgacaagagaggagaaaattgcatagtgcaaatccctacatggggtgagagtgcctactggcttctcctcgaacattaagcgactagtgtcgatgaaggatctgtcgctttcaggctacaattcccatgactgtcatgtaatgctcacagtattcctcgccattgcaattagagtagttgaaccagttcacgtaaagctggtcatcactaagctgtgttatttcttcaattgcatatctcagaaagtaattgatcttgaagagttaggtcctctctgggctttcgctatacagacagtgtgcgagcttgagatgtgtttccctccatcatttttcgatatgatgcaacacctcatagttcatatcatgcctcaaataattgcacttgggcccctgtacctgcatcagatgtggtcttttgaacgatacatgtccattctaaaaggctacgtatggaaccgcgcccacccagagggatccatgatagagggttacacaaccgaggaggtcgttgagtgttgcattgattacctaaaagatgggaaagcaattggtttaccggtacctcgacatgaagcaagattatctgggaaaggaacaaaagggaagaaaagaatccacgacaatgactacaaaaaagtgaaagatgctcatttcactgtgctgcagcaactcgcaatagtggagccgtacatagagcaacacttgcatgaattacaagcaacaaatgtggggcgatctaatgcatggatcatgaagaaacacaagcatcactttactgaatggttcaagaacctcgatctaccagatggccataccatggaagaaagaacaattaaaatgctgactgacgggccatcaagtgtgtataccttgtggcaagcatatgatctgaatggatacacgttttacacaaaagcaaaagacaaaaggagtgcatgccaaaacagtggcattcgagtagaagcaatcgacacaactgggcaaaagagcacatactatggattcatagaaaaaatctgcgaactagactacgggccaaatatgcagattccactgttttggtgccaatgggtgaaacacccagctggcgtgtctgtggacaattttgggctgacaatagttgactttgacaacgtaggccacaaggatgacccatgggtgcttgccgatcgggtcgctcaagttttctatgtgacatacccatctcatttgaagaaagacatagttatttcgggaaaacaaaagattttaggagttgatgatgtcgaagatgtcgaggcatacaatcaatatgagaacatgacactattcacagatttttgaaacaagatattacgcgtcgaagaatcaattggtgaatcgccgaagccatacataagaaatgaaggtgtagggaaaagtgttagatgctaattcataatatatgtatatcttgttggacgtatcgatgaattttaatgtattataatgcgtgacaatgatggatgataaaattttgtatatggaatatggtgacatgataattgtaggatcaagaaatagtttggtataaatttatttgtatgcatgcattaaaaaaatatcaggcgcaaacattaaaaaaagtaatattttttttgataaattaatcatatatgtgtagaaataaataaaattattttttcagttgagaatgacatgtggggccaaagggttttcgctggcggccggctttgcccaccgccagcgaaaactgttttcgctagcggcccacataagctaccgccagcgaaaactgttttcgctagcggcccacataagcttgctgccagcgaaaacccttttcgctagcggcccacagaatcctccgccagcgaaaatgttttcgctagcggtcggtgcgttcctccaccagcgaagatgtcttcgcctataagtagctagcgcacgcggctgaaaatttcctatgtcacggagtcgcgcgaaccctaaaatttgtgccgccaggctgccaaaatttcgagcgccgccgccagcgataaaactagcaccggccaccgccgccgcttcctcctccattcgcaccatccacttttcggacatagctcctccattctctccacctcctcctctccgctgtctccaccgccgccgcaccagatcctcctcctctccaccggctcctcctactcgggccgccgtctccaccaccgccgccgccgccgccagatccaccttcacctctaacccgccgccaccaccgccaccaaatccagctacctctcctctgccgcctcgtcgacaccgctggtcttctctccgccaccgccaggaccgtcgtcgccgcctctgggacctcctctcggtcgccgcgccagtaccgtcatcgccgccaccgagatctcctcttcgctgcctcctcctctcgaccgggacctccacagtgagcccacgccccctgcctcctctcgtttactattggtcaccgattaaccccctctcctcctcctcagcgccgccgtgccaagaaaccgccgccgcgccgccgtgccgagaagccgtgcgccatgtgccggccgggactcgtcgtcgccgtgcgccgcctcctctgctcatcgtctcctctccaggtacccctctctctctgacgtcgatgaatggaatagtgcagtggatggatgaatgaatgaatggaatggatgaatgaatgatgaactttggatgaacgatgaattttggaatgggtggatgaatgatgaactttggatgaatgatgaattttggtatgattatgaatgaatgatgcagcagcagtccatggaattttggatgaacttttggatgaaatttttgatgaattctatgtgaattgaaaatgcatatgtataattgtgcgctttttttgtcattccgttcagattgttgcaactgttatttaaaacttgaatgtgtagctagtttgaaacttgaatgtggatttaagtgccattttgacatgtaaccattcatggagtgtatactgctttatatgttgttttgttcccttttgctagaactattgaattttgggggataatgtttacatttagctgaaaaaggatggattgatagattggcaacagtgtggttagctaggtagggtagctagctagaaatagtttgtctagctagctagttaggggttatgttcccttttcctataaataaagcatatacagggtttgaagtttagttcaaatggaagaattgaaagattggccgcatatttaatgtagttccgaggttatcaaaccatcacagaatacaaaatgcatggggaattttggtggatttgtcagtgtagtccaaggacggaaccaacctagacaccaaaattttccatgcattttgtattctgtcattctttgataattaaggaactttaggtttagggtttgaaatttagttcaaatggaagaattgatagattggccgcagatttaatgtagttctgaggttatcaaaccatcacagaatacaaaatgcatggggaattatggtggattggtcagtgtagtccatggacggaaccgacctagacaccataattctccatgcattttgtattctgtcattctttgataattaatgatctcaattaggtagtttgaaatggtcagggttggtggattgtaatattgatgtcgttaccaatctcattgattgctttaagcgatcaaggagtttgctagcgataaaaatatttatagttgtagtacaaaattagtatctaaattttgccttctttttggatttacaataataaaatgattccattttgcaactaacataaattcaccttcaagcgatatcaatggacaaacccacccaagagcaacccacgggtgacaagggcaaggaaactcagctagtcatggaggaagatatttgcatgcaagtagtcgcggaggaatcttcgttgtctagctcaagtgaaccaggcagtggatcgtatcactcgtcgagtgacccccatccttctcctgcaaagaagagaaagggcggtagcgacaatgaagttgactccgactacgttcctcccgaaccggtggtacgtagcatataatatatgtttagttccaatcatattaactgcgaactatggattttaattaaagtcacatgaattgcaaacaatagttgaatgctccacgtcgctccaaaaggaaagaccaagccgcaactaaacctgaagctgaagctacagctgtcgtgcgcacaacagcttcaagcaaacccaagaaaaggagggtcgagcgagggaagaacatgctgttgaaggaagtaagcgttctgacgcggatgagtgagataggggaacccctgtcaccggaatactcatgttcgaagtatagcaaccaatgtggggcggtggtcagggatatcgtggagatcacatggaaggattggaagaaagttccagagagtagaaagaacagctgttggacgtcgctgcaaagcaagtttgaatatccagaggggacagatgacgataaagccaaggattatgcgttgtagacaatggggaagctgtggcgaaactagaaaacggacctgaataagaaatatgtccagaagggactcacgccatttaaggctacggaaggataacacaggcccagtgggatgagttcgttgcccttaagacatcggcggaagaaaaggagaagagccagaagatggctgagctagcaagaaggaatgaatatccacatcatttgggctcgaccggttaccggcaagcggtgaagaaatgggcaaaacaagatgaagagatggagaaggctgggaaaccagttcctacgaaaaatcacaacccatgaagcaggaactgggtgcgtgcaagaacaccggtcttcacccctgagggggatgtagtattcaaggatcagaagctcaaggaagtagctgtcaagatgaagaacatcgtcatgcagcaacaggccgggacgttcgtgccagatagagaccgggacgagctgatctatgccttgggcaaaccggagcactctggctatgtacggggagtttcctcaaagactagctggaaggatggattcaaacaggatgcttatacctacaagaagtgtgatcgctacaaggaagagattgactctcaggctagggcagcagctcgtgacgaatgcaatatatactggagtcagaatatgatgcacggtgctgctgttttagagcctgagctgagctatcctttcgatgatgtaacggaggatactccgtgctagctcttgattccggtcggcagggcgggaaagaaaatactcgttgcaactgggaggttcataccaggccgcaggtttcattgccaagacattccggatgactacgtcaaggtagtggtccggacggtcattaggcttaccggatgcacgagctcgactttccaactactgagcagattgtgtaccttggagatgccgtcgaccaattcatactatggcacaagaatgatattgaactagggtcaacggatggaattgatcgtccaccaaggatatcggtgtcaccgtcgcgtccaccagtcgtagccagtccgagggatagtcctattgcttcacgccctagaccagagccactagttgcatcaccttcaggaccagagccaccagttgcatcacctcctagaccagagcctcctgttgcatcacctcggaatgaaaaggatgcagaagaacaatcggtgcttgcaaagcaacaatcacagctagcaatacaggaaatgtctcccgcacaaccatcagagcctgtacaagcagagcctacaaagctagcggcgggtgaaatagaagcggtgcctgagcagccaatgcccgaccaaccagagcaatcgcaatcagagccatcgcaaccagaggaacctaagggtgccgatgtgccagtgatggtaaggacgcacaagcacaaagcaaaaagtgcgtccaagaaacattatatggtaacggcattccgaggaagggacaaagatatcgtaaatgccgaatttgataacagaaaattaaaagggttcaagcagacctttgatgactatctcaactatatcaattccccagacgtgccacacgagtttgagaatggcaaaccattcatttacgactggcaactaagagaaggaccgtagcaactaagaagttggtacgattggtacattagggcaagcaccatgaaaggcatcgattcattcacagttgccgtgggggagaacatcttctggagcggtccttgtctactccaagcccatttctccgatatgcattccctctaccgtaggaagaggccggacgccaatttgattgccatctggtgtctgttgtcacgaccggaattgacccaacgggcgttccttacgtgcgtgtattattccttgtcccaggaggcaaggtacaccaaaagttgatacatttcagagtttatcaagcggaagcgtaaatagttaatttattacatgggcagcgaaggcccagcacatacaaagacaaacgagaaacagcggaagactagggcgacgaccacaggcgcttgacggcaggcacgagctagacaccaaagccttcatcttccagggactcctcttctgggtttggaaaaattgagcaagactgagtacaaccaccgtactcaacaagacacacccacaagtgcaggataaatgtaaaggagtacaagggggttatgatataaagggttagggtttgcagtaaacagcattaaaagacacttagttgctcaaagctattttgtaaacacgtttccagagctatacaatattattaatcaaggccgtgaacccaaacgagcctgccttaacccaaggcctctgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgaggtgtacatctttacccataagacacatcttcctcacgtgtagccacgtgccacataccaccacggtatacggacggaagacgtgacatactttccgacccatcctagccatagacaagagtaccgacccaaccccacctatggccggaacccctgggacaggtaggcaggactgagcccctagcagcaggacactggccctgtgccatgacatctcgactaccgggccgcagctcgtgtagccttcatttgtcctagagatgtccatcgacctccgacttcgtccatctccatccgtgtacttttgtttataaccagactgagccacaaactaagccttacccactagacatgtggaagtacggtagtgctttgcaatagaggcccgaagaccggtccttatatggccgaggtgctactatcaaaaccatgcaccccgagcccagcctaaaaccattttggggattttgaatagagggggcggtgtgaatccaattccacaataatcaaaccattccataatgtccaggtgatgagaaaatcccacagtctagagttgtaaaaccacttaatgttgcctaattaaccagcgaagcatctacctaaaatcatactagtggtaccatgagtagagtgtccactagttggggttttgtttattctagggtgaacaaggaaataataacaataacaataataaggtcataacaaaggtaaataggcatggctagataaaacagtgataacacgggaatttaaataaagcgataatgcaataatttaaatcaaaataattttataaactgggattcaatatgttcaaggatgatgtgacttgccctgctcgctttcccaaacgtcggcttcaacctccacgaagagcggatcttccgaagctgcagcgtctacacgaccaacggaaaagaaaatgcttttactctaaaaaactccacataacaagctgaaacaaagcacaaaaatgggttcttgacttcataaggaaaaattagagacatgaacggtccaattccgagttcaaatggccaagttatggccatttgaagtttatatgctctttaaatgaatatttgcgaatttattcatttaaattttaattaaaaaaaggtttattgcgtcagccgaggggaggggcgcgcggaccgggtccacaggagtggggcccacgcggcagccccacggtccacggtggaccgggcacacccgggctcacaccggccggcgccgtgggtcccacgcgtcagctggacccgagggcgcgggcggctgacggccgggccccacgcggcagccgctcggtgcgcccgaaggcggccacgctggcgcagcgacgggaggcggcgcgcccgcgcccctatggtcgccggcggtggccataggcacggcggagcggcggccgagagaggggagggaaagggggaaacgaagcggctgtccacggctcaccccgggtcgacggcgacgacggaaacggcgaccggagcggaggaaggcggcggcgcggctcgggtggacggggtcgacggtgctccggcggtcggcgaccgaaacggagaggtggacgaggtcggcgaggatgcggctaagccgaaggaggcggcgccgaggtgggaggtggtcggggcgacgacggcggcggaccggagctcggcggcgacggcggagagagagagcgacggcgcgagctcgattccggcggggagagagggcggtgagtggcggaaacggtggtggggagctcggggagggtttatatagggttgggagtgagagagggcggccggagaggtggggaacgggcgtgggagacccggccgccattaatggcgccggcgaggttaggggagaggtttccaaacgaatccgagggagagagggagggaaaatggggggaaagggggaggggatcccggggaataattccccccactttattgcgcgcggggacggcgggaggtggcgggattcgcggcggcggcggcgctagggcgcgggcgaggcggcgggagcggcgggaggaaggggatgacgggtgggccccacccgtcagcgagggtggcgggcgggcccgcccgtcagcggcgcgcgcgcggggaggaggccgaatgggccgcggggagaggagagggagggggaaggagatgggccgagccggcccaagagggagagggagggaaaagggactttttagagcttttctttttataaaaccattttaactttgtttatttcttaataattattatttgtgctctgaaaattccactaaaatttatttacgcattttagacttttaggaaatatacaaaaatcctccaagccttatttgacttttaaccttgcacattttaattgttggaggctttcacacggattttaattattctaggcataatttagaggatgtattttagagtcgttttgggacgtgacatctgtaagtgctacacttgaacgtgttaatagatcactacacctatatgcgtagctcatttgatatccattgttggcaggatgaattacgtggaagccgaagcgatgaaaaagcctgtcgcctacctaaacccgtgcaggataagtaagccgaaccacacatacacggtagacgggaagaagctaccggaacacatcaaggcgatgactcccgaagagaggaaagcttacgtagcacaaaggcatcatgaaaaggtgctcgatgtcgctacgtacgtagctattgcgcttgaatctacgcaggacaaggagtgtgtttatgccccatgtgcctttgagtaagttgtaatatatatgcactgagagtatatacatataatcatggctcgactaacaatttcgtttgcagcgaccattggatagtctttcttctctatccaaagtacaatgaagtcatcatcttggattccctcgacaatgatagcaacacctatcaggaatttctaagaattcttgatctgtaagtaagatattagcatgacgtgttttaacctctgacgaatgtaaattaattatatctgcaaacagtgcttttaaaaggtattaccagcgaggcggacaacgcaaaaactcaagagaacgcatattcgtccgcaataagtggccggtaagtacatatggatgccaaacagtactagttaattttcataaatgcttgtgtgtttccatttaataacctaatataccttataatcattttgatgttgaaagtgtcacaagcaaccggtgggaacagtattatgcggatattactgctgtgagttcctaagggttaatgggaaatattgtgcgaattacaacgaggtaagtaattacttgttaaattagtcgctaacttgtattataatacacacttgttaaattagtcgctaacttgtattattgttaataattaatttccttaattctgtcatgatctgatgcagcttccaaaattccccaagtctgaaagacagctcgatgatacttccattcagaacattcaggcagacatgtgctacttcatccaccttgagtgcgcacatcagcttaggcgatttttcgacaatgaaggagtcttagccctgccggagaatgaatccctgtctaactggaccaggcgtataatatagctaggattttgtaattcattcaaaatacttgtaaatgttatgtcgtcggtcaaaattaatttatcaatgtacatatatatatatatatatatatatatatatatatataggtgtttccgaattactatatgtatattattctacttcatactcaatgtgtggctctaacatacgtgaaagagaacatactctatcgatagctcgattagttatatcaaccacgtgtgactctgaaacacgcgcacgaacaaaagaaaaaaagtatatataataatgttttaaatttttttaaaaaaatttgcatcttcactggtgggccacatgtcagaactaggacggtccatatcttcgttgtcgggccacgtgtccatccacataagccttagtttatttttcctagcgtgccacgtggcctaaaatactgtgagccgccagcaaagaattatcttcgctggaggccgtcctaaggctactgccagcgaagagttctctttgctggcgggcgttcctttcttgcctgccaacgaagatgcgttttttctggcggtaaataaccgctagcgaagatcgacatttttattggcctttgctttgtggcggctgcgattttcaccagcggaaatccaaaatggccaccacaaaaaatggttttcgtattagtgatagtgacaagtatcgatgtgttctcaaatcacaccataaagtttcaaatccgtcgaatcatagtcgaagttgtcaaaatcgagttccaaatctatatatagagaaattaattaagtattagcctaattttttttttaaaatcaattaatatgatttcttaaagcaactttcctatagaaaacttttaaaaaaacgcaccgtttaatggtttgaaaaacatgtgcgcgaaaaaagaggaaggtgggttaggaaagaaggggaagaacagtcttacatacgtaacaatcctttctctaatctaatctgttcctcatctacatgctataatgcattcaaactctgttgcagctgtactagtacacaaagcccttatggcagataaatttggaactctttgcttcgaataaaaaaaaatctgagaacactaacacagattgcacatcaccgatcgaaaataataataataataataatacaagggaactatttcaattcccatcctatattgctgccttatggaaagacctcgataatggatcgaatgcctaacacaggactaatcttgtactcagtgaacccggcctcgttgaatatcttgaaccactctttctcatccctctccatgcctggtgttagcatagaaatggttagatcaaacagcagttgggttccatagcacattgcttgggaggaggatccaaccacaacatcaatgataatgactttccctcctttatctttagaaggaattgcctccttgcatcgttttaatatctttacgcagtcctcatcactccagtcgtgtaggacaaactgtaatcaagaatatttgttaccatctaaatcactgtactaagttcctactgcctaatatatactatacactactacaaaacccctcgtagcactagtgaagaaacaatcttttaacaccggttgaaaaccccctttagtaccagatatagcaacagtgataagcaaattaggactaaagatcttgatctttactgaataccaagtaaaaaaaatgagtggtatatgggattcgaactcaagatctcccacctcagccctcacgcgtgttaccatccaccaactacacacatctaacatagatagagatgctttcttttcaaactaacctggaggcatttttagtaccggttagtaacaaccggtactaaaaatttctttagtccgggttggtgttaccaaccgtaactaaatttaaatttttaattcgggttactattaccaactgggactaaagatcctccagcattcatctcggttggtaacaccaaccggtacttgagtagtaccagttgttaacatcaactggtacttgtttagtaccggttgttaacaccaccaaccaggactaaaaatgttttcagggactgggacttttagaactggtactaaagtatttttagtactggttcttaatataaccaagatattttttattttgtctaccacaacgaaagatcagttcttcagtagtgtaggtatcgactcataggtgtcagtttatttagaaccgacacctatgaacctttcccacctccacgcgatcacatatgggttggtttttagaaaaccaactgagccgagccatccttatccggccacccatccttatccacactgatacaagcatatcccacctctcggtttcttcctttccatctgccgccactcccctcttcctcctccctttctattcgctgccactcttccttctcctcctctccctggtggcgcccgtccaagctgcgctgcccctcctccacctcaccgcctccgagccgcgccacgtcggatctggccgcctgtaggtcaggagccgctagatccagcttcctttaggtcggtgcttgccggatccagccacctgcgacctcaccgtcgtggatcaactcgtctagctccaccgcgtccatgttatagttgattcgagcatcaatacaatctttttttttaaagattataggtgtcggttgaactggcaccacgcggatgggcaaaggtgccctaaattggtattggttgggcaagcggctcctataaagggtttaccagggtttctaaaccagcacctatggggccttttgtagtagtgataaaaaatgttgtcaaagcaacaggagggcatcacagatagtatgttgcatttgcattgcatattgctaagacactgaccttaagcaggagggcatctgcttgggggataaaatccatcatatcgcctgcgacaaactgaacaacgtcgccatgatcacaggaatggaatcgatcacgtgaggaaggtccagcaccgtgcacttgatatgcgggaacgcagcagccaccgccctcgccgccgcgccagtgccgcctgcgacatccacaagggaggtgatcttgtcgaacacctggcgtgcgccacggatggccgcgtccatgatgaacgccgagtcggccgccatggcatcgttgaagaaatcgccgagctccggggcgcgcctgcaggcgccccacaatccagcgccgtgcgccatctcgaacgccgtctcctcctcgccggtcttgagccactcggccatgctcgtggcgggcgtcacgcagagcggcgagtgctggaggagcacgaacggcagaagcgtcctgccggcggtgacgagcagggacgacacgggcgtgaggcggtagtggtcctcctcctccttgacctgcgcgaagacgcccgaggcgaccagcacgcgcatgacgcggcgcaggaaggggagcttggtcgggtggagggacagcgcggcgtgcaggtcgtggagggtggcgcggccgccggcgcggtggatggcgtcggcgacgccgagcttggcggcgcacccgagggccatggacctgacgtagcccaggctgtggtgcatcagctccgtgctggcttgcactagctgctcgtgctccatgatagactaggcttgggtgagctagctgattcactggtaagtgaaggctcgttcgttgtatatggttggtacgtggcctcgcattgctatcgatgtcacactacaaaattccttgtctgggccaggactgtatgagcgactgcttatcaggcatccttcctaggatcgaccttagcctcacattactatcggtatcagattatcaaaaagacaaaactccttgtttgaacaggaatatgtatgagcgaataatttggggcctttcatttttttaggtcccgttcgatcgcccggtcacttcacaattcttgtgggtaatgttccgatcacccacttaggattgcctcgttgatgggcctggcgagatgtaattaaacttctcttgatgtttttttttctctcctttgttttgtggctaggagagccagcgctctacgtcgtattttcttctacgttgtaattcttttgtatgttaggaaaaaaagtatgagcagaagggtattatactcatttctgtaaagaatatatctgtcaaagcaagaccaactacatatatagaggacaatagtgatgggcagtgaatttgccactccatccgagcatgctaactcactccagtcattgggaggtgatcttgtacgtccacgtggaagctgaggatcaatgactcagattggggtttggccgaaccttagctgtcacctcagcccgtgggcttcctcgttcgtctatcccgtcactacctgttaatgtacattgggagttactccctccatcccagaatataagccctctcgaaattcttcatggggattaaggagataggatggaattaaatgggatggttgtaattggttgagatgagtagtagtaggtgaagaaataaaattagagatgacgtggttgattgagataagcaagtgagtagaaaagtagctacattttgagacaaaatttaacacttctcatttgtcatatcttcttttgataaagctaatgcccactcaacacttaaatctcaacatgcaagcatagtattattagcactcctaaaacttacatgcaagcatgccacatcaacttattaagcacacaaagctcaacgtgcaagcatatagtaattatatctacaatttattttattttaaaactaaacatacacatgctaaatcgtcattctcaaatcattttcataatatttcaatgcaaatcatttcatcatttctccattatcaaatatatatcctgcagcaaagcgcggggcatcatctagctacatgtatagatgatgttggttgacatgtcaatttttggttgtgatgaatgtgtagatgctgaagtgacagtttgctggacttggttttattttgtgcacaaaataaatagtatatactttgtgtgattgtctttttcatagagtaaggaagcaaacagttggcgttatttttttaagaagaaatcttatgttcgtgtggctaggaacaaccttttcttgtattggtgaaattgtggctgcactatctcgaaggtctcgtaagccaatatccacacatctgaatatgtgagtttatttttcgtagagattttttatggttcaggattttattgatatcatcccctctcgagcctttgttaaaagagggcacactttactctccaccttttggctgagttaaacttatggagaacataaaatggacttgtcatgtgacccaatttcttcatatttatttccttggacacatggattgatcctccaccaagaagattggtccaatatcttgatatctgtttccttagtcatatggattggtcatccaccaagattgacccacttggcctagagtattttctggcttacttcttacttgcttctagtcacctttcatacgtgcatcaaatacaaattagtacccttgaataccacgtacatctcatttatggattttacttccaacattttatcatcttgatgaggagtatatttatcagtctcataatgtgtgttgatatttcttaatgacattactagaaatataattccaagcaattgcgccaaaatattattgatatatttatggttacatatatgatccgcaagtgcacagatataccattgtagcattttacccgggatcaatccaaggtattttatgtacttaatcccaaggaaagatatgataagagagtactaagctaataattcatatattacttgtataaaccaaagtctaagcaggggttagtcaattcattagtaggataaggttgacacacagaagaaagaaccaatgtattcttcactaaaatataatctaggctaagtggaggaagaataaaaaaagaatcattcctatacttcctgtatataggtaatttagtttacacttgctagtatacaatcatgcaaccaataccccgtaattatgctctcctagtgtttcaacagaccacccctgat

SEQ ID NO: 39157 - DNA, 10872 bp, Oryza sativa
caaaaacatgtttttctcaaaaactccaaaaattatgtttctcccaaaattcatctcttctcccaaaactcatctcttctcccccttttgacaatgatttcatcaagcatagaaattatgttcattaaagtataagagcttatcatacatatggcatatcatgtcatgtgttgcaataaaaagaagatgaaccaatctataacataacaagcatgcattaaagtataatcataaaccaaagattttataattaagcttgaatcaacaatcaaaattcatgatttcgtacgatttataatgcaacatcttaacaagcacataggttgaaaaataaacactaaacacatatacctattgcatttatcactctttctcaaattagctctagcacaaaataagagaattttttaaccttttttttcaagcctttttgctcatatttttctctcttattccgggtacgtccctgtcgtcaagactatttccagggattcggcacccattattttgctcacatcgaatacgtcattgtcgtcaagactgtttccaaggattcggtattcatttttttcatattttttattctcttttcacaatgagcaattaaagctatttgaggaataacaattcaataaagcatagatatagagcatttacaaataaaaccatatgctagcatcaacattgcatatttacttaattcaagtatagaatttaagtgtcatgcatcatctcccttaaaagtaaaatctaaatctcatgaaaagactagaatatatacaagctatgctagagacaaataaaccttcaaagtattgctagcatgcacaagaaaataccatatgtatagaacaaagctctcttttctcaattttttcattgtcatattattgcttgataaaaccatgaggtacatactccccctcaaaccatgccaaaagaattcacgaataagaactaactccccctcaaaataacctccaattctcttcgagcaaaaatcaagaagaaatcaaagattttgaaacaaacatccaatagccaaagatatcaccaatactttcaaaattgacatacatccattagtattaaccaaagctactatctcaaatactagcatatgaaaaagctaataaactagagagtagaacaaaattatgtcaatccaaaagtaaagtgatgttacctttcaacgcaatcgtcatctcaaaattgaacgcacatggggagtatgccaccaaaatacctacgaacgagaagatgtcgaggcctccgtgttggggttagaaataagaaattttggaatccaacactgagtcacacgaccagtagaaccagtaggtacaaatgcactaacaaaatcagaatcagacttacctgaaaacttaccttgacgcttcacaaaagtctgatttgaattatgcgataacttgccccgaggctggtctgaccgccgctgagactgcgatatgacctggcctggtaattggtctgaccgcccgttcacctgcggtttgaccgctggccggtctgaccgactggacaatgtcggtctaaccgtgctcctcgaattaaaacctgatttttgccaacgtcgttttgcaaaagcaatttctcttttctttttctatttatgggcagatctaaaacaaaaaccaaccaaatgtccatcttttccacaataagaacaagtgtacttctcacgacaagtttgtgaagtagatggttttgaaattgatggttttgcaacacaagtattaacagaaggttttgcaagcacaacatttgatttcgaagaagatgcattcaaagaagacatgatgccggcagatttaaacacaatattcttaggctcagattcaatcaaaatttcacctctcctagcaacacccaaaacagtaggaggatgtctagtatgatgatcataagaatcaaaacctaaaccacggttgtgcgtgctaactttggattgatcaagaatcatattgaggttctttttaccatcagaaaatctttccaaagaacttttcaaataagaaacctcttgtgtaagaacaacacaatttttgcatgcatccaaaagacctttttgttttctacaagttgagcaagaaaacacctcatcttgtttaacaatttcttccatgtgattaacacgctctaaagcatctttcaacttcaactcattcaaaccacactttgaacaatattgagaaatcaaagcaccattgttttgttttgccttatttgcacatgaaacattgaccaaagaacttgcacaaaaagcaactttgtatttttccaaaacgttctttgtcaaaatcaactcatcaacaacacgagcatgtaaagcaaatccaagagcaaaagaagactccaaccttttagatttttcaatctcaaattccaatttcttgcaactaatagaattgacatctcgcaaagcattaatttcagaaaataaaacttcacaagattgacaattattagcattaggaatcaaagattttaatctagcaatttcagcattaagaatctcaatagtatgatccttctcatcaagcacaatagaacatgtttgaagtttcttagcaaatttataagcagcatattctaattgatcataactaagcttttcttcattatcatcatcagattcatcaacaccagaacttgcattacgagcaataaaagctagatcaacaacttgcttacctttgctctcatcttcatcttccggttcatcaaaaacttttattaattcttgaattagccactgcatgcaatgcttcttcttctccttctccttcatgttcttcttcttgttcaagtcatcttctttgactcttacatcatcttccttcttgcctctcccaagcttaggacaatgcgagcgaagatgatcaagtgcaccacacttaaaacaacgattcggtccacctcttttcctgttcctaacattattcatagctcgagaaaatttgttagatagcaaaaccaagtcctcctcgaactgttcaagttgatcgtcgaacatggcattaaataaagcaagaacagaagacttcgatgaagaagcatcaacatccaaagaagttgtagacgaaaccaaagcactatacttagaatcacctttacgagaaagaatattcatctcatgagttttcagtttagtgtaaagcgaatccaaagtcaaagtagacatgttaacagactcctgaatagatgtaactttcatctcccaaatagacatgtcaaaaccattcaaaaagtgacgagaaatctcagattgtggataattagcatcataagaagaatcaacagatctaagatcactcaaaattttattaaacctagaaagatagtcatccaaagcttctccaagtttcatttcaaatttaatgtactcctttttgaaaagatcacgacgaagttctttaatgttatttgtaccttgatgaaaatttctcaaagcaatccaaatctcatgagcagtttgaagatgagcaacacgatcataatccgaacgagaaatcccactcaaaagaatattgcgagctttgcaatttagttcaaaagcagttttttcagcagcagtattaatagcttcaggaatcacataaggaagagaaacttttctccaaatatcataattctcagccataatgtaagattgcatcctactacaccaatgagaaaaaccgttctatcgaaaacatgaggcttagttgtaaacttattagaagcagccatagcaaaaactttagatcgattaaaatccaaagaagcaaacaaggctctgataccacttgtaggatcgaatcacaagaactaagccaaccagagggggggtgaatggttgatatacccaaaaaccgaaaacttttagcggaaataaaagttaccctcaaaatcgatggatcgtggtctgaccgaagtagatgcaccggtctgaccacctggttgccgtcggtctgaccgagattcaatctccggtttgacctccaagatcagctgccgcttgctgtcgccaccgccggtctgaccgcccgtataccgccggtctgaccaccgcttgtcgccggtcggaccatcgttgagtcgccggtcggaccgccgcacccgatgaaacacacatcgaagaactctcaaagtagatgacaactttattacttctctctgtgtttacaaagtgcaacaacagcactccttacaaaaatctcaactactcgaaaccctaactaaactagcaactcaattgctctaaaaaacgatacaaaagcgataccgtgaagccccacgctccccctctatttatacatgaggtaggcagcctaaagccacgaaccaaactcatactaagagtcctaatccccataggaaacctcctagtacaagaaacaaactctacataaccaatcataccaaatttggactccttccaaattcgactccgcatcccatacgcacacaatacctccatcgtatgccatatggaatctccataaaccacgtgcatcaactctagccttagtatcccgcatgatatctgaccaccacggacatcgtcttaccaccaagccgactcccggtccatcaccgcaaatactctcccgaggcatcgagtcacctacacatgaaacaaacaaagaaaccatattccgagaccaagctatcaccaacttgactcattgtattgttagcaaacaacagtattacatacgtatagtatccatctagaagccataaccatgaaacaaccacagatatccaaagaaacaacccgaaaccgaaaccgacacagcgtcggccggtcagaccgcgggccggccggtctgaccggcaaccaccgcccggtctgatcggtcccgacacacctgaaaatcaattatctccaaaaccacttcaacagtaatctccaaatatcaaaaccaataatcacagatgctaattgttcgtcaccgaataagaatcaaaacacacgttgatcttacagtaccagcaactctacattcttgaaattcacatcacttcattgccaatatctatactccttttaaaagagggcaatggtggtgacagtgaatctgccaccccactaacttttgtatagagtttttttaaccaactactccttcatgttttttaccaattactacttcatgtgctttaatattacaaaaaatttcttcacaattattcgtataatacaagtttattatacaaagacattaacaaggacaaaattgtgcaaaaacatcacaattaatttgttccaaacaatattagcacacgcataatttattttaatccgtagcaaaacacaggtacttagctagtaacattatatatttctttgtaaaaaaagcagaaaggacatcctcgcatatatattatagagaaaagagcgatatatagtgcatacatgaagcacaagacaatgataaaagaagacaatcatacccaagactgcgaaaatcgaaactggggtatttgattcccatatactgggaaacctatggaaatactttgataatggatcgaaaacctaacactgggctaatcttgtacttagtgaacatcttgaaccactcttcctcgtccctttccttccctggtgttagaaccgaaatattcagatcaaccaaatgttgggttccttggcatattgcttcagaagaagatccaactacaacatctataatgatgatctttcctcctgcatctttagaaggaataattgcttccttgcaacattttagtatctttatgcagtcctcatcactccaatcatgtagcacagactataatcatcaagaattaatgttatcatctaaaatgtgttaaattttgtactagcttagcttgctatccaatacacaaaaatttgttaacaacactacattatatatattggatatatataactgaccttaagcaggacggcatctgctttgaggttgaaatccatcatatcacctgcaacaaactgagcaacgtcgctatgatcagacgcgatggaattgatcacatgtggaaggtccagcatggtgcatgcaccatgtctcctctggttaccaatcgtgcattgtccagttgaccttgccgagaaggctaacccctgcatgcgaattgaagaacacaaacaagaacaaggtagactataactcaatttgcagatgaatgattaagatctcacaattggggttccacaaaccgaactaatggtgaaactgcaattacataaataatctaagcaaaacccaactctaaattatgatgactactgagtaaatatgattaggggtgttctagggttagccctaggacgtccagctattgggtttagcccacaacacaattacaaagtccaaggcctaaatcagactcgaactggatgtgatacgtggcttgttttacagattcccaatagttgagatggaattttaacgtgggaccaaaagcatcaaaaagtagactacatcagttttccaacaagtactcatgagccctgaaattccttctaaatcaacgacggtccgtttgaatttgatgttgttaggatatccgaatccgaataaaaaacgtgttgaacttcatcttttgccttgtatggaccaaaagtgacgcggtaatgatggagtacacttggagaaggtcttgtattggtccccaatcaattttattgatcatccgagcacttcgtgagtccgttgttcattccttgacccatgcaattatttttgcgaacgagaagatgcaaaactcatagcgcaataatgtttgttcaaatatatagcacgtaaatctcacatagaaagcatgcacctttggtcgatgcatacataaggtagtcatgatcatatctgagctagctagtgatgtcctcatcaacaatgaaagctctcctccaacaccgccaacgctgagggacactctccagcgaatcccctcatcctcccctgccaagctcgctctaaaactagtggtcagttattcctcccacccaccaccgtaccaccacaacacctcgccaatgacgaaaggcattaatgtagtgctaccaccccacgcggtcaatctcctcactctcccattcatcttgctttgtctatgtcaccaacaatagcacaccgctcgttgtcgactcctcccccaccctacccccaaaactataaacctaaccctaaccctaaaccacacccctaaccggcctaaccggtgcttgtcgtcacgccctagggaccatgcgcatgacctagcgttgatgcaccgatagacccccgtataattacttatgatactcttcgattccaccttactcttatcccttatcctctcccacatctatacattattagttcttatagatagctcaacttactctaccatagcatttactgaatctgcatgcctaaaatcgaatactgaagatcatttcagatctttcagaaccatatcttttttgacaattattccaaggactcgctaaatcttccttactgatctgtttatgttctatatctaactacaaccatacgttctgcagatacaatcatggattcaccaatattctatgtgatcatgttggacgcaacaaatcaagactatctggtaaatttaggtccaaataccttatcaccctgtacagtctcctgccaaacacccataataatacactactcggtttgtacagccggtgcctcttacaattagaacatgtcacctataggcatgcacacattctaagcttagtcacatcacatggcttgaagataaaaaccaaagtgagagaagcatccaacatgctctacatgacaacaggatggaagcaattcataaggcaactggattaaaaatcggagaaaaggttgttttcagactgttatcatagtcaaagctgcatgttatgatacttaacaaaaaaagaacccactagatgtccagtcacaggttaccccaacagcccaccgccggtgaagaagggattagttcctagaacaaatcattctgtccaggggcggagctaggtaggagaggggggccagggtgcccaagaatctggtcaagaaaatttttagctatagttcatctattttcaccatatgtgcacccctctcaatccaatttcaagcactcatatcagcctaaatttaatctaaagtagagtaaagcaagcgagtagcacccttctccattccattttagctccacccctgattctatcgaaagaggcacatctcgtatctcactagacagtgacataggtaaacatcttacattttcaaatttattcacttcacctataactttcattatccgttcatcattgtttcgcttacagatacaacctgcagattaaaccgcgcatgcaccaccacatccacacaagacaaaacacaatattgaatcagctcctataaatccaggtacttcaattactgtttttgatgatattgttaatgccaaaatttggtaagcccctaggagaattatcacatcgccaatagtcagagtcctgctatattcggttaaggaaattaatctatcaaaggaatcttatccagaagtgaccgagttcaagaaggatgcggcatgtcaagttatctattaattaggaatagttgttaagttccttttatatttaagaaagtgtgttcagtgtcctataaggactttatgttttccttttatctttaggaaagtttctttcttctcctacaaggactagtatctacccatgggtataaatatgtacacccggggtcattgtaaaatatctctcgatcaatacaactgctctcggcgcaccgccaccctctttcccgaggttttacttatcaaccggcagaatttggcacctgacgcggggctgcatctgttcagttcgatctccggcgaaggggtaagtcctacattccaccagccccagtgaatctatcggctacattgatgttgttcaaggttgcatcgcttcgatctcttggatcgctctggtttggtcgatatatttgcctacctgatatctcaattctatctctaattgcattgtatttagagacacatcggttttgttggaattgtctcagttaggtccgatcttctgtcttagccgatatatctctacaatcacaatgctgttataaatagatttgctatatccatcacattagacagatctattggctcatcgagtattagattaccacatataatctcatgctgcatcggttaggtctgacctactagattgttgttgataatataaatcttgttaagctgataggttcatgctagtgttttatcggggtgctagccgataagttatctggacgttacatcggtttataaggatatacatataagttggatttagccgatgacaacaaaggtttcattgatctatctaatcttgtggattttatgacatccgatcttcagccgatgtatgctttaacctttggatcaaaacttcttctattatatcatactgctagccgattggtttctactggattatcttgctatactattgttatttatcatcatcagctgatcgcctttatatcattatctacattggacatatagccgatagctcaaaaccctatcactatcggctggtatcggcatcggctggaattgctccatcggcttgtcagccgatcggctcattgatctgctatttgcatatcttgtcagttgcaggatcaaactgactggcacgcttgcatctcaccaaactttggacctgcactggagctaagcagatctcccaggccagtgtgtgttttttgcgtcaacagatatgcatccatatttcctttcatgcacactaaaaatacttatccaccttttttagaaagcaaaaaacaagcacagcctgaaggatatgtgcttttgcagcaagaacgtcaagctttcggttgagctgaaaactatgtcaaagatattgcagaattcctgcaccactcaagcaaattctatattgtcgctatgaacaacacattcatgaaacaagacagagtggtcaaatccttcacctactactaatctatttatagccacaataaacacctaacattcaattttcttgacagtacttcataaaagaattttcgaagaaatatgtagagaatatgggtaccggatacccacacggcctccatattcgactagagataggaggtgggccagattcatatattatgtaatagagtagaactcggttgctatgttatcttgtaccttaaggcagggtatagagccccgacaggtactaccatgtaatagattagaaaactgatgtcgtttctagctaggtttctacttcgtaaccctgccccccaacctatataaggcaggcaggaagccccctccaagggcacgaacacataatcacacttgagatcgtcagatcaataccacaattgacggaatatttccccagacaagagtagggtattacttctcatcgagaaggcctaaacctatataaaccctttctctcataacccatccacttttatatagcttgttcaccaccccctttcaatattgctgaaatctagtttcgacaaaatacatagcaaaatcttgtgcaaagcaagacagagagcattcaagtacaaactgcatgcaggaggcccctcaaccgccatgcttcttcacaaaccaataaatggtttctacaacctcacagcaggatggacacattttgcagcaaccaataacatacaactacagacgatatgtatcttccacttctacaaaacagatcgattgcaggcaacaatatatcttctgtgaaggttatttcgatgccttgtgccataaccatccatctttgccatcaaagtgcaatgccaggct

SEQ ID NO: 39158 - DNA, 6528 bp, Oryza sativa
tacttaccttatcattttcctctgcagttttcattgtacttatgccaagtgaacgatgcaccatgtttcccacaaacagctaccctcttatgttctgtttgtgatgtgcttatttactcttcctaatttcaagttgctactggaaacaacatcgtcatcttttaaactacctgtatacaggcggtgtgccaatgacatgccccgacatgtagtgcagataacaacagatattctatatgaatggttggcgcacaaattcgtagtcataggaaccggcaatgtcctcgacgaggttgataaggtgacctaatttctgtaagagtagtcctccttccatcctcctctcccaatatatatgtgtatgtgtacacgaaaaataaccaatatcatctctctaattatatgggtcccctcccaatatatatgtgtacacgaaaaataaccaatatcatctctctaattatatgggcctgactcgttaacatacaaacttccaatctatccctaattatataagcttgacccgttacaacgcatgaacatgtaactagtaaaaatgaaagtaggaggtttggtgataattggcttcgtcatcctctgcagctgttttagaagatggatcagtcgacagcaaggctcccaaaccactagtaaccgcacataaagtgggggtacggtgagggttactggtgctagggtttgacaaagaaaaaaatttgaccacaaattttagaaaaaaaaatgaggaaaaaatccccccaaaaattcctagaagtagtgtatgatttgtaatgatatccggtgataaaattttgtgaaaaatactaagctaactccatgtgttggctggactataaggtggcattactttgaaatcaaggttttgatagtcgtgggcattattttggtagtattggacattatattatggtatttctattgttgtgttatgttttttttatgattttctttattttcaagtcaaagacaacggttattgtgccttaccacgagattactgtgaccttaccatgggatttaaaatttttgaattcattttgaagataaaattcatgtggttttcagtggttactacggtaactgtgttattgtggggagggggagggggtgacaacctccccacagacagtttgggaaaccctggtcgacaattgttacaaaatggtaagggaataatgagtgcaaagggagacaattgatgatccaatgttatgcaatggggaatggaaagtaggcggcgcagctacactagttgggcataaaagtggcatgtccaattcgcttagatttgcttttagaaaaaagtacgaattacctcccccacaaactatcgtggtcgaccgaattacccccccctgaaccacaaaagcggacattgttcacctccaactttgtaaaccgaacaaataacccccccccccggctcaatccgtggtggttttaatcctacgtggtagtccagtcagcaattcatttataaaaaaaaataggtgggccccacctgtcagtttctctctctgtctcttctatctctttcccaatctttcactctctctctcttctccatcaacggcggaggaggcgaggcaaggcggcagtggcaggcgcggctgggtggcgactggcggcacgaggcggcgacgtcgcccccctccccctcccgccaaccgcctcgccgccacgctcgcctccttagccaccacgcttgcctcgccgctggagaggacagagctcagggcggctagaggaggggaggcggaggacggagctcggggcggtaggagcacagggtggcggagggagctcggagggagttcatggtggtgctccacctcacctcggccaagttcttgacgacgctcgtattcttcctcatcgccttcacactactcaccctcatcccgcagctcacccacgagatccgcaagtcgctcgaccgccacaccgtgctctacaccactattgacggtcgttatcgaccaatttcgaccgtcaatactacccaatatatgaagactagctatgcttgcaatgcattattccataaataaaatattctattccactatatgcttggaaaactaaccatgcaggagaagctatcaaaatggaggagaatcgacagtacaacaatcgatcaatcaaacagacgctgtcgaaaatcagacttatggatggatgggccaagaactcagaaatgagctatcattttgacccaaaacattgtgtaccataaagtggggcccacatgacaacatcctgaagaaggttgtgggccaggggagctagccagggttcgaccgaaccccctagttcggccgaaccaccagctggcccaatccagcccatcttcggccaggcagttactaccagcatcctatgacggttggagctaattctacctgaagaaaccgtcatggacacatggcaagaggagatgaaatatgccctttggatgcttgaccatgccacttgtcatgatgagagcaaagatgctcataggatgcttggagcatctccactctcccaaggcacctcatggcctataaatacccctcctctcattcattccctcaaacacctcaagaagaagatcaagagctctctgaagtattgtttagtagttctaatattagtggagtaggaaatagaatagtcttcatagtcctcgagtcttcaggagaattcgggtatggctctagtagcttttctctcttcttttgtaagacttattgaattaatagaatattcttctttatacacttttggtaatttattccattcatattacttgagtgccgactttactttatacttgaatcaatatagtcgtgtaactagctttccagataggtgtattggtgtgggtttagtgtctgattattcggttgctctatgtcggttgcaaggatgtagagtagtatttagtaatgtaagcacggtgcttagattattagataccattaattggggttatatattgcggatgagaggtgggccgctgatggtgacagctcagtacgggtattcctccgtgctggtatataatcctaagttaattccctggggagggtattcctacgtatttagccccggttgtatggtcatgacgggctgtcgtaaggaactcggcagtgaggggtggcttctcgaaacaccaggaggacactgggtacggggtattggttgcatgactatataatagcaagtatagattaaagatgtatgtatactagaagtacaggaatgatacttttcttattctttctccacttagcttagactatattttagtgagagtagttcttagttctgtcttctgtgtgtcaccctaccctttgaactgaattaacccttgcatagactttgatgtatataagtaatatataaactattagcatagtactctcttatcatatcttcccttgggataaaataaatacgataccttgcaatactctcgggtgaaatgctgcaatggtatatccgtgcgcttgtggatcacgtctgtaaccatagtataccaggattatttctagtgctattgctcggaattatatttccagtagtgtcgctaagaaataccaacaaccaccctcatcgagctctccagggtgctcggcctcaccaactgcgccgtctggatgcccgccgccggtgaaatgtgcttgacgcacaagctccggaggggcggcaacgacgatggcgttgaggtcggcggcgtcgacaacgcgaacatcgtcgaggtgcgggggagtgatggcgtcaagctgctcgggccagactcggcgctagcctcggcgagcggcggcaaggagcagggctctggcgcggtggtagcgatccagatgccgatgctgaaggtggccgacttcaagggtggacgctagaggtgatccagacgagctacgctgtgctggtgctcgtgcccccaagcggcaagagctggggacagcacgagatggagatcatcgaggtggtcgctggccaggtcgccgtcgcactgtcgcacgcgactctgctggaggggtcgcgggcgatgcgtgtccggctggcagagcagaaccgcgagctgctgtaggcgcagcgggacgcgctcatggcgaacgaggcgaggcaggcattacagggcgtgatgagccaggggctgcgccgcccgatccactccatcctcggcctcgtgtccatggtgtaggaggagaccctggtgccagagcagaggctcgtcatcgacaccatggcacgcacggacaacgttgtctccatgctcatcaacgacatcatggagatgtcggtcgacaaccgcgagcgcttgccgctcgagatgcggccgttccacctgcacgccatgataagggacaccgcctgcgtcgccaggtgcctgattggccgcaccgagctagggcatgtcacgctccgggtgcactccgccactgacgatgtgctggagggtttggagagggagagagggaaaaaaattggggacagatagatcataactaaggataagaccttcaaagatctaatcttttactgatgtgatgttggtacattaattctgcaagttgattaagcaagcaacctatcatggttacatcacaacccatcgatgtaaaccacgcgctacacacacaagcaagaaacaaacgcctaaaagaaaacaatggaactcttggtagcgtaggttcaacttgagggttcttcgggatcttcactccttggcacttggaggggaaactttggaggcaggttccttcttcacaactagctccactgcttcctttgctttcttgccacctcgttcaactattatgtgttgaatccaagcaagggagggagatatgaacactttgcaaatagcatatgggaagaagcagaaagggattttgcaaagtcttttacaaaataagtccttagggtttgtccgtttggcttatcctacagtcgagatggcactgataccaacttgtcacgcccggaaaatacctttcccgaacactagtgtattaatccccgtcccaagagaagccggggtacaccacaacaaacttgatacagaagacacatctttattaattatcacgataatatttacattattacaaaggcacattacgcctgacaacaaaagaaaaacaactgcggactagcgggcctacggctccatcttcacaggcgctcatctagggtataagctaggactccacctaagacttcttcttcaaacaacttctctgaatggaggggggaaaattgagcaagaatataaccaccgtactcagcaaaccatgctgagaaatgaattataatgcaaaggggaacaaagagttggcataatagggttcatttttgcgtaaagccaaagttgcaatattttaatgtttttaaagcatagttttaaactcggtcctatatctaagcaatattatcacggttgtgaacccacgcataccagctttaaactcaggttaaccacctgtccaaagtgtcatgaattccatccatcgcttagaagaaaaacactaacttgggtacattgctaggcttgcccataactgagggcgcggctattcggatagttttactctgatcagaggtgtacatctttacccacaagacacaatacttgacttcatgtcagccatgaatcatgatacctcaaaggtacccgaaaagtcaagattgtgacaagactatccacctacctcaacccaaaacagaaggacctgctaaggtttcgccgcccgccggtccccgacaaggtaaaggttgccggatcccccaggatgagacaggccccttcttgcgccaggtcaaagtcggcctcccctggccccagacctatcataccaatggcctttgttttgagatgatctagacttctagtcaggccttaccaattagacttgtggttgcactgttatgtttcgcaacagaggcctgaagactggtccttgtagtgaccgaggtgcttctaacaaaaccatgcacctcgcgccccaccaaaaaaaataggtttagggagttttgaatgagattccaccatgtccaagctcaaccagtcacctaatcatcattcttacatattttagttgttacccacagtctaatttatagaaagggattctatgttagatctaagcatagataagcccaacctagagcaactagtaagtccatcatatagggaaccatactagtcattttatcattttactaaggttgacaagagcatgggtagcaattcaataacatggctatataacgaggatcacaggaatattaactattaaataaataatagtgaacgttatataatttataaaagtgatgcatatagaagtaaaacaacatagttttttttgcaaaaatgggattcaatatgttcaaggaatatggtatgacttgccttgctcgaagagaaggtcttctgacaacttgacctgcacttcgggaacttccgaaacgacgacagctacacgaaaaaaaaacagggctacaaatcta

SEQ ID NO: 39159 - DNA, 8699 bp, Oryza sativa
tgacgggaacgacgaccggagggaggcgaggcgatggggcggcgttccaagagtcttcgggcagcgaggagacgtggtcgatgatgaaggtgacgagatgaagccgacagcagcgacggcgcagtgaggcaatgctccggcgaggagggagggctaccagagagcaaggatgaaggctacatcaccactgctcaccagcgaggacgagtttccggcggtctccaggagaaacggaggtgaggccggggaagaggaggccgctgcgaagccgatggtggcgacgccgggctccgatgaggacccgaccgccggcgaggggcggccggagttgcacgacagcggcggcacgggaagaaggcagcacagcggccagggagagaggaggaggagggctgcggtgtgtggggagagaggaggcggtcagggctcccttttatacgccggggtggaggagggggatggccgggagaggaggggaaagaccagggagctcgctggccggtcatcaatgacggccacaaattttactcttggttgattatccaaaacagggtgtggactgtagatagactccaagcgagacagtggccaaaccaactcctatgccttttatgccgctctgtgccagaaacggcaatccacctactagcccactgtaggttgtcgaagagaatttggagttcaattgaagcctggctgcagtttgatctccacctctctgaatggaccaacttcctcactgtgcacgactggtggtccttcctactaaaaattccaagcagctcgaggaaagcccaaaaatcccttgtcattcttgtttcctgggaactttggaaggagaggaactctagaattttcaaccacttggcaaataccccgaccaatatcattgcaaagattaaggaggaggctaaaatgtaggtgacagcgggggcgaaatggttgacggagatacaactattgggagaataaaaacactgctttcggtcggggaatgacctaaactcccataatgtatatattgttatgtactcccttctctatcaatatataaggcaaatttcttgccttcttttcaaaaaaaaatgacggcagttcatcggagggtaaattcggcgaatcaaggccgaattaagaggggagaacgtgggggaattgatgatgaggaggagaggaaccgatttttggtagaggagaacgagtggggagggagatcaagaggggccgcggcgcttctgttctttggctgggagaagaacaggcggcggtcagctggaggaggaagacgaccggctgctgggccagctgggccgcagggggaagaggaatggactttgtccgagggagaggaaggagagttgggccgagcaagggaggggaggagatgggccacggagaaggaaaaaggcccaggagggagggagaggaggatttggggccgaaaatggcccaaagagaagaagagaattatttttagcttttcatttttaattaactcttaacttggtttttgttgcatttaaattattttttgtgctctgaaaattcaagtaaaaaattgagggaccaatttagagcatggaggatttaaaaaaaaatactccaagccatattcagatttttgttgtatgcattttaatgtttgcctatttaacttcgaattttaattaattttattattccttttagagaatgatttttaatttaggatggatttatcagggcgtgacaaattcaccccctacaagaatctcgcccttgagattcgaagggttagaaagaaggtgggttcggaaagtctttgatttgccttctcattctttgaacagcttccacttttatcttgaatgatctaaccagatccttcaatagtgaatcatgtaatctttcaataataaatcatgcgttccttttccgttctatgtttctctagtactcgtgtcgatttttgtcatagtcaatagcttggtttcaccctgattcttccatttttagcttttatctgagttgcgagcacttggaggtgttgcttcaattctgagtctgagatctacaacatttgtatatgtctttgatttggacaggggaggaggagatgaattagggttaaggggtctgcacgaatcttaaagcatatctaatggtccaaaatttaaaagataggaggtagaattttttgtaaacaaatatgtagatagtttctttttagtatggcccagcccatatgttccaatgagagatgttggcaacgcatctgcgcggaataggctttctcacttaaaagtgataggagtcagtacaagtaggatagagagtattgtatgccctggattttgcgcacgagctacggtttgcatcatgttcaagttcacatatggtgaacacaatttactctacaaataaattatgataaaaatctgcgaaatgacattgacaagcgtcccaatccatgaaatgcctcgacaaacccaacttcctagaaataccatcgtacaagcgcttgtgtcccagaaataccgtcgctgttaagtttccattagtagacctccgttaagtgttataaaatatcattttacccctacaaattgttgaaagatgattacaacttttactctttctgacaatgtacaataatttagtttaaagagcaaactacaaattagtataagctaatggaaagagtaaaagttttagtcaacttttaacaattcatatgggtaaaatgatctttttatagcacttaacggagggatgctaacggaaacttaatggcgatgtcatttctagaataaaaacgcttgtacgattgcatttctaggaagttggggataacatttctgaattggagcgcttgtcaatgatatttcttggattttctcataaattatttaaaaaacttcacatacaaaatataaattacttttggttacactgttatttttatgaaatttgccactggacccacctatcaaggctcacatgttatatacagcgagtgacaaattcttaattgccacattttaaaagtggcaaatagttaaatgtcgctatttttatacggcaatcagtttttaaaaccgaagcggctgacaaggtgtacaatatttctttcttttataaaactggctaatggaagttcacttttgtttaatttaatgaaaaaacagaattactttaagaaaaaggagattcggtgttcgagcctcagtggctgaactgaactgaacttacaaaaactgaccgttatctcttctccgcctcacctttcccccctctctctctcccacgcactctcgccttctccacacaaagctcgcaaatggcgatctccacctggagcacgcgcctcctcctctccccctccgcctccgcctcgagccatagacctaaccctacccgccgcctcgccttcccctcccccatctccggccccggccgccaggctccccgcgcctacatctccgcgccggcgtccggccccgacgcctacccgtccccggccctcgacgccgcggcggcggcggcggacgtcgccgcggccatcgcctcctcggacgccgtcacgtgggcgggggtctgggccctcctgtcgccgcacagggcccgcatcgcggtctccctcgcggcgctcctcgcgtgcaccacctgcaccctctccatgccgctcttctcaggttggttaggttggggtggttggttcagggcacacacacgcctcttgcgcgctgatgctggtttggttgtgagatgtgtgatgtgatgtgatgtgatgtgggcgtgtggcttggtttggatggcagggaggttcttcgagacgctgataggaaggggctccgaacccctgtggaggctgctgtccaaaatcgccgtgctgtatacgctggagcccatatttacaatcgtattcgtgatcaacatgaccgtgatctgggagaaggtgatggcgaggctccggagccaaatatttcgcaggattctaatccagaaggtaattttgctttagctcattagctgtgtaacggttgcattgcacctacaagtatttacagtagcaattacaattgccagacttggggtaaaaagatgttgggttattccatatgatcgcctaagttctgtttgctcattgggtatgcagctgcttcaatcatgtccaaataactaattttaggcatggttgcgcttacacacgagtcctttgctactactgtatcatttgtatgatgaataagttaaaagctgctaagtgggtagcaacttagttcatatgcttgtttttggattgtttacaaattatgcccacattagttttaataccattatgaaattattcatcccattctattaccaggttgcatcaacacttagtaggttttactagggtgaagttgttcgttgaggtctcctatgctttgcacattgtacattaatgaaatatgaaggactagggacatactgtgtggagttaacgtaggtagtactaatgcatcgtgaaaatatatttttttattgtgcatgattgtgtagccttgaggggcgataatgcactgcttcttcatcttagcaatttggcattcaccaacatggttatatcagttttcattagtcatttcatagtttatgttgataatgaatgatttattctgtttggttgtttgcagatggtattctttgatcgtcacaaggtaccgactaccagcataccacattcatattaaattgtcacaattagttagagaaagataacttcatttgtaagatattgttcctactaaattgaaaatctttgtatttttatgttcagtgtctgtattcaagttttcaaatcatccaacacggattttgctttgtgaaaaatatagttgagcaatgtagataggtagcttggtaagccactttttccttcttccattatggaaggcatgtaattaatgttgggttagggttatgcaaaaaaaaaatgttgggttagggtgtgtggatagtgataacagtgaaagatttacttctaggttaaaaaataactagatctaattcaatttaccaagaaaaatggtggctatgatcagtgtattatgcattatctgaattagtaaagcagtcattgtttagcttggtctgttatacaagttatagagaattttctttcataccaaagtacattttttctgaaaattatgcaaatgaaaggatacactgctgattattccttgcgtgtgttctatgttgcttcaaaaattttacgaataaaagaaccttactatcatttgatggcaggttggcgagttgactggtttgttgacatctgatttgggtactttgaagagtgtcgtaagtgacaacatatcaagggatcgtgggctaagggcactctctgaggcaagaaactttacactatgagaatgtaagcttgatactgctaatggcctagaatttgcgctatacaatcactgaatcacatattctctctgtgctattagcaatgctttcaaaaatactgacatctcgaagcattattgaccagttagtccatttatatcatatacttgattatttggaaatcatgccattacctgtaaggtcaattatctcagcatcttctaaagcagtttttcctcttttctttttctccagatcaccggtacactttgtatacttttcacattatccactgagctagctcctgtactaggactcctaatggtctctgtctccgtgctagttggtaattatccaaatgatgactgatgccatttactattcattattctctatatcacatgtctttaagcgtagaatgactttcaatctttcatcatcctgaggtccatcatatgttctagaaacaagctgatttgtggtaaatatcacacattagttttgtcaggtccttaccgtggaagctggtccctcatgtcttatacgtttctagttagctgttgataatgaattgggcctaaatttaatcaccacacttgattttttatttctctgtgaaatatatgggtgctatgctgaaccatccctggtattttgctaatgcaaaatagaagtcctatttaggaatttgcatgagtggaatgatattgaattattgatttgggagcttttgatgcaaatgtccataatgttattttttagtttgaagtaattgattagacatatttgagatgatacagaactttgcaaataagaaataataccttttttactggctcgtaaagtttcaccttttgctctgcttttatttctttcttagatcattgccgcggatatttccttcatgttattcttgaacttatatatgttcgatgttgtttgattatagtattttacaatttcattgagtgatttgtcttccaaatatatttttgtcttgaaggattaacatagtgtggccttctaaaaagatattatttactgaagtagtgttggcagttgtatgtcaattttcaaaagcatttatgatctgacaagctatttttattaaatcagctcttttcaagaggtcaactgttcccacatttaaatcttatggaattgtccaagcacgtatatcagacactgcatcagaaacattttcagctattcgtactgtgagtattttttcgtcagaattgtatacttccttgtaatacttgcattaatagattttatctctttattctgttaaataccagtccacatacttgggggttatccttattttagtcaaaaatacatttgcaggttaggtcatttgggggtgaaaaacgacaaatttctatgtttgacaatttggtaagtcttatggcctttcacctatgcacttctcgggccatccattagaatattactctcattgttcatttctctattacgtagaaggaaatgtgtcattctaccaatcgttatttatattaactggagatttgtaaaactccacattaatcctaggaggtaaaacgatgataaatccccactatgtaaaataaaagggtagatatgcccacattaattggaaaaagagagagagagaacatcatatccatccaagttattgcacagacatcatgaagcgttaatttgacttatgtgttattgtagtattgtactggtccccatataatgtgttgaaaaatgtccaagtctttatctgatttggatttggcagattctggaatgaaggccacatgtctaacatacactaatagaaaagcatttgtaaagtagctaactatgttattttctttcctacaatttagtctactatatatgttatagacacaatacaagaaagggttacacatttgttcttgagggctaaatttttttatatcaattggtggaaaagagagatttacatcgtcttttgttgtgagcccaaattataactatgcatatttcatgttagattaataataatgaattccatgttttgctcagctaataatactaacctataccaaaaagtcaaatagtttacaacaaaatcagactactttatgtatttgagtagagttatgatgggtggctctaaattctctaaacctgtttggtttgctctccatgcatagtcacatatccacaagcttgataatagtttctttttatgttttttcaacatattttcttcaaatttttaaacaaactcttcaaatacctcttattaaaaataaatcttttggcagctttgctagcaaatgtttacatgctatgaaccatggtgtggcaacagtgacttgccacaccaacgtaagtgctgtgcccaaatccttgccaagccattgttttttaatccttggcattttatgtggccataaggttcagtctggaaataagtttcaagagggttttgacaattacattcaaaaaaagtacaaaaagtaataaaaatttgatgatacttatcagtcatgacctgcacttactacacccatgaatcgatgcacaagctgtagtgccgcaccacgatccagtaaggcatgatgtggcataacttggcatggttgctaagtgcttgctagctgtgttgtctgaccatggtaatgcgtgccgctgccaatttgtgcttactataaaaggatcttgaaactgtagatttaatgccataaaaatttaatgcatcttgtctatcaaatcctgttagacaagataaggtaaaacaactatattacaaaggttcatgcctttgtggatgtgatcttaccctgtgagagcttatatatataattgtatgaacccatgctctaaaatggtggtaagtagtaaccaaactttcaccccacctcttaacacttaaagctatgttaatcatttgagttttgtaaaaaagtgggagcattatattttgaaggaaaagaaggtaatatttgtagcttctacattgccttcgatatcttgttaattcaagtttttgtttggcaggcacttgctttccagaatagtggcacaaaactaggcgtgctgaaatctgccaacgagtcattgactcgggtggtagtctatgtttccctaatggcactttatgttcttggtggaagcaaggttaatgcggtaagcctctgaattgcttggagtgtgatatttacgtgtaacctcattttctaaagctgcaacacatttcatgtagtttggttctgccatagaataagttccatgttatcctgtaaaacatcctgatagtttttacaagtacaaaaccgggggggggggggggg

SEQ ID NO: 39160 - DNA, 2836 bp, Oryza sativa
ctattctataaagcataatggccgtgtgaagtgtcctgaagtatttccttgtacaatgtagaatgatctacactttgatagatgtcccatcccaccatacatggaaatcttaaaagatgcatgaacagttctttagatgtacaagtgtgactcatacaacagcactgaacccctggacaatggctatccaatgctgaaatttgcatagatattttgttgcttctgggttctggccaattccatggaacttaggtgccctctagtttctccctatgcgcaacactaggtcagctgcagcccggaagccctttaccatgtgaatttgtgctatatgtattgaataaaatattgttaacacttctggcagcaaacataaccacagctgtaggattaaggacctgcctaaagcttctcttcctttttgcccgtaacttttgtttaagaaaataataaaaccacttcagcttttagatctagcatgtgttatacaagaattaccctcaatttgtaccattgatattcagtatctacaagtaaactaattcacatcagatacatcatccaaatatttcagtatcaatactaaaaattgattctcttgtatgcgccggtgctctcgagttgaatatctatagaagttctcattttatttaggacctcaattttaactgttggaaacacattttatgcctatcaaaagaccacatgcatgcaaccatgtcaattttactaacctgtatggtcatttagatatttaataatcatttgtcttgtcattgaaatctgaaaatatgatacacatgtatttcagggaaaattgtctgttggaaccatggcatcttttattggttacacattcacactgacattcgctgtaagtatcagattttacttattgcatgactttttgtagcttgatgtgtttattgtattttggtcatcttacttgtcagaacatgcattttaggttcaaggagctgttaatactcttggtgatctacgtgggacatttgcttctgtagaaagaataaattctattctatcagcagaggacattgatgattcacttgcatatggtttagccaaagaactagaagattcaaatggtgcagtgcacgaaaatggcactgctaacaaacattacatgtcagcactaaaatcatcaagcagctgtagtaatcttgcctggtctggtgacattcacctagaaggtctgctcgccactattcatatttgttttatacatgcagttctttttccatttcaaaatatttttatgcatatgcatatttctttcatactataatcttctatacaataatttttcttaagtaatttgtctctagttccactaggcaagatgaagaagttcagaactgggatgccaaaaagagccaatttgcatctcacataataggttaatttccttttgtatcataaaaactactagattaagacaacaaaggggacactctcctcttcaaatgttgctggagtcatatcacttgcttgcctaaactacatttgttttagcttatgtagcatttacatggataagtttatgtcgatgtggcatccatgtagacaaataactcagcaaagctcaatgatataaaatagctctggctgtcagctatctcagccaaaactcatggggctttactttggtactgcctacacccagttagctctgcacttgaaaagccaaatcagccactgaactcttttgtgtcagttgcccctgtttgatttttctattcatgaagctttcatcttccttgaatattgattcatgcaaatgcgtagcgccatgacagagcaaccagagtaggcaggtctagtctgtgagcctcaagacaactccactcatgtacatgtcacaggggcagggtagtatggggttgtggtggctggtagttttgagctatagagcataaggcaaggacatcaagcagtcgcactgaagctctaatgtttgtgcagaaggggcacaaagtaggtagccttgctatgtccaatgagaactagctagtatttctgaattgtaaacgtccaggcaacaggttgtttagcgtggaaacaagctcctccagtgcctaatatctaagtaagaagaaaactccatgaaaagcaagaacgaaaacaaattgagctgtatgaagcataaaagtccacatctttattatcaaagacagaaatttgtcaacaccttcatgtggtgtagctcaaagttgctgaagccaagcaattttgcaaatgatggctcgagacatgcactgtaccaggatgaggcaacaagtgaggtgtagatagaaaagagggatgtatatcagtgtggagattattatgtcttaagatataatttcatctttgaatgtatcggtactttttttgtgtccattttccttgtgttttgccttttttgtgtgaaagcctaacataagaggtgtttccaagagacacttaaatgaataatgaagtgcacacttatgaacattggcctttttgtgtaaatctctaacttatatagatgtttccaagatgtacttcaatgaataataaagtgtgtagttatgaactctatttactaaaaaaacagaaaatatgattaactagattattcttggaccattggcatgcaactgatgctcatctatattttggcaggtgtccacttttcttacccactgagatctgatgtggagatcttaaatgggcttgatcttacaattgagtgtggaaaaattacagcacttgttggacctagtggtgctggaaaaagcacagtggtgcaacttcttgcacggtactatgagtacttctgtgtatccacatt

SEQ ID NO: 39161 - DNA, 1519 bp, Oryza sativa
  unsure (1)..(1519): unsure at all n locations
atggtctcgagttgtatccttagtgaatcaggtatagtggtacattatctgtctttttataccacgtatcatcctcctgtcctacatattaattgaggtacacaagttttagtttctctggtaaagtagcatttggaatagtattttgttctggtgatattcattatgtggttgtaagttcatgtgagaagggggaacacaatatattgtacccagtcttttggtttgccattaattattctgattaggtatagagaacagctctgttagtgggatgtgtgggactgtcatctctagcatataggtttcagtccttttatttagaacttgggtgcttgatcttttattcattttgatgcaaaatttatcatggaatgaaagatgattccacttttctttaattatattattttggtatgaaaatttcaggaccctgtcctattctcagtttctgtcggagaaaacatcgcttatggtcttccggatgatgttgtttccaaggatgagataataaaggccgctaaagctgccaatgctcatgaattcattgtctctcttccacaggttgaaacaatatttgtcatacattttagttgtagttcctggtgtccaaatgatatgagatatgacagtagtttgattctcataatttgtttgggatttagggctatgacacacttgttggtgaacgtggcagcctcctaagtgggggacagagacaggtaatttgctactccctccaattggacacattggtataggaacaagatctgttgtactttctaaacttggctatcaatatcttggactggaccgttgaaagtgatacatgtggattgttctgaaaatctcttttataatactgtaaatttattactctatgtagatatataacagtggaagtttgtagttttcttgggcactatgtcagtgtcccaaatatcactcactttgtgacttgaggataccttaacatgtaaacactctctttgaccatatatgttcacttggggtccatatgctcaaggtttcaaaatattgtccctgggtatatgttaaaatatataaactcacaatacaaaaacagtattgttggatttgttttagaaaatacattcattgtttgttatcattactactttacaattattttgttgttttgcagagaattgctattgctcgtgctcttctgaaaaactctcctattctaatacttgatgaggtatgtcctacaaaaagttcgcaattttgttgttagttactattcaacgtgtcttatatcatacctactttttactgtgatgtcttataccctacatagctatacaacattttatcttgataggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 39162 - DNA, 1584 bp, Oryza sativa
gaaaaacatgtttttggttcaattgagttgctagtttagttagggtttcaagtttagtcgagatttttgtaaggagtgctgttgttgcactttgtaaacacagagagaagtaataaagttgtcatctactttgagagttcttcgatttgtgtttcatcgggtgctgcggtccaaccggcgacccaacggcggtccgaccggcgacaagcggcgatcagactggcggcatacgggcggtcagaccggcggcggcgacagcaagtggcagctgatctcggaggtcggaccggagattgaatctcggtcagaccgacggcaactaggcggttacaccggtgcatctacttcggtcagaccgtgatccatcgatttcgagggtaacttttatttccgctaaaagttttcggtttttgggtatatcaaccattcacccccctctggttggcttagttcttgtgattcgatcctacaggtactaattcttggaaatgtttggcaaattgctattctactgatattgaggtgattaggtgaaaacatgacacttctacactgttgacggtcgttttagaccaatttcaaccatcaatataaccggaataaaggagaactatcaatgcttgcaagcatattttgtttaagaataaactatatccacttgtacttggaattttattcgtttgcagagagctctacatattcgaaggataatcgacagaaaataactgaacaatcgatcgccgtccgtcgagagatagacgtatgggtggatgggcttacaaactagtaaaataacatcaaataggcctaaccatcatcacggagaataaatcccaacaaaagacgcgcctgccaaaagtggaggccggataggccagcccaggttcggccgaaccctagccgcggccactcatcccggccttccatgtggatgctccaaatgcactctcaatgatggttggagggcgtttccaccatttccaactgccataaccgtcattgagagactatataaaggggtgctcattcactctcccatacacactcaagaagaagacaaaagaagctctctgaagtttagtttagtgtattagtgctagtggagtaggaatataatagttttcttaatcctcgagtcttcaggagattttgagtatggctccagcaactcttccttctattgtaagacttatagtattaatgaaatattcttttttatataatttcggtcttttacttaagtcatattattcgagtaccgactttagttcgtacttgtctcgatataattgtgtaactagcttatcagagatatgctttggtatgggtttaatgtttatttctatgattattgtatgtttgctgcagcgatatggagtaatatttagtaatgtgagcatggtgcttagattattacatacgattaattggggttatatgcagtgggtcagtacaggtgggccgctgatggagacagctcagtatgggtattcctccatgtagtatatacccctaaggctgtgtccggcacacccttttcctaactcctcttcctcgtttttcacgcgcacgcttttcaaactg

SEQ ID NO: 39163 - DNA, 45245 bp, Oryza sativa
  unsure (1)..(45245): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctggttttatgttggcaaataaaatgggacagtgattaaggttagtgcaaacgacgatgacatgtagtacttcattttacaggttgaggcataggtgttttttttttttggcaaaaatacctgtgtcatatagctggttttggacaccaattctgtggttgtatgtgtttaatagtgtgcccgtgcattgcaacgggaaaactaatcattaatcagggttcagttttcgtgatatgaaggggatattttcatctttgtctttatataggagaaaaaattgcccatgatttatttatctcaattgcatcatgcacatcatggcaagaaataatgtctacctggaagctgcaacatggcagtcttattatagtactaacctaaaaattatataaagatcaaataagtaggcgtcaccgaaaaatgatctggtgaaatggtgatgtcaaaatcagtaggcttctatttagaaaatgtggctacattccaaagttgcatgaattccagtttgcttcatccagatagaccacttaacttaatttacgaaaattgagtgactgaatttgaccgactcaaagcttatcaaacgtactgagtgggagaggaatacaatttacttaattcagaagaccggtttattgtggtgagcagcttttgttttcttatttactatttcaaccatgcttaattgtatttgttaatcttccagcagtgcactatattttgcaatttcagtaccctattaagtagcacaccatttcagtactcgttagtcttccagcagtgcacattatttttcaatttcagatgttagctttaaattgacatgtgttagctctaaattgacattattcgacaacttccagtactaaagtcttgctctgaattcacatgtgttatctataaatttcagatgtttcatatagattgtccttgggatactgtcgaaacaagatttcggcaataataaaagggggtggctatcaagttaggaaagtggatgggtttggagacaaagaattttatacaggttcaggccttcttattcaagaagtaataccctattcctgtccggggatgattccgccgagtatgttattgattgtataaactgggaaaaaagaatcgcgccctaagaggcacacggaccctccttatataggggaaggagtccgctttacaaaatacagtccatatcctaacggaatatgggattacagataaaatacaatcgtaaccgactaggatcccgggtattttcttgacatacaagtttagaatctaacccgagtactcatagagatattctatctatatttggtaccatatatccgactaaattataactgtcgtgtagatatggggtatccataatctccacagtagcccccgaaaccttcgcagttgacagtaatagccttctcgaaacaaaaaacagtaatccgagtgcttcaattcaacttgccgagtgctaaaatcaaagactacgaagggcaaaaataaaacatggtgcatcgagtagatgcacctaattaggtgtagcccctgactatgtgattagttgaaaaaactaaacatatagtcaagaaccgagtggttatatagcgaagcacgcatggtacttagtaagatacccagccgactgcttctcaacttgaacataccaagaacaaaaatacaagaagggccgagtgataaacactcaaaggtccaaaaataggcatatttgataggaatctgagtaagaaactcgtaaaatgatccaccaaatatgataaagatcatggcaattaggaagtttaatagcctaggctataacccttaccataatcaaaataagcatataacatgctaggagaatgactactaataaatcagtcatctcaaattaacccaacagcttttgtagcctaaaaaagcttacaaaaatagtataacacctttctgtcgggtacctttttatgtgcatcataataattccaaagaattattgaattgcgttaaaaaagattttaacagcatcgggtcacatcattgtgagcacatattgccaaagcaaaaagcgcttaagtccctagggatcacaacgggccacgctgaaaacaaaattgggctgaagtaccgtacaggcccaggcccattagtactcccgataccctaaaaacaccgaagtccaaacgtcatttcgtcttccccgccgagactctcgccattccccgctccatgctacagtacagaaccgcgccgacgaagttagggttcatcaatctgctccaatcctccctcaaaaacttcacaaaatttctccccgcgtccaccgctccaattccccattccactctagccatatctcggaccaaattaaaccatccagttacattcatggcggaagaaagagaaagcttcgagagtcagtgggcgccctccgatgtaacagaagataatctgaaggaaatggtggcgcacagcgttcttccggcgaaggaaatcatcgggtggcgaccggcgttcggcgaagcattcccgacccccgacacgcacgaaatcgtggtatttgctcatttcttctacgacggattttctcttccaacctcaagattcttccgggggattctgaacttctacgggattagcttgcatcatctgaatccaaactccatagtgcatatcgccaattttgttcatgcctgcgaagcttttctgggcattaggcctcatttcgccttattccgccgaatcttcttcctcaagccccaaccgaataagagcaaaccatgtgtggttgggggcgctggtttccaactcagaggaacactgagccaaaagtatttctctatgcccttcaagacctcacacaaaggctggcacgcaaactggttttacgtccaaaatcctgaacccgcacttcccgagtattcctgtcttcctccggtttaccaggacacatggaactcattgcctatgggagatgaagctgctcaggcagtggaattgatggaacgcatgctaaaactgaaggaacaaggtttgcagggagaacagatcactcgacacttcatcaaaagtcgattagctccaatcaaagagagatcccgcacggcttttgagtttgacggcaagcatgatccaaatcaggaagatccagattctcttgactttaaggtcatgaaagaaagaactgtacaagatcttctcaaacgctattgttgtcagctattcacatctgctgcccattgtgccattcaatgcattcaaccctcctccaccggtatgcattcaaacatttcaacgcttcctcaaaagtatgcttttgtcctctattaagctaattgaaaattcaaaatatcatgcccaggaatttgccttgatgaaatcggatcctccaattgctcaacgccgatcaccttgccagcagactggtcaggcgagtggaggaccaaaaattcggtctgacgctcaaccaagtgcttccgatccagtcggccagtcagattcttgcaagaggaagctagttctaagcgacgacgaaggcgatgataccggaaggctcggagacaaaggagcgaccggaaaacccccgaagccaactaatccgaagaagaaaacctccagtcgtcctttgccaaaaatcagaaaatcttccaggtacaaatcatttggccatcttccttgtcttgcagcttacccgctgttgaaataatactaacaacataactcaaattcgtaggaagccgtctgacatagatccttctgaaaaagaccctgagccggctgacatagaggcaaacccttcaaaagaaaccgggccaactgcagaggattgcccgagtgacaaacaaccggcaaccgacaatgtagaacccagcaacgagcccccgactgcgaaccagtcggccgaagctgaagttggcgctaaccaggagcccccgactggaaaccagtcggatgtagggtcaagccaaaagattcccgaggttgaagctcaaacgaacaggcctctcgggaaggatgctgacagtgaatcagaaaccagatctcctgtgaagacaccaaagtccactcgtccccgaccgggaatcatcacaggtagacacgctatctgaaatcattttgatccaacagactttatttgaccgcttcatcttcattcatggatacactagggccaataattggtgatgaagaagaaatcctccggatacaagcagctgaggattcacgccctcctattctggtcaagtggtgggatgacaacatgcagcctcaagggatcgtgataaataagcaaaaagaggacgaagagttatgcctactgaaggaggcacttggtcaggcaacctgcattgtaaatgtaagctctctggcacctgatctcaaccatcttgtttgccatttaattcatgcgctaattaaactgtcttgcagaggattcatcttaggaacgaagccaaaacggtaaccttagagaggttagtccctcatctcggaaccctcgaagccaccaggaatcaactgcacgaagcaaaagaacttgctaggaagaatgaacatgatctgagggatcggattgctgagctccaggaatcaaattttgaactgagtggctcgtcaaaaggtatgcacaaactctgctcaactgactcatactgttatctttgcaatcttgattaaccgtgatcaatgtagtgcaagctgccaagatatctcagttagagaagcagatttaaactctggagaatgacaaggcagagctagcaagacaaaaagacttggctttaaaggaagttgaaggtatcaacaatcaatacctcaaaagccattatcctccaaatgctgactcattaatgtgaatctgttgatacagaccgcaatatcaagtctcaagctcaattcgacgtcctggttggcaagatcaaaaaacttgaaggagcccgagatgaggttgctaacgctgctgccccaattgttcaagcgatgttcttcaataacaacggcccgagtgcacttgatgcttctgaaatcttcgacaagctgagagttgctccagatacatatttcaagagcatcaaagaggttagaagtatgggagcaagtctggcgtgcgatgaccaaatctctttatccgagggttgacgttgacgccattgatggctttgcagacgggacgagcgaagaagctgctcttgacctcatcagcgatgcacaaaaatctgctgataagatagcagttgatgtagttgagagatttcaggacaccgatcttcgaccgactggtcctgataattctgataatgaaaagactgatattgattaatataccaatgattttgatgattaatgatgatggaggcacaatttgtacaatactgatgaatttatgttgtgcttgatatctcaacttagttcctgatttcttaaaagtttttgtcaaaccttgttgagcctaaaacccgcaaaagttgttaaaaaactttcagtcctcattgactaagccaagaaatcaaacagggcaatgatacatcaagtaagcaaattgaattgataaaaaatcacactccattattattatagtagcccctcgactgaaaacttcaaggaaaaacttgaagttagcagtcaaagaggaaagatacaaacgaaatgcctaagcataaaatcgacgaaggtgttcaatattccaagaattgttgatgagagtaccatcttcgtgcttgagtcgataagaacctggccgagtgactccagcaattatgaacggtccttcccataagggagataatttatgccgatcctgtgtggtttgaattttcctcagaaccaggtcgccgactaaaaaggctcgcgatcgaacattctgattatgataacggcgcaaccctcgcaaataccgagtcgactgaattaaagctacttcacgggcttcttctagtcgattgatgtcatctactcggccctcttcatagcgctcctcgttgaagttccgaaatcatagtgattcaaattccacttcactcagcaacattgcttctgcaccataaaccaaaaagaacggcgactggccggtagcccgactgggagtagtgcgtaaagaccaaagtacggacggcagctgatctacccacttgccagcatagggacgtagtcggtcgaacagtcgtgcttttatcccttgaagtaccatgccattggcgcgctcaacttgtccattactcatggggtgtgccacggaggcataacaaattttaatgccaaagtcttcacaaaagtctttaaatgctccgccagtgaattgagtgccattattagtgatgatccgattaggtaccccaaaccgatgcacaatgttgatgaaaaaatctctagctttatctgctgtgatcgtgatgaccggtttagcctcaatccacttggagaatttgtcgatagccacaaagagatgcgtgtacccgccgactgcccttttaaacgggccgaccatgtcaagcccccagaccgcaaacggccaggacaacgggatggtttacaactcttgggctggcagatgaatttgtctggcaaaaaattgacaaccttcgcatgtccgcacaatcttgtcagcgtcagacacagctgtaggccagaaaaaaccttgccggtaagctttgccgacaatagtccgtgtagcagcatgattaccacaaatactagaatgtatatccttcaacaattgtctcccttcttccaaagacacgcagcgctgcagtattcctgatggacttttcttgtacaactccgtcttatgaataatgtaaagtctgctgcgcctggaaatccgctcggcttcatttttatcttgaggtagttcttgtttgctcaaaaattttatgtgaggttctctccaatcggtttcgattatgcttacgccttgagtatccatggctccgattgtttcttttctgggtacggttggttcgtaaagatgttcgacgaacacatcagaaggggctgcctcccgtttggaaccaaaattggccagtctgtcagcttcctcattgttatgtcggaggatatgggtgagctcgagtccatcgaatttatcttccaacttgcgtacctcttgttgataagagatcatattatcatctagacatgaccactctttcatgacttgattgacaaccaactaagagtctccacggacaattagtcggcgaatacctagagatattgcaatccttagtccatggagtagcgcctcgtattccgccatgttatgggacgcagaaaaatgtatccacaatacgtagctcaatctttctccagtcggggagattaaaacaaccccagctccagtgcctataagcctcttcgacccatcaaaatgcatagtccaatattccatcttttcctctggcatgtcttcttggcactcggtccactcggcaaggaaatcagctaaagcttgtgacttgatcgaagttcgtggcttgaacgatatgtcaaaagacatcaattctaaggcctatttcgcgatccgtccatttgcttcgcggttatgaagtatatccccgagtggaaacgatgtgactaccgtgaccgggtgactttgaaagtagcgagataatttcctgatggtaatcaagacaccatatagtaacttttgaacctaaggatatcttgtcttggaattggctaaaacctcgctaacgaaataaattggacgttggactttttgaatatggccttcctcttcacgctcgacaaccaggaccgtactcacaacctgggaggtcgccgacacatataacagtagcggctcttgcggatgtggcgaggccaaaactggtggagtggtgagaagtttcttgaagtcttcaaaggctttctgtgcttcgggtccccactggaaattgtcagtcttcttcaacagcttgaagaagggcatcccccgctcgccgagtcgtgagacgaaccggctgagcgccaccatgcaaccagtcagcttttggacgtctttttgggagcttggcggtttcatgttgaggatggcgttgattttctccgggttggcctgtatgcctctttgagataccataaatccaagcaatttccctgacggtactccgaagatgcacttttccgggtttagtttcatcttgaaagcacgaatgcttgtaaaagtttcttctaaatccacaatcaggtcatccttctgcttggtcttgacgactacatcatcaacataagcttcaacattgcgaccgatctgagttgaaaaacatctttgaatcatgcgttgataggtcgctcctgcattcttcaatccaaagggcatagtgatgtagcagtaggccccaaagggcataataaacgaggtcttcaagcagtcggattcttttagtcggatctgatgatatcccgagtaacagtccaagaagctgagtaactcgcagctggccgttgagtcaaccacctggttaatgcgaggtaacccaaaagggtctttgggacaggatttgttgaggtcggtataatcgacacacatgcgccattgccccgtctttttccgaaccaggactggattagccagccagtcgggatgaaggacttccttaatgaagcctgctgctaacagcttggttaattcctccttgattgcatccttcctgtcctgtgcaaaacggcggagtcgttgcttgatgggtttggcgtcttccttaacatgtaaagagtgctcaatcacctctctggggataccaggcatatcagatggtttccacgcaaaaatatctttattattctgaagaaaggtgatgagcgtgctttcctatttacaatctaactcagcgcctattacagcagtcttatcaggatcggagggatctaagggaatttttttcgtcttggcatcactttcttcggtcttcgttagcttggttgcgggcacttctccctcgcttgctgtggtcgcagccagtcggacctcttcgcgggcgagcgtagtctcgtgggtttgggccatctcgcaactttctttgtcacatgtgacggcctgcttgatgtcgctccgtagtgatatgactcctcgaggaccaggcatcttcatcatcatgtaggtgtagtgtgggacggccataaatttagccaaagccggtcatccaagtatagcatgatatgttgtctcgaaatcagcaacttcgaaacaaacattttctgtgcgaaaattctcccgagtgccgaaggtaactagaagagtgatctggccgagtggtgtagctgacaatcctgggataacaccgtggaagggtgcattactcggctttaattccgtgcgagggatctgcatatcgtccagggtcttagcgaaaaggatgttgagtgcgctgccaccgtcgatgagagtccgtcagagcttgacattgcgaaccactgggtctagtaccagggggtaccgcctcgggtggaccactcggtcgggatgatccgagcggtcgaacttaattgctatctctgaccaccgaagatattagggcgtgttaggctgaaccgcattgatctcccattctgttagcttctgctttctcttagattcataagctaggggtccgccgaagatgtgattgagttctttgcgatgatcttgaaaaccagtcggggcatcgtcttcatcatctttcttctttgatgtgccttgatctccgtttgagggcttacgtgcgttcttgacgtattgctccgcaaactgtttgttgacgaagcaatctttggccacgtggttggagttgggatgatgcggacattgggagttcattatcttgtcgaaggtgttgacgcgggaacgttgtcgggaagatggagaggttgtggccacaagttcttcgggcttacgcttgcggtccttgtggttgttacttccactccctcctccggtcggcgtatccttctttggtttccaagtggtgcccgactgcttggacaccgtaatagcatcttcggctttggcatactcgttggctttttcaaatatctgcttgactgtcttgggaggtttgcatccgaacttgccgactaggtcctcgtgtcgaatgcctttagtaaaggcggcgatgataacgtcgtcggtgatgtcggagatcttgttgccttgctcggagaagcgtcgaatgtaatctcgaagagattctccagacttctgaacgatattgtagagatcgaagtgtgtaccaggccgttcaaaagtgccttggaagttggcgatgaagtggtcgcgtagctctgcccatgatccgatcgtgccgcggggtagcccgtgaagccatgaccaggcagaatctgctagggccacaggcagatagttcgccatggctttgctgtctcctcttgctgcgcggattgcgagaccatagacggtgagccaagactcaaggttggtggtgccgtcatatttctcaattccagacggcttaaagccggctggccaatccactcgacgcaggtcgcttgtgaaggcagcaactccgtccacgtcgtcgtcatcgcgatctggtgaatgatggcctcttgctgcgtggcgctggttgatggtgtcgcgaagatcgatggggcgccttcgatgtggggagtgtggtcgttcaactcgacgctccctatatcattcgggaggcgaacgaacagaccgttcatcatgtcccctgctcctgcgactagatccggcgccggcaatgctgaggcttggctggtgatagtcttgagatcgaagatgagggactcggctaccagtcggggtgcgggtgcttgcggagttggctggaaccgaggcggcgatcatggtctttgtctggttcaagatgttgacaacatgatcagcttggttgagtgcgtcttccttgaggagggtgttgaggagagtgattgctgcaaccgtgttctgctggggggtgcgaaagaccgctgtcccatcgacgtcttgttgcccaatgagctctctcgctcgccgcccagattctaaggcgcgttgtcgtcgatcttcagcctcctttgcaatccgttcgcgatcttgttgctcacgctgtagtcgttctcgctcctgtcgctgtcgctcttcctctagtcggcgacgttcagcttcttgccgtgcacgatcttggtccgcttctcgggcttggcgctgttcctccgtttcgttgtcagccatgaatacgccgaagaagaggggcgtgtagttatcctcatagctgtcgtcgaagttgtcgaggtcgccgtggtcgtagtggtagccgaaatcgtcgtagtcgaggatctcggttggtcgagaactgacgccgggggagctgaggtagccatccaactcttccgtcgagactgtcccgaggggttggagtatgtcacatcctgaatttttgtttcaggatttataaattatttaataaattattattagaatttatattaaatgttcattaatttacaagtgaagttaaatgtgggaaataaaatttcctaaatttaaagcatggatggatttaatttttattaaattctccatggttaattatactctctggaatattctcggatttttcggagctcaattcctaatttttaatcttacaaagagcatttcagtaattacccacatattaaattaatcattaaatggtctaattgtaatttttttaagtactttgagtgtccaagtattttgaggatttttcttgaaattatttgagcattggaagtatttttaacaattcaaagatcatttaagtgattattttaattgggaaagtaataaaatcctcctcctcagcttgggccattttcggcccattccttcctttccttcctctctcttccgccggcccaacctgagccgcctcctctcctctcagcctagccggaaaagtctactttccctccctgagctactgttcatcttccaactcaggcagagcccgagccagccgtgccgtgcacagtgccgccgcctcttccttccaaatctcgcctccccgttgctctttttccaatttagttgaggggaaatattcctcttatcctcctctatctttaccccaaaaatcggagctaatcgttgagtatcttatccgaatcgagctcgttttcgagtttatctccaaaaccgagtttttgatttcccggatcgatttcttgcgggaggagtccgatctcttcaatccaaggctataaataggaccccctagtcctcctctttcgtttgccccctcccccgtggtctcccgtgcctcgtagcgccgccgccacgtgctccaccccgccgtcgtcgccggccgagctccatccgcgtcgcgccgccgcctccgtcgtcgccgccggtcgccgtcaccaccgttaggtgcgcgggagggtggacaagcccggccgcctgacccccgaagccgccgaccaccgcagccccgtcgccgccgtcgaccgaagccgcgccgccgctagacctcgtcgccggccgtcgtcgttcgccgtttggttcgagggtgggtaccgttgggttcgtctcgtcgtcctctacgtgttcttgtcctccaaagtcgcagccgaccatccaatctccggcgaggtcgccatcttggttcggccattgatgaggtcatcatcatgacgtcatcatcgtttttttctttttcctgtttttctaatagattaaatcttcggaaattcataactaaatcatcgtaactcggttttgagtggttcaagttgctaaattcatctaaaatcatgatctacatgtttgtttactttatatgtactgtttatttggtttttattagtctttttcttcgttttgcgtgttagtttgtcgtttccgtcgttgcgaaggttcgtgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacctattcctttgttatggccaatttgcattgattactttattccttgataccttgggtaacaaattgattagcttgaaccttatatattggtttggttcagctaaatgctatgtatatataattgcttagccatgcttagaaacattatcacataattgggataactaatgttacactatcacttatgattatatttaatggtagctcacgatgtttaatcgtgttatgataattaattgataactaaaacttgacaatggtgggttgtgagcacatggttttgaaggtcgtgctcatgacaattaaggaccggttcacgagctactgttgtgaaatattaaccgtaccaaccacaagccagcatgggcaacggctttaccttctgtatagcatgattcattgcggggcaccagactgagaagcggcgagaagtccgtgggggtcgctggggagtccatgcctctggttatatttatagagggggtgattatgatccaggaatggtgcactgtggtgagttgtgttgtgcaaagggtattgtcacagcctctattcgggtactttccagtatcgcgacgcatggtagacatgatgatgaggctgtgtcttgtgggtacagtggtacacctctggccagagtaaaactattcgaatagccgtgcccgcggttatgggcgggttgagcaatgtttttcgtgattagtctcacacctctcacaataattatggatgttatacctggtaataatttgcttagctcctggtttggagttagatctgtacagccgggtatggttgttcaggatggttgggcctgtgcagcatgggtgtgttgttcagtgttgattaaaatttttaattaattactctactgttttactactcttaactctttgctaaatgctgctttcgcaaatgagcctatattatgccatcctttggtatccttgtgcacttgcatatttgctgtgtggcttgttgagtatgtcatatgctcattcttgcaataatcaatcaacctcagttgaagataaaggatccagaaggagaagacgtttggcttataccccagttgagttgcctgtgggagtggagctgaagccatcgctagaccgttaattccgctgcagttttcttttcttttgaaagtatgtaacactattattgatgattctgtatattaaattgtcagtttgtgtacctcggctgattcctggacgaggattttatgcacaaataagttcggaaattactagtgaatttctgggcgtgacagagtataacgccaacctccctggatctagatcggatcggggccaaagccggagctcgcctagatcttcgagtgggagatgtcttgactgtgaagacagcggccaagtcatcatgaagtttcatcaggattgagggataggacccgtcgtcttgatctggtcgcggaagagtagattggatctcgtccgagtggtttgaagccgactcgggagagatgatcttggagtaggcctcgaccgagttcggaataccgaacggcacgggggcctggtctctccccgactggtttgaatccgagtcaaggagagagatcttgccgaagtcgttggtgatgaagttgaggctgccgaacttgaatgcctgctcgggagggaaggcgaagtcgtcgatgccagagacggaacccatcgcacttagtcggcaaaaaacttgacgctaccctacctggcgcgccaactgtcgaaacaagatttcggcaataataaaagggggtggctatcaagttaggaaagtggatgggttcggagacaaagaattttatacaggttcaggccttcttattcaagaagtaataccctactcctgtccggggatgattccgccgagtatgttattgattgtataaactgggaaaaaagaatcgcgccccaagaggcacatggaccctccttatataggggaaggagtccgctttacaaaatacagtacatatcctaacggaatatgggattacacataaaatacaatcgtaaccgactaggatcccgggtattttcttgacatataagtttagaattaacccgagtactcatagagatattatatctatatttggtaccatatatccgactaaattataactgtcgtgtagatatggggtatccataatctccacagatactaacagcaacgaaccttgttgtttctatggaaagttgacactttttattttattttttgatgcatttatgacgatcaaatcccgtgcactgaacgttagaacttagaaccattcagtgccttgttacgaacagaggtggtgcaatgcatgacatgatctgcacttttatcactgaaattgaggtctgaatgttttaggtctggagttgagtttgagttttgaatcacagttcagtgacttcagtcctgatgatattttcccaatccatacatgttgtattccttgcatcactagccatcatagcagaagggaatgagtaactataattttggttgcggcaagtatttctgaaagaacctgttaccctgaataggatttaagtgtacagcttaattaggtagaaaagatacagaatgctgtttagtactccttacttgaaggcctttgacgaagccatgtccatatggtcaaatgtcatctgtaatatttcaaattcaggatggtgtgggatgatgagcttcatattttaaatttcctttttatcccagaaatacttttatgttatttgttaggtttaatatggccaaatttaaaatatgaggtttttagccctgcacttcttaacctgaacactcttggatatgcatagaatcttgtactaactttctccattgcaactgaaacactcagtttttttagcagataagcattacgttgtgaaaaactgaaaagattacaggtatttatggtaaagtagaaacctaaaataagatggaggaaggcgaccagtacaggttagtgccaaataaagggagtatgcaatggccaccagtaaggtagtaacaaattaaatgttcaccagcaggataaggactaatatcttatattcgcgcaaaaaggactaatatcttatactattttgttgggttgcattaaataaaggttagtctttgggtaatgaaatgttttctggttaacattcagttattaatatgtcaaacatgctggtctgtgaatgggatggaaaaccctggttgattcttttacaacttattatgtttttaatatgattgtagaaacttgtactaaatttttgtaccgcttgctgattgataatctctattggacactacaaaatagacgcgccagttgggtcggtaaatgattttcacacaatttaagttcgtatgaaattttccctatatctccccttttattcatatgaaaagatagaaaaaaataataggattgtattcctgcgctttgcttttataggaaaaataacaaggggtatgatctcttgctaaactttcatttctttttcttatggtactatcaaagtgttcctatcctgtttcttgtgtttttattcccgtatgattggagaagcatgccacttcaaatcttccgttttacccatttcccttttttttctaccatgtgaatcttagaacatagaattttgcaaaaaaaaaaatctatgttcaaatggatcattaaaaaattggtgcatatctacagttactcaagtactacctcaggttataaaactttctagcattgctcacgtttaactttttgccacttttaagatgtggcaattaattatttgccactcgtgttctttgacatgtgggccctcatatgtcaatgacatgcgggtccagtgacaaatactttatcaccactcgtaagagtggcaaattcttaattattccttattctacataggcatcaaatgctttgtttttgtacttgtttacacccgcaacaaattaatgaaataactcatttactttttaaacatacttttaaacgtatattgccctctatattgtatactaagtgattatgtaatcaattctggtccagatttattgtgcctatataatatcatattattgtactttttgtgaaatatatttgattaaggcatgcattgaattaaagcttaattgtacatatcataaaaaaaattgctaacatgaaattttaaatgttaataaagataaatagaatagtcccgtagcgtatagcacgggcatattactagtcaaagttagtacgagatttaaaaggtatcacggatctgaacagagttcttatacagatttttagcactagatacgttatattttgtagtattagatttgttttgatggaaggttatcatcaaactaataggataagtcctataaaaaacttaattaggagtagcaacatgttaatggagcacgttggcttttcgattccaagatctgaaatattttactactccctccgtttcaggttacaatactttctagcatgatgttaatgaatctaggtatgcaacatctatatgaatgtccctgaaaaaaaaacatccatatgaatatgggcaatactagaaagtcttataaatgaaacagaggtagtagtatttcacgttattgtcactcctagaaaacagattttcctgaaaactcccattttcccagacggaccgttttcgcgtgcatctacgaaaaatcggcctcccattttcgcgtgcagatccttaataggcccgcacgtgaaaatcgtgtgggcctcttaagtggaccgcacacgaaaatacctctccctcttttccctctcactcacttcaaaattttcaccttctctcttcctttttccttttattctccctcaatcactcatctctcccttcttttcctctcctctcctcccctcccctcccctccccaccgagcgcacggggtgtgggaggcgcccggctcgctgctgccgccaacgaggcggcgaacggaagcaggcgggaggcggcacggcgagcgaccggccggatctgcgccacgccaatgacgaggaggaggaggcgcccgggagcagtgacggcggccgatcgcggtggcggtcgggatcggatggctcggaagcggcgcggtcgggagcggcggtggcacaatgacggcgatgacaaggacgacggtggccacatgcggcagcagccggcgattctagggttagggtcgttagggttttggattttttggattttattttttttcgtttttttgcgtgcaggcggtataatttgaccgtaggggataatcgatcatcttgtacggtccacttaacccgactgcacgggaagatggattatcccgtgcggttgggccacccgcacgcgaaaatatggattttcgcagacacctaggtgcagctaggcgggacctccgtacggaaaaatgcattttgaccgcacggaaaaatattttgtgtatgtgtactagtgtgtagtacggcatgagtatcacttgctctgttattaggagacatttcagattttaaatagactagcaaagtgttcgtgcgttgctactggaaaagttacaatatatcatatctagctagagaaacgtgaaaggcaaataagactacgataaaattaagtgagaggactggagagacttaaattagtaactacacctcactcatttagctacttacgtcaaactacacatgaaatatctatagtcaaataaatcgataaccgatccgaaacaagagttagagctattgattttttttttgaaattatagacctttgtcataggttggatttgaaattaagacttgacactatttggacgacgcagagagcgtaaaggaagtcgttttgaacagcgacacggtctccaaaacacaactttgatttcttgtttctataaaaatatttattgaaaaatgatatatgtatacttttatgaaagtatttttcaagacaaatatattcatataatttttatattttcaaacacaataacttgagagttatttatgatttatattcctaaggtttaacttaaatattattctaaatgattttcttaacgagtacagagagtagtttggttgaaccaatttaaatcttatggatagatgcatagaaactttctctcgcctcgattatcgtatggacgatatgatagtcgagactcgagagtacatcacgggctcgcggtgattagctttggctgcttggtgggagcaatgagctaggtggcgagaggagtttaggtcacgatgaggcttttatttggcagactcagctcaaggaaagttttgtgggctgtgggcatcctagctatttgatcagcaccgatgcggtcgatctttggatggatgttgtctctaccaatggacaaaaaaaattcttgaaacttatcaaatcaaattgtgatcacgaattggatatatacgtgcagaaaaacttgacccaaactgatttagtaacgcacggaggactcccgcgggactcgggaagtacgtcaatgcgtgcgtgaaaaaacccaaaaagcacatcaccgaaaaaccgatacgaagaagaaattgatgaacgaagaaaacaaatttcgctcttcatagagataggatatatagaacattgcggggtgtcgaagaggtttttttccgggacgacttttttttcctggaatcagattttaaacgttgagcgaaatgattttttttcgcgaacctttttttaggctgcgttttttcttgccattttttttcctcgaatcggattgctcttttttctcgttgcgtggaaccggatttttgtttctcgcgttacgttgtgccaaactttttctcatggaatcataggaaaatgcttacggtcgaacgtccgatccagctaaaaagatcggaccagacgcaccgtataacacttgccccaaattacaaccaacatacatgtcgtttctttttcaacaaccaatgcatttctctctttcatcagtcagctgacatactacttattgttcatgcatgtagctatttaacaagcttcaaatgtttttttccaaataaccatatattaaaactgtgattcgattacactattatatttattgtagttaaatctttataacaagatacgatatgactatattccaatcaaaacattttttgtagcaataaatctttgtttatgtttcaattattttatttagatgtttcaataagtatttcgtaatgtttcactagtttatttgtaaatatcacatagcatgttttaagaatgttttagttggtaatttgtgatgtttcaatgcttatagcgtgatatttcagacgtggtataaaaagtattaggtatttgtaaaatataatacatgttgcatatgatattttttctatgtttcattcattatgactcaaagtttcatatattcattgatggtgttgcggtctgtatattattaaatgttgcatcttctggaacatttcatgtaatgagtagaacaatgaaacatatttttggtgaaacaatatcccattgtttgacaaatattttttcatcctttttaaatttttttatggacacgtctttttgtttttgctggattttttttattgtgacacggtattttttcccgtggtgtagaaatcgaatgatttttttctgcattttttgggattctttttttccggcttatttttcgttgcctaccaatgagacgtttttttcgctgtttttttattttctttacatatgcgttgttttgttttttcatggcttttttccgccactgttatttttgcgatgattacgaatcgtactttttttgctgttcttttggacggcgttttttttccttgtatttttaccgaacttttgtttcgccttttttttcgatggtgttttattatttggactgtctagccaacattcggctgataaaaaaaaacagcatgctgctctatagcaaatcccttattttttgcgtgactttttttccgctctctttttattatggacgacggaaatattttatactttttaagtaagtagaaaaaatgcctgtgcgttgaaacatgtgaattatattttaattttattatatttatacggtttagctaaatgaaattcatcgtcggaattcgcttagatatttttttagaaaatcatgagctgtaattaggcgtacgactttcatctcaagttagcatgcgagttttattacagagatttcttatacgacttcttttgcatttttaaaagtaaacgaagttaaaattcaactcaaacacggatatgtattttcaaaagcgaacgaatttaaaaaccgactcaaatacggttgacgtattaaaatactgacaaaaacatcttcaatttttataatagtagagatagagaacagacgtagagatttatgcatgagtacttcatcgtatatgcgtctaaatttgtaccgatagatagaccaaaacatcttaaaaaagctatatctattcgctccatcatataatataaagaattttgattttttcttgcactatttgactactcgtcttattaaaaaaaatttgtgcaaatataaaaaacaaaaagttgtgtttaaaatactttaaataataaagtaagtcacaaataaaataaataataattctatttttttataagacgaatagttaaatagtgtaagaaaaagttaaaatcttttatattatgggagtatcgaaggaaccacttgcggccaaatgtgggttaggtggtttcggtgtgcgcgccgcgcacccggctgccggcctgcgttgtcggccgctgctgtcccatgccccgttcccatgccgcgcccggtgacgacgcttggtggcgtcgtgaaacgcaaaggaaaatctcggtacagacagctcggcccagtactacaaaaacaatcaccaaatcgggcccggccacacataaaagcgtcctaataagctcgcgggcttagcacaaacaataacaatgttgatgttattatgctaccactaattaatgtcgcatgttaatatatatgcctttgtagtttgtcctcgtatatcaccaccacattttatatatattcgtctcgttggacaatcagtgtgctatgtgcatttgtgtgtgttgcacatgtttgacaacgatcgatcgcttgcacgcactgttcatcactgttgcgtgagaggatcagaggactcgaccaaaagggatgttccagctttggcaaccggctcacgtatcaagtgcgtcagaccatatctgtctcgtttcctttcctaacctttctttttttttccctgaagggtgtgctttctgtgaaatcagtagaggatgtaaaccatggttatattcttaatttctgtttggtattatcgtagattatgataatttcgaaccatgtgaaacaacttttatttaaaactatgttacatactactctccgtctacaaattttgtacagggactataatatttttatgatctctccataaaataaagaaaattatttcaggtacttcctcgaactgatcgcttggcgcatttaaaccctaaattttttggataattttaccctattctcggtaatccactttacttcttattgatatttctttttttcctccttaaatttgtatttaaagtttcagtttttttattccccctatctccgtgttgatgaggtgactcaaaaacgactcatgctttctctcggctgaccctttcctcctccagttctgacggctattagtcaccgattaggagggaggagcaaccgcggtcgggcttgttccgtggttggcttaatcttgtttccctttcttgttcaaattgaaggacttttcaatgtccacctccttcatcacggttgtggctagttgtggttggaacttccaaacttctctccggcatctaccatccggtcgaccgctaactactactaggcgtgccaccaatgcttgccacagagagagcagtatatgtgcaccagatttgatgtcagtcctccattttcacaagaagaaggttgtcccaaatgatatgaacttcttcaatgagttttcctcaatcgccttccccaagaggagagagctatgcagagaccgagggtggtcttagaatgattgtatcctcttgatgtaattatctaagatcgataaaactctctttgtcaaaaaaaaaaaaagaggagggagctattggtggcggagagaggtgcaaatatcatgtgaagggcaggctgaacgatggtgctagtcaaagtgacggaagtgggcagtgcactaggcggagatacatactttccatggtttattattggatgacaattttgtatggttctagcatcatagtttgactatgtaatctaggtagttcacaaatgatatctagaactaaaacttgcaatttgtgatattaataaagaggcaatggttttcgttaatctctattgagctttcatagctatttttcatgttaaactagggggattgccttgcgcaaaactgcagttttgcccgttgctagataattcacatagagtaagatttaatatgtaactccaaaattttatttatataggtaccattatatgtgaaattatatttgaatttcatatatgattcttaggttctatttttataagctctagatttcatatacaactcttaaattctatttctgcagatataattgtattttatatagaacaatatcaattgatctacacttttataatccgaacccaccatgatctaacacttaagatatttttctttttctccaaataattatgtgacaatttctggttttcaaaatgaacgtggtgccttctttcaagtcagtcttagtaaaatattataatagatagatactcccttcgtttcaggttataagacattttgactttggtcaaagtcaaattgctttaagtttgaccaagtttatagaaaaaagtaataacattttcaacccaacacaaatttattatgaaaatatattcaattattgatttgatgaaactaatttagtattataaatattactatatttgtctataaacttagtcaaacttgtaacagtttatcaaaacgtcttataacctgaaacggaggagcagatcataatgtccttatctgtccttatctaggcctaaagttcttcttagcagtaagtcttcagatggaggaaaaaaaaaacatcacgtagcaattttttttgccatgttttaggttcctctctgttcttctcatagattatcttgcaatgagacatttgccttttatttgaggtccaatttatgaggctcttggattgagggtttacttatgttcttttgccatattgtaagcatgtaagtgctggcgttaattacttatgttcctttggtcatatagctgcactatacatttctttcaaatccataattgtggtttgagtaaaatgcacctgcggtccttaaatttgtcagcaggtttcacttaggtncacnaacttgcatattgcacatccaagtccctaaacttggtttattgtatcatcccggtccaaagccgtgtttgaccgtggtcttgctatacgtggcacgccacatgaacgatgacatggaattgggttaaaaaaattctcccttcttccttcttttttcaccactgctacagcccctcccctcgtgccgcctctcaccaccgagaaaaaagaaggaagaaataaaaaaaagaaggaagaaggaagaaaaaaaaattccatgtcattgtccacgtggcgtgccacgtagacaagaccacagtcaaacgcggctttggatcgggataatacaataaaccaagtttagagaccttgatatgcactttgcaagttcgtggacctaagtgaaacctcctgacaagtttaaggaccgctggtgtattttactcttgtggttttatccatacgtgcttgtgctgcagtccattttgctggtgtagtgatattaggggggccatgcattagagttttggcttttaatttgtacgaaatatggtgaagaactttagatctctctctgtggagtattgtattagctgcaataatttcaaactttagggatctcaattcttgttttggcattagaaatttgaactgtgcacctgtcattttgctggtttcttttcctctcagggcaggaggatcatccccactgacaaccagaacacggcgtcagtatgcctgaccaatcaattaatgatggatgccactgacaaccggaccacggcgtcttcgacaccaccatgatttctgactggttattgggttaagcttcgttatgtcatctcctaatttttttatgtccatgtttgcttagagcaagtttaatagtatagccgactactaactctaattcatctatagctaatctaataactcattcatacaatagttacatactacactattaatacctggtcccacttatcatacacacagcgtgtcttagagtccgtgctacaactggctataaatttgtagtccgctgctcttctctctttttatttatctccttaaaatatgtttgcagctggcttatagtttgctattgtacctgctcttacgatggtttatcattctccagatctatgaactggttcttgatcatttgatcatcatgtgcttgaaattttacacatttggtcctgagtctgtattaaatgtgtaaaatttcaagtgataaggtcttctccagtgtcatgatcagtttgctgatcgtcacattatcaattagtcccctttaattaatccaagcgtgaagcatgcatgcttacgtggaacaattaattatatataagccttgcggacttgcacaaacaaagatgtatatagaggcataagtacatagtactccctccgtcaaaaaaaaaaaataaaccctggatttccgtgtccaacgtttgactgtccgtcttatttaaaaaaaaatatgaaaaaaaaattaaaaaatacaagtcacgcataaagtattaatcatgttttatcatctaacaacaatgaaaatactaattataaaaaaattcatataaaacggacaatcaaaagttggatacgaaaacccagggtttatcttttttttggtcggagggagtatatagtaggagtagaggagcaagactaatttgagaggacacaactctgaactgtcttactcaagctcagcaagatagatatcgatggcaaaggagtgcggcagcagcagtgtgatcgtcggggtggtgaaggtgaaggtggtgcgagggaccaatcttgccgtccgtgatgtcttcagcagcgatccctacgtcgtcctcaagctcggcaaccaggtgatctctttcactctttcgacctgctaattaagcttgctagtacgtactattgccgagttattattgaaggcctgttcagattgtaattaaaacaaaccttactaaaatttggtaatcttgctaaatactgcatcaatttagttttttaccaaactctagtaaatacatagaaaatcctgtcaaaacttgacaatattaccaaattaaaaaaatggtattgctaaaatttggtaaggtttattttggctacaatttgaacatgccataagattattaaaaattgctccgtatttcgaacgaatttgtaccaaattaactgaaatatgttcaaatggatcatctgaaacctctggggtataacattagctaagtgaaaggaattgatttgcgagatgtgcatacgtatacgtgccattaaagatttactggatttaaaaaataacattactattcgactattcacaaacatgccattacaatttcgatgaaacaccttccatgccacgttatacgctggaatcgcgtctgtagccgttttttgtgcactgtattttcgtatggactggaatgcccccagcatatgttgaagagggacctcatctattcggtttgaccaaaccgagtccctggaaattaaatcaccactccctggagtggcctcggtacaggggctattattcaagttggaccattgcaaatgctcttaggtagaggctttatcataacaatttatggtgttcatcgattgatttggaccaacttaagctgccgaatggtgcggtcgtgactcggtcagagctaaaatatgtagttttcgctgccaatgcatgcattcatattggttgcttcaaatgcttaattagttgcattattatctcatgacacatcgatgtgaatgtactgacaacaatcaagataactgctacacgagttgggaattgaaagattagttactggagtatatgggtaatcacaaatgatgcggcattgacgtacatcgagttggttttttagataatggaatagaaaatcctggtatttgctcaatgagttacaactaattattatagagtagcatacaaaataaaaagtttctcacacaaaaaagaagacacctaccaacccaagataaggagtacacaattattgaattctgtttgtgaatcttcatccaaaattagtaaacagttacataaccattgcctcaagattacgacatcgagttggtttgggggcaaaaactaatagttggtgacaaactacctgtttggcgtgcaattcggtacgtagagaaatacgaaaatgcagtcatattgtttagctatacgcgtaacaacagtcatatcttggaaagagcagtgtcatgagtacttcgaaaattcttacaacatccttgccaacgaggaacgaagttctcaaccatttaatttaattaattaaaaatcatagcaaatcaagattcaatcataattttttacgagaaacaacaggattattaaaataaaatataaaaaaatgatatttacaattttatttatgaaggattaaaaaagaaaagaattttgtgaacaaaggatcgattcaatcgtaagttcatagtgtgctgaattagtacgagggatgagcggatctttatagttctggcttagttgtaggccagaaggcgaccgctcttgtatagcggccgggggccaggttgtgctaggtttcagttgtgtggagctgtcgtgatcagtaggtggttggctcatgggtgcagttgcctagttggatgattttttcttggttctttttttttatagcttccaaggctttagttatatatatattttttctaatttgtcaatagaatcttcggtctggtgttggtcgttaaaaaaaaatgtgccatatgtaacaagtgattatggcattgtatgttttggattgagcgtatcgtttatacattaattttgctatatatttgttgacaaattttctcctaaaaatttgactgatataattatagtataatcgtaatgtaattgcactgtaacttacatatatctataatataatgtaacatgtatgtaactttcatataattttaaaccgttagatttgtttcaagatttatttaagtcactgacaatggaaacctgactgcaggaggtgagaactcgtacagtgaggaaaaacaccaatccagtgtggaacgaggacctgacgctcatcgttcaagatctcaaccatctcctcgtcactctcgttcgtaccttccaatcctccatcgatcgatcgatgtactccattgtgttctcctagctaggctagagatcaattaatctccgcttgcttgcttacaggaggtctacgaccgtgacccgttcgtcgacgaccccatgggcgcggcgttcttcgagctccggccgctggtggaggcggccgcggcgagcagccgccgccgtaccccctccggcgttgacagtaaagaggacggcaccgccgtggtcccaaggagcgggagctccgttgtgtggtcggcgtcggaggggaaggcggcgcagggcctggtgctgaggctcgccggcgtcgagtccggcgaggtggagctgcagctggaactggaatggcacggcggcgcggctggcgacacctcaatgatcgatcgattgattgatcgtaactcgtaaaggcctgaattaagacagaataaatcgactgagctagctcaagcttgtaagatcgagttcagtcagtacctctggttcgatcgaaaatttagtttctcgtttcgatttcaagaaacaaagcagctcaaggatcttgcatgcttgtattactattgaagcgattgttgagacaagtttgtccaatgctttgtgatttctggtaaattggattattaaaagttttatcgcatgattagctatatttatagcaccatcttttaagaaaaaaaataggctgttcattttttacattctaatttacatacacattataaatacactgtaaattttgtaagtttcaatatttacatttgtaatctatactaataatataaaaaagatagtagtggtggcgaatatatcactgccactcaattattatacggtacccataaacaataagataaaactttacatggcccgtatgcctaactcaacagataccttcaaattaatagaaaaaatagcgtgatgatgatatattaaataataaaaataatttatatatactaatccgttacgacacacatgtattatgctaatttttctaatgcacaatgtataagagaattaggattggaactaatttattatttacttaaaagataaaagaactgatagaaaagatagaggcatacttatacgtagaacaggggaaaattgactaaaattaagtgaaaaatatagcaccataattttaacaatgatgttacaatttcacatagttgcccaagaataaaaaaagagggggaaatattgagagggcctcgggcagtcgggctatctatgagctaggctaggtcaagggcgacccagtgtgtgatataaagttggaataaatctattttgcctccccaatctcttgatcctgtatcgctccaccgcaaagccaggtataatgcctccaccatcttcaataatcagtgcaaattaacttctcggtggtttggaacgtggtttttgtcaacaacgcccatatgtaagtgaaatatgataaaacatatgtggtgggccccacatgtcaatttccttttctccttctccacctcccccctctctctcctcgcattcttctctattgcagaggatgagttggtgccagcactcacgaaggcggtgcatggcatggtcacctcgatctctaggtctgatcggctagcgctggcaccattgcctctaggacgagcacgcatgcgcacgccaggtcggtgggggatcttagtgcccgtttgtccaaggggagcacctcagagatcacgtccatgacaaatctcgcctgattgatgcaacgcttgagcacgttagggagctcgtcacggagtgtgtccacctccttgcgcgcgcctcgcgacccgcaaaagtgaagaaccccgccaagtccatgctagcgcggagtgacctaagtcacttagcaattccatcggtggagccggtcctcgcgcaaagctcttggacagggaatcgagctgcaagagcgcgagatggagccgtcgatggaggcctcctggcggtaaagcgcctcgagcctatagtttccgatgtggaatacttctttgtcgtgtagtagctcgtagtgaaaagctgccatggattcgatgacgagaaattcatcagaggaatagaaaaacaaagagagaggaagaatgttgcttgccttgatggccttttctattgcttcctttgcaccgcctcctccttagtgtcattgagctggtgcgcaacgttgcacttttcccagtccttcgcatgttgaagaacatgcacttggtgcgggccacggagcgtctcgaagcaagccgagaggcagtgctctagggaactgaagtgctccgtgagttgctgatacaggcgcgtgcaggtcatgagcaagaggagatgacgttgtgcttgcgctccctgcaccgcctttgcgagtgctaacgccaatgcatcctccgcagcagagaagaatgcaaggagagaaagagaggtgaggaaggagaaaagaaattgacatgtgaggttccctgcatatgttttgtcatatctctctaacatgtggacctcgcatgcagaaaaccgcttcccaaacaactaaggagtcgatttacactggttttcaaaaatagggagatcttatacccgattttactgttgaggattgtgacttaagcaggagggtaaaataggcttatcccatacaaagggcctgtttgggagagcttctagtagctgcagcttcttctacaatctccaactgctagaagttccttcaaacagttcagattttcacctagattctgagaatctgtaattgtagaattcagaaaataaactagctagaagctggatttcctagcttctctcgattctcaccctgctgcttctccgaatcttaaactccccaaacagacccaaagtttaggcacagcccggcccgcttttgggccttgcgccttccgggcctctcgtaaaatgcattgggccggtccatgtctcagttctatccgtcaacaaacctacaattaatactccgggcctgcacggcttggacccggtcaagactcaccacggtccacgcagcagcgggcagcgaggaggagaagatgccgccgcccgtgccgccggaggagcggcggaagccttcgccggcggagtcccgccagtggacgcagcgcttcttccaggtcctcggcgccggggagcccctcccggcccccgcggagctccccgctgcctactccgcgctcgtccgcggcgtcctctcctccgccgccgtctcctcctccgcctccccgcgcgtctcctgcacgctcaccgtctcccccgccgccgttgtgagcgcccccccccacccccacatctcctcctccgctgaatcctatcctattcctaccctagcgtcgtgatgacgtcgtcgctgctcgatccgcgacttgcagaacgggtacaacacgctccacggcggcatggtggcggccgtggcggaggccgtcgggatggcgtgcgcgcgcgccgcggccggcgacaaggagatgttcctcggcgagctcagcaccgcctatctctccgccgcccgactcaatgtgagcacacacacaacatcgacctcctcccaaccccaacaggcgaacctacgtttttcttttttcagaaaaaaaaattgcatcgttaaataaaatttgtttcacttattggattattcctatcttgggtattggagggaaattgattacagcgaccgatctgtggttggggtaattggtgctgggtaatctagcaagagatgagctttgttttctttaggattggaatctggcaacagctagtccaccatctgagatgaagtagtttatctaggactggtggtaaatatatttcaggactgcaagagggtgggtgatccagctgtagaaggtgtatttatttctaggatgaatcaaaatcatccaaacagggaaacaactgttctaaacagatggtgaaatgaacatagtttattcttttgtcacttaaatagttccagtgatatatttgaaccctttgctattctcttgatatatatgcatgtaataatttaccaatgaaagctgattttgcacaggaacaatccagattacagaattcagtccttctggacatggtgccagtttaataatgtgcagacattccacagcataaaaatgtcattgcactaccactttaccgcactgtgttgctagcctggtgcccaaactcacaacatcatataccctgtatgaaagcacaaattaaccatttcaaccacaacatacaaatgcaactcctcgttttcagaaacttccatcttattagaggtttagagtgaagtgtgtattcttttccctgatgttcccgttgtttgttgatgcagtccgaagtggaagttgaagcgcagatactcaggaagggcagatccgtggtggttactacggttgagtttaggctcaaggataccaagaagctctgctattcatctcgagccaccatctacatcatgcctgtggtgagcctgtgaaaaaccacatggtacgtggatgaccaagtgtttgtttacacaacaattactgtgtagtatatatatgtgcatatatagcaaatctatatatgccacattcacaaacatagatgagaacattatcatatgcctatccagcaaccttccaaagctcagatgccttgaaaggcttccctttaagttccgcatccttgttattttcacttggaacttcagccaacaatgaatgtatgttagtcaggacatccagacaagaagtatataaaagattaaaccatgcgagctagtatatgatacagttctgttttcacgctttgaccttcaagtcttattgctccgcagtattcatccatgtcctatttaaactgtggtttccgttgaatcagattcctcgcaattcagatcccagcatactcttgttcacgttcgtgaggtttttacggaataaattaaatcttaaaatgctgatatttaggacgctttcttgcagcaataaatagatatttatccagtttatacatgcccacatacgccagtttatacacggcatctcccagatgttgggccatatattttcctgttctattcactgcatttcgttcgtcatactgagcttctaaacggtacgatttttgtaaaacctatatttatatataaatttcttagaaaattgttttaaatttgttcacctttaaataattatcataaatcattccactattcagccactgcttgcctagacgtcatatattctgtcagagtaacaatgtcacccaaatactcttacatgtccaaccataccattgccacctctattgacacgccgacggcataaccatgatactgtcttattgggtcatctatctagctgtatatccctgctgcatttgttgcattttgcattccactgcctggacaccattctgtctgtcagaggcacaagttctctgaattctatcatgtctttaacgatttatggtagttccttcggccctcggcatgaataggcctgtaccccctccatttcatattataagatatattaaccttttcataatcaaacttatttaagtttgactaagtttataaaagaattagcaatatctataatactaaaatagtttcattaaatctaatattgaatatattttgatagtatgtttgttttgggttaaaaatgttactatactttcttagaaacttagtcaggcttaaaaatgtttaaaaatgtttgactagaaaaaaaaaagacagcgtagggagtagaattcatacatgtccaaacggtgaccattgctttctagttactggaagaaggcacggatacacatgccatcatatacatgcatagcacatacacgcaatgacaatgcaagattttaatacaatggggttgaaatgggatatgatatccatgacaatgcaagattttaatacaatgggattgaaatgggatatgatatccatgtggccaaatactcagttggccagaccattataatttaagttttgatcctgtggttgaatattttgaatggacaaatcattgaagtatgatacttataattggttagtttggttagctagttaagttcgacaattgaaaagattagttgctacttagctgagtaattggaagctgacgtggtcacatgagcttgcttcattaatattcagacattcagtagatggcaacaaagtaaatcacgtaattgaattaagagtaggaaatttacatgatttctttgttagttacatagagagaatactcagataagccagggaacagggcagcggtgccctgtaaaaggtgcagtggacacatcaatttatacttcctataaatcaccaatacaagtgcatgactttctttttccgattgataatctgtggctggtcagagaaaacatgccgaatagctatatttatattttgagtaaagttcatcaccagtccctaaacttgtaccgctgtgtcatcccggtccctaaactccgctgtgtcatctcggtccctaaactcgcaaatcgatcgttcaggtcctcaaacttgttcgactgtgtcatcccggtccctaaacttacagatcactcgtttaggtcctccaacctgttcagttatgtcaccccggtttctaaacttgaatgtaaatatcatctgggttaaatatgactgtctaaagactttatatttaaaaataattcataccttttccatgtgaaatctaatgaagacaaactttatataaacttgtagccattgacgcgatctacaactatagttgattttttttattttaagtcattttttggtctcaaaatgtaattttaaaattaaaatttcaaaatctataaacatgcaacaatattttgggaccctaaacagttttaattcaaaaacttttcaactacaaatttgtaagtcgcgtcgagggctacaattttgatataaagtttgtcttcattagggttcacatgaaaaagttatgacttattttttgatataaagtttttagaccgtcctgtttagggaccggggtaacacatctgaataagttggaggacctaaacgagtgatctgcaagtttagggactgggatgacacagtcgaacaagtttgagaacctgaacggtcgatttgcgagtttagggaccgggatgacacagcggtacaagtttagagaccggtgatgtattttactcaaaatataaatatagctattcggcatgttttctctgaccagccacagattatcaatcggaaaaagaaagtcatgcacttgtattggtgattttaacatgctagctgtcacaaatctcagcacctcggtactcgggtgatcgagtataatgaatctgagcgcttttggactgattgatcgggtctatgatactgtttgggaaacttaagattatgattatgagaatttgttggctgacagtcagtttatgagagtatgaaagagctgagttttttgcttatggtttctagttagttttctggattgtacaattatatattcgtagaatctagatcacaactgagaagctacagaattctcttaaatagttcctatatactatggtaatactcctgtagctagtgatcctgatcccggcgcactgaatcaactcgaattagcgaatttctctcaacatactcgaaagagagagagatttggcgaaacataatgacttgtttctctattttctttcttttacttaggccgtgtttagttgcttgtcaaaattttttttttgacgtatacggatatacatttaaagtattaaacgtagactaataacaaaacaaattacagattccgacgataaactgggagacgaatcttttaagcctaattaatccatcattagtacatgtgggttactatagcacttatggctaatcacgacgtaattaggctcaaaagattcgtctcgcgatttacaggtggactgtacaattagtttttctttttgtccatatttgatgcaccatacatgtgtccaaacatttgatgtgacagaaaagttggaagtttgaataaaaaagttagaatctaaacacagccttagtgtaagtaaaatgagtggctgacgatcgcgcccctcgataaaaaacatcctgcaccatcccacacgatcgatcgtgacaagtatggagaaaagaaacatcgcaataaatttgtccactgaaagcacacatctcagggtcataaacaaaaagcgccctctccccacgtagtgcagccacgtggcgcgcgcggaaaggggagatagcggagcatgtggatatgcgacagtttttcctttttctcatgttttaaggtatttttagtttttactagaaaaatacccatgcgttgcaacggggtaaaaacgttttttaccctatacattatactccctttggtttgggactgaacgctcattccatcctttctagctccagtcctaacctagtccactacctccctctactcaacctatcttcgactcagcccacaagtggaactgtatgcccatctcgaacaatctcgtgcctgtaccataatgccgatcctcccatcaaatccgatactccggtcaagcttggatagtagccgatcctcccatcaaatcctgtaatctggtcaagcttacatagtctcgtgtccgtacgatgacggagccgatcctctccatcaaatttggtccaatctttctcgatctccaaaatttaatctggtcgagctcgtatagtcttcatagtcctgtgcccgtgcgatgacagagccgatcctctccatcaaatccggtccaatctttctcgatctccaaaatttaattcgtttgagctcgcatagtcctgtgcccgtgcgatgacagagccgatcctctccatcaaatccagacaaagccaatcctctccatcaaatccggtccaatctttgtcgatctccaaaatttaatccggttgagctcacataatctcgtgtctgtacgatgacagagccgatcctctccatcaaatccagtcgaatctttcttgatctccaaaattgttgagggattttaatccactcaatctcctttttctttttttttattaaaatctccaaaattgttgagggaaaatgatgagagagtagtgaagaatcagtttttgcaattaattggagaaggaaaacatggggaggcaaaacaacatggtggtgacgctgggtttgacacggcgaaataaaccgcaaaaaaaagcgacaaaagaaaaaaagggaaaacggtgaaaaaaaagaaaaacggcgaaaagaaaataaaacggaaaaaaacgaaaaaaaggaaatggaaacgaaaaaaaaggagacagacagcgaaaggaaaataaaaccgaaaaaagggaaaaaaagaaacagacggaaattgttggcagaagccttatgtattttttaattaggtatatagatatgtagtatacatacgtatataaagtttgtatatatgtatatattttttatacatcaaaagtgtatgcgtataaatacatatatattgtatatatatgtgttgtactttacatatgcgtataaaaatttatacatatgtatataaagtatatactacgtatacacgtagagaggagagaccagggttttaaatttcgaaaatgacatttctgccgcaggtgggtgatagaaccgaaatttcggaaattttcgaaaaatttcgtatgagattttttaaatttttgacagattttgaataaaatttaaccaaattcacaaaaaattacaaaaaaaaaccaaaattttcggtcgagatgttaggatttctgtgaggggcgaaatttctgaaatttctaagccctgggagacactggaggggggaaatccactgcgcgggagtgcaactacccgtgtagtatcccccacacaatgtcttataagtcggactcactcaagaatagtgaaaaagaaacaacgactgaaaacctatgcggtacagtaactttgaacattgaagaaatcaagaaaatgccaacaactcccattacacaaatataagtatttctaagataaatataagtatttttaggttatttagtacatggtagggattaatagttacaagaaaatattttaggttgtgttctgtagctggtgagagaagatttctctagttctctacgtgcacgctttccaaattaatgaacaatgtgttttacaaaaaacaatctataggaaagttgctttaaaaatcacattaatttgtttttaaaatttaaaatagttaatactcaattaataacacactaatggttcacttcattttacatatgttctcaatcttccattttcatgtcaaatcaaacatagccagtgtccgttgtcaaggagatatgttagggcattagggggtgagagatggttaaagtgcgacagtgtttggaggtaaaatatgaaaaagatataaataagaagtgatttgatgtgataagtaataccgtatatattttttatatttgtgaataaattccaaatactttaaaatataggtacagccatatggcggattccctacaaaagagagaatactcagataggccagggtacaggggttccctataaaggtatggcgcattaaagacgcacaatcgacacaaatcaaatttatacttctccaaattaaaatatgagaaaaatcaaagaattgcacaaacgtcctaatccaagaaataccatcgacgaacccaacttgaaaatgtcatcgtacaaacgcttttgtcacagaaatactgttaccgttagatttccgttaataaaactccactaagtgctataaaagactattttacccatatgaattgttgaaaaccaattaaaacttttgctctttccatcaacttactataatttagagcaacctacaaattgtaagctgacggaaaaagaaaaacttttaattaacttttaataatttgttgagatagaatcgtctttttatagcacttaattaagcattgctgacggaaacctaacggcgattgtatggctattgtacttgatgtgatttgatgatataagtaatactgtataattttttaatatttgtgaataaattccaaatactttgaaatacagatacaggtagagttatttgtttttaactttcaggtacaggtagagtagattcgatttgatgatgtgaggctgagatccaaagaacagccctatttttttttgtctagtgataagcctccgcagccctcggtcctatatatatccatgcatggtacggtaataatcaaggaagcagcaagctagctaaagctagcccagtcatggagaaagagcagcaagccggccatggcaagctccctcacgagcagctgttgctgcaagccagcacggagctcatgaacctcagcctgggctacgccaggtccatggccctcgggtgcgccgccaagctcggcgtcgccgacgctatccaccgcgccggcggccgcgccaccctccacgacctgcacgccgcgctgtccctccacccgaccaagctccccttcctgcgccgcgtcatgcgcgtgctggtcgcctcgggcgtcttcgcgcaggtcgaggaggaggaggaggaggaggatcactaccgcctcacgcccgtgtcgtccctgctcgtcaccgccggcgacggcagaggcaggagcctcctgccgctggtgctcttccagctctcgccgctatgcgtgacgccggcgacgagcatggccgagtggctcaggagcggcggcgaggaggagacggcgttcgagatggtgcacggcgtgggattgtggggcgcctgcagccgcgccccggatctcggtgagcacttcaacgacgccatggcggctgactcgcggtttatcatggacatggccatcaacggctcgggccgccaggtgttgacaagatcacctcgatggtggatgtcgcgggtggcaccggcgcggcggccagggcggtggccgccgcgttcccgcatatcaagtgcaccgtgctggaccttcctcacgtgatcgattccatcccggctgatcatggcgatgttgttcagtttgttgcaggtgatatgatggatttcatccccaaagcagatgccctcctgcttaaggtcagttatatccaatgtagtgttgctgacaacttttcatggcggacgcagcttcaaaatatagatggggcggagaacggaaatgttcactcgataaaagcaatcaaacacaacacatatcgtatttatagtttaatcacataactgcctcgatcattatttgtggcgtgcgtgcattatgaagagacggactaatttgttggacgttcacaccttgtcatacctaattttgatggcccatgactactataagggggtagagggttcttggggatgtagagcgacacgggtcgtagctggatcggtcgatccaccctgcctaatgggtagatccgcccctgttttcatgtattggatagcaagctaagctagtacaaaatttaagacattttagattataacattaattcttgatgattacagtttgtgctacatgattggagtgatgaggactgcataaagatactaaaacgatgcaaagaagcaattattccttctagagctgcaggaggaaagatcatcattttagatgttgtagttggatcttcttctgaagcaatatgccaaggaacccaacaattgtttgatctgattatttcggttacgaggaagagtggtgcaagatattcaaggaggcaggattcactaaatacaagattagcccagtgttaggttttcgatccattatcgaagtatttctataggtttccagtatatgggaactccactttatatatattcttgcactcttgggtgtggttgtcttcttttatcattgtcttatgcttcatggacgcgctatatatcgttattttctctgtaatatatatgcgaggatgtccttttccctttttgtccaagaaatctactagctaaatacccgtgctttgctacgaattaaagtaaattatatgtgtgctaatattgtttagaataaattaattgtgatgtttttgcacatttttgttcttgttgatgtttttgtatgataaacttgtattataggaataattgttaagaactattttgtaatattaaagcacatgaagtagtaattggtaaaaaaaacatgtaggagtagttggttaaaaaaaatctatacaagagttattggagtgacctattcactgccgccaccattgcctttttttaaaaggagcctacaactaatattaaagtaaatcatgcccttttccatctcctcataaaattatctttttaccctttctatctaagtacatgtatcaatacttaaatattttttacgtgataccttttattctagagcattatatctttactatttctgaagtgcaaacaccgtaaaacttctctttattcatttcaaatagagagtcttttgtttggtaccttggaatataatggccctgctcgaatttccaacaaaagttagataaacttttggataaaagtggcacgctcttcaaactgctaaacgtgcatttcgtgcgaaaactttttatataaaagttgttctagaatatcagattaatccattttcaagtttataataattaaaactcaattaatcacacgttattaccacctcgttttacgtgaaacacttgatttttatctttatcttcagaagattcaaacaccaccaatatcgtaatcaggacattgcggtcgtgtccacattatgaagatttgtgaaatctgaaatcggaactttacctcaagtggatcagtctccccatcaagctcgaccataacaagagcattcatgctgcataacaatagataagctcgaatttatatgattaattaacttaattgatgatatacaggttacattttataaaaagcataccttatctgcaaggcagtgtaccaaggatgcgtgcacgctcgtattttgtcatatacattgatgttttctgtgggcgagccatctttttcatattccttgtcatatacagtatcctcattgttactatttctggaatacaaacactgtaaagattctctttattcatttcaagtggagagtcttttgtttgataccttagaagataatgtcataatcaagacatcgcggtcgtgtccacattatgaagatttgtttttttccgtaccttttgtcttcagcttttgtgattaatgtattctctgatgaaaatgtatttgcaataatgtacattaaaggagaatggtagagcatgaatacatagttatttgcagtaagatttttgtaacaagcatatcctatttgccacaattacccttccttgaatattccttgctatgtaaagacaatatatcttactacagatatatgtatactttcttttgtgattatatgaaagatccccaacacccgcatatattgcatagacacaaaagtgtgccctcttttaaaaaaggctcgagaggggatgataggaataaaaccctgaaccacaccaagtttctacgaaaaataactcacagttacatgtgtggatattggcttaattatgatacctttgaggataatgcggccacaacttcaccaatacaaaacaaaaaaagttgtttcctagccacacaaacataagatttattcttaaaaaaagaacgtcatgtgtttgtttccctattctatgaaaaagttcacacaaagtatataccatttattttgtgcacaaaataaaaccaggtcttagcaaactgtcacgtcagtgtatacacattcatcacaaccaaaaatgggcatgtcagccaacatctctactctacgcatgtagtaataaatgagaaagctgttagaataattgggctaggcccgatttattctattaaatatcaaaggcccataataagtgttaaggataataataccacctcaggaattaagcgaggagtatctcaacttaaatagggagttattggaggctcccagttgaccggttgaggtgggaatcggaaagccacacgcgcgcgccgggccggggcgaggctggcgtgcatgcgtgccgtcacgtctctatcctgtttgcaaccacgatcccacgttcccacgactgcctccgtaacggcgcgtgcacgatcccacgacgtgtgtgcagcaactggctagtccgatcagaacgattcgctcccacgactgcctccgtaacggcgcgtgcacgatcccacgacgcgtgtgcggaatctctcctgctatatgtgcgtgccgtcacatctctatcctttttgcaaccacgatcccacgttcccacgactgcctccataacggcgcgtgcacgatcccacgatcccacgacgtgtgtgcggcaactggctagtccgatcagaacgattcgctcccacgactgcctccataacggcgcgtgcacgatcccacgatcccacgacgcgtgtgcggcaactggcggaatctctcctgctatataaggaggccgctagtccgatcagaacgattcgcatgctttcctctccctggtgttcttcctcctccgcgcgcgcctgctgcttctgttttcgcttcctcgcttctgatcgctttcacgcacgagagatcggaaggagcagggcctccggaaccacaccttcgcctgagatctgcaccgggtaggcgggtgatcaggtttttggggagtgcttcccgcacgactgctctgttcgttgttgtctcgtcgtccaccatgtctacgcctggacacctggagccggagctgccgccggcgccggtgctgctgtctctggagatggcacgccgggagccggagccgttgcgaacgtcaacaccaacggaggcaattctgcctcacaatccagcggagggccattctcggtgtatgtccttctcctgctgttaactcattcgttcataccgctgttagtcgtgttagtcgcaagtcagttgcgtccttggtatgtgcatgatgcttatgataccttaagcatgctactggttatgctacatgttgttactagatcaccccacattgtttatactatgattattgtcttaatattttggattaaaatatgccgatatatgaccatattttcaacgattcaaaaacctgataggtcattttcggtagttggctttgctgctgcactgaaaccatatgcatttgatggttctaactataagaggtggaaaacacgtgcactattgtggttgatagcgatgcaatgcttctatgtttcacggggcaaacgaagtgaaccacctctctctcccaaggaagaggctaagttcgaggcttcggattgcctgttccgtggagcattgatcagtgtactcgctgacaatatagtggacgtgtaaatgcacatgtcttccgggaaggacatgtgggatgcacttgaggccaagttcggagtttttgacgccggca

SEQ ID NO: 39164 - DNA, 25472 bp, Oryza sativa
cttgagaacaacaattgtaagttgctggacaagtttgtggcgggtggcattattgccaaattgccaccttcttggttggactttgccacttctctaaagcacaagagacaagagttcagtgtttctgatctcattggctctttgggtgttgaggagaaggcgagggcaaaggacaaggcaaaaaggttgagggaggttctagtgccaatatggtacagaagaagaaccctcatacatcccacaacaacaagaaagtcaagcctgatgtcaaacccaaggctgcaaccaactttaagaagaaaggcaagggaaaggcaaagggaagctgctttgtgtgtggcaagtctgggcattgggccaaggactgtcctgagcgcaaagacaagaagtcttccaacatggttattagcgagggcggaggaacatcggggtacggtaaaatattacctacagttctctctgtttttcactcacctgattggtgggtggatactggcgctaatattcatgtatgtgttggcatttctctattttcttcttatcaggtcgggagaggttcctccttgttgatgggaaacgggtcgcttgcggctgttcatggtgttggtacggtcgatctgaagtttacttcaggaaagaccgtgcagctgaagaatgtgcagcatgtcccttcaataaagaagaatcttgttagcggctctctattgtgtagagaaggttttagacttgtgtttgaatccaataaatgtgtcatatctaaatatgaaacttttgttgcaaaaggttatgacagcggaggcttgttccgcttttctttgaatgacatgtgtaataatcataatgttgtgaaccatattagcgagaatgatgagtctaatgtgtggcattcgcgactctgtcatgtgaatttcggttgtatgacgcgcttagctaacatgagtttaattccaaaattcactttggtcaaaggttctaagtgccatacttgtgttcaatcgaaacaacctcgcaagcctcacaaggcatctgaggtgaggaatttggcacctctagaacttgttcattccgatttgtgcgaatgaacagcgtgttgactaaagggggaaagaaatatttcatgacactgatagatgattgcactagattttgttatgtgtatctattgaaaacaaaggatgaagcattgcattactttaagacctataaagctgaggtagaaaccaacttgaaaggaaaatcaaacggttgaggtctgatagaggtggggagtatttttccaatgagtttgcatccttttgcgaagagtttggaattattcatgagaggacgcctccctattcaccccaatcaaatggggtggccgaaagaaagaaccgtactctaactgagatggtgaatgccatgttagacactgcggggctttccaaggaatggtggggtgaggcagttttgactgcgtgtcatgtcctgaataaaattccaatgaagcataaggaaatgacaccattcgaggaatgggaaaggaagaaattaaatctctcatacctacgaatatggggctgtttggctaaggtaaatgtacctatagccaaaaagcgaaaacttagaccaaatactgttgattcacagtgtgggttatagattcttaatagtaaactctggagtacccgacatgcatgttggtacaattattgagtccagagatgctacattctttgagaatgaatttcccatgaaacatacacctagcacttctagtcaagaaactgtcatgccccatgagcactttgcaccgatagaacacaatgatcaaacgcctgaggaaaatcctgaggaggacaacattgtagatactcgtaagagtaagagacaaagggttgcaaaatcctttggagatgactacattgtatacctcgtggatgacaccccaagaaccatagaagaggcatattcatctcctgacgctgactactggaaggaagcagtacgcagtgagatggactcgattatgtctaatggtacttgggaagtcgttgagcgtccatatgggtgcaagcctgtaggatgcaaatgggttttcaagaaaaagcttaggcctgatggtacaattgaaaagtacaaggcaaggcttgtggccaagggttatacccaaaaggaaggcgaggattttttcgacacatactcaccagttgctcgcttgaccacgattcgagtactacttgctctggcggcctctcatggttttctcgtccatcagatggacgttaagacagctttcctaaacggagagctggaggaggagatctatatggatcaaccagacgggtatgtactagaaggtcaggagggaatggtgtgtaaactgttgaaatccttgtatggccttaagcaagcacctaagcaatggcatgagaagtttgacaccacgcttacatctgtaggctttgttgtgaacgaagctgacaaatgtgtgtactatcgctatggtgggggagaaggagtgatcttgtgcttatatgtcgatgacatattgatctttgggaccagcctcaatgtgattgaggaggtcaaggactatctgtccaagagttttgaaatgaaggatttgggagaggctgatgttattcttaagggaaaagtccattttacaccctctaacttttatgtttgtctaaaatgcacccctaaattacaaaaccggatataatacaccttccaactattaaaatcggacactttaaccccttaagctatttttatggtggttttggtacacttggatgccagctgtataaatgctccacgtcagcaattatttgggtgaaagtaagatgtttctcccttcgggtaccttgcgagcggcgacaactaacataacggcgccgtgaagtgcagcaatcaacagccacgcgcgcggcttgccggaggcagcggcggcggcacggagaaggagcagccgcgtgcagcgggcggttgccggcggaaacgacggcgctgggaaggagtagctccgcgcggggaggaggcagcagcaagcagttgggtcgcagagacttgtctaagctttcatcaaccacttctgcaccttcatgttgtgtttcagaatgttctatatacagtagcatggtgtgtgttgaaaaacagcagtagcaagcaagatgaacaatctatcttgactgaattgttggcgtcggtgccgagcttgacggcgagcccgcccctttggccaatgaagaagaggggatcggcaacaagctcgacagagaccgcacctttggccaagctcaggagaatacatgccggcggtgagcttgccctccttcgctgagctcgaggaagcatgcgagagctctggcctctgagtctccgacgagttctcctagaaaaatattggagggagaaggtataggaaaggagggggaaaggaagaaagagagggagaggaaggaagaagatgggccggtcccccaccccacccccgcgaccacggtgtagagccttgccgtcgaccatgcaatggcagccgccgcaactcgcaaggcaaaccccgccgaacatacaaacatctggcatccacgtgtaccaaaatcaccataaaaacaacttaaggggttaaagtgtccggttttaataattggagggtgtattatatccggttttgtaattcgagggtgtattctagacaaacacaaaagttagagggtgcaaaatggacttttccctattcttaacattaagctacaaagaggagatgagggtgggattacacttgtgcaatcccactatgtggacaaggttttgagtcgctttggatatagtgactgcaagccagctcctactccttatgatcccagcgtgctattaagaaaaaaccgaagaatagcaagggatcaactgagatactctcaaatcattggttcattgatgtacttggctagtgcaacgaggcctgacatctcatttgctgtaagcaagctgagccggtttgtctcaaatctgggagatgattattggcaggctctggaaagagtaatgcaagggcactatgagctatggaattcactataccgggtatccaaaagtactagaagggtatagtgactcaaactggatatctgatgctgatgagataaaagccacaagtggatatgtgttcacacttagaggtggcactgtttcctggaagtcttgcaagcagaccatcttaacgaggtcaacaatggaagcagaacttacaacactagatactgcgacagttgaggccgagtggcttcgtgaactcctgatggatttgccgatggttgaaaaaccagtgccagctatcctaatgaactgtgataatcaaacagtgattattaaagtgaacagttcaaaggacaacatgaagtcatctaggcatatcaagagaagactgaaatctgtcagaaagcagaaaaactccggagtgatagcattggactatgtccaaacggctagaaatctggcagatcagtttaccaaggggctaccacgtaatgtgatagacagtgcatcgagggaaataggcttgatacccacctaaagttgcacaatagtggaaacctgtccattgtgatcggagatcccgtgaatttggatggcgaaacaaactattgtgtaactgagagaagagacccttgaaaaaggctcattttcatgatgtatttctcttcttttctgcatggtaggatggctcatgctttaatgtgatccgagtggcttttccaagcagcgatgttgacctgtagaacatctcagaaggaacacacctatatgagttcgactgctagtcacagtctatgagatttgggcgatctctagatagtcatgaaaggcctggagtttgacttatatgctccaaacagaggggatgcgaacggcagctcagtaccagtcaagggtttgagtgaaacctgatcatacaagactgacaattcaagacatagtccattgttcagttgtggtctgatgtagctcatttcctaggtggaagttcaacttaacagtctccaccaaaacactggtatatcaaacaggcatagccttgagaacatttgttttgagctttgaaatttggtggggattgttagaataattgggctagacccgatttattctattaaatctcaaaggcccataataagtgttaagaataataataccacctcaggaattaagcgaggagtatctcaacttaaatagggagttattggagactccctgttgaccggttgagatgggaatcggaaagccacacgcgcaagtgcgccgggccggggcgagggctgggtgaggcgtggctggcgggcgtgcgtgccgtctggcggaactctcctgctatataaggaggccgctagtccgatcagaacgattcgcttgctttcctctccctggtgtttttcctcctccgcgcgcgcctgctgcttctattttcgcttcctcacttctgatcgcttgcgcgcacgagagatcggaaggagcagggcctctggaaccacaccttcgcctgagatctgcaccgggtaggcggatgatcaggtttttggggagtgcttcccgcacgactgctctgttcgttgttgtcttgtcgtccaccatgtctgcgcctagaaccgatggcgtgcctggagtcggagctgccgccggcgccggtgctgctgtctctagagatggcacgccgggagccagagccattgcgagcgtcaacaccaacggaggcaattctgcctcacaatccagcggagggccattctcggggtatgtccttctcctgctgttaactcattcgttcataccgctgttagtcgtgttagtcgcaagtcagttgcgtccttggtatgtgcatgatgcttatgataccttaagcatgctactggttatgctatatgttgtcactagatcaccccacattgttcatgccatgattattgtcttaatattttggattaaaatatgctgatatatgaccatatttccaacaaaagcaatatgtgcccggatagctacttctagtgttaaattttttctcaaaatataactacttttctactcacttcctcatctcaatcaaccatattcatctctcatttaatttcttcacttactacccatctcaaccaattacaaccatttccatttaattctatcctatctccaacttcaaaataaaatgcttatattataagacagagggagtaactcccattgtacgttaataggtggtgacaggatagacgactggtgttgccttacctctcactccaatttcagtaacatttcaatttttcctaaaaaaaactaaagaacttcaagctatctaaatttcagcaaaattacttaacaaacacagtgcaaagcagccttaaaaaaaggctcaagataacaatacccttatttcagtgtttagcaaattaactttggtcactattatatatattgcaaaagataataccgctatgttccaaaaagggtcctattatatactccctccatcgtcgatctacttttgatagtcatatttccaaatctgaaaaatttatttttgataggcatatttcaatccaacaacttatcatcttaatgactttcttagatttaatgcgtgaccctccatttttccacacaagattagctacatggacatcgagaaatgtaaatattaatgaatcacttgtttacgaggaatgactagctagtagcatgtttaaattaatgataaatagaatcacttatccttgatctgtgtgctaagatgaaatatgaccatcaaaagtagatgtagatggaaggagtattacagaagataataccgctatgttcaaaaagggtacagcctggtcaaagcccccacccccaactcaaaatgtaggtttgtctggttttagttcgacgcggtaaataatgtgacatatacatggcattaggctgacaaagccaccgccacgccccctgccccctagtatgaaattaataaagttagcgagcatgcgtgtgtgtatgtgtatatcgctagctagcacaaacacacaatgatgctttcctcctctcttaaccaccctttctcgttgatgctttcctcctctcctatccaccctttctcgtatgccgtcaatgtcggcatatcgatgccaaggaacttgagcatgtagctagtgatttgtggcaaaggtcacaaatttccaaccacgacccaagcaagggtcaaggcacgaaggcaccacccgcgtcattatcatccggcatttgtgaagtgcaccagcggtccctaaacttgtccgggtgtgtcatctgggtccctgaactctcaaaatacattttttgtcctcgaacttgtcttgggtgttatataggtccatccgatgacgtggcatgccacggaggcgcctacgtgtcggtggggaccccacatgtcattcatatgtataaaaataaaattaaaaaccatattttctcctctctacctccgcgtcgagctccgccgcctccactcaccggcatgcgcgcgccggcctacgtgcgtcggctccgccatgctggcctcctcgccgcaggcgatgccgcacccgcctcggcctgggcagcctcagatggccctccgcgtcgagctccgccacctccgccggttgcaccggcttccgtgcaccggcctccgcgccgcaagtgacgccgcactcgcctcgcccgaggccgtttcctcggcacctccgctgtcgacgtcgcgacctcgcgcagctcgccgccgccaccaccacgtgcgactccgccggtcacgcgcggctacgtcgcctccccacccaggcgcgacacggcgaacccctcatgcgaatgcatgtgggtccccaccgaggcgccggcgcggcaaggcggcgttgccgcgcgcggccagctgttaacgaccaaatttggtaatctgagtatcggggataaagattagatcgaagcggaatcgaagatgaagatcgtttcagaaacagagtaagaatcgactggagtccaaatcggctacgacaagggttggttgagttcaagtcagacttgataagccgatacaaccgattccgacaatatgactcagtgtgcatcatcgggttgagttaatgtgcttcatatgaattgccacatacggattgagtcctaagaaggcaattgtatctattaattaggatattttatgtaattttcttagagatatgtttgggcaaaagtctgccgcaaagacttatggtatcttagaatttgttagagataaaagtcatgtccgagatggacatatcttgtaattctcgggtataaatagacccgaaccccatgtaatcgaattaacacacgttcaatacaatcttggcgcattgccaccctttttgcttttgttttatttcgacgagttcttgctttcgggttgagctacatcggttttgatcttcaacaagaggtaaaacttgttatggcggcttgcgttctcgggattagtgcttccatctttatgatactctaattttgtttatgtaattcgtcgagttattatatatcttacataatctccggcaatatcgttatctaacctacaatcggctaacatttgccagtagagggcagccgattaggttaaatactgatgttggcttagattatataaggtatctaccactctatgacactttcaatggcttgattgtctagatattgtctttctttttatacttatagctgcatcagttaagtttgatcttatgagtcgtgagtagaatctcaatctctagcctacttcttggttgtcgattagggtagtatcggggtttcagccgatcttacctgatttaaccatcttttcctcatacgctttatttacatgttaaatctgccctttatgttaagatcttgtcacatttaaatatattaggcttttgtttggtatatttcacttgctttaatatattaacatagagtggtattggagtattagccgatacatgctagatctatctgatcggctatgctatgaacatatatggtctcttgttagcatatatttcgatctaagtgatttatactgtctcggcatggcgaccgatctatcccaatcacttgattcaagtatatatcgacataaggattgcatatcgttaatatctacagccgatcgagtagatttagttctttcttacctattaatgactgccgatcgatgcatttatgacatcggctcaaagataaatgatatgtcatcggcacctagccgatcggctatcgtttataggtttaaccgtggtttctttgtccttctttcttgttgattgcaggatcaaatcaactggcacgctcatacacccaaaggcaagttttggacctgtactggagttaagcagatctcctaggcctcgtgttttcacgtcaacaccagcagatcgcagcgaccgagcgagaccacagtggcggtcccggaggtggagtcgtccggggccttgacgcagatgcggaggtgatgcggcggaaggtggctcgcacgaggccgcgcgtctggcgtcatggcggagttcggcggaatggtgcgaggccacggcagtacctctcggaggcggagccgcggtagaccttgctcatgacgctggaaccggctccgagcaccacggctaaccgggggaaaccgcggcggcggagcgaagctaacgagaaggcggcctcgcgcgagcacgcaggcatggctgcaggttgcctcgctcctgcaccttgccacatgaatagggccatgcactgcatgcatctatccacacgtgctaccaagcagaggctgcggagtcgcgtggtgccagcggagggtgccggttgccgctcatggcggcgccgctaggagctcgcgcaggcggacataagcggactcggctgcggtcgacgcggaggtggctccgcacggcattggttggtggcggaggccagcgagtagttgcggcggtctggccaccgtgtcacgcggaggggttcgccgtgtcgcgcttgggcggggagccggggaggcgacgtagccgcgcgcggctggcggagtcgcacgtggcggcggcggcggcgagccacacgaggtcgcgacgtcgacagcggaggtgccgaggaaacggcctcgggcgaggtgagtgcggcgtcgcttgcggcgcggaggccagtgcacgaaagccggtgcaaccggcggaggcggtggagctcgacgtggagggccggttgaggctgcccgggccgaggcgggtgcggcatcgcccgcggcgaggaggccagcatgacggagccgacgcacgtaggccggcggccggcgcgcgcatgccagtgagcggaggcggtggagctcgacgcggagtagagaggagaaaatatggtttttaattttatttttatatatatgactgacatgtggggttcccaccgacacgtaggtgccactgtggaatgccacgtcatcggatggacctatattaacacccaagacaagtttagggacccaaaaatatatcttaagagttcaaggacctagatgacacacccggacaagtttagggaccgctggtgcacttcactctttctaataaaatgaaaagtctaatataaattgtacacgataaaacgtagcaacggggcaaactatcatgtcagcatgtgcatattattcatcacaaccaaaaactgacacgtcaggccaacatctattgactgggcaagtgtattttgttgtcagctagcagtattattattaactaatttttacgacgcaatgcataagtgttatgcaaaatcatatggacctgttcgtatagggtgcacagacggaagtacaccagaccagagtttcagttgcatatatacttccccatccaaaaaaaacagctcaaaactcaacttagaaagtgatatgacccctcctattacaacgattctagataacactttgtccagattcattgtaacattagagatcacattatcttctaggttgagcttttttttagacggaggaagtacactagaccataatctaagtacaccagaccagagtttcagttgcataccagaatctatggctaataaatgagcacctcgcaacctctcatcagccatcaaacaatcatccaagacaaccaaattcaaatcaaatgaaggcaggcgcaaacaaaccaaaagtttccctaaacggctaaaccagtaccatgaagtatgaactcacaaagtcacaatgaagggcatgtttctaatagtgtaaagttagtcagaaaaataggtcaacaaaacatatcaaattaagtcaaaatttacatgtaagtcattcaaaatatcaaacagttcaaagacgactattaaaatgtaagtgattgagcatgatcacaataatctgaaaaagtccatgaaaccagacaattatagttccaaagtacagcgcaatcatatgcggccacataactgtgcattacatcaaccttctgtcatagaaagtatcatgttaacttgcccgaaaaaactaaaagctttggccatactacatcaaacatgggtatccagttatttagcccccaccaacttgccgtttccaggagtcctctacaatgagctcatcaactccccagtcctcatagctatttcaaaacaaaaaaaaaaaaacagtcagcctacaaagaatgtcgagttgcctggttaaagtttctaattttgtcatctcaatatctcaccttccatcaggtaaataccgcctgattgtgaaagggatcttgcgtgctctcaattctttcatggcaatctgaaatttcatcatcagatgaagataatcaacatttttattttcaaatgaaacttgacccctccaaaaaaagaaaatcaaagggctccacaactttgttttatttttggttgtgcaatgttgtttgatggctactttgatgattttatacaaaagtatgagccatttaaatccatagtccaacccaataaaacaacatattttatcagagatacgataaagtatcagacataaaaaaattaatgaaaaaaaggcaatcaaaagaatacttcaaacaacgagtataaggttccagggaaagatagtaaaacagaggccacaatgatgttcataaaccatgttaatttgtaaaatctactatgtaccaactaccgcctagggcgttactagcaccctgttctttacaattgcatggggacacatttatacttcaaaaggcatatttactatcatggaaacacgtttacagccatgggatgcatttactactttgcaggaatgtgttcacagttgttggggacaggcagtactgcgcccagggtgtcaataagttacaacaataaacttataaccatttctcatattttcatacacaagacttatcagtcagcttaatttctattatccttacagattcaaactatagttggtaactattgcagagcaattagaaatacagaactggtgctgtagcttatgaacatgtaaaccaatgcaacgtacaccagaacgaaaagcaactgttaaatacctaagaacatgatgaaaccacatgataaatgccaaattgaactaacaaaatggcgtagttataagattcagcatgagaaagaaaggttgtagttcgcacaatatattagaatgaaaagaatatatcactatctaaatgactcaaactatattagaatgaaaagaatatatcactatctaaatgactcaaactatcatgaaactgctacaaaatacttcccacagtataattaggttttcaactacgttgacaggatcacatcaatgacaactctcagaatcatattgtaaagacaaactccatagttccatcaacatgtgcacatcatcagccagttaaacatcgccactcccatcaaaacaataaaagtactagtatgttatatacatagcatgagaaggcagtcacataaatattaactattttttctagctctgcccctcactctggtcttaccttgtacgtgctacatagaaatgaagagctcaaggaaatatagaaggtgacattttgtgcagacttgtattaattgaagaagtctatgtctagaaaactgaaatcggaactttacctcaagtggatcagtctccccttcaagctcgaccataacaggagcattcatgctgcataacaatagataagctcgaattttacttaattgatatgattaattaacttaattgatgatatatgaattacattttataaaagcataccttatctgcaaggcacgtgtaccaagaatgcgtgcacgctcgtattttgtcatatactttgatgttttccgtggacgagccgtcttttcctgctccttgtcatcttcagccccaaccacatcatccacagcatcctcattgttattctcaggctcttcctcagctccttcctgttcagaaaaggtaaataagccacatagctcttcctgataaagtaaagtccagaaataaataacaaagcagcagctctgtacctcaatctcaggttctgggggctcatcctcgtacctgtaaaaaaaagtacaagcatctttagttcataaatttatataatactaaaatgattctgcagccatatataataggtgacactaagcataaccaaaaaaaaaagaacataacaatcagcaaagataggtatttttcaagcaacatatctacaatgtctcatcaagctagacatgaacttaaaactatactccctctgttctatattgatcatcatatacgttgaaaaagctaactctaaaaagcaaccagcaccttgaaaaagttccattattttgatccatcaattaaaatagttgggaccaattcttaattgatacaaaagatgtggattatacttaagccaagaaacatcaaacatcaacatcttatcccaacaaagacaaatatcataatgtgcattctcattccagaaggatgctgggtgagctaaacacaagagtccatctaatggctaggaatgctcaaaccccacataattcatggacacctggtcacctagaaatcagcatagtttcttacattccgtattaaacctgattgaccataaacctggcaacagctgcaccatttagccatcccattaaagactaagaaaaaacccaccttttaacaagcacataagcaatcaagcatgggatttactgaagaattaaagaagtcacccgacgatcagcagccaaacatagaatgaggcatgatgatttgagaaagagaagaaaaaaaaacgatgtgtcaatcaaagctcaaagacccatccatctcccaaaaaaacatcataccccctcgtaatccatgccaatgagagagaatagaccaaatactggcctaaagaaaaactccgtactgccaccaaaccagcagctagaggcagagccctcccttgagaaaggagagctccccccacgaatcccccatcaatcaacgtgcccgtaacccacccacgaagatatcggactccctcctaacccccctctccgcccgcgcccccgaacgtaccagtaaaccctaagctaggtgcgaaactgtaacggcggaagcgagcgagggagggtgggggagaggcgaaccccatgtccatgtcgttgtagtcgtcctccgccatggcgctcgctcctcctccgccgccgccgcctgggcgctcgcttcgctagggcttccgaaggcggcgatgaggggagggtagtggaagaggaggaaggaagctggagaaggcggcgtttggtcgggtcgggaaggtgtgtatgtgtagcaaaatccaagggctgtgctgtgcatttgggccgctcgacctgatctctagcggtctggccctctgtcgccgtaggattaagttcactttgactccctttactagttactctgaatccgattcttacccttaaaccgtaatacggatatctcgaccctccaactattaaaacccggtgtaattttacaccctcgatggttttggagggtggtttcgctgatgtgaagtctacatggcaaggttgacgttgatgtggtgcttaggtagcattaaaaataaaaacatatacgtgggacccatttgtcattaacacaaattttttcgacgcccacgtgtcacacactctctctctctccttcttcctcctccccctcccccttctctctctttcaatccccttcggccgtcggagcgagaggatgggcgctggaatagcggcaatgacggtgggcgggcgagagccggagtgacggggcggctctccttggatgttaggatctctaggaaatcgcacggcaaaggagggagaggagcatcggccccatccatcacgaagcacgacagctcgagctcgcagaacccatctaggcaggaggtggaggtagaggtgaaggcgaagagctgccgatcccctagccccatctccaacagtggcgacacaccattccccgttccccgttcccccagcggcacgccaattcaccatcaccctctccgcactgacggcacaccattcccctctctggcggcaaaggaggggccaccggcagcgtcgtcagcaaagccggcgatggagtaaaggcctccctctggcccctccgtcgagcagcgcccagctgccgcccactactgccctctccttcaccttcgccacagcactgcttgccaacgagcggcgccctactgctgctcgctgttgccctctcctccacctcccgccctcaccacccaactgcacaaggaagagagaatggagaagataaggaaggtgagggaggagaggatgacaagtgggcctacattttttttaatgacaaatggatcccacatatatgtttttaatagtagagatcagctgttaagattgttgtgaatttttttggaaatggtggtgaatatacatatgcgatgggaaaaaatcgatatgtcagaattaaaattagacatggaagctaaggtctaattcttttcaattaattgcaatttaaaaagaattcaactaatcacatgtacgtacaaccgaagccgttggctcatcatactcacatgagccttcaaagttcgtcaccacgcacgcgcacagtcgccgctctggaagcggaaggtcgcgcaccatggcggccacggggtggtttctagcggcagcagtagccgccatggccgtcgtcgcctgcttcgctgcgacgtcgtcatcgtcgtcgtcgcagctgcactgcggcacggtgacgtcgctgctgtcgggctgcgcggcgttcgtccgcgggcacggcggcggcgcccagctgccgtcgccgggcacgccgtgctgcgacggggtggccgggctgtacgccgtggccgccgactccgcggacaattggcgcgccgtgtgccgctgcatggcgaggctggtacggcggcacagctccaacgcgtccgccatcgcgctgctgcccggcgtctgcggcgtcgtctcgccctggacgttcgccgcggggaacaccaatagtaatcgtccctactgcagaaggtatggaagaaatcaggttgattttaaatggattcgttcaatttggttgcattgagaataattgagatttgagagaagtatattttacaacaatgttagttttggtttttgaagctgattaatatcggttttcattccctttttgcagcctcccctgacaggcatgagaatttggttaagaattgtgagcaaacacgcgccgatcgatcatgtagagaataaatttagttaggttcggagttatcatatcttgttgttgggcatagttacgtttacgtgtgatttcttttctctcgaatcaataacatattcatgctcaatgtaaatatgcaattcttggatttgatcggttaaaagagcatagttagcagacagagcaaaacgtatagattgccatgccatataggcatcatggtttcaaatgtcgatattgaaaaaaaaaatattggtactaataaacaggaatattagatatatcggagttatattgatgatttggaaaaacaataggataaaaattataaaaagggctcaaactgtttagaaaattacacagattgtatctacaaaattttgatataaataattatattgggatttgctaactggctgcctgctgatttatttttagttgtcagccgaatttttgtccatccgattctgcccaagattcgtgcgtccaatcttcaccacggcccacttgagaaaatctggcccggcccatctcttcgcgcaaaatcacacatccggtctcggcccatctctctgtgggctgttctagcactctcgtcccatctctctgtgggccacaccagtgaagtatcaatttttgtttcccatctatctactagaaacgatttgggcaaaattatgatgtgtgcttttgcttgtttgtggctgaaattacattctgaaaattttatggacatgcaatcctattagaaccggttttgtcttgttttgttgtatacttgtagggtttgttcagtattgtagctctagtttcctttgtcagatctggtcacttgtgtgggtagatgtccatgctgggttacccagtgctgcaaattttgtacagatttcaatttagggtgtgtttagttgacgttaaaattaaaattttggttgaaattggaacgatgtgacggaaaagtttgaagtttgtgtgtgtagaaaatttttgatgtgatgaaaaagttgaaagtttgaagaaaaagtttagaaataaactcggccttagagttttcctcacaagactctgtactagtgttgtggtagtagtactccctccgtttcgaaatgtttgacgccgttgactttttaaaacatgtttgaccgttcgtcttattcaaaaaatttaagtaattattaattcttttcctatcatttgattcattgttaaatatatttttatgtaggcatataattttacatatttcacaaaagtttttgaataaaacgaacggtcaaatatgtgctaaaaagtcaacgatataaaacatttcgaaacggagggagtacctcgaagaggcgagcccggaaaccactcgtttatttttacctgcatcaaccaacagcatacccccaacgaaactgaaggcgatgctattgctacactgcaagttttttatttgtttttgtcactattttaaaattttcaaagaagtggttgtcattttgtatttttttattttgtttttgtaattttttgaatttttcaacatatagagagagcaaacctgatccttttccttccctcctggctcctgcctattgcacttgaccacttgcgatatgaccgaagtgtctatacttttggtcgttgatttctatttttgtttcttttatgtaagatgtaataaaagaattatcggtataaaggaaaagagtgagacaaatcgtgcaaattgactcctggatgatagaatcaagccgacatagttttggatcttatttaattagtacttgtttatttgggaatattcgggaagtaattatatgggtgtgatgcaagaaagagagatctcgcctcatcgcatcagttcattgttaattaccacatgaggggaaattaaagggagattatggttagtctcacttccttttttttttctcgaatgcacccattgttgatcagacttgagaaatcgaagatttttatcagggtagggcgtgccaaattacaccgacaggaaaaactgctcagcatctttcgatttctcaagtctgatcaacaattacgccgcaaattgcgtttggttttcagttactgtattaattattataattactctgtaaaacggagcttgtgtgcgtgctagctcgtgaaataatcgtcgttgcgtgttgttcccaaccccctgccacgtgatgatacggttgcacctaacggtcagatagatcggttacgtagcaatcgtgttcgctatctctttttattagcatgatttttaaactattaaatagtatattttatatagaacttttgtaatgtagaagtatcaaataatttctttaaatttataataattaaaactcaattaatcatatgccattggctttctagctcgtcacgtgtttccttacttcgtcatgttcatcatttacgaacaccataaatcgtacaattttcagcggtctttttgagcacaaaaagtaaattattcttatatgctctttgttctgaatccactgtgcccacagaaatgaaacaatgttaattaattgaatttttacctgaggcacgcgtgaaatatgtgtcctattgtatttgacaatgaatcaattttcgggaatggaactattcaaatattaaaaaacttgtaagatttcctcaatttttttaaaaaaattctaagaggcttttgtacttacaaattacaatctttagtggttcttttatataaatgaaagtccacatgcacataaggctgtttcttttttttttcatcaactcaactcaacttccttgtttttcatgcccacactttataaactactaaacgatacatttttttcgaaaaatttctaaaggtcctattgattttttttaaatagctattacttaattaatcatacgctaataaatcactctattttatatgcgtgaggactagtacccatccttttagccgaacacaatttatgttcaatggcaatcaagttccttttatatattgtccgtatctatatagtaatataacgtatatagttcatcccactaataatatttctctgcatccacaattaaccacgtcgtcaaatttgcactgacactatatattgctttcctctccaacacagctccaccaaggccatttcaattgcatagccatgcattcgacacgctcacacttgctgttgccccatcaattgcactagaaaaatgaaaacgatctctggcttcttcaattactccgtacctccgcggcactagctactggttcaatttaggccgtgtttagatcctattttaaaatttttcaccctaccacatcaaacatttaaatgcctaattaagtattaaatatagacaaaaaataactaattacacagattgcgattaatttgcgagacgaatcttttaagcctaattgctccatgatttatcaatgtggtgctgcagtaaacatttgctaataacggattaattaggcttaataaatttatctcatggtttactgacgaattctgtaattagttttttattagtacccgaacactccatgcgacatactatataatacccgatatgacacgccaaaactttacaccctggatctaatcatctaaacacccccttaatatatgttggacgaaactgttgaggagccaggaagtctaccactccattactggttgcttgtatgctctaccggtaaaacaaatctgcatattcattcagcgagcaaagcatgttattttcaccttcatcattgtcatacctaatcaccaccggtaattcaacaaagtagacgcacaaggtgttaggtgttagcgtggcaattcaacaagttcatactctttccatattcattttcttttcccgtagcaacaagtggggcatctaattaattcaatcttctagtctgtttgcacatgaacaccctgttgtgacaaatcaacctaccggatctatccgtacacctacttctgttcagttgtgcccttttgacagttgtcacattttcactgtcttattgatgatgcttgctagcttgtcgcctaaatttgcaggaggttgtcttaaagaaaaaaaacctttcaaatgcagtcgagtgatgttgaatacggattcatatgtatagtttttccccataataggaactgaatacgataagtaacaaaaataataggaatcatcaattgaaacgaatgtgtttgaactgagtatatgtagaaatcgctccaaacaaaatgatgctcaacatcatattgatactggtttaggtgaagtagaccgatatttatgtccagataaaaggtaaatgcgttaagaaacatatacatttcaatagaaaacaaatagtgatccaagagtagtgtatgattttttttagttgtttttgccatttatggaggttttcccatctttcaaaagtggatgtcttgtgaaatatcaaattggagttgcattattatatggagtactgtttgtgcatacttaaaactacttacatattttttactaataaattcctcaaccgtttgatttaattaattgaaagttataggaggaaaaagattcaaccacagtttgcaatatcaacgtttccaatagactgctttctaacaaatatactttgtccggttataaatatttgacgatatgatttgatcgaacttttgaaactttaaccatcaataattcctagaacgcttagttcaaaaagaaggaaaataatatgcacagatttgcccagaaaagtacgatttttttaacttttgtaaaatagaatttacgatcaaagttgtgggccgggggatatgagaacggctgggtccccatctcccttgggtcactggggcactatggaacacatctagacatacaatatctatatcttcaaggcactaagatcagtacatgtgatgagaacacccctggctccagggggtgccccaagtaggtgaggtgccccggtaccaaggacgaccaggcacaatggccacccagaggtgaagcccaacaatcttcagatcccgagcactcttcatatcccgggagggggcctgagcttgtcccatgccccaggaaccacatgaggagcgcaactactttaaggagaagctgacaggactaggggtagctttaaccactcccttgcattaatgacgatatgatgtacgccttgtacgcatcccgttgacaacgtggggaacataagggtgtctataccgtatgtcacgaaggagggcccacaaaatagtaggggcaaaggtgcttttttcacttcggcgctcctcttccgttagtcaacaagagagaacattcccctcagtcggattgagggacatcaacaaagaccaaccatgacaaatttaatggagtagagcctactcccgcacatatatatcgacattgtagacacccctagggtataaaaagagaatcgatgccaacggaaagagggttcacattccagcaagctagcatacgcccttatattttcagtttcatgcattgtaactctattccaccatccatccataatctaagcacaggagtagtgtattacacacccgtgtgaccggaacctgtataatccatggggtttatcccttgcacgtgatttggaccatggcttgaaaccatctcctggctgaatctcttaagggggagtgctcacttccccgttagggaagttccatactctgacaaaatcttcaaaagtttaaccaaatctttgtcctaaacatttttaagggccttatatatatgactaaagggagtaaaaaacattcaccccaacgaagttttctcatgtgtttaattctctctttttttaaaaaaaaagtcaaaccaacatttgctaaaataattgtaatttggatcaccatggattttacaaatttataatctattaccacaaatttcaaatttagcaacatgacaactcaaacttaacaattttggacctacacactccgtagaaaaaaaagaaaaaaaatccttaatgtgaatctaaaaaatgattgatttgtagttagaggttgattcttttttatagggttaattggatacatgccactgcaaatgtgacaaatcaaaaaaaatgccactactatttacgttattagctggatggcaccgaaaatttttaaaattggaactatgcctctacgtgactctttctatcctccctgtcctctctcacgccaccatcctcaccgtcacgctgccctcatcctaccaccaccgccgcggccgacctcgcgctgcctccttcgttgacaacgacggcaggggcaacgacgcgccgaccagcggagcacggcggtggcagcatgcgggatggcttggcggcggctccggactccgacgagtcggcggcggtttgattccctccaagacccggcgtgcatgcggatggttctcgttagtgaggtcacaaggatggttcatgcacaaggaatcgacacgaagctcaccgaagcaataggaattgaagattgtggccatcggtcggagtcgaggaagaagacgccgatctccctccttggtgcaccgatccatatggttcttggagcatcttgaagaggacatcggggctaggctactggcgaaggagctcggcttggttaggttcacattggccggaatggcaacgacgtcatggaggcggtgttcggtgcgcgctcccgagccgcggtggcgtggtcgcgttcgcgatcatccatagcatgaaaatgggcgaggttagcggggatggaaccggtgtggtgaggagatgatggaacaaggaaaagatgaaggcatccacggagacattggagaatggagacattggagcgctctctccctcgacttgctcggttcgggaatggagtaggatataggacgacacgactgggaggagatgaaggcaagcctccccgtgcgtgcgctgctggggccaagctcgtggagccccatctcgctcctcatgctcctctcccggcggcgacgctatgcggcgtgagagaggacggggaggacagaaagagtaacggggaggacggaaagagcgacgaagtgatatggtttcaattttaaaaattttcagtggcatccagctgataacacgaatagtagtggtatttttttttaatttgccatatttgcaatgacatggatccaattaaccctttttaggggagtacacacaacgactcattttgctatcttcataataaattgagttgtgaacatcatttaaatactataaataattgcacccattgctcctcctctcgtgaagttcctctctaatataaataattgttgccattgattattttccttctcaaagttacagccacgtttagaacccgtgattccttttcgaatatttacgtgtacataacaaattcctgtaaaatttccacaaatatcttactatcaaatctggtgtgacctgtcatctgaaaaaagaaaaaactgccgtgacctgaaatgacaagtggacaaaagacgtgataaataaaccctgcctaaatgggaattaaacaacagccagccagccaagccagccagcgctggatgacgactgtccacaacaccacgagagcacgagcaaaaaaaacccaactaattttcttttcttctcctcaagaaattgatcagaaagagagacaagagaagagctagggtttcatctcatctccagccatggcgtccgccgcctccccgccgcgctccggcgacgcctccccgtcctcccctctcctcccttccccgacgtcccccgaccgccgcagcggcggcggcggaggcggaggacgcctgcttccggggctgcgcggcgcggcgcggttcctgggccgcacggggagccgccgcctgatgcgggagccgtcggtggcggtgcgggagacggcggcggagcacctcgaggagcgccagaccgactgggcctactccaagcccgtcgtcgtgctcgacgtgctctggaacctcgccttcgtcgccgtcgccgccgccgtcctcgccgcctcgctcccggagtccccctcggtgccgctccgcgtctggctcgccgggtacgtgctccagtgcctcttccacgtcctctgcgtcaccgtcgagtacaggcggcgccgggaggcgcgcggcggcggctttggggcggaccagggggctgcggctgatggggatttcaagctcaggtgagggtttgctcggatcaacccccaaaacacttcgtaatcctagtagatatgtgctattaaaagtatctcgaacttatgcattccactctggaatcaagtcgatgtaacagttttttttttcccgttgattcatcattgctataattatcgtattcccatgtcaattatgaattctgttggttttatattttttattcatttctgtctttgaagtgctggtgcagcctgtagtattagttttcgatttaccttcaattcaactaatagtttggcaaatgctactgtgtctacttatatggtaaattctttcttggatttttaacaacaaatttatttgatgtggcaattcgtctttcgtaatgccttcaactcatcatccttgagtacattacattgctcaaacgaagattattctattagtttttcacttttttagaactattcttatgtgatctttcagtgtgctgttgatactattgcatttgcaattttaaagtgggcattgttaggcaatgaatttgtggcatatgttagtataggataactgcaaattgaatgggcaagaatgaattccattt

SEQ ID NO: 39165 - DNA, 15227 bp, Oryza sativa
  unsure (1)..(15227): unsure at all n locations
ttactggtacgcacttagtagctgtggcatgtgaatgatagtatgtattatcattagtggctgtagtctaagatgtttatcttattgcccattattttgcaggctctccattgtgtttctggcatttgatgttttctttgtagtcttctgtgttgccttggcctgtgtgattggcattgctgtctgttgctgcctgccttgcattattgctatcttatatgctgtaactgatcaggtatgccagttcttgtttaggacagatatattcttcaaatggttgtgatgagatttagatgatcatatgatcctgtctctgctttgtgttctagatacattttcttcaaaaacaattttccaaatgcaattgcttatgttctatttgtgcaatttaagcattattactatattacacatacatcactctacttttgtctacagttcattttatatctcttaaagacatccatgtcttgaaagaaagaataacctcttctgctgtggtataaatactttttagtagaagtattacttcagagtggttttgcatgcaatgacctgctatcaacattgttttgaactcttttaaaggtagttttgtttcttttctcactatggcagttagttatcactcattatttctgaatgttccatgctaaatatgattttcaaaagtctggaactgttcttgttaatcagttatctccccttgacataagcctaataaaacagtatgtggactgatacatccagaaataatcatctcacattcattgcactgagactatttgtttgtttttaagcaggaaggagcatctgaagaggacatcaacaacctgtccaaattcaaatttcggacaatgggtgatgcagacaagctggttgctggaattgcagcacctgtgggtggagtaatgactgagtgtggcaccaatcctcctgttgaacacttcctttctgctgaggatgctgtaagttttcagtttcccccctgaaattctgttagcacaactgtattgttattctcactacatagcttgtcatggatactttggaatgtcatggcacttgcctttgtttattggacgtcaaggatctaatttgtaaccaccgaatacttctgtaccaagagtgctgcttgaaatttgttcatttaatcttcacaaaatcatagaagcatttcttagcagctaggcatgttaatgcgaaaaaattgtatcgattgatgcctatctattgttcataaactcactaaccatatttaatactccctccgtcccaaaatataacaatcgagtactggtttggacaacaactagtactatgaatatggtgaggccagatgtcctggattcatagtactaggttgtgtctaatacagtactagattgctaaatccctcgtgcactttatacaaactgcagaagataaacatggttgtttcaggtataaatttgtttagagcttgagattttgttttaccccaacataacagtctgtgactaaccccagccagtgtcattagtctaacctagcaggctaactctagtttagtttagtagcttagttatcccagttggaattatgtgaagtaggtgacttaacagatggtgaagactctgtgacttggtcaagtattaacatgttagattgtgatattttttaagcccatttaggtatgcctgaattaaggaagctgaacaggcttgtggaattgaagccatatgtatattactcttgtaaaaaaaactgtggacaaatcacacggtccccttgctgctgttgaaatctataatagtataatatgtaactaacaattaatttcttggatcttaatttgataccataccaaactgtacaagtgctatacggcacttcaagtactttaccaaaacatagcttggaactgctctggggaaaaaaacttggaatggagcaagttcctgttaagatatctgaaattgtatatgcatcctgtagtactttccaattccagcttttagtcaaattgttacctcatttagtttgcccttcacctgaggaaaaaaaactagtttaagctggccctccatactgatgctggatatcgcaaaattgacttgaaagatggagcaatgccaatattttcatggatggccaaagttattgaaacaaatacaactagtgccattttaagaggtattgtatcttatcgatcattaacccactcttgtacctgtcaaatgcaggagtgctgcatctgcttgtgtccctatgaagacggtgcggaacttcgagaactcccctgcaatcatcatttccactgtacctgcatagacaagtggcttcacataaatgcaacatgtcccctgtgcaagttcaacatcatcaagagcaaccttggtccagaagacgtctaggtttcacaggacgagcaatctgttgaaggattgatatgctccagttgcgttctttagctatgggttccttcaggtgtaagtatggggtataggtgatgcacagctggttgatcagtattcgctcctgaatgaaatgttttagcagtttcttgatgccggtagagatgtacattccttctctctaagtcaattgtgtcgcagattctcattttagccttgtaggaagtatttgaattgaggattctcatgtacgttgtgttagcaagtgttgaataaatacatggaaatgcagaggtttgtaagaagaaaaatggttgtggaattggagctttgttaacagcacatgctgtctccttaatatgcagtagacgtacattctacccctttggtgcttgatacccttgtctgcaatcctgttgaagcaaattttgcactttgttcgatgatgtttaagcgacagctggaaattagaaaggcggagtatgacggtaagcaacgcagccttaatctttcaccgtctcaaatcagagcaattcgatatttccagcaagctgtgtaattactgcttagggggtacaaactgcgaatttggctgataattacagcgtttaacttattccgtcaatgcaatggtacccaatatactctacatgttaaacgtgtaaattgcacaccacaaatacagttattgctaccaatccatgcaattgatattcacaggctcgccacgggcatgatgtagaaggtggctcgagacgtgtagcagagcttattggtgcccttgagcctaaactcaaccgtagtaaccaccacggatctgcccttcctgagtatctgcgcttcgacttccacttcagactgtatcaacagaaagagaacatgggcatcaggaaatacacacttgagatctaaaagccccccaacaagatgtacctaacacacacttgagctctaccaggaaatactactccctcgtatcctttttacttatctcaaggcatcgactgagtatctaacacacatgttgtaccattgtttttctaatcatatatctatgaaaaatattaaaaagataattacatgaatgactagtctaataatctcattttcgcatgtcaaaatcttaatattcagttcatatattgactttaagattttgaggtttaattgcacgcacgtatactggtatctaaaaaagagcagtctgttttttatgttgtgccttgaattgtttgtgctttattgcatgatatatgatggtgcgagttttacaatgctatcttttgctgtgaatggctaatacacattaaaggaaacacgatgcattcaaacccagcaggtctgaattctgaaattatgcaacatcagcatccattggctggtaggttatatcagggttcaaaattccggaacaaaatttctgaaatttcggttccgtcggatcctcaccttcccaatatgatattatttcaatcgaaatttttaattttttatgtgaatttggcaatattttgttcaaaattttggaccgaaatttccaaaatttcggtatatcggcaccctccgatacaaatgccgaaaatgaaagattgaaccctgggttatgtccatatcaagccagtgtgtgatgttcatttcatcgtctgttttggtgacaaatgttgcaggcaagtactttattactatatctgttgaaaaatgtgcttgcttgtgtgtagatgatttagttcatactagaaacaaagttccctcccctgttctagagctggatcatttaccctcttgcagtgttgaaatatatttaccactagtatcttgtacaacatcttcatcctagaacatcttcatcctagaagtgaggctaaaactgtgtccagcttccattccgaaaaatagcgcctatttattgggagattattcagcatcaaatttgcccccaattccccatgtaggaagcatccaataagtgcaagaaatttgtcttgaggatgcaatttttttctgaaaaaataaataaataaacaggttcgccagttgggtgagggaagtgtgtgctcacattgaggcgggcggcggagagataggcggcgctgagctcgccgaggaacatctccttgtcgcccgccgcggcgcgcgcgcacgccatcccgacgacctccgccacggccgccaccatgccgccgtggagcgtgttgtacgcgttctgcaagtcgcggaatcgagcagcgacgacgtcatcacgacacgctagggcaggaataggataggattcagcggaggaggagatgtggaggggtggggggcgcgctcacgacggcggcgggggagacggtgagcgtgcaggagacgcgcggcgaggccggggtggcggggacgacggagacggcggcggagaggacgccgcggacgagcgcggagtaggcggcggggagctccgcggcggccgggagggtcccgtccacgccgaggccgcggaggaagcgccgcgtccactgacgagactccgcgagcgacggcgaccggcgctccatcggcggcgccatctcctgatctcctcctttccctcgcgtttttgcttggttggtttgcattaactgcatgggtaggtgacagtttgaggaatcggagcagagaattgggccggcccaacgcaacggccatcgccgccttcgtggctttgcgatggtgggtaaaacgggacagcattagtaaatagtactccacccattctaaaatataaggcataatcacctctaacccaaagactaagaaaataattattatcatcttgtagtttagatcaccctaataaatataatgcatgcatccaatagaattagagaacatgacagtggatgttttaaaaaagtaataatttaatggagaagagatcatagttaatggtctatatgcatgtatgccttatattatggaacattaaaaaaagtggttgtgtcttatattatggaatggagggagtaatattacaagaaaattaatggattgccacttctaacggtgcgcttcgataaaataatactctaaaatatcagtttatgttacctattttatggaggagactcgcgcccaatgggaggggattaaaatcgggcgctgatgtcagcgtccgatttacgtgcaaaattattttaaattgatttttctcttaaattacttatctaaataatgattcgattgtaccattaaattcgttgcaattaaatcaaacaagactacacatagatatattcggacgaaaaaaaatttagcttattatttaattatttttaaatattgcacgatgttccaccaagtatatcggaattgtttcactaagtagatcgaaaatgtttcactcgtttaaattgggtgttgtttcaccttatataaaaacaatgtttcagcaaatagcgaaataatgtttcagttcaccgcaacattagatctatacatagtgaaacattgtgagtatactaggtgaaacatttttggtggaacaaaaaataaaacgaattcgagggtttccaaaatatgtgggtgattttttgcaatagagtatttcagttcactgcaacattagatctatacatagtgaaacattgtgagtgcactagatgaaacattgttagtggaacaaaaaataaaccaaattctcttaatagaaggtttccaaaatatgtgggtgatttgttgcaatggagtatttcagttcactgcaacattagatctatatatagtgaaacattgtgagtgcactagataaaatatttttggtggaacaaaaaataaaccaaattcctttaacagagggtttccaaaatatgtgagtgatttgttgcaatggagatatgtgtgtggataagtggcaggtggggacaggtgacacgtggtggggaccagagggagctggtgcgcacgtgatgtggtgagggaggagcgaccgatttttttcccctcccccgggcgaccgagaacgagcattctcactattttattctctctctttttacgattattttgattttttttagtttcttgtccataagaggccatgcgagaaataatgctttctcacctttctccttgacctcactccgaggcatctccttggcatcaccgaactagagctaccttttttaggctacgaaaaatcttaaaatatatttttagtctaaacctgaaacggataataatacggatccaaaattacaatatatatttaatactcctaccatccttaccaaaagtcaaatataatttttatcatgctagggatttaaactcgagaattctccttcacttgtacttatggataccaactcacctgaagtcaatctttttagcagatggatatgtttccttttaagcatttctaatcgagatttgaatcatgaatttgagtatataaaataaatcaaatgaaaaaagttgtcaactacaaaatcataaatcttatcgagatctataattttcatataaactttgtcacaatctgtcatgaaaaaaatcaagacaacatatccggaactagcactaatgtgattagggccatcagtgccagattataaaaaataccaagcactgatgtgagtggcattagtatcacgtatttgttgacgaaaaatccgtgcttggccgatgatgcctgatctgtgttggcacgaactaagtcgacgaacacaacggtctgggagatttgcttagctccagtgcagatccaaaattgatgagatacgggcgtgccagttagtttgatcatgcaactaacaagatatataaataacagatccaagagttgatcggctgacaaggcgatggaatagttgcgaccaatgccgatactagccgatcccgaaaccagctgatgttgatagggttttaaacaatcggctatatatcgaatgcatattctgatacttgagcaaataacgatatatagacaatctgctgatgataataaaaataatgatataatccaatataaaccaatcggctaataatgatatgatagaattaagtgaaccgatggttaaagcatacatcggctggaagtccgatatcataaaatccaaatgattagataaataataaaacctttgtcacaatgggctaaatccaacttgtaaataactcatcggctaaaaccccgatgaaacccttattataatcaaagacatgttagcttttatgattctatgcacgactagggatgatgcatcgcaaagtatgcaaagaagaataaagtctaaacaataaagcctttgactaatttttagggtggtggataccttagttaatataatctagcaagataatttagccgataccagcataaaccctaaaacgaatctcagccgatatgatcaaattaagatgttaaattaggttaactaagatatatgataaataagtagacaaatatactaaccgaatcagagcgatccaagaggtcgaatcgatgcagccttcaacaacaccaatatagccgatataattgccaggaccggcgaaacataggacttaccccttcgccgaagatcgaaagccgatgcagccctgcatcaggtgccaagttccgcaggtgataagtaaaaacctcggaaaagagagtggcgaagcggcgagagtaattgtattaatctgtgagagagtttataatgaccacgggtgtacatatttatacctatgggtagatactagtcctttttttgacaagaaaaaaaatttcctaaagataaaaggaaaacataaagtccttatcgggcactaaacacacttccctaaaaataaaaaggaaaccaacagattcttcctaataaatagatgaactgccatgccgcatcctccttgagctcggtcttttctggataaacttcctttaattgattaatttctttaaccgaatctaccaagaagctgactattatattggtgacgatattttccatcggccgatttcaagatgctgaaaccgatagtgactctgagcccatgatgacttaccaaattgttacgttaacggtattctaattaatcacccggcactgacgtcttttcctgccaacaggccaacccatccccattccaatcggtttaaaccgacattgattggttaatcatccatgccagatattcttataaaccagcaatggtatcttctcatcagtgccatctaagcatgaaaatgtccaggtccatatactacaacatcaatattgatgtttgaatagcattcactgtctgttcttcgcttcaaccaacaacgatgtataatttttttcagcgaaaccaacaacgattatttttggctgaaacgaacaactgtattgacatgtctatatgtcactcatccatgctagtatgtctatgtgtagcttaggcataccaaagttaataaacttattctccccagtggtaaacatgtagggccaatcgtaaaagtggcaaccagaaagtggcaagtagtcaaatatccctgagtaaatgcatgcttcgtcgatagattgtcatctgagtgaaatcatgacttcattttttttttctcactacaccatcgcaaggaattgagggtggcggttgaagatttaattgttgcaaagtacttagacacttagttatgattaatgaagaaaatacaccttttatcaccaaggctgcaaaaaatagaaggcgaagaaatcctttcattcgctagacggcactactggaaaactgatctttgctcggtcgccccaaaaccacaatagtcccggttacaaaaagaactgagactaaagatgatctttagtcccggtttaaaaccccacagccattctacgatctttagtcccggttcatccactgtcagtcgcttgacagaggggcgggatctttagtcccggttgacaccactttagtcggggagtaaagatctcctagatcaaatcacgcgtagtatataatccctattccctatcctctcccctacaaccagcctcaatctcctcaacaaccggcctctcctctccttaaattcatctccctctcctcctccccctcctccccttcctcctcccatcccggccctctcctccccctcctcccttcccatccgatgcccagcaagggccgcctcctccccctcctcccttcccgtgcccagggccgcacgcggcaggcggctggcgggcccacgcccggcggggccgcacgcagcaggcggccgcacacgggccgagtagcgagcggcggcaggcggcgctaccggcatccattctgttttctttttctttttacaatttgtgattcactgagatgtataattttgtgatttgttgtatggatctgagatgtataatatgtgatgtatttggtttgtgtgtaatttttttaatatttgtgatgtatttgatttgtgtgtacaagtaacttaagatttgtgatgtgaatgttctaggatgttactttgatttggggtttgatttggtaatatgtatcccactcgatttgggagaaaatacatggattaaactctggctaaaaaataatgaaaaaaagaaaaggagacctaatgagactgccgctgccctctctctttagtctcggttggtgttaccaaccgggactaaagataggtatatttagtcctgattggttatttcaacctggactaaagatgggtatctttagtcctggattactagtcccggttggaaaaccgggactaaagggggttaccaaccgggagtataaatggtttctccaccaatgtgggaatacaaatcttcatcactaatatgactttagagacaaatattaatacacaaagtaattatgcaagagagctatatactccctctgtttctaaatatttgacaccgttaactttttagcacatgtttgacattcgtcttattcaaaaacttttgtgaaatatgtaaaactatatgtatacatttaagtattttttcaatgaatcaaatgatatgaaaagaattaataattacttaaattttttaaataagatgaactgtcaaacatatttaaaaaaagttaacagcgttaaatatttagaaacggatggagtattcaattcccgtattatgagattgccctatggaaagacttcgataatggatcgaatacctaacacagggcttatcttgtagtcagtgaatcctgcctccttgaataccttgcaccattctttctcacctctctgcatgcctggtaatgtagtcgaaataagcagatcaaacaacagttgggttccatggcacattgcttgggtggaggatccaaccacaacatctatgacaatgaccttccctcctgcttctctggaaggaattgcctccttgcatcgttttagtatcttcatgcagtcctcatcactccaatcgtgtaggacaaactgcaatcaagaatgttgttaattaccatctaaaaatgtggtaactaagctagttaatttgatatataccctgtacatcagaagatgtcaatacacatacttttgagcgcttttcaacgcaaaaccggttggattatatgaccattaggcatgttcaaaggcatttctatttagagactatcctcatacaacaattgagtaaacaaaatactctcaataaatgcaccgagccaatttttgtattatctactccctctggcggagggtgatcctctctagcgggaggctgtgagacccccctttgtgagctcggccgggggaccgggtgcaatattgaggaacgtgttctcgcgcgagcgaggtgaatctccgggaatcaagctcacaaggtggaaggcgagagagtgagagagagggtttatacaagttcgggccgctatcaagcgtaataccctactcctgtctgtgtgatgaccttcgtatggttacaaagatttaagatcctcggagtacaagctagggcttggccagcctctttccagaatctggttttctaagagatgtccctttactcgtagggcacggtcctccttttatagacgaaggggataccacatgcattgcccctacgctctccccgcgggataggggcccacattgcctacataaaaagcgtcttgtgccttgggccggaagcgatccatgcggctaaccttgggtggcccataccgaaactttacggctgacacgggagacatcccccatcattccctattaaatgtttggcgacttcgtgggcacacacacattgggcggaccaacctgcaggacccacccctgtgcatgatgggacaaggcatacctgcccccacgccgtctgacacaaaccgggacgtgggtggactgccgcctgtcccatccgtccatcggcgggtcacagaccggtcaaaaagcggccgcaggcgcacgtcgagcgatctgtggcgcatgctgagccacgccgcataaaacacggcgggggcggttgcaacgccgctcataaatgcgcctggcggacggcgctcccgcccgctcaagcccccacatgggccttggggcgatccaacccctcgggcccgaggggtgtgacggggcacctcgagcccgaggggaggggaagaaagctgccgctctctttccaagggcgtggcccattcggggggactgggcccaccgtatgcgccacacaggaagggctttctttccccctagaccagggacccccaggggctttttttcccccctgatattatgacttttttctataaagttagtgaaacttagagcagtttgactttgaccaaagtcaaaacgtcttataacctgaaattaagggagtagttaacaacttgagcctgctactaattgccgtgctattagttgtcatcgtacatacctttaccggaggatcaagggtgaatagccaatacggtccctgaagtttaacttcgggctcagtttagtcctcgatgttttaaatcgtccaaacaagtccaccaaattaatcatttgggttaatatagttcttggacctaaaaaatgccacgtgagcatgccaagtcattctcgcatgcagcggtaggaatgatatgagcattccactcttatataccatatagaaaagaaataaaagacaaaaaatataacaagctagcctaggctcagcattgttgcagatgggtggccgacaaaggaatttatgcgaacagtgcttggctgagcaatcatgagtgacaattataaaacgatcatacacgtgtgaaccattttatcttcttttttttctttcttttctatatggtatataagggtagaatagtcatttcattcataccattgcatacgaggatgacttggcatggtcatgtgggactttttgtgggtccaaggactatgttgacctacatgattaatttggaggacttgttaatttgaacgatttgaaacctaaaagactaaactgagcccgaagcaaaacttcagggaccgtattagctatttgcccaaggatcaatgatttagatctcctgcttcaccactctataaatgtttaaccgtcatttaggaacatccaagcatgcatgccatgttacttttttgacacatgtcttaattttatggtatctcttatatagtatacatctgtaaatattaaggaccgaaaaatgtccatggagagaacacttcggtgtccaaaccacaaatagtgtcacaaattaaaaggctagaaaaaaaaaactcatttgtggtctagcaaatccttttcacagttgtattgtgtggttggcaattcattatataatcccgccatttttaaatatgtatcactgtcaatgttttaaacatgacatttgactattcatattacatagaaaagtatgtaaatattatttactttgttgtgatttattttatattaaagatactttaaacccgacttatatttttatacatttgtactacatttaattaaaacatatttacactaaatcttaaataagacgaatgatcacatttatattaattcaaaagtttattagcatcgttattaaaaacggagggagcacatttcatataactcaccttgagcaggagtgcatcagctcgggggatgaaatccatcatatctcctgcaacaaacttaacaacatcgcggccgcgatggtccgccggaatggaatcgatcacgtgaggaaggtccagcacggtgcacttgatatgcgggaacgcggcggccaccaccctcgccgccgtgccggtgccacctgcgacgtccacaagagaggtgatcttgtcgaacacctggcggcccgcgccacggatggccacgtccatgatgaaggccgagtcggccgccatggcgtcgttgaacagctcgccgagctccgggtctcggctgcagacggtccacagccccgcgccgtgcgtcatctcgaacggcgtctcctcctcgccgctcgtgagccactcggccatgctcgtggccggcgtcacgtagatcggcggcgagagctggaggagcacgaacggcagcaggctcctcccgccgttgccgccggtggcggtgacgagcagggacgacacgggcgtgacgcggtagatatcatcgtcgtcctcctcctcgtcatgcgcgaagacgcccgaggcgaccagcacgcgcatgacgcggcgcaggaagtacgggagcttgctcgggtggagggacagcgcggcgcgcaggtcgtccatggtggcgcggccgccggcgtggtggatggcgtcggcgacgccgagcttggcagcacagcccagggccatggacctgatgtagcccaggctgtggttcatgagctccgtgctggcttgcagtagctgctcgtgctccataacttggctacttgggcgagcttggttcactacaatatctataagctaaaaaattacgggtaagaatgggcgtttggttacccgtctcactctcctcacataattatattaccacatagaagggtgtccgtgtgtgtttgtagggataaaagtgcgcatgttataagtgtctatttgtactgtgtttcccaacttacacttccacattaaacggttcaatttttgtaaaaaaaaaattacatgaaaaatactttaaaaaacacattaatccattttaagtttttttaacaaatacttaattaattatgtgctaatttatttttttttcgtgtataggagattagttctaactcacaccgaaaaatatgatcttagaccccgaccacaggacgtactgatagtacaatatgccaacgtcaatgaagttacacgacttttccacatataatatagtattagacatttggacaattgcagatagcaaccaaaaccatcgctttggggtgctagatgtcatcgtatctgatactgattgttttgggatcggtacatgtcatcatacccttgtctagaaggtaggggcgacgagcgcagctagggattcttccgaaaattgcgggccacgcacctcctacttttccaccgcccactactttctgccacgtatccatctaagattaaataagagtaactggctatggttatatctgttctatacgacgagttttttttccacaaaacacacgccattttttattgtttgaacatatgaatacacatgtataccatattcttataagcactttcagaaggacgcgactagactacacgtgctagcgtaatacctctaaccagcgatgcgctactttttttttttttaaaaaaaaggttcattcttttccccacgtgagtgtgtcttgctaaaaaaaaacatgcgaacgntacactcattagtactaagcagagcccacgttatttaaaaaaaaatatatgatatcctgtctttcctcatgtacatccttccaaaaaagaca

SEQ ID NO: 39166 - DNA, 1719 bp, Oryza sativa
aactaatttaatgttattttatgaaaagttaattcctttcagaattgagttacttctataatgtgagcaaatcacttttaaatatttgaatatatttaatattgtactcatcttgtcatacattttaaatagagtaagtgttaacagcaaaatttggtaagccccgaagtcattatcggccgatgggaattatcaagtcatcaatagtcggattattgctatattcagttaaggaaattaatctaccaaaggaagtttatccagaagagaccgagttcaagtaggatgcagcatagtagtttatctattaattaggaatagtctgttaatttccttttatctttaggaaagtgtgtttagtgtccgttaaggactttatcttttccttttttatctttaggaaagtttctttcttatccaagaaggactagtatctacccatagatataaatatgtgcacccgggtcattatgaactatctctacgatcaatacaaattcggcgcatcgccataccttttacttttctactttttcgacgagtttatacttgtcatggttgctttgcatcggcagggctagggctttgacactctgatctcgtcaatgtaagcacatatttatcatatatattagttaatctagtttggtagttgaatttacttgtatcggctaagattcgttttagggtttgtgtcagcatcggctaaaatgttgtactagattaaattagctagggtatctagcaccctgaaaatcaatcaagggcttgattttctagatattatgtttcctttcatactttgcgctgcatcagccttagttgtgcttagaaccataacctctagcctgctttttgattgccaatacggatttcatcggagtttcagccgatgaggtatctagacgttgcatcggcttataacgattacatacaagttggatttagccgatcgtaacaaaggtttcattgattatatgatatcggacctctagtcgatgtctgctttaaccttcagatcaatatttattctatcatatcattattagtcgattggttcaatggattatataattattgttatttatcctcatcagccgattgtctctatatcatttatttactcaagcatcagactctgcattggacatacatccgattgatcaaaaccctattagcatcggcatcggctagtatcgacatcgactggaattactccattagcttgtcagccgatcggctcattgatctactatttgtatatcttgtcagttgcaggatcaaactgactggtacgcccgtatctcatcaacctttggacctacactagagcttagcagatctcccaggctgttgtgttcgtcgacttagttcgtgcccacacggttctggcaccattggccaaatgcggatttttcgaaaggggactgtctagccaatagacagctgaaaatttttatggtttcagccggatttttccaccacacgataaaacacgtgtcatgatctgccgcctgccgcccacctctcgcgcgccagagagcctgacgctgttttgtacgggttctttcagactctaagctttgtcccatttgtttggcacacaacaagtccggcaaaacataatctttagcaagaaaaacaagggcagctcaaagtaccaacagtgcaacatgaatacctctgcctctgtctccttatcctaccaaaacacggcat

SEQ ID NO: 39167 - DNA, 6711 bp, Oryza sativa
  unsure (1)..(6711): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnaatttatgtatacatataacatacttatgtaaagttaaatatatatttttatagtttaatatttctgtatttgttactggcttccgatctgtaccgacatgtttccgtttgtattgttccttttccggttttccgatatttccgatatcgttttcgtttccgactttatcatttccgatatcgtttctaagaaaaaatatggttacggaaatggttgaggctgttttccgatcgtttccgaccgttttcatccctacatttatatacaccagatagcaagcctgatttaaaacaagttgcagagtcccaagaggcacaccgggtaacgaagagcctcaataagtgagaaaatagatggacggcaaatcataaatgcaaacatattcagatctcgaggggtttaaagtagacgaacagactgcaattgaattgcagtagtaggaaaaacttaaagaacaggaaatgattaatccagatgttaaaagagcaacgttatgttagtagaactactatggaacacgatattccaatttttgcagcaaaacagaggattgagctatgcaggaggagcagtgaactgtgaccgcgcagcattacatagcacgcgaatcacttctgatgctggaattagacgccacaataaaatggatactgataattctccatagttatatcatatactattattgttgctaacccattgatactatatataggaacatgagtactaattaactccatattctaacgctgtacaattactgctgcagtaacccgactggtaagtgaaaaatggccagccccaggcctgcgccgcgtgggatcaactaattttctccatcaagtaagcgctacttgactacttgtgttcgcttctgcctggccgttctcttgaccttccatttcttgtccttgtccgacgcatggcaatgccctttttctcccttccatgaggaacatggggcaggcacgtcgcatacgtagcagaagcactgcaacacatgaggaacacgtttggtgacaattcagataagtaatagcagtgcaactgtaatagggtgtatggatgtcaaccaacaattcactaacacacagtagaccattttgatgcttgaaagacacacgccaacacgcgtgcttgatttaagtggtgtggttgtatactcgacaaaactagcaagtttagttacatgtcaaggcagctcgtctctaccacaagtgtacaacgcacactagtattcaatttcagtatttaacagggaacatggtgattgagttcattaaaccatgccatctctcagaattcttgtggacaaattgtccatgatacgcaacgaaggattggaggtgcttctctcacagtctcactgcaacatggaagcaatcaccatatacagaaactgatgctgttacctactatttatgtaatagtagtgcaactgtaatagggtttatggatgcttgaaagactgataaagtaagctgttacctactacttttggtatagatacataaagtaagctccttagtgctctgtcctgtgcactacatgatcaagctagctaacagttcactagtatatacataacaagaaaatcccaaacaattagtttttgcagtaaggagcattataattgaatttttagtaggtaatttgatagcaaagcatgatcacataaagtaagctaattttagtgaacaacaactgttagaggacagcattctgtggtgcagtggtgctttctctcctgtacataatctgtgtaatactagaacacttgaaaaggcaaatggacctaaattttcacaaccaccaagcagtaacaaacgactgagcgagcaacgattgtactccataacttgttgcaagtagaagccacattgtgagttttttttgtgtgtgtttctatacccatcctgtctatggaaaatcttctatggctagatgtatggacatgaaagtatcaattgcaggattttgtaatggaaatgcattgtttatcacatctgtaattttgcatatggtggtttgtttacatgtagtattgaactagtgagagtatcgaatgcgcggcaaggggtacctgctcgcaatgatcatcatggggtgtagtgccgaatggaaacttggcgcaggcagatctcggatgggggtagtcacggcacgccacctgcaaacatcgaaaccgccgcgtctcacactcgagtcgatcgaaatggggcgcgggggagcgggcgtaccttgccgcgctcggcgacgacggcgacgtcatcgttcgcggcggcggcggcggtggcagcgacgacgtcgggggagagcgggtcggcggagaggatgcagcagtcctcgtcgaggcggcgcttctggcccggggtccacatctcgatcccgtcgagttcgatgtcgagcagcgaggggggagcccgcttggtccggtttccgctgccgccgcccttggtggtggaggcgtcgggggaggaggtgaggtcgatcacgttcgccggcggcgcgggcggagggggaggcgtgggcggaggcggtggcgcgggggccgacctcctccccctagtcttgggcttggccatggcggggggagggagtaaaccctagggatcggagggagggaagaggggatttggggattgaaacggaggcgggcaaggcgagacgaggcgagaggatagagcggttggtattccattttgaaaacagtcaccgtcactgacatgtgggaccaacctccgcccctttcccgctgcattttacgggccgctgcctgaaatcaaggtctttgtttgttggagcccatgggccgagagtaatttaggccttctttagttcctaattttttttttcaaaaaacgtcacatcgaatatttggacatatgtatggagcattaaacatagataaaaagaaaaactaattgcacagtttgcatggaaatcgcgagacgaatcttttgagcctaattagtccataattagccataagtgctatagcaacccacatatactaatgacagattaattatgcttaataaattcgtctcgcggtttccatgcggtttatgaaattagttttttcattcgtgtaaaaaacctgttccaacatccgatgtgacaaccaaaaatttcctttttggatctcgttgtcacactgcatttacggatacacatttgaaaattaaacatagtctaataacaaaacaagttacagattacgccgaaaaaccgtaagacgaatttattaagcctaattaattcattattataaaatgtttactgtagcaccacattatcaaatcatatcgcaattagacttaaaagattcgtctcacaatttacacgtaatgtgtgtagttttttttctacatttaacactccatgcatgtgtccaaacattcaatatgacagcgtgaaaaatttattttgagaactaaacatggccttacatgatggaataaatctacagcgttaactgctatctctttctccttctaggagtattaaggacaattcactcggattcaagttttatatttgacacggttactagagtggtggatgatgtacccactgtggtgacttcatgaatctcaacatatgcgagcccaattttctagagatgcttacgagatagctccgtgttatgagtgtttataattggggtttatgcatgtgtgtatataagggtaagtgtgtacacgttatgagcgtccacgtttgtgttgtgtttctagaaaaagaaaaaaaacaaattagttaaaaccgcatgctctttgctgcatgcaatttaaatcacatcaatcaaaacaccaatcacacaaacaaaggataatttaaatcacatcaatcagacaacatgcacacattctcccacatgcatgcatcgattaaaacactataccaattataccttagcatgcacagattctctcatgttgtattaattatattatgatgaaatcagtttcaatgcggttatattataatcaatttgactaattttgaattttattatatgatgatcaatttagaaaggagagaatatttcttcgtgtattagcatttatacaagggtatagtttcttcttttgtttagaaaacaaatattggtccggccaagcccagaataacaatgttatgatgatcttcttggatcaaagctcatcagttacttttgtgaggctatacacatatactggtactagagtatactatacggtatggcatgtatttctagagtattcgaagcagacggagccagatgcgacttcaactgcgtgcaatgctgtgtatccagtggtcctctcctttatcacaatagcatgctataaaccagctgcaaacatattttaagaaaataaataaggtgagagaagagcagcgggctacaatttgtagccagatgtagcacggactccaagacgcagtgtgtgtatgacagataggaacatgtattaatagtgtagtatataactattgtataatgagctactatattggttataaataaaatagagctagtagttggctatactattaaacttgctcttatctacagtacagtatcagctgcaggccagtagtcctgcacacaatacaacgcctgctgctacttgcgcggtgttttcttataactttcaacttttctatcgcatcgaaacttttttacacgtaaactttaaacttttttgttagattattctaattttaactaaacttctaattttggtgtaaactaatcacatccttgatctactggagtatcacatttgcactttacgataccaccccgcggtactagaaattcccaaaatacggtactactccaaagctcagaaacgacgacgtactgtttttgcaacaaagcacaggaacgatgcaatagctgtgtatggttggtgtttggtgttattgcgtgaggttgacgagacagaaaactttcaagcatacagctaagctaaggagagcttattcttttttcataaattatgtagcatttcaaaaataataatagggattacggagctagttgtagagattacatgtattcagccatagctattttctgcccctgatggtcatgggtttttcttttgaacttattggtgaggcttttctaagcgtattagggtttttactcctattcattaaaatataattgatagttctcttatggtttaatttcttttttaaaaaaatattgaatttaagtacctttgggtacaatgtgcattcgttgaagaaaccatttttattattcgcttctttatagttatagacgagggtagtaattattaataagaaaacaaaggaaggggcagatcaggcatagtgattttccagtgcgtttgcagaaaggaaaaaagaaaaggaaagaatacctggagatatcaaataaaaagtaggcatcaccgtcgccaagttggttgccaaagtgtgatttggagatgatctaaatgtgatgtgtgcttggatgtccaagtcacaaagtgtccctgctacaaaattccttcaaacacctactcacagtaactgctactatatttattcattttctgctgaggctttccttttggttgtttctttgattgagccaacagcccccaaccctaaatttccggcacgctcactggacaaccagaagggcccacctgctcattatcattaagaacaagcctgatatggccccacctaccatctcacattttcttaatcctacccttcctgcaatcatttaatttgttactgtttttctgaataacaatgggatataattgctatgagacacctgaacatttgtcaaaatacacgtcgatggtccaccatccaactcgccgaaaagtgaaccaccggtttcacacccctattttggaagataatgctatgtcgagatagattcttcttagaagttatcatttctagtgtcctattgattttttcctttatataggaagagctatatctctactattataaaaatttaagatgtttttaccggtatttgatacgttattcgtgcatgagtcggttttaagttcgttcgcttttagaaatacatatatgtttttgagttggtttttaaattcgttcgctttagtaaatacatgaacatgcatgttaaaaataaaaagttagaaggacctacacggaattgaatatattgagacctacaaaattaaaantatgttcatacgtcatgtagactacggttttgtcgacataatgtatacacatcctttttagtatactcgtatttatgctttacaaatgtctcgtgtgttcgtcatctgttaatccagatggcatatataccctttttttcagtaaattcccaaaaaatatgttttttctcaaattatcacaagagtatagatttaagatggtgtatctaaaactacagatttaacaccaaatatatcatagattatagatttaaggtggagtatcgcaaaactatagatttattaataaaattatcaaaaaaaaactatagctttagtgcatatttaagcataaaacttaaatgtttataactcaaacatagtgctaaagatttaaaccctaaaatttatagttttgtgataagtttaatatcaaatatgttgttttgatgtactt

SEQ ID NO: 39168 - DNA, 736 bp, Oryza sativa
tcctgcagcccttggtgtatgggataaaaaggaaactgatttttaaccaatccaatctactatatctttccaaaacaaacttgactactttcaaaatcaaaatttggaattcaactttcttcttttcggccccaacacaggcccggccaaaacaaacacacacaaggatcggcaaccttaatgcaactaaaaaactccaaaactaaccgacagaaacttctgaaaactacaaaaataaaaccgtggcagcgagccgattccgttttcgtaggtcccgacaacaacagagacacggtggcagcgacgactgtggtacaaaacgtgaccagaactcgaaactctaaacgaactagacgctaagaccagcaacacgacgtgacgatgcaacacaaaattcaacaaagcaaaaactgaaaagaacaatgcaatggcacaatatggctaggtaaatgatacgaatttttttgttggctattttctggttataggaagataaaaactcaccgagcaacgaaagctctgataccacctgatgaaccctgagttcctctcgacactcaaggctgttgttggcccgatcttttggtgagttgtgataactacgatttgggagaaacgttgacgatccgactacaaccgtacgagacgttgtgttgcgccttagcgatcgatacacctctccatgggttgctgatcttgccggtgcagatcaaccctatttctgcaagcaaatcga

SEQ ID NO: 39169 - DNA, 766 bp, Oryza sativa
ttccttcctctttttcccaaaccggcaaggaggcaagccccctttccctcttcctttcttctttttcctcctctcgccggcgtcacctcctgtcgtcgttttggccgctagccgggcgctagctcgccggcttgaccgtccaatgtcggttcccctctcctaaaccgacattgtcgcccctataaacccaagcacctccctcctccaatctccctcgttttcgtctctcgccgccacgccattgtcgccgcctcccgtgctctattcgccgtcgccgttagtcgttgcgtgtgtcggaggagccggcacgagcaaggacgcggaaggggactccgggcgcgccctccccctcctcttcctcggcccgaggccgaaacgatcacgtttcgcgccgtcggctctcgtcactgcgcccgcccgcacggtagtgcctccctccgttcttcctcctcgttccacctcctccccttagactcgggtagtagcacgagtagcctccccgtagctagccggcgccgccccgaccgttgccgccgctcgccgtgtgctcgccgccgtcgccgcccgagctcggaagcgcctctcgtcgccggcctccctcgatgcgtttctcctaatccggcgcaagggacggattcccgtagccgcgtagatgctctcgccgccgggaatcggcccctcgtgacctcgtcgccgttttccccttttctctccgccggttgccgccgccgcaaatccgcgccgtcgagctcccttcggcgaatcc

SEQ ID NO: 39170 - DNA, 2645 bp, Oryza sativa
ccaaatccgcttcgatcttcttcctccttttctgaatctgatgccaaattctattgttaacactaccaaaactgctcaaccacatgttgattacttgtgttttgacctaggaaacacggttcaaagtcctctggagttttggttattgtagcggccaagacaccttccaccgaagactatttagtcgcaccgcatggtgactaactttgcatagctagacaaatctagcataaggagatagaaatgcattcatattgttattctctgaccaattgagtttgtggaatgcagcaataaatctagcataaggagatagaaatgcattcatattggttattctctgaccaattggagtttgtggaatgcagcaatgctctaatattcagaggtcaggctatgcaatcctaggtgctggtagcaagaatcatgacggaagcaataatgcattggcatagggcaggtggtggtggtggccttgcaggatggcgtacaatatatagttagttggatgaccgttcttacttttccatgcatgtttttgtgtaacgtcctgcctctcctaggccaggcccaataatgcattggcatagggcaggtggtggtggtggccttgcacgatggcgtacaatatatagttagctggatgaccgtggccctgtttgtttcagcttaagattagtagattactgtaatctagattattaaatcagattactctaaggtggattataataagctgacataaaataagctgcgagttgtttgtttctctggattatttgaggcatctaattgtagtgggcctttagccactcaataatatgaaaaaagctcctttagaggagattattagattatactatctggcttatagattataataatccagcataataatctacttgtttgtttcagcttactactaataatctagattataatattcctaagctgaatcaaacaggggcttacttttccatgcatgtttttgtttaacgtcccgcctctcctaggctgggcccacttacatctggtagctttcataggtcatagactatcctcacagaccaacacaagttttttctgcacattaagtttttgtgtaacgtcccagctctcctaggctaggcccacttacatctggtagctttcataggtcatagactgctctcactaacacaagatcactcgtgcgcactcaggaagaatttcatacatgtttttgtctaacgtctcctcactcgtgcgcacccgggaagaatttcgaatttcatgcatgtttttgtctaacgtctcctcactcgtgcgcacttcataggtcatagacttccctcatagaccaatacaagatcactcgtgcgcactcgggaagaatttcatgcatgtttttgtgtaacgtctcctcactcgtgcgcagttaggaagaatttcccgatcggccacccatccctaaattgctccaagccaagcacgcttaaccttatagttctttagagatcggcttctagaaaaaaagttgtaacttgttgatatgagtattctattaatcctattaagccctgggccgggatgttacaactaaggtcatcgcaatagacatggacatggacatgatcagtcaaattattcatggacagcacacaaagataagttagcaaagtggtacaaatcagagtagcaacggctagaatggcaaagaaataatagttgataatgtggatagataatgacagcagaaattctaccaggatcttacaagcttatgcaggattaaggccagatagattcacaacatggaatggaaactgactctttgcgcatgtatgcacttgacattttgatttaaatgaagagacataattttgtatacaaataaaggaacaagctcaaaatctactggtagtgcatatagaagcttcaattttcagtgcaatataagttttagttttttctcatagttgcagtttcacttgatcaatttttttttaaaaaaaccataatgataaactgggcaaaaagcaaaagcaaaaattcagtagttgaaacctaccttgctaatttataccccttccgtttcatgttataagacgtttcgactttagtcaaagtcaaactactctaagtttgactaattttatagaaaaatgtagtttgactactctgaattttagggtttagggttggggttagggtttagggttttgaaaggaaaccgtcataaaatggacacttggcactaggaggatgaagatactcattggatgcttgaagaaactctatcctcccaaggcacctccacatataaatactcctcccatccttcattctcacatacactaaatagagctaaattataagaggctttaagtatactttaggttatttatatgttctgttttttctatatataacattggtgttataaatgagtttcttgtccttttttcataaggattgactttatccatagaataattctaattaaaacaatactaaatttcttccaaccaaccctagattgttcgagcaccacattattatctacattttattatgtagaaatagaaatatgttttgagtggatattgagtcgcattttattatgtagaaatagaaatatgttttgagtggatattgagtcggtt

SEQ ID NO: 39171 - DNA, 3961 bp, Oryza sativa
tcctgcagcccgattgaatatgcttgctagtcagcttgtttgaagctcgatttgagaccttttacttaagaatatcttgataagcagtataattagagatgtaatttttggggcgtatggaatgagatggttcactgtttgcatatttctgaaagcactatattgatacatactatatctgttgtatatatgtttggatttgatatgttttaagattttttaagtgagcacttatgtttttctacggcacatgtcccatttaagcaaactcatacaatgacagtgtggttatgcataagttacatgtaaacaaaaacattttgttcaggacaagcagcagctattaattaatcgaaaggcacaaaacttgagaaatgaaatgttagatttaaaaggttttacctggtcaaataatctgtcaagcaaatccagatgatgtcgacacctcaaattgtaatcctgagaatctctcgatctctgcacaataaatactcataagagaatagtaaatgtttgttcgtaaagaatttaaacaaaagtgaaagtaatattaccattttagcccacaattttatggtgtttctgatcttttctttttatattcttgacatcgtaagttgatcttttcttttatattcttgataccgtaggttgctccctgatcacacatcttctgttggatcaaccgataagactcttccgacagctcaccagaagcctcgacttcttccacacaatactgatataacataagtgtgtcatcatcgctccacgtgaccctaggaaaaaaagaacgcccaagacttagggggagaatgatggaataagtcttgtggcgcggaggggccgaatctcgtgcgggcgaggctgtcggtgacggaggtgtccaccatctcaggcttcttggtactgcaaagtgaaacatttgatgaattaagatttatctgagtttatgccaaacatcagtttccctatcggaagaaactatcggaagaagaaaaaaaagcacaatttcacaacctattagtatggttgactcatgtcgaggggaaaaaaattacagttaatgagaagttaattgatcacataaatttgaattgtgcccttgagccactgccatgtggggcccgcatgtcggcgcgccccctctctctctctagggtttaataatggcgcaataaatcaattaaggacttttctatttatagtaaaaacactgtggatcttctaaaattcatagaaaattcatccgagctccgtttaagcccattcaagtctcagtaaattaagaaaaatgcaaagaatccattaaaaatggttttgttctctgttttagtagtcttatagcctttttgtattgtttgctttgtatgtcgcttagattccggctctcccgacgctccggtgtactttgagatagtcgccgaggtccctccagctgcagagcaaggcaagtcatgcttgtcacttaaacatgttgatcctatattgcaaatgctctattattttcctttaaatactgcattgttttacaatgataccatgggatgtttacctactgtcttagccatactaattatttccttgttcctttgttagcttgggttgtaacatgattagatgttggactaggaatttcttagccatgcttagtgtcacgccccgaactagtcccgaccaaactagcccgtgacgctccaaattaacctgttaatcgataccagtcccaggaaacagtgctagtatcacaagaagacagaatatcacagcaacagaggtctctttaatatagagaaggagtacagtcatgttgggctgcggacagatcccgagctcacaactgcattacaaaagggaagcggaagccaagacttggaccaaacaacacagacgcgacttgggaactaggccgaaaccctaaaactcaacgtagccggcttgctcctggaagaactcctcgtcagcgggatccgcttcatcttcttcagcaactggggggtagttatttatatagagcaagggtgagtacgggagtactcagcaagccatgggaaataagtgtttaatgcaggcttcaaggaaaggctgttgtttttgcaattgattttatttgaactcttttctgaaaacaactaagtgagtgcttctcaaacgacacggatgagacagtgcgtctcgtccggtcggagtatgtgcaaatatatcattctttagaattgatcaagattggcacccggccaacaactttcaaacagccacccgggcctagctgatcccatcagctgcagattttccaaacatcgatcccctttccacaacagcaatttcacaagcagtagtcaaacaaaactacgctaggaatcacctcacatccgcccatgaccgtgggcacggctgttcgaacagtttgttaacctctgcagagggggtacactttacccacatgacattactaacccggatcacctagcccgtggggatcagccacgtcgggagacctccaagctttcatgataaggcatttccaaagccgacacaggtttaccatatgccgacgagaggggtcccagaccaacaacaggttaggtcccagaccatactgtgccaggaagcccaggggtcctccccgacaccaccccgatgaattcacatgtctctcggcatcaaggctcccctgataagctagttactcggccaggggtgtcccattccacccatgtggtcgtacttgtcttatgtttggatgaaattccaaggaaacggtccttaagtgcaagagcgggaaaccgtacacccggtacgttccccggtccgcggttttggaaattcatttagttcgcaagcaccgacccaggtgtcgggttttccaagtcttttgtaaaacccaagttttacccaagttgtttttcagattttaagtttgaaggcgtccgtcgatactcgcactgggtgcacgaatatcgagacgcaactagatggttgcaaggggacatggtatcacaattaacaaaggaaggatcaaatgcaacaatttaggtaggtctaccaatctgccttgcagacgggacaacagattaagtgcgatcctatcaatgcataatatttttcaagcaacataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggcgaaaaataaagccctattaatgatctctaagcgtgccattagatagatctcgagatttgaggaattttggaagttgaacggagtcaaacggatttacggttgggaagatattgaatttctaagattattggatttttggtctaaaggaaaaggatttaattaaatcctttttggaaaagaaaaagaaaagaaaagaaggggggaaaattagacttccctcgggcggcgagggcgcggcccgagagaaaggaggcggctcggccgagctaaatgggccggccggcccaaaaggcggcccagagcggcccaagacgcgcgcgcgcgggagggaggagagagagagccggtggaccgggctcaccatgcgcggtctcgggtgggacccgcttgtcagcggctcggctcaccgtgcggagggagcacgcggcgcggcactagggtgggggagggacgcgatgcacgcgcgcggttcgcggtggatgcggatgcggcgggcccacgcgcagcctcacggctcgcggtggaacgcgcgcacggggagggactgaccggggtcggctcgacccggtcttggctgagctggcgccgacgtggcgcctacgtggctgccacgcgggccggcgggaggtagacgatgacgccggccggaacggacggcggacgacggcggcgagcggtgagcgaaccacggcgatacaggcaa

SEQ ID NO: 39172 - DNA, 31825 bp, Oryza sativa
  unsure (1)..(31825): unsure at all n locations
acggcgataacggtggggcggtttgaaccggggcaacgacacgggcggcaggcgcgggcaggcgcggcagaggctaacggcggcggcgaccaggcggtcggccaccacggcacgcgcacgcggaaagcaacgggcggcgctgcggtttgagcggcgcggctcgggcacgagtgctgacccgcggggccgagcggctgcgcggctacaggcgcggcatggcagcggggccgggcggcgcagacggcacaggcgcggcacgggcggcgaccacgcggggagctcgctagggatggaggcggggagagggagagcgagggggggagggcgctcgacgcggcttacgcgcacgcgcgcgtggcgcgagggcagagcgagggagagagggagagagagagagagagagagagccggggagggaggggaagatgggccgagagagattcggcccatcgaacccgagggaggcaaaatagacttttgcggaggaattgatttgggaaggatttggattcgggattgaactcgacgatagatcggggatttgagatctgagaaggcacggacactagacaacaagcaaagaaacagatttcgcaaataggatttttaagagataatttttcccgctaggcgccacgacggaacgggcgctacagaccaacccccctaacaagaatctcgaccccgagattcagcacctaagggagcagctccgggaactcggcgcggagaagatcttcttgctcccaggttgcctcatcttcagaatggttgctccattggactttgtagaacttgatggtcttccttcgagtctgacgttctgcctcttcaagaaccttgatcggtctttccttgtaggtcagattcttttccagctcgatattacccagggggacttgctcttctggaactcgaagacatttctttaactgggatacgtggaacacgttgtgcacatctgcgagaccttcaggtaactcaagatgataagccacttcgccacgtctggcggttatgaggtaggggccgatgtagcggggtgctaacttgccggacatcccaaacctccttataccacggagaggcgatacccgcaggtacacatgatctcctttttcgaactcaaggtcacgcctccgattgtcaacgtaattcttctgacggttctgcgctgcctttaaacgttctcggatcagcttaacttgttcttctgctgccttgagtatgtcaggaccgaataccagcgcttcgcccacctcattccagcacaagggagtgcggcactttcttccgaacatttcctcattcgatgacatctgaatgctggcctgataactgttgttgtatgagaactccgcatacggcaaacaacgatcccaagtgccttcgaaatccagggcacacgcacgtagcatgtcttctaggatttggtttaccctttctgtctgaccatcggtctgcggatggtaggccgtactaaaatttagatcggttccgagggcttcatgcaactgcttccagaaccttgaggtgaactgagtgcctcggtctgacacaatcttcttgggacagccaaatctacacacgacatgggtcatgtagagttctgctagtttctttccatcaaaggtggttttcattggcacgaaatgagctgatttcgtgagtcggtccacgattacccagatggagtcgtacccgctaggggttcttggcaaaccggtgatgaaatccattccgatctcttcccatttccactcggggatcggtaggggttgcagcagaccagctggcctctgatgttctgccttgactctttggcaaatgtcacacaaggctacgtattctgcgacatctcgcttcattccagcccaccaaaagtatgccttgatgtcttggtacatcttcgtacttcctggatgaatggagtaggcggactcatgagcttcctttaggatgagatctcttaactccttcttggccggtacacagatgcgtggaccataccaaactgtgccttgatcgtctatggagaaatcggtgtctttcttctcctgtattctttttattaactcttttatcccttcgtcgtctttctgagctttccggatttgcgattctagggtaggctgtactgtcaagctggcagcgacacctgactgtactacggtcagccttaacttttccagatctctgcacaggcgatcttggtcgggccgtatttgatctacattacaataggtcttgcgacttagcgcatcagcgaccacattagccttaccggggtggtaatggattccaagatcgtaatccttgattagttccaaccatcttctctgcctcatatttaactcggtctgtgtgaagatatacttaagacttttgtgatcggtgtatacttcacatctgttcccgattaaatagtgcctccagatcttaagagcatgaaccacggctgccaactcgagatcatgggtgggatagttgacttcatgaggcctgagctgcctggatgcataggccacaacctttcgttcttgcattaggacacatcctaagccttgtcttgatgcatcacagaagatctcgaaatcttttcggatatctggcaaggtgagaactggggcagtggtcaaccttttcttcatttcttgaaagctgtcttcacaggctgtagaccattgaaatttcttttctttctttaacagctcggtcataggtctggctagcttagagaatccttcaatgaatcttcgataatatccagctaagccaaggaagctgcgaatctctgacacattcttgggcgggttccaagcaagtacagcctcaaccttgctgggatctacttcgacaccgttgggggagatcacgtgtccaagaaatgctactcggtctaaccagaattcgtatttcgagaatttagcgaatagttgatgatccctgagcttttccattatcagcctcaggtgttcagcatgttcttcctcattcttggagtatatcaggatgtcattgatgaacaccacgacaaactggtccaggtattccatgaagattttgttcattaagttcatgaagaatgctggagcattggtgagtccgaaggacatcactgtgaactcatatagaccataacgcgttgagaaagcggtcttcgggatatcttctgatctgattttcaattggtggtaacctgatctcaagtcaatttttgagaaaactcttgctcctttaagttgatcgaacaaatcgtcaatccgtggcaacgggtacttgttctttatagttacttcattcagggctctatagtcgattaccattctctcagagccatcctttttcttaaccaggagcactggggctccccaaggggatgagctaggtcgcacataacctttactctccaattcttcgatttgtcttttaacttctgctaactcattagctgccattcggtagggtctttttgcaattggtgcggtgcctggtgccagttctatggcgaactcaatctctcggtctggtggcatactcgttaattcttctggaaatacgttgggatattcacagactatgggcaccgactccaaggaggtgacttgtaaacaggttaggatagaccgactcgcggtaggggtgttagaggtaaagcggacttgctttcctccaggtccttgcaaggtgatggacttttcggcacaatctatctgccctttgtgcttagccaaccaatccatccctaggatgatgtccaagctttgcgagtctaggactatcggtttggctaggaagtcaacttcctcaattctaaggttaacttccgggcatatttgagttgcccttatattcctcccagggaaatgtactatcattggtacacgtaaattttgggttttccaaccatttcttttcacaaaagcttgtgatatgaaagaatgggaagctcctgaatcaaacagaactattgcgggtacggagttgacagagaacatacccatcacaacgtctggagcatcctgagcggtctcagcttgaatgtggttcacccggcctcgaccaaagttgttggaaacacgagaaccttgtccacttgcctgagagctaggacgagactgagctgccgctggagtaggagttctggcagtgctgccattagcatgccctgagttggtgttggtaggattctgagggcactgtcgggcatagtggcccatctggttgcaccggaaacactgaactgctgacggtcctagcgatgacttgaaagaggtaacattgtttggcgcagtattgccactaggggcacgctgctgtggctgaggtgcctgacggttcatctgaggacgaggggcgtagcctggctggcggttagcctgagtgaccgactggtggtattgcatgggttgaccgtagcgagggcgaggtgcgcctcgggaagaatttccctgatggttagacttgcgtttcttgtattcttcggtagcctcttttctggcatcctcaagtagaagtgccttgttgatcatatgttgaaaagtggggaagtcatgagcaagcaactggagtctcattccaactgcgatccctttcaagaacttcctgatcttctacttgtctgtgtccacttcctcaggggcgtaccgagccaacttgttgaacagacttaggtactcattgacactattattgccttgcttaagtttgttgaattcctctttcttcatatcaatggcgctttcaggcacatgagctgcacggaaagccgtagcaaactcagcccaagcaatgttagtgggttcagggtgtgcattgcagtaattctcccaccaatctgcagcaggtcctcttagctggtgagaggcgtagagcgtcttctcaacaggagtacactgcactaagttgagttttctatcaacatctttcagccaatcgtcagcctcgacgggctcgacggtctgagagaactctggcggacgagacctcagaaagtctgtcagcttggatctattgttgcccatgtgagggtggccatttccatgcgcactatgctgaaaaccggctatggctgcggctaatccttgcaagatttgtgtctgaactgccattaagtgctgcatgttgttttccacatgaggtggggaagggaggcgttcttctccagaattgtgactagcagtgcggtgagagcggtgagactgttccatctctgcattacgggaagctgtgtgatgcgagcggttgctgcggcggggttgctcaacttctgcgttgcgggaagcagtacggtgcgaacggttgctgtggtgagaccgctcattagctgactcatgattttcttctggctcaactctaccttcttcaaaaccgaagcgggctggcgcacgagcagcacggcgggggcggctagccatctaaactcccagaagagggcggggtaagaatcagataagcacttaggagggcaaggagcaaagtaaatagcaactcagatagcacacactaggcataagctggatttttcaatcataaaaacacctaatacaacgggtgtggacaagtcacagagctacgccgagcttgactgtacgcacaccacctaggagaaccagactaccaaacaacacccacaacaaacacacgcacgcactacctcgccacgactccaaaagagttggcggcgaaacaaaagggcctaacacacggacggctgctgaagactgcctcctctactcctcgtccgtctggctgcctcctgtagtcggctcctcagtcgaagaaacgtcaatcggctgacgcgaagggaccggcggaacctgtcgagggccgatagcagcacgggccgctggcggtgggggagctgggtagtcgaatcggaacacggtggaagaaccaacaacacgcttccgcgcagtgcggataaagcgtgggccacggcgggaggaagcaactggggtgtgtccgggggtgtaggaggggctaactgggtgtgggtagggggagtacactggtgagtacggcgcacgtgagctgggggagcgcgggccactaggagtgcgagcagagccgcgggagctgtgggaggacaggtggctggcgtggcagaggcggcctgagtcccaagagacagtgtcaactgaggtgacaccctcctcggccagacgggcctccagagcggcgtagcggcgggcaagggagcggtaagtctcaaggagtaggtagtgctgagtggcctgagcctccgaaagctcaaccatgcgagtcagcactggctaagactcgctgtacggacaagggtacctggcgtctgcatggccagaaggaaggcgtggaagctgccggaaggcagagcccccgagacggtggctgtagtcgtgggccaagcgacgaagcgcagtccaggagaggtcctggtacgcgatctggagagtgggcctggccacagtaaagtggtgtgggcgaaggccggctccgtgtatacctccacgagggtaaaggtacacagagagctcacagcgagggggaacacggtccacggagtaccccgtgtactcgggacacgagaagccaaggaagcgggcgaggtcacgaagctgagcgacgtggtgaccctcaccaaaaccgtgggaactgaagctggcgttcactgccatctacaattttgaaagagggagaaaagatcagtaaccattttagaaacaaactattaaaaataaggaaaccaaaagaagccttagcttttcgcaagtagttttgaacttagtatccttagggtcgtcctaaacgtcgggtttcgccctagggccaagcctgtgctctgataccatcccttgtcacgccccgaactagtcccgaccggaactagcccgtgacgctccaaattaacctgttaatcgataccagtcccaggaaacagtgctggtatcacaggaagacagaatatcacagcaacagaggtctctttaatatagagaaggagtacagtcatgttgggctgcggacagatcccgagctcacaactgcattacaaaagggaagcggaagccaagacttggaccaaacaacacagacgcgacttgggaactaggccgaaaccctaaaactcaacgtagccggcttgctcctggaagaactcctcgtcagcgggatccgcttcatcttcttcagcaactgggggggtagttatttatatagagcaagggtgagtacgggagtactcagcaagccatgggaaataagtgtttaatgcaggcttcaaggaaaggctgttgtttttgcaattgattttatttgaactcttttctgaaaacgactaagtgagtgcttctcaaacgacacggatgagacagtgcgtctcgtccggtcggagtatgtgcaaatgtatcagtctttagaattgatcaagattggcacccggccaacaactttcaaacggccacccgggccaacaactttcaaacggccacccgggcctagctgatcccatcagctgcagattttccaaacatcgatcccctttccacaacagtaatttcccaagcagtagtcaaacaaaactacgctaggaatcacctcacatccacccatgaccgtgggcacggctgttcgaacagtttgttaacctctgcagagggggtacactttacccacatgaaattccaaggaaacggtccttaggtgcaagagcgggaaaccgtacacccggtacgttccccggtccgcggcggcaacggtcggggcggcgccggctagctacggggaggctactcgtgctactacccgagtctaaggggaggaggtggaacgaggaggaagaacggagggaggcactaccgtgcgggcgggcgcagtgacgagagccgacggcgcgaaacgtgatcgtttcggcctcgggccgaggaagaggagggggagggcgcgcccggagtccccttccgcgtccttgctcgtgccggctcctccgacacacgcaacgactaacggcgacggcgaatagagcacgggaggcggcgacaatggcgtggcggcgagagacgaaaacgagggagattggaggagggaggtgcttgggtttataggggcgacaatgtcggtttgggagaggggaaccgacattggacggtcaagccggcgagctagcgcccggctagcggccaaaacgacgacaggaggtgacgccggcgagaggaggaaaaagaagaaaggaagagggaaagggggcttgcctccttgccgctttgggaaaaggaggagggagcggggggctgacgcggcagagggaggaggagctctgcctcctctccttggaagctagcgcgtggaggggcggggccgagtcgatgacaacggcgatgacggtggggcggtttggagcggggcgacgacatgggcggcaggcacgggcaggcgcggcagaggctgacggcggcggcgaccaggcggtcggccaccaccgcacgcgcgcgcggaaagcaacgggcggcgcggcggtttgagcggcacggctcgggcacgcgtgctgactcgcggggccgagcggctgcgcggctacaggcgcggcagggcagcggggccgggcggcgcagacggcgcaggcgcggcacgggcggcgaccacgcgggcgcgcgcacgcgagcaacggcacgcgggggccgattttggggcagggagctcgctagggatggaggcggggagagggagagcgaggggggagggcgctcggcgcggcttacgcgcacgcgcgcgcggcgcgcgggcagagcgagggagagagggagagagagagagagagagagagagccggggagggaggggaagatgggccgagagagattcggcccatcgaacccgagggaggaaaaatagacttttgcggaggaattgatttgggaaggatttggattcgggattgaactcgacgatagatcggggatttgagatctgagaaggcactgacactagacaacaagcaaagaaacagatttcgcaaataggatttttaagagataatttttcccgataggcgccacgacggaacgtgcgctacacttagctcaactagtatacaatgggggaaatcacattaatgcatagacttcaggttctagtgttgttgttggttcaatgccaccgctctggtgatgattaattaaaatatattaaatggtgggctgtgggtgcatggtttggatggtcgcgcccatggcatttaaggaccggttcgcgggaaacccgtacttaccacaagctagcgtgggcaacggctgggcttgtagtgtagctttcctctagctgacgcatccaggcaagggtgagcgtgatggagttcggatgggccctgcgacggcctatgcgacttttggattcacctaggcacgagaggggactgcccactgccttgcgatgagtgggggtaaaacctgaggtgtggtatgtttggttagaggtggttatgcgaagggtcctgacacggcctctttccggtatgtcgtggtggcatatcggcacacgggaacgtgttgtggggctgtgtcttgtgggtacaattgtacacctctgatcagagtaaaactattcgaatagctgtgcccgcggttatgggcgatcgaccagattcaccgtgattagtctcaccctagtttagtctaatggaattgattagttcagatggatgtttgggcctgttgcaacgtggtgtagcattggacagtggatagttaatattgattaattactataaccgttttactgctttcaactactgtttataaatgccagcttgatgcaaaggatcccctttagccttcctttggttatattgcatcataccctccgttccggtatgacttgctgagtacagtgggaagtactcagtcttgctctatctcccaatcctcagagttcgagtatgcgtccgatggtggtttctccgaggagtaggcttcgtccgtgccatcaaggatgcctgtggagtggtgttcccgctgcaatccaagtcaagacttagctccagttatcttttatatttccgctgcatttatataagacttttataatgtttgtaagacgtggatctgtatgtcaactttgtcgtttgtgtaccctggccggtcctggacatggattttaatgcacattctgcttggaattctattcgggaatttctgggcgtgacacccttgatggctacaaggtaacatttacttgtcgctgtgctttgagaagtgcaagagcacaactccactataggaagtacaaatgttgtttatatatcttggttttctcttttctagtgcatagttgtatacaaattaagggcaaaagagacattttctaaccgaattattgactataaatagccatatggcatattaagtgggcccaaggataattttaagcaaaaacaaattcttagaggacctatatggacaaaatgaaacttgaaggattaaattgagctttcgatgaaacttaaaggactaaattagctatttactctaaacttatacttatcagctaaaatctaaattttcaaccttaaatttaattcaagagctgattttgaggttttatcatcgaagtttatttttcagcctttacttttagatcgcaaagaacacgtatataaaggttttgttcataaattacttttcgtttataaacatgccgtttcgcttacgcgtgctccgtaaatagggtactgtcggtgacatgggaccgggagtatcatgactagaggcttgaggcagacacaatcgcccacgtggcctggcaccctcggggggcgtcgggcccgagggtgatgtgttcgccctcctctttgtctccccgagggggtcggaccgctcccgcctcggccccgagggccgaggcgccccgaccctttgtgggttttgcgccgcgtatatgtggtaggtgagcatagcggggctcacctaaccacatttattgcggtttggacgagcgcgtcacgccgcatgtaacgcagtgcagcgcgctcgtttatccggtcagtgaccagtcacagaccgatcagatcgtgggttaggtggcgacaggcggtctaacgcacgcctcgccccatcccgtcaggatgagagcctccaagcactcgtccctagccggagccggcgtgttagctcctggagatggcacgttggtcccggtcagatatataccaggcttcatcctaaccattacaagcaagacattgtatgaagaggggcgaacatgcagattgataaactgacgcgtggtggacaagaatgaccgatttgtgaccggtctgacactggtcatgtcgtcagcagacagccatgttcccacgtcgcgcctgcttccggcggaagtggaggtaggtatgggccgtcccatcagaaggtcattcggacgacaaccatacaagtctccgtctgttgatgaaaagataggataagtccccacaaaaaagagagagatggtgcatgtggtatccccttgaggtataaaaggaggacattgcccacttagaagggggatttttcggatccagaacgatcagagagggagagagtaagagctctctggttctccagctcttttgtagcttcttcatacatagatccaccaaaacacaggagtagggtatgacgcttctcagcggcccgaacctgtatacatcgcccgtgtcttgtgtgtttccattctcgcgaaccttccacacaccgagagcttagaatctcacccagggcccccggccgaaccggcaaaggggggcctgcgcggtctcccggtgaggagcctcacgctccgtcaggtacactagccggttttgacaagtcttagcttagatcaccgcaataatctttaagggatgactccctatgttaaccgatcccgcctcagatccgcgctcgtcaccaccggcacaacattcatatccggccgatatggcgatttaatatatgctactatcttccttccaaaatataaggaatataaggagttatattttgagatggagaaagtactagtgatgatgaggaagatacactagtgcttgaaggcttagttgttttgttctttttcccaactcacctatctcgtttttcacatgcacacttttcaaactaataaaggtatgtttttttttacaaaattttattaattcatttttttaaaaaaataactgtaaattaattaatcatgcgctaactggtagtatgtttcattttgctaaattaattaaaattcccaaccctgcaggagccaaacacagcctaagtaaataaagggattaaaattgaaagcgtatctaacagccacagctactagtggcttggtggattacgagtcacgtcagtaggcgatccccggcgtgtgcgatgcgaggttagcttaattagctggtctgtccatgtcgtgccgtcgcggcgtcgccttcttcgccttggcaacggcatgcatgcctccgatcatccgtaaacctcacggcggccaccataccacacgtgcgtacgtacgtccacaccacgcccaacaccgacgacgtcgatcgagctccaatccatccacccccacccatggccgcgcgcttctcttagctggagtaattaaattaagtcgatctccccagcgcgcccccatgcaccaatggccgctcccacgcgccgcctcctcctcctcaaccacgaacccaccaccacccccgcttcgtcttcttcgagttcgaggcaatccttccccacgctgctccccgtttttatcctcttcgtcctcctcctctgcttcctctccatcttcctcgtccgcgacctcctccacttcctctccctctgcctccgccgccgccgcctcctccttcgccacggggaggatcatgactcctcctccgtctccatgcagtcctcagcctcgccgattaatgcccaggcgccgcgcaagccgccgggcttggaccccgccatcctcgcgtccttccccacgctgcgcttcaaggcctccgccgccgcgccggagtgcgccgtgtgcctctccgacttcgccgccggcgacgccctccgcctgctcaccgtctgccgccacgccttccacacgccctgcattgactcctggctccgcgcccacaccacgtgccccgtctgccgctccgacctcgacgccgcgcccgcgccggcgcctcgccacgaggaccccgccgccgttgccgtcgacgtggaatgcgaccggaggggcggcgccggctgaccggtgaacgaccgccgccgtgctggatgacatgcaggatttcctttaattttgttcgcgccaaaattgattttgatttgttttgttttgtttgtggctgcctgcattaccgtgtaaatactcaacgacttgtatcgtccttgtgcattgtactgtcagtatttccaaattgttggaaatgataatgtagagtattccaggtagaattatgagctagtcaccacagcttcagctagctgtttaattcaattgcaagtctgcaatacctgtcaagaaaataaatcaactgtatcaatgtatcagttggaagcttttgcaatgttatttttagccacagaaatgggcggttgccggttggtaccaacaagggcattctaaagtaaggatgccactaattttagagtaatctctctcggtgcatgatttgatacatgagtctatgagaaaaatgctaaccagaaagaggaaacacaatatatatatatatatatatatatatatatatatatatatatatatatatacaggcatataacagttttgctactaattgtcgcacacgcataccacacagggcaatatacgggtctgctttacaggatttatggaagcaagtacataaaagcaccatagcacgcctcaggtgctttgattcaaagacacaacgacgctgcttatttaataaacaacagcgtgtgagaaactgcttgcgtatcagcaagggacggtaaattatttatagaacacctcctctattcatgttctttgcttttaaagatctgtagaagcccatgaacctcacagtgaactctgaaataattagagtgtttatagttagtagttggtaagatccgttcattctcataagaaaacatagaagactatttcagttcagaactatactgaattggcaggtgaattattttctagtaccttcaatctttataaagcattggatagtttcgcgttggtcatggccctccttggcaaaaccttctatatttatgtttctgatttccaaacccgtgtcgccggattcgcactgctctttttgacgcgcgcaatctttgatctgattacgccgagaagcaagaaaaagaacaaagaataacggttagtatacagcaattagatcatgaattgaaacaactgttactgaagatgcagtagtcatgctaacatggttcaactccgatgctagttgatcaatgctattttggaactcctcatccctgtcccttttcagttcagcaaccagattctgcatttggaaggagacaaacattggtgacaaatactgaaaacaacgaaccctgtttcagagcatggaaacattaggcaaagtggagcttacagagaaaatgaagtaaggtgacacattatgttcaatcagttttctgatcttacccctaatgacatacagcctgcacaagtcgaagtaacaacatttgtatgttttctttcttgagattaaagacgctcaaatatactgaattatggggaaaaaacacatgaaagggatatcctactgttttgggcttggttcctccaagatttttttggctacattggagatttcctcttcccatcctgtcaaaatggcatggccttctaggaaggcatagctgcagttgtgaggggttatttatcgccttgagaaacccaattatagtgcttcttaacaacagaatgaacacagtaccagcaatctactacggagtaacatattctcaatacgaatgatacatgcaccttgattgagcagttatatgcattttttgtcaaaagagaacataccaattgcaattgtttctttagaaaatgaaggaggaacatttttttttttgggaatacgcgaggggcgcatctttgtattaagaaggaataaaagtatttacagagcgggccgaaaaataaaaaacacgaaggggacaagatacaggagtggggaggaggaagaaaataaaagcctaatctcccaacgaatgtggcgaccttccacccgacataggagtcaccatggccggtatcgcggctctagccaaccgccaaaggtccgcttcgcccgtgaggaacatagtatgttataaagacatttctccagtaacgaaccatctactttaaccacagtcaaaacgttgtaacatcccgatattatatttcaagaagcaggaaaggagaggagaagcaatgtttgatgttcttttatctaaaaacaagggagggatattcttatgtgcttactttgctttccaagtagcttcaaaagaacgtattgcctgtcggagattattgcctgagctcattgttattctcctagcaatatcacgaggcagatctatgctctcttgcactgcaatgtactctaggaccttgattatctaagatcaaagacatttttcagtaaactgtccagcattgcaaatgcgaagataaaatatccatataaaaagtacctcatcagatgaaggtggcttaagtgtcacaaccttgcagagatgcctgacagcctcaaggtttgaagcatcagaacagcagaacatgattttattgcatcctacatacctccccagaaaccatccaatataatgttgaagatcagatgagagtttatcagcgtcgtggacgacgatcactgcatatatatgaattttaaagtattaccttggtgtaatggtttgagatcaataaagcttcatttattataaaaatatatatgtatatgatacactagtacatcaatgtaacacatataaataccagaaaataaatgaagaacatgcagttgtgtcaagaaagatcactgtttcatcattttaacaaggtaaaatagtgtcctcatgtacctctgcagttggcatgactgcaaatggagtttggtgatgggatggattcattcaacaaagtagtaatgacatgcttctcatagccgtgtatgtcagccaaatttacctccacatgatgacttgaaatcttcactctgatatcaatgtgttttgcaatttctccctacagtgcgagaatggtcagtagtgtttcattttacactttcctctgaaggagtagtagagatttgtaatggcgacaatgtgcaaaagaataacaagtcattctcatgcaacgcgtaccttcagctcgaatctctttgtctgttcctctatctgtgaaacggcaatatgaagcaagaacaattgtgagcttaaaggtttagataattaggttggttaaaccttgtgcaaaagtgagtagcatcaaccttgagattatcagtagcaaaagcatcccatatgagtgccgacaccatgctcctctttccgacggaggtcgggccttcaaatatgatatggttgcattcttgtgcggtaacctggggggtaaaccccttatcagaatgtcaagacggtagtagtatcactcaatgtagtgaaatatttgactgtaaatgggtagtaaggagtgtgtgtgatgaccatcacctggttgtagagctcaagggcagcgtccttgttgcagatgaaatcgttgaggaaattggggcgatacttgtctgcccagatgtacttgtcctctgccgtgggtgtggattcttcagaagtctgtggcgaatccaccatggcgaccgatttgggcaaaacccggacccagatgctccctcctctcccgacggcgacggcggaggcgctgtggtcggagctctgcgtgctgtggtcgccggcggacacttgtggctcagaagcagcttcagctttggattcagccggcgtgtggtggtcgtggatgcgtttggcggcggcggcggcggcggcggcggcttcctctctctccctcaaaggcctcctctcggcgacggcggcattggctacctgcggctggggcgcctcccggcgcggcggcggttggtggggcacggagctaggggcggtgcgggggcgggtgaggggggcgccgcttctggggatgcaagcgaagcccaagcggtggagaccgagcacgagctgcgacggcggcaggaaggtacggtagcgtcgggcgtcgcggcggcggtcatggtcgagcgcgtcggagagggtggtggccgggggagccatgtgggcggcgcgcagggtagtggcagtggcagcggcatgggactgggggtggacatgagatgagagcggagatgaaaccaatgcggcgcggcggtgtggacgaggggagcgagaggaaggaggtaggcgtggcgatcaacgcggcagcggccggccaggtggtgaggtggcggtggcggtggcggtggcggtggatggtgaccggagaagcattttttgccgggatcattcccatcctgcctcctctcctggcgccggcaacgcctaccatcgccatctgatctcggcccaagctctccatttccatcctattggcccacttcgttatttgggccgcctctggttgcatattcagagaggatttaggccggccttctttcgctgttacttccactagttatttaattattttttagagaagttattttattttattttatttagaggagtttcttaattttatttttttagaagagccttttaaataaggaacttccctgtaaccttcgcattacttccactattattctactgagttgcttgatagaccgtttggtaaggaataagtttatgtctctcgctcttgattgagtcacatccctcaatcataaaactaggtataatgtcgcctctaatattaaaaaaccagtgtagataaactatttcagaggtttagaaagtgttttttcgctgacgtggcaggttgaccacaattgacttgctgagtcaaaaggagggacccacatgtcattgattgttctctctttgagagggctaatgtcgcaaaggggatccatgactaacgagtagtgacgtgaccggggaggagttccgcgatgggcggcgacgaagatgggtgttgtgactggcagcgaagactgcagcagctcgcgtgaactaggggatgacaacccatagcggaggacgataggcgataaaacagcgagacccgaaggtagaagggcggcagtgcaacaatgacggggtagcacacacatctctcgctccgacgtgaccctctgccgccgccaccagtctctacgaatgccatcctatcaggtagctctattaccctctttctttttcctatggagatggcggtgtcccaccctgtcccagcttgatggcctacctccccctgtggggcctccgatgccgccatcgatgctggaaggaagccacgtggaaggaagtggcatggaggtggagttccaggctcaaggtgagaggacaacagccaccgctaccatgagcaccactatgcgcgtgctccttgaacggacgatgacagtaactcaatctgcccccgacgatgttggccacctcggtgtcgccaagctcctaccaccgcatggggtctctacatgctccacctagcttctctgcttccatcaccctcggggagacgaccccctccccatcggccgcctccacccgtgagctcccctttccactaaaggaatcaatgccgatttttaaagttgtttggagagggtattatacatgtttttttgttgaggaaggctattcaggaagtagcaatatacgagaaagacaaacaagaggttgtgttcgggcacgcatgtattattgcaagattaattaagtattaactatttttttgaaaaatggtttaatatgattttttaaaacaacattcatatagaatattttttaaaaaaaacacaccgtttagcagtttaaaaaacgtgcgcatgaaaaacgagagatgtgagttgagaaaactgggataagaactcagcctaaaccgtttggcaatgaccggaaaatttgaagttgggcgatgattttacaggccgattaaccgagggcagtagttccctcagcagtgtccggccttggacttgtgccgcacgcacacttccatttccatttggaaaaagtacaccgaaggtccctcaacttgtaatcgggataaaaaacatcctcgaagtgcaaaaccagatatacgaggtctcttaactatacaaaaccttaactatacaaaaccagtcactcgaagttcttcgatggttttgaccccggttttagtctacgtggcggctgagtcagcgtagaacctacgggccctacatgtcaggtgtccacctcaccctatctctttccccttttctctttctctgttcatctctctctctagcggatgggagcggcggtagcggcagacttggcgagcgcgcggcggtcggcgggagagcgcgcggcggccagtacgcggtggtggaagccccctagcgttgcggaggcgggctgcaccgacacggcggcgggagcacgaggcgacgcggcggcaggcggttgtggacgagcgacgattgcgcggtggcctcctgcgcccacgcgccaccgacgttgggtgacccgtcgtggaggcgacaggcgcatgtgaaccagcaacgattgttgggaggcttctagagctctcgtcgcgccgctgattctcggtcatctttcaaagagtggcgtcctccaccgcacccggtagcaagctatcgcgcatcaggtaggaggtatacagttagggtttccccctgattttcctcgtgctccacccctcccccggtcgcctcgtgctccagccgcctcagctgggagggagagagctagggtcggcggccgcgtcaccttgtgctcccgtcgccgccgccgcgtcgcctcgccttgtgctcctgccgccgccgtgtcgccggccgcggccgcgtcgcctcgtgctcccgacgccgccgctgccgccgccgcatcgcctcgcctcgtgctcctgccgccgtcgtgtcgccggccgcggctgcgtcgcctcgtgctcccgccgccgcgccctggcgacctcctccccacgaccccacctgccctggctttgcccgcgactagagaagtgagagagagaaaagggagagaagagggaaaagagagagtggctgacctggacaggctgacaggtggagcccacgcaggtcccacgcggactcagaagctacgtagtacaaaaccggagtcgaaaccatctaaggacctcgggtcaccggttttataccgttaagggacctcgcgtatctggttttgtggttcgaggacattttttatcccgataacaagtcgagggaccttcggtgtcctttttcctttccattttggaaatctgatatcgatgagagttggacgacctcagcagcaaccaattatctgctacagcatgcaggacctttgacttggactgcctccctactcctactcctactcctactcctactcctagtcaagtcaagggtaagctccaagaaatcttctacttctacttctactcctactgatgaatgtattggccggtatatacatgcttcctcatgtatcacactggtggagaaaccctttgtactcccggttcgtaaccccctttagtcccggctatctttagtccctggtgaaataaccgggactaaagagaggtatctttagtcccggttggtgaaccgggattaaagatcgatctttagtcccggttggtaactgttaccaaccgaaactaaagagagggtagcggcagtcccattaggtctccttttctttttttttattattttttagccagagtttaatccctatattttctcccaaatcgagtgggatgcatattcccaaatcaaaccccaaatcaaagtaacatcccaaaacattcacatcacaaatcttaagttacttgtacacacaaatcaaatacatcacaaatctttaaaaaattacacacaaaccaaatacatcacatattatacatctcagatccatacaacaaatcacaaaattatacatctcagtgaatcacaaattgtaaaaaaaaagaaaaaaaaagaatggatgccggaagcgccgcctgccgccgctccccgtgcgcggcctgcgtgcggccccgccggccgcctaccgcgtgtggccccgccgggcgcggccccgcctgacgcgtgcgagaagggaggagggggaggaggcggccctcgctgggcatcggatgcgaagggaggagggggaggagagggccgggatgggaggcggaaggggaggagaaggagatggatctgaggagaggagaggccggttgttgttgaggagattgaggccgattgtggggaggaggatagggaatatggattatatactacgcgtgattttagttccggtttgtaataccaaccgggagtaaagatctaggatatctttagtcccgtttagtaataccaaccggaactaaagtggtgatctttagtcccggtttgtgacaccaattgggactaaagagaattgacagaggatgaaccggtactaaagatcatctttagtctggttggtgttaccaaccaggactaaagatcgtagaatggctatggggttttaaaccaggactaaaccgggactattatggttttggggcgactgagtaaagatcagttttcgagtagtgtcaggtaagggccggagaatgcatcatgattgatgatgatcgatcggctggcagcgcttatatagtactataagtatactatctcgcaatcaaggatgataccatatctccggctaattaatcaatgaatgagggaaagccatggtatatctatatcataccgaccaaatgatcatatgtgcctgcctgtcctgatttaattatatatgacaacattatcaagctcatgcattcggtcggtagataggttggcatgtactaactactgtagtctgtacaaattttcgcactcgaccgtgcgcttgcttagagtagcaattagcaggaacattacagtacttattaagctcgcttggtgctcctcctcctcctcttccttctagaaacttcttccacgcacacgatatcacgtcaacatcgcacccgcccgctcacgcaccgcatgacgtcaccgacggctttggtggcccacgagcgcgtggggaatacgctgcccacccttccccctccgatcccaatccaacggacatcttctttcgcgggaggattaatgttcatttattgatggattttttttctttctttaaaacaattaattatttattgatgatttgtaaaacgggtcaagaaaagaaggcggcggcggcggcggaggagagagagggccccaccaatacccagtagccgccgagccaggcaacggaggccaatgggagcttaacacgtggcccatctgcgggccacagcaatgacttgatcgactgttatttgctcttgacattccactacactaccagcttcttcttcttgtgccttttggaccttctcttcaaacagcagagcacactagctgaccaaccctacaatatactcgtactaataatagagggtttttctctcctaatttcatcacaactcgtttgctccaggctgagataatcctcatctcaaggaaaatccctttctacaaatacagatacaagtcactgaaacagtgttatagtatggctttatagatgttgagaccaggttttattccatcgtttttttttagaaaaaaagaagactattagatggcttagttctctgaaacatactgtactccagtactgaagaacattgagccccaggacaagcaatagccttccaaatgaatttccatttggaacaatccatgtactgtagcagtctagcagatactacaagaagaggttttggttgcccatcccagaatgctgccaatgcaaagccttcagaaatttccatctctattctccaatccacatatgtgatatgtcttatactttccatccatccatgtatgtatgtcgacatccaccactctccattggaaaggcaaggccctcagctacctccaattgttgctcatcttttccatcacccccctcaactttctcaatgttttcttcagtattccctcaggaaagagagattcttcatgcaaagctatgaacattatttctgattatatgtaatctgtagacagcagagagactactctactgctcctaaagaatgctgcattttctttagatgcctttctaatgctgcatatattttttttgggtagtagatgccttcctttgttcttgcatttagaaccgcttcctctgctttagttaggcgtagtaggttagggtggttgcctaacatacatatgccgtctcctcttcttcatcttctcattcttcttcagtgtcaacttcatcaatgctggcattgaccctgcaaatcagaactatggagtatatatatatcacaactctttagtttaataaattcaaccgggaggataattagatgaaacaagagagcaggagcaggatttgctttgataaggctgaacatcacattcacattcacattgaaagcaaacttttagcgagtttggcaataacgtaacggcacttgctttggcagcatcagaaattctgagtcaagacacatgatactgcaaaaaactatcctctgcaattgcctcgcagctaagggtcaacacactgagaaaaaaacacacatcaaaatccatttctgatccacaagaccacattataattaagaaaaaaaggaagttactggagtaataagcaaggatcattcatgccctcttctagcatccatatttacagatgaactgaacaaagtagcactaatcctggtaccaccagttagtagcagccatcacaaaacttaagcaccaccagctacttattatcatcactgctaatccactaggagtattagctacaagtctgctcaaagacatctaaaatttgaaacatctcaaaatgaaaaaaaaaagactatatagaaggttgaacacaagagagagagggagggggtggtcactaattaaagatgtatacatatcctgtctgtatttttaatgtgttcctagtaatggtaatggagcaattagcaatggaaaagctagtgcttttgtacccttccttttcttcatcttcctcctttcctttgtgcaaagctaatggcatccacctcgagaagcaccaccaaaaggcaacaatggtaatggcaatgggcaaaggccgacgaggtggcggccgctttgcaatgcgattcccaattgcgcacgcgctggattcctgcaggtgaagttgctgttggttggcaatggctagtactcgacgatgaggctgccgaatggcgcgcggtgtggaatgcccttgcggcgcttgggcggcagggtgggcggcggcggcggggtggacggcgtgaagctcctcttggcaggggaggtggagttgtcggagtcggaggtggaggccatggcgtgggcgtggcgtagtctcttcctcctggcggcggtggcggtggcggtggcggcggcggtggcnncntggggggagccgccgncgaccttgcagccgagggagcagaagcggaagttgtcaaggaggctgcggctgcagacctcgcagatgttggcgacggcgcccttgccggccttgtgctgggggcgctcgttgaggaacaccacgcgggcgctgttgatgacgtatgtctgcaccccgccgatgtccatgaacctctggatgtcccacaccctgatcacgtcgtggtacgacgaccgccggatctgcaaccacaacgccgccaccgccatggttaggtaggtttggtttgggagagggagactgcaatgcattgggaacaaggaaatggttagtacctggatggtgtggtggtcgcggtggttgtgggcgaggcagagggagcagagcgcggcggcggcggcgtcggcgtcggcggcgcagtcgaggcagaacatgttgcactcgcgctccggtgcgagtcggcgtgcaccttgcactgcgagaagaagctggccgagagcagcgggctcagccaccgcggccactgctctccgtgcgccaccgcctcctcctcctccggctcaggccctcctcctccctgcaagtttcaataaaccaacgcatccgtcagtttcctttcctaaactacaactcgatattagattggatgaaaagaggcagttttgaccaagataatcccctctcctttgaacgattcatgcacgcaattcacagcgcgtttcttgattcttggaaatcacggagaagcgatttttttttaaaaaaaaacccacggatttggcggcgaaaggaatgcggggattccaacgcacagagggaagcagcaaaagcaagaacccaagaagaagaagaatcctttaatcaatctggcgccattgcccatagaaatcggccgcccaatacaacagtaaccgaaacaacaacgaaggggaataaactccagaagcatctcattccttcattcattcatgtagtactacacaagaaacaaggagtaatcgaaaaagaagaagagaacggaatggcgcagcatataaacataccatgatcctcctgttcttgaggcggagctccttgaacggcgactcgtggtcgatggccatcgatcgatcaatcaatcaatcagtcctctcctctccgaatgcaactaggcaaagggtaggaagaagaagaagagagagcggaggcggcggtggatggatggaatggcagaagaagaagcaaaaggaatgaataaaaacagaagaggaggaggaggggtgggtggactcgcggcttttatcgacgagacgagaaggcgaaggcggcttgggctcggtggaaacaagaagaagaagcggatgagtcgtcgtcgtctttgtaggagtcgtccaactccttccttctttcctatccccctcgacacgcccaagtaatttcttttttctttcctttcctttttttgcctttttttttcatcctccttaaataaaccacttgtcagtgacagtaataatatttactagtaaatttatgcgatttgtggctctttcctctatctgagtaatcaatgggcatgggttgttgttgattagcactaatagggttgtttggtagggcacaaaattttaaattttactttaaaagttagatatgaaataaagttgtgaagctatctaaatccagttttaccttatttgtttattttataagagcacttcaatcagtttaatttttttttttgaagctgaagccctttttttatgaagctgaaactatttggttgtgtttcagctctaaaagagatgaagctagagttgaaccaatgccctttctattaggttattactgcttaatttaatttatttttgatgtgaccttaatctcttgtgatggtttgttttggagaacacaaggggaaagtggatgccgaaatggccaaaagcgggatggagggagggcatttgcgcgtgcgtgccgaccagacgagacaccggacgcgctacagtacactacttgtccacgcacgtgttgctctctcgctattccagattgaacaccctattgggtactactagattattagggtggattatcgatttaattattaaaacagattagatattttaactaaataaacactgctcaaaatgagtggtctaaataaaactacaacaggaatattacttaacatatattttttttactaaatcttaacatatttttaacatattttttaagtgtgaaacaaacaatccattttaataattcagtgaataagctgaaaagaacaatgccctggaatcagtttcaataacccagtaaatccgtttcatgaggaacttcagatgaaacttctccttaaaaaaacttaaatgaaaccgccttttctttgtgcagttgtattgctccttgttgctacttggcctcgtctgactgacccgtcatcccgcccaatttttctttgtaaacaaatccatccagcaaaatgatcaatggcttacaagtggcacactaatcaatcaaccatgatgcacctgttctcttcatttccaaccgttgttaatttatctgcttaatcaattatgccacttaatggagtacagcagttcgtcgctttgtttgttactgatgcttggtttgcattgcaattgcggacaggcgcaccagcaccacaaatacaaaaagaattccccagagtatccaaatatccaatccactgctactatttttcctctctttgcctaattgccttgttcgattctttcaacatactatgatcttatattattcttatctgtgaggagccagcagatagatagatagatagatagatggactagtcgttgtactggtgccaattccagtcctaccaccaataatgctgccggtctacaaatgcaaatgcattctacaaactactccaaatgcaaacattatgccattcttttcacacctttttgttcttgttcccctttgaaaaactgcaaagtttttgtttgcactctcctctgtcagtctgtatccaactcaagttcttcttgcactctttgcttgccatggaagaaaacaaagttcaagacagcaaaataatgagagaattttgaaaggtcagtgaaaggaggatttgaatttcgaaaagattctgtggctacccactcaatcaaaggggcatgctttgccggtgcacggggaccgtcggattctccatctgcggccgtgctttcagatgctgctctttcttcacatgccattgattcctcctctctagtatctctcactctctgtctctgtctcctgcttcttcaagtgttgatgattagttaaagcaagcaagcaggcaggcagtggagcccttgaccttaaagagatactcatcatcagatgttaatctaatagtactagtataatctaatctttataatacttatatctagtttagtactactacatgaatgcaatgcagatgcaggagggaacccaggaatgcaggggaggcacatgtgcttgatggattggatggctgctatctgcaacttgcaagaacttcctctcactaatctctctctctttctttcttagtagtacagtacttgtcatctgcaatgcaagccatctaatctactcctaactgcccacttagcctgcactgcatccctgtctgctgctgcttgcaatgctaggttagttggttagtagtttgtgtgtcttgcaaatgtctatgcatgctgcaacttgcacacaccaatgacacatgcattttgatttcaccacaagggaaggggagatcgagagaatgataatgcagcaatttacgtcagagaaaagtgactcctccctccaggtcggcgatgaacttgctgcatctcatggaagctgaaaaggacatgaaatgggcagatgcatgcgtgcactcacaaagctcaaacctttttttatatataacagagggaaaaagcaaagggcaaagacatgtataatttgtagagtagtatgcaatatggcaatggtgctggactgctggtgtcgctgccacttgcaacgagtagctgaaaggaagatacgccattgccatttcccattagccatcgccaacattggatgtgaactagcccccaatttgccacgagtaaaatggtgcctttcttatctctagttggtatcttgtgtggacctgaacctgtttcgcactcgccgttgtccttgtcatgtactactagtcttcagcctgcattctgaagccagataaactgaactagctctcaatgttcagacatatttcagctatttcaccggattatttgcaccacgcctcttaaaatacgtttttctcaaaaaaaaaaaactttcttctacagcattatttgttctaagctagtatttgttaagtttatttctcaaaatgtataatttagagaacttttatcccataatcaagtagataatccggtgaataatgtgtttcaaatgggcccttagattttaaaacaactgaaattctagctcattcagaacagaggataaaaaggttgtatcactcactgctccttcacatgctaggaaatgggtgaactagtctcctcaggtgtaattgcatttcgttttctgaagactagactactgggtccaagtccaaaccggcgaaacatataatacttttcacgtgtgtggtttcacctcagacaaatccaatccaatccacagaaaatggtggattccttgtctccgttccccacaatgggatgatcacaagttggagcacttctttctttttttccaagtttcacaaaaaagaaagcctttggatttttgaagttaatttaatcggttctaaccgacttctaacattgtgatgatggtagccactggaggctctctctgaaagcaacagggaacaaaagctgtgcaagagaaatatcgacacaggctgaaaaggacaacccccaacactgtcatggatgttgccgtgtgacaatgggcaatcaaattgattaattaagaacatttccttccctaaatcagttagttagtgttccatggctttggtttggatgatgaattagtcgtcatcaactcatcatcgaagcaggaatcaaaacaggagagaagaagatgaaagtttcggctttgttgttgacacagacaattcaactgaatgctcacggaaaattcatgctgggagtacaatgatgaatcatcgccacaagagttttgtcaattctgaattaactggagatgcagatgttagttgtatcaatgatagatagattgctaggacggcacattacagaaagaaaagtactcctagtagaaaagaaaacaacggccaattccatgccaatccaatgcttgatatattgatgaatgcaaactgctttgctgattctcatttcctgcaatgccagcccaagtagcagtacattattacagttagatatctgttcacatattgattgaatggtgatccattcacatcaaaactctcccagctgcattgccgtacgatgctgggaaccatgattaagttgtgcgtgttagcctcctccttgcaattagctaagtattaattaactaggcaagtagtttcctgtggtgtctgaataattcctgtgcctttcaaattcaggcagcaaggcagagagagggacaagaatatatttgtgtgtgttgatggatggagattggagaggaggaggaggataaggaggaagaagggtatatgaaaaagcagggaatcattggtggccgtccgttggttgggctgtccaaatgtgctgacagccacgccgatagatggaatggatgccatcctcctccctctttacctaatcaaatttaagcatctgtttcaaaggaaccattaaattttaagcaagtggaggtagctctcggattggccaatggcagccaaagtaacgaaacaatcaggcaggaaatgcctgatgccgttctgttgctgggggaatcagaattcagttaaatttcaagctagtagctcacctctttaatttcaaagtgaaattttcactctgaactagaagtagtatcctttttgcaagcaatgcatcagtgcaccgatgagtgtttactgtgtctgtgcgtgtgttggacgttgatgcgacaaggattaaccgcacacactgtcactgattccgagtaatcatgttaggacaaaatatccacacgctgccgacgaccgagggctggtcaaatggaagacttttgattcttctcttttcccagaagatggagctaaacttctgctagtgttcaaagcctggagagatacacacattcagatcagatgcctcttttttctctactttgctcaggtcgtcgttgccggtcgtcgaaagcaacctagtacaaactacagatagtaggagtactattcacaagtttggggctttttttagaagtacgaagtagtttgtgcatttgtagcatgatgatgatgatgatgctggctcatcgctatgattacatgcacattcatagaccatcctgtctgtattctgcaccgaacgatagaagctacgcggatcaccaccaagaaaggcaacaatcaggccaaacttcgttcagaaaataacaagccatcttgtgacaaattaccttccatatggctaaaatatgtactgggtattatatggtatgaaacggtcattacaacgcaacgacacttttaggtagcatctaagatcccactaagacggttttaacaattttatgaaaaaacattcttgttacaggtgcatatgcttacatgactttagccagtacagcattcacgacataacattttctctatagctccaggtctttaagttttaagttataggaactcctgaacatatctgccaagcaggcatgccgtcaacttattgtcacggcgaatcctgtaacggctgaagaaatgtcacggagtctcgactgtagattgaactcacaggatccggtcttgaagatcagacatgatgttcgatgccaaagatgtcaacttcttcccagtttccccagccatgttcttgatagaagacagatcctgggaagcctacagagataacaagacatcaatcataggtctatcaataaacccagctgtactatgctactcttaatttacctggaaagaaagccggttgatcaaatctgaagcactcagatccacgttggaacta

SEQ ID NO: 39173 - DNA, 1657 bp, Oryza sativa
ttcaggcttctgctcatagagactttcatttggctggaacaaatggcaaaagttgttagtacagaatttcaatttacttgaggagaaaaggatggacactttgtaattgaaattcactgggtatttgggtatatttcattgttggcaacgcaattcaaatcagggctatggtttgttaagaagatgaagctctaactcaatcggatatgcagagagcatacctttgacgtaagtttccgtgcaccaagtccaccggtcttatttccaggcttcttcgcaacaattggcttcttgaaagaatgagttggagcccttggtgaacgaataacctcaggctcagtcttctcatttgcaacttctttagatgcctctgccagcttaagatctggaattgcatcagcttgatttgtaggttgtgaagctgcaactggggaggacggccaactgttgttcccatcttcagtggaatttttagcaacatccttagcgagcaactgccggtataagtcagcagctcttgaagtatactttgcttcaatttttccaccatctgtccaaccatgctgcttgaagaaagcttgtgcacggttgttacctccataaaccatcattttcaattgttctggggtccacgaatccaaatttgttgacctgcagattgcagcagtcaactcaacgggtttccagcaaaaaagaaggccacaactaaacaagaagttcttatattgtttagcatgtaaattctgtagtcaaatggtaagaacatatctaacgaagcgttgtagttacgtcgatctctaaaccaaatttgacagagcttaaaatttaattactcataagtagaaatggtgtgattgtgtagttgatggcaaacagaattacaacacagacaaaataacttcaagcgcaccacccatgaaatcttcagccaatttactacaagatactattgtgccagtttaattgagtgacctaaaaaggaacagtgttatattggcatcccaaaaatatatcgcccctagtagattgaaaaagaaaaggaacagcaccatgaaaatatctagctttgaagaaattatcatgagaatctagaacttccaggagaatgtagattgcagaagtacaaagagaatatgatgcaaaccgacactgcaggccatattggattttcttttagatgtaagaatatattggattatcagataccaagtaaatatctctgtacagtttaatagatatgacataaagatgataagtttgcacacggctgcgaatcataacagaatgtgataaattgcaaaggaaaacataaccggcaggccgaaattcagaatttagtagagagaaaaaaatacatgattagctcaaggcacctcagtaaatgatatgaattgtaaggcaggcagacatagaaggagtgcgggggtgtatgagggggaacctgacgaaggagacgtgaacgccgaggctacggtggacggcagagcagtcgatgcagaggaagacgccgtaggtgacggaggcccaggtcgggttcttggcgttgcagtcgaagcacatctgcaaattaggcatacgcacatataaatatagtcgactcgtaagagaaaaaaaatcacacgaattacagaagaacacagtctctctcacacacaca

SEQ ID NO: 39174 - DNA, 7385 bp, Oryza sativa
acaaatatgaacttttatgtccaaatcattatagtaggatggatctattcatattcagagtctataattaggtttatccaattttgatattaagcgctgcactagttagctattatctccgtccaaaatataacaattttttagctattacctccgccacttttgtccaaatttatagttaaaaatgcttatattttgggacggagggagtagctctttatcatcatagtatttatgtagctaaatgatcaccatatgccatcagtggcggaggcagcgtgggggcttggggtctttagaccccccccccccaccccctaatgaatcattagagtccctattaagaccccccctaaaatttaaatccatatatctattgcaagggggctaaaatatactttgtctgagattgttagaaggcccaaaaggctgaggagctcccactataattttatcctgactctgccactatatgccatacattatgtattacagttcatggtaccaagctgttgattatgagtacctacacttacaaaagctagttaattaattagccaggaatataattgaagaagaattagggcttattcgattaatcccacctataaagatattaagagagattactgaggtgtaaaattaatatccttcaatccctttcctttggattaaccaaacaaggtataaggtgatcgatgtatgcacatcatgctgatgtgtgtgtgcgtttggttaggcgttgctttcggatagactgatggagacgagatggctgcttgctccaggcagtaccatatagcgatagcccacttggagaaatgagtagtgttgtgttagtagtactagtactccacattgtaactgaacactgcagcttattttgacaatttaaacatgtagaaatgcatagtccctcctattttaacgtttaagacaaagttgagattaaacttttataacttaaactctcaatgatttttaaaatatttagtttaaaggcaatagaacaacgtatatatagatttatcttacaaactactaataaaaataataaaaaaagtatttattctatgtattatgatagaaaacatagtcaaacatatgtttttgataccagagggagtagtactacttatacgtactagcaagtacactcttcgttttaaaaagaaatcccaagtgagggttcattgtctgttatatacaaatctcaatttacattaggtttttcttgtacgaagcaagtatatagaagaagatataaaagtgggatagttctatggaaatgcatgctcctatagcttagcttctgaaattaaatgtaaagagaatggagtacgtagtactaatacatggaaaggctgaaactggttgaacacgtgggtcaattagtgagactatatgatgtgtcatgtgtggctgagaatgggatagagggagtgcatgcatgtgttgttagatgcgcatgatctcactttcactaatactcctacttaattagtgctaaaagtaaataaaggagaagaaaagggctgtggcatcggcctgccaggtttatttctctcttttctttttttttcttttcctttttttttgtagacgactctatttcgatcttttggcaacaaaaatgaatgcagacaaacggagtgctaaaaaattgattacttaatttaatctggagagtcgtgttgcagccagggtcttagttagagcagatacaataacaagctataaaccggctataaacatattttaaagagataaaaaaagagagagaaaagcagtgggtcacagatttgtaataggaccagatattaattgtatagtaagtaactattatatgaattagctatagatgatttggaactagtagttagctatactattaaacttgctcttatctcataagcaggaggcgcccatgcagatgcaggacaatgaggaaaataggccggctccatttgatgagtattacaatataatttcaaacactatatgtatattagacccaacgtagaattaaacccaccctctcatcataatatttaggagttgttgcagagaaaaaaattggttgtagtatctcctgactccaggtatacctggtctgctggtgcatgtcaaatatttaacgtgcgtactgtacgtcgtttagtagttactctctccgtttcataatataatagattttaacattttacttacactgtttaaccatttatcttatttaaaaaagtttagaattattattcttttacttactttattatctaaaatactttatgtataatttttcgtttttttatttgtacaaattttttaaataagatgagtggtcaaacagtataagcaaaatgtcaaaaactcttatattatgacacggatggagtaaaaattaaagcccttgatatgtaagtagtactacgattaatctttgaccatgctagtacaattcatgggaattaatcctttactgtagtagtagtagtgcaagatatgcctccatgaccattaattaattcatccccgggccagcatccaagtgtggaattcttgagtctcgtcttgattcaaccaaccagccattggatatatcgacatcaggcattcataattcaaccaaactaactaattaaccagacagtgcgtacgtactcctactccctccgctctagagagacaaaccctgaattttcgtgtccaactttgactgtccgtcttatataaaatttttttataattcgtatttttattgttgttagatgataaaacatgattaatattttatgcgtgacttgtctttttatttttttttaataatttttttaaataagacggacgatcaaatgttgggcacggaaaccagggtttgtctttttttgacggagggagtacgtctcagctcagattaacgtgttccacgcgctcgctcgctacgtccactaccaagtcgatcgtacggtaatactagtatgtaggagtacatactactccatactcatgaaagaagtcgtttaggataatgtttaagtcaaactttaggaatataaatcatgaataactcttaagttattgagtttgaaaatgtaaaaaattatatgtatagatttgttttaaaaaatactttcataaaagtatacatatatcacttttcaataaatatgttttatagaaataagaagtcaaagttatattttggagaccgtgtcgctgttctaaacgactttctttagagcaagaataataatatagccaactccatactattagcccatcttaaagctaacatatataatagattagctataaggttggctacaattttcttctcatgtctctatctctcacttatatatttaatgtatttgtcttagagcttgtgataagctagctcttgcataagagctaacacccttaatttttcactacctctctcctccacttaagcttatagctcactattatacttattcttaggagtatggagggagtatagtatacttaattaattcaccccctttttcccgtttggttgagaggtactagtgtgtgtgtatatatatgtgtacacacactactcgtatagtatacttcaacaacattttaggattaaattagatacatatagatatagcagataatttatctagattcataatataaatagtaaattctgtttaaccatttattatattgctatgttttaaaaagagatacaatacggagcaatgctactggaagcggctggaacacgtgcggaaattttgggtgacaagagacgaaagcacccagcacagcagtcaatctaatcatctcatctcatctgatttcatctgattagatacaactggagtgagatatttttaactatatatttgtcactcttataaatagtaggactaagcccttgtttagttcctattttttcttcaaactttcaacttttcgaacacatctaaatttttttctaaacacataaactttcaatatttttcttcaaacttacaattttagcaagggagtgttatttaactaaggataatattgaagcacataatttttatatatactaatatgttatataaattaaagcacataatattgattttgaaatttttaattggtttttatgtaaacttaatatatttattcatattattttcgatccatcttattttaaatattattttgtaagattgtgtggaaattaatagtaaggttgagatgctatgaaaattaagatactagatgggatcagtattgtttcggcctgttaagatcatagtatcgtaaaataataggataaggatcgagatactaacaaccttactactcgttatttagctataggtatataatagaattacttaccgatataactatctaagcctcgaaatacatgtaattgtgggatgtaggtagtagttatacggtgtagtattatgtgcagctgccacgaggggaaacactttcaattccttaaggggacgttgaaattaaagaaaaacgtacggaagagcatttgtcgattaatcccgaactaacaattaagatgaaatttctatatagaaagttctttttaaagaaatatatcatataacaattaaaaaaaatgctcacagaatagaggtagtagccaaattgagaagttgtttaaacgcagccgtagtattccttccgttgcataaaaaaccaacctacgatggaatgggacagtgtcgacaggatacccataaaccggatataaagggtatatattggggtccgttggtacgagaatttacgtagtacgacatcaagcaaacaaaagataaggattatactgattcagactccttggtaggtaataatccagttgatatgggattatatgatggaaaccacagattacaaatgaaataacagaactcgatgataccgacgagaccgtagtcgagttgattcgactagatctcccagcgactcggctcctgcgcgcttcgtaagctgtggtgggtgtgttggcagtgatattcgatgccttaggtcctgctcagggggtccctcatataccacgggtcaattgatccctaaataggactcggagatatcggacccctcacgatatggtatagaccagtcttgtccgagtaggactcctcccatccgtagataccatatctatcacgtgatagattgtaacgtcccgcctcgcccaggccgggcccacttggcccacttacatctgatagctttcataggtcatagacttccaacacatatccaggccaagcacgcttaaccctggagttctttggagattgacttccggaaaagaagttgcaatttgttgatatgagtattctattaatcctattaagccctaggccgggatgttacaccctcacccccttaagagtattaatcctattaagccctaggccgggatgttacaccctcaccctcttaagagagattgacgccccctaagccctaggccgggatgttacaccctcacccccttaagagagattgacgcccccgtcgatcaaccttaggccaggaacgtccttccaacacatatccaggccaagcacgcttaaccctggagttctttggagattgacttttccgccctaggccgggatgttacaccctcacccccttaagagagattgacgcccccgtcgatcaaccttaggccaggaacgtccttccaacacatatccaggccaagcacgcttaaccctggagttctttggagattgacttccggaaaagaagttgcaacttgttgatattctattaatcctattaagccctaggccgggatgttacacactcacccccttaagagtattaatcctattaagccctaggccgggatgttacaccctcacccccttaagagagattgagagattgacttccggaaaagaagttgcaacttgttgatattctattgagagattgacgcccccgtcgatcaaccctaggctaggaacgtcctctcttggccacgtccatgtgtccagtgccagcgcatgtgccatgctgtgtaaccactcccggtctacaccagccatgcgcaccatgcctgcgcaactgcgacacatgtgtgcacccgggaagaatttcccggtcggtcacccatctcaaattgctccaggccaagcacgcttaaccctggagttctttggagattgacttccggaaaaaaagttgcaacttgttgatatgagtattctattaattctattaagccctaggccgggatgttacatagatttccttaacgcatacggaaactatctgtatacgcgcggatataccgtatcagtatacaacgtacatctaaaatatagcgcttactttatccgtaaccctgacagacagactgagtatataaaagcggcgcttgttgtgcaggtggccggtcgatgcgtccgctagatggatgcacaacaagaattttcatttcaactaaaccaaccgagagattggaacacgctccacgcatgcatatatgcgacgactaacatcattttctcaatcaggtctgttagtttccaagttacgtgagggattagtattatgcagtgtttaacgactgagcagcaagtggcgacaaaacaatgaaagctaacggtgagagtatgtataactcatccaaaattccttatattttaagactaaaaagatatattttagtccatagaaaaacaaccctaaccatgaatctgaatacctgatttatatagttaaaaatatctcttttattgtcagggttacggataaggtataccctcatatacgctatacatcgatatggtttatctgtgcgtattaaatgtagaaaaaaaagagaaattacgagacgaatctttatgcctaattacgctatgatttaataatgtggtgctacagtaaatatttgctaataacggattaattaggcttaataaatttgtatcgcagtttcatgacggaatatataatttattttattattagactacgtttaatactttaaatgtgttttttatatccgatgtgatatgcaggtgtaaaattttttaacaactaaacaggcctatagctccagcagtactaccagtacgatcaaacaaaataaaagcaagaaatcaggaaggggaggagaaaaaaaataaaaaaaaaaagaaggagaaggaagcgcgtgcgtgctgccactgggtaacgaggttcacatggtgtttgacgtttggtgggtgcgaagggccacaccacgtgacgacaacgcacactgactgacactgccagcggagcgtcagccaggggcccacgccacaataaaaataatctaatctaatactccctccgtttcgaaatgtttgacgccgttgactttttagcatatg

SEQ ID NO: 39175 - DNA, 8404 bp, Oryza sativa
gtcatttttttctttttactcgagagaaaaatgttttttttatttttttcgagagacatttattttattcttaaaaacattttttctgttcaccaaacttttatctaagcaaaactcatacagggctgagataaagttacataacatagcagagaagcatttggcaatatacgtaccatgcaccttgagaggtgatatgtttctcctttgcctgttttggcaattgatttgttcctggcccttgacttacctccagtgtgactcgtgcttaagaactcacccatcaaattgaaaagttttcctataggggttagtacatgaagggtatacatccgaagtccatgaaagtactatctctacggttcatttaagcaaacttgacaccacgtcaactttgattaaagcaagctatttatcctaagcatcatgcttaatttaaaaagcctatgaatgtcgacgaccacccaaaccatagcatacgaaaatagaccgaggacgcataaccatgcatgatcaagctagactcaactagagataagtatgaataaaagtaatggtgaatcttttgttgtatacctgagtgtgcttaccgccggcatgatgtatatgttgaaatctctagagcggtggcacggtcaaatgtgattgtcgatctttcctccgtcttgatgcgggttgtggcggaggaaggcactttgattatgccaactcaggcaagtggttcggttatgcacacatctcgggtgcaagaaccttatgccttgaaggcatgttccgtcggcataatgctgaagagacgtaggatgcatctcttttcgggcaagtatgcaagtgccaactggagtagagcagcaaacacctagaaaagaagagggcatttcctgttgcttgtatgcatgtaggtgttgtgggagcgacaagttgtccacacctaggagtggatgaaggctaagtcaaggcggcacatgagctcaagagaggggctgggtgtagcctagcagcatggttgctaatagcaaggtgtatagccatattttaaagactcgcagatatctattgaaacattccaatcatattcctttgttccaaaagataacataggaaatcctttccaagcattccaattcttaaaaatatcctttaaagttccttcaatgcgagcccttcgcggagccaaatttaggcatgttcaaggagcttatggtagtcacaacttcttctagaatctacatctctccaaacaatgacaatataaaagtaagaaatacgtgagtggtaccaaacgactctccaacacgtgtcctcggctccaccatgctacaccccacgcttgctcgccttgctagtttcaactctcccatctctctctatttacatgttgatggagggggtggtggaagggataaggctggctcatggagccgtatggtgttgggtcggtcatgctattaccaatctggctagtcatgggagctagataatgttgttgtatgtttttttcttcttaaccagagattgggttttcgtcacccattgccatttttcatcctcatgcgcacagtggaaaaaactagaccagaccgacgatccaaccagaaaaaatggaaaaattgttatcctcggtttggttttttcgtcactcatcaccactcatcgtccttggaccttagcttctttactccgacaccagcatcgcctatggctttatctccatcttgccgccttgcacatcatcggcttgatcacccgatcaagtgcctagctacaacgatgatttcctcaactggtcgtgttcaagaacgagcgtcatctgtcactaagcttcagggtgcctacccatggatcacacccattgttttgtcactaagatgtgccctttttagcatggcctcaccgcttgtggacttcttgtcactgcttttacatggaacgttgctcgccgtagctgttttgttctactcggactttagtgtcaccactctcttcatcttgatcgccgttcacacgacatcctcgttgtctgcatcggtctacatcacccacttgaggtcttcttcacctacttcaagtatcgctgccacatcttcttctaacggacattgttgctactttagcacggtggtccagttgcccttgaattagccaccgacattgcggtttggctttctcatcatttttatccctgactttggctacatcgaccacgactgctttacacaactcgctcaaccacagcttcttcgtgcccttagatttgggtacctcgacaacatcacaaggattatcgttatcgagcactctcattagtttattctccaatgacatggatttggtgccccacccaaaaaggagacccaactcctaataaccctgttaagtgataattcaatagcataatactccctctatttctaaatgtttgacaccgttgactttttaacacgtgtttgaccgtcgtcttatttaaaaaaatttgtgaaatatgtaaaactatatgtatacatgaaagtatatttaacaataaatcaaatgataggaaaagaattaataattacttaatttttttaataagatgaatggtcaaatatgtttaaaagaaatcaacagcatcgaatatttagaaacggtgggagtatcttactataccattcaaggctagtgtggttggagtatagtctggatgtacgggcgaagctaaatacctgagcacgagcacgtacataactcataagtggtttcgcaggttcgttatttggagtgagcgaagcattttttttttccgaccgaaatgaaaaaaataaaaacagcttgcatgtgctcggcataaatcaaatataaattaaacaacactcgaattattattcattttgaatagcggtgttgatcgatcattccagtagggaagggcgtggatagggacctgtccggcacgccggccacgctacacccaccacctcccatgtcgcgattttatttgattcaaatcacggggattaatttaaaaaagcacaaggggcaaaagcacgcttctgccctcgctaaacacgtgaacatggacggcccagattttctggcaggttttaaatgataagatcgatccccaactagcacagtagtttatcattcctgtcactgcctcgtgggcctcacctgcctttcctgcacgtggcccaactcatcgatcgggtcaacggtcaaatcgggcggctgggtcacttgctgctagcgacgacgaggctagagtatttatataagcaacccaaatcgttgttatatctactctctgcagccacatttattagcccagtagttacagtgacctgagtaacaccttaaaatcctaattttaagtgaattttagattggattatttgggagctaaattccgtacttcataggctaagtttttaatttaaaattactgtatatatccagttggatgtagaggcacacttctcttaaaaaactctctgcaaccacatgtgctaagctagcttaattagcactaataccactctacttacacatgcaaacatgtttatattaatacaccgtactatttatatactcactccgttcgtaaatatttgacgccgttgactttttaaaacatattggaccgtttgtcttatttaaaaatttaagaaattattaattatttttctatcatttgatttattgttaaatatactactactattcaagtttttgaataatatttacaaaagttttaaataaaataaacggtcaaacatgtttgaaatggccaacagggtcaaacgggagggagggtatagtagcacaacttgtgtgttacggccctcgtggacgcacatgtacaaatatcttcatcatgcacgggcacgataaaaaaggtgcttactaggaacaatttacttattttttattcttccttttgcacacaaatttttccccccaacttgtctaatgtactttgttggaagatatacaatacatatgtatggtatgagttaaatatgcgcctaaatttgcccacgtcagaatgtggaatggtgtaactaatgacttgtgatggtgaaacaaattaacaacccctattagataatagtactagtgtactacaatgaaaatgaacttttaccactcttacatcgatctctttaagagcatttatgcgccgtaattcctttccatcttagagcaaggaacaaggataatagcgagttataagtctactataattttacgtgaagaaggtatatagaaaaaaaaaggttagctctcatacaagagatagttctaacacgtgccctaacacaaatacattaaatgtatcattgagataaagacaaagagaaaaattaaagctataaccttataactaatctattatatgtgttggttttaacttttaatatggactattttttccatttcaaattgatcatcatcttacgtagatgtaccaagaccaaaggaagcttctctcgtcctatatttactccagtaacaaacttggtgtatgcatcatccccattattcttagatgcataaatcaatatccatttactctaatgcacaaaaacgaatatacttaatgaatgaatgcaaatatgatatcatttagaaataacatcaataaaattatatgatgatcaatttaaaacggatggagtaacaggtagcagtgagttatacttatgaaacttgctcttatgaaaataacattgctgtcagtcaattgatcttttttttatgacaatagtacaaaactgcccgcaagttaaggaaggggaaaatagccttaaggcttgagtaactcttgataatgatagaattcgtcttaaacttaaccataggaccgcatgaaccttctgggagaagcacacgtgattttatatttttcttcaaaggaatacgatgtgatccacaaagtcctaaaaagatttagtagtagtataaaacattgtcaaaattcggatcgagcgaaacatatgctccaccactgcctcctaacatgtaatgtaaaatctacaaagataagggatcgtaaaacacttcccacgagaggaaagcagggagagagagcatggtatggaggggaggacgctgacatgtgggatcgagcgagagcggaggctgattacccggagggaggttacacaaacaggagataggagggtggttgcggcggctaggcgagcgatcccataggcccaagccaccatgtgagcgcaccgatgatccgaaaatcgctctttcaaattctattttttaatatatatttttagattatcattattttataactatttttactataaattatactagataaattcatcctaaagatgtcaaaatcttttataaatttttttaagataattataaaaaaaatttatttaaaaaaccttctgtttttttaaataaaggtctatatataaattcacgatatacaaaatgcatgcaaactttctatttataaactttattatgtataaatactcgttatttcagggaggctgaaaagaaaattagtatatactgtactttattatttgcagtatacaaatcgtggaggctaatcacggaatgatgcgcatatgcatgatttgtgtggaaacatgcataccacacgttgatagcgaaaaataggaattgcgggcgatttaacatggtatggctaaaaaaaggaagatgagtgaagcggtgatggtgcggctggcggacgcgcgaatgatcgctaattaggagtgtagacataggaggagtgataataccgaaaatacccctggacactaaatatgatttgatttgagtgattagccatgggacccatgtgggttttgttatctcctctcctcaccaccaaaaatccattccaccccatacccatccccacctttcctctcctcctattctcttcttctcttgtaggagtcctcttccaaatcaaatcaaatctagaagaagaagaaatcgagatcaaatcgatgaacctttggacggacgacaacgcgtcgatgatggaggcgttcatggcctccgccgacctcccggccttcccgtggggggcggcctccaccccgccgccgccgccgccgccgcctcaccaccaccaccaacagcagcagcagcaggtcctgccgccgcctgcagcagctccggcggcggcggcgttcaaccaggacacgctgcagcagcggctgcagtcgatcatcgaggggtctcgggagacgtggacgtacgccatcttctggcagtcctccatcgacgtctccaccggcgcctccctccttgggtggggcgacggctactacaagggctgcgacgacgacaagcgcaagcagcgctcctccacccccgccgccgccgccgagcaggagcaccgcaagcgcgtcctccgcgagctcaactccctcatcgccggcgcaggcgccgcccccgacgaggccgtcgaggaggaggtcaccgacaccgagtggttcttcctcgtctccatgacccagtccttccccagcggcgtcggcctccccggccaggccctgttcgccgccagcccactggatcgccccggcttgtcctccgccccctgtgaccgcgccaggcaggcctacaccttcggcctccgcaccatggtctgcctccccctcgccaccggcgtcctcgagctcggctccaccgacgtcatcttccagaccggggacagcatccccaggatccgcgccctcttcaacctcagcgccgccgccgcctcctcctggcccccccaccccgacgccgcctccgccgatccctccgtgctctggctcgccgacgcgccccccatggacatgaaggactccatctccgccgcagacatctccgtctccaagccaccacccccgccgccgcaccagatccagcacttcgagaacgggagcaccagcacgctcacggagaatcccagcccgtcggtgcacgcgccgacgccctcgcagccggccgcgccgccccagcggcagcagcagcagcagcagagcagccaggctcagcagggccccttccgccgggagctcaacttctccgacttcgcgtccaacggcggcgccgcggccccgcctttcttcaagcccgagaccggcgagatcctaaacttcggcaacgacagcagcagtggccggaggaatccgtcgccggcgcccccggccgccaccgccagcctcaccaccgcgccggggagcctgttctcgcagcacacgccgacgctgacggcggcggcgaacgacgccaagagcaacaaccagaagaggtccatggaggccacctcccgcgccagcaacaccaacaaccacccggcggcgacggcgaacgaggggatgctgtccttctcgtcggcgccgacgacgcggccgtcgacggggacgggcgccccggccaagtcggagtcggaccactcggacctggaggcgtcggtgcgggaggtggagagcagccgcgtggtggcgccgccgccggaggcggagaagcggccgcggaagcgcgggcggaagccggcgaacgggcgggaggagccgctgaaccacgtggaggcggagcggcagcggcgggagaagctcaaccagcgcttctacgcgctgcgcgccgtggtgcccaacgtgtccaagatggacaaggcgtcgctgctgggcgacgccatctcctacatcaacgagctccgggggaagctcacggcgctggagacggacaaggagacgctgcagtcgcagatggagtcgctcaagaaggagcgggacgcgcggccgccggcgccgtcgggcggcggcggagacggcggggcgcggtgccacgcggtggagatcgaggccaagatccttgggctggaggccatgatccgcgtgcagtgccacaagcggaaccacccggcggcgcggctgatgacggcgctgcgggagctggacctggacgtgtaccatgccagcgtctccgtggtcaaggacctcatgatccagcaggtggccgtcaagatggccagccgcgtctactcgcaggaccagctcaacgccgcgctctacacccgcatcgccgagcctggcaccgccgcccggtaactcaactctagcgaggaaacccaatcgatatactctctactctccccaagccggcgtagccatggccagagcttcaggaatgccaagaagacgacgagacgatgatcaaatcatgttgttgttgtaaaattaagtttaaagatctgtgttaggatggatggatggatggagaggatgattgatatcaactcgcaactcaagctgaagctgctgctgctgatcgtcgtcttgtttttgatactgatagcagcggttggtatttcttttcttcctttctttgttagcaggaaggaaggaagggaggaaagaaatcatcggcgatgggctgcagg

SEQ ID NO: 39176 - DNA, 16507 bp, Oryza sativa
tttgcttgatcaatcaactctattatctcatcagcactttaatgtttagcaactgcaagcaaggagatgaggaggaatggtggttggttggttggatggatagttattcatcctgttcatgtcctgccatagcccgtaatgatccatctcttcttcaacggagagcagcacggagaagacgacctgcacacacatgatggggacatggtcttgcagcacatgtgagttgggtgggtagatctcgccatcacaaacaggcagtagcacagtacgattagcgaccgagggagaactgagaagcaagcaaaaagcaaagtaggagctgctcttcttggcttggcagcacaaaaacgaaacagaccaaaacaaagctggatgtgcgtgtgaatgatagatcatcaaagctaggtttagggcacccgcaatggttatctatatgctctctacaagatacccatgtcagcatattttcctatatggaagagattaaatgaagagagagagcaaatctatctactaacttgaagatagtctatagaaaaacgaggcaatgcattagatagctatagatacctatgtagatatactattgaggtggtttattattaatttaatttattatttaggtatatatgttttatggaaagcaccttagtgatgagagataaaatgaacgttgacatgaaggacatggcaggccaggaccaaccaaccaacccacctcatccatccatccatccatccatccaacaaaacaaagcaaatcaaacgcaacaagagagatactgtactagtacagcaaaataatgataattgattttttaatttggtccgtgggatggggcagaaaaatgcgtgggtggcgtgcggcttttgttatcgcgcatgtgactcgtgaacaaacgggccatcggtgtcgacaaaagtaagtatctggccccagctcgctcactcatcactattcgctctaatctccacatgcgtttcaacatgtcttgctccagtagctccttttcttatttttatttttttattaaaattctttgcctgttgaattctcgtaagcaaacagcaaagactagaaaactcctgttgtttatgcttgtttcgggttgatgattacgcacgttttcgttaacagtaaaattaaacaagtaattaatactaattctctcaaataacaagcaccagtggtctagtggtagaatagtaccctgccacggtacagacccgggttcgattcccggctggtgcaaattcgtcttttttgccacgatttcagtacaagcttcgctcaattattggtatgagcatgtgacaatcagctaatcttgtctgcttccatctccagaaaagaaagccgccatcaatttggcacccactgttgatgccagactgatatctttgtaaagaatgacggttagtgtattaaaatcctataaattcgtttagactttttggattagcatttcagcatgacattgactggtacccctaaatgtcaaccgacaaccggcacaatttgattaagcatccatcaattcatttctcttctaaaaaggagaaggcaaaccgcacccaaaatgaatcgatacacattttcagcttgcatattctatggacaggtatgttacagtgtaaaaaaaaacaaaacaacaatatgctttacattctcaagaaactagcatgaactcgacctctatgtaatggaaaactgtacaggctatgtactggcactgcaacgcaggcctcctgccccaagttgcgagtaatgtatgggtgaaactgtattttgctgttgtagcaagtcccctttgtggcgctctggcctgtgtgcgaaattgctaggccaaccaagccaaagaataaaacttgaaatgatcacaccgctaatgatctgagcttaacgtggttcatttcgcacgctatgaatgctgataagaatgccgcccactgggatttgcaggagccgatggtagcgctggagctgtagaaggtagccggaccaaggcaggctgaggtggtggtgcagtaagggcgtaggtcagtcttgacgatgagctctcaatgagccctgcaactccagcagcagaagactgtgcattggatgggaggaataaatcgtgcttctggtccttgtaagcactccatacctaagaaagaacacattgttattttactcacgtctagtgctcattttcatttagtgctgttacttctaatgatcccaacttcgaatatgaactacggagtactcgagatggatgaactcatcagtaagttacttacatcagaagaattcagaatttcacgaactttagcacagtgtgcgccttccgttgcaaaagcatgaagcacctgcataatttaagaaaaaaaaatataaaacaaggggccagcagacgtacaagcagaagaggccaaatcaaactaccaaaacacatcatttaaccacaatgagataaaacaattgcatcctcttttaaccattcatcaaaatatcatatctatgccctgaaaacccttgttttttcattctaaatttaatttatgaaattatttctcaaacgcttcatgcattttcaggttttcaatctttcagggctagtgtaaactcctggtttagtttgatggatacaagtcagtccatctaggtactgaaaacaagcataaaaggatgactggttcttagttaaggacacttcctaacttatggctatcatctgcctaaataacatatatgatcaattcaactttgttttgattgcaccaagctgatgcggaagtcccatgataactgagaaaaatggcttaagacggtgcttacctccactgccaaaacacgcccaattgaagcctctgattcattccacttcatttggttacacagtccctgcctgccaccagctcgccaatcaagaataccaagcagtacttcaacaaggccaaccctgttttcaatcatagttgatgaatatgtgttaattttttgcaagacacatgattccatgcaaaaactaggatgaatgaacgtaagccttgttatcatttgttttgcctcagaaggactgaacacatcagatatgctgatttaatttaaacaaaagattactagcttttccattttcactcagcagaaataaaaagagattcagtacaatagaatttctttggtcatgttagaagtacagaaacctttttttttttggagagatcctacatagtgccaaaattttcgtgttaaaatcaaacaacattgattccttaagttatccctacatatgtatgatttgaacagcttactttagcccctgtgcaacaagtgcatctctagcccgattgccagcaccaacaacacgctttagtgtctctagtgccagtatacttccaccttgccatccaattgctttcataagcaatggaacaacctgcaaacagttgaagcaagaaaatatttaggtaggtctttatatgccattcatgaaataatgtgctatgcgtcaattggataggacttcatttttggtttctcctccaatcaattgtgagaaaagagaagtaacaagttattggaagtcaatattcaaaagaccttgactaataaagacattgaaatagagccaacatgactattcaaagttgtaggttttgcactaaatcaataaatcattcaagaaatggaatcttctcaggccaaaacatttgaacactacagggccaaatgtaataattacattgccatgaatgcattctagatgaccaggttcacactaaacttaagtgccatcatgtcactaaaaactgtactaagtcaaaccacaaaccatactgttggataagcaaagaaattagtgtgtaaaaaaaaaatcaatacgcaagtaccaagaaaattaaaacagaaaaaacaagggttgcaattcaatacctgaggagttcctgcacttgtggctgccatagcttctgcacaagtagtgctggaagccagctgatgcagcactcgcaaacaactaagccggacacgttcttgtggagtctgcacggtagagtccgccgagttctcttgattgctaggttccgcttgcaacctacttgtggtttgtccggatgccatagtgtcccgtctaccctcatatgccatagctgaaaccagctttggaacataacctaggtaaccaacatggtctgcaagggctggatgaacacgcaacaatgaaaccaatgcagcagaaagcagcaacggaagctctggatcaacagcattcgcctcatagtgtgtggcagcaactgatgagacatactgatctagcagcccttctaggaaccttttagggtttctcaatggaaacttgggatcctttaggaagagtctcacataaatacctccaacctgaaatttgcacagcatgagaacatatagcccaatttcaggaaatgaaaataataggatgattctagactaaacactacctgtggctcatccttcattacatgctggccagatgcttgttcaggcacatcccaatcaacaacacgccctttcatctgctcttggtagaggtctgtggccatggttgacaactgcgcagaaagagaagctgccattgcgggtgtccatacaagttcaggggtttctgtggtctgttcaagacatgaaacaacagcttcaccaggcccatctctaattgcagaaaccaaaccatcaggtaagaatctagcaagtgtgattgccaccctgggaccatgcattggctgcccaacaagtttgcccaataatgatgcagctgcagctctttgctgcatagggatttcctctacacaacataaaaaaaagtaagtaatatgttgcaaagaagtagatctaaagtattgggagtaagttaaaacatgaaatgatgaatacaagtgaaaagcagtaaaaacaaagcaactctgtcgaatgttcagaaactttactggaattgagtctggcaatgtaaacatgagaagttttttggatttttttaaaaatggaataattagaggagaaattatgcataaaagcatcagcttgtaaagaatgctagaaacatgtaaaaacattaagtgtttgaaataatgacaataagcagatcatcagctcatagactcaaaatctcatatgaaacaaaacacgctaaagtaaatattatcaccttcaagtggtaacataagttctagaatgtacactacaccaccatgcttggcagcagcccaggccagctccggtgtgctggctaaagaatagaggacagtaagggctccatccctgcaagaacgattgcagtgcagtatctggaaaagcaaaatgagacttgttctttctgcaaccatggcttccaaacaaggcgcatgcttcgtcaggagagaaagaacgcttaggcaaatttgtgggatgttgctttcaggaggaacaggtagcgcaagacattcaaaaagaggtgtcaaccgttccttggaagcaaaaacagcagccaatcctggattactggttagaagattctgcagtaaaaaaataaaatgcattttaaaatgtgcctcataggtataacacataaaacttacaaaacttctcctgaaatggtacctgtagtgatgttagcccacttcggaggttcataatcacttcagaatctccatctgttactcctctattgtgtttttccaatgaatcttcttcttttccttcattcgttgaaccactgatatcaccattttcagtgactgatgtctcaatagctgtaccacattgatgcatcatattttcatccaaacttaatgaattccacttctgtactagctctgctataaatttaagcagcgcgatgcaaaaaccttcctggtcacttatttcataatctggttggttgttgtaaactctcaagtacacattaccaacattcagttcttttgataaagcttggtatgtgaaacaatgtgattccgtcaaatcatatgaaccatcaggtccttggctagcacgctgctggtctacaaatttgaggagctcgcctctggtggaagaattccatatgatctgcaacaaggagagttattaagctaaacatcacatgcatacattcatctaatagtattatattattgttagataaaagtggtgttgcatacagaacttataattataatttctcattgtcacatacaataaaatagtactagattattgtgaaatattacctccgccccaaaatataaggagttttaaggttggacacagttattaagaaagttggtggaattgaatggaggaaggttgtgattggttgagaaaagaaggtaggtagagaatttgaatggtggaaagttgtgattggttgaaacgagaacgtaggtggagaagttatattttgggaaaatttttgaaagctagaagtagttatattttgggacagagggagtaactacattgagcagaaggagaagaacttatagttgccccatataaagcaaatattgatgaagcaacttataatcaagaacatgataaatattgatgaagcaaattgtatggataaatgaattagtcggtcttatgttcatttcacaaagagaaaaacaagagtgccatgcccagtcaggagtaatctgagaatgtgtattcaactatcatcgctacgatttttagcatgtcgaaaaaaaatccactctaatgataattccctaaattgagcttaacacgctcttgcatgtgtttgtctgcacataacaatcacagatgatgcaggttatggtgaggaacaaaatgcaaaaatttcaaagatatactaatgacaatgatcattggattgatggaacactccaggcatgtaatacaaatgaaatttaatctattacctctggtgactccaaatttgcattcagatttgacaacagttctttaggtgggtggtttctcagcatatcagcaagcttcggagtaagaagcgctcttagtgcatcaaaagcagattgattagatgggcttattccatcaccaccaagaccacaaagccttgacagagcctgagttgcatgtacagcatgcagatttttagcaatctgcacccttgcaccaacaccatgtgcttcacttgttgcattctcttctgctgttgaatcgtactgaagcaatagaggcaacacatacctgcgagtaaatcttaattagatatatcattcacataacttgggatttcagtatgccattccctaatctatctatccagattaataatagtaattgcaattaggatagcaaggcattaccataaaaatccagccgcgagcagagaactttgcaattctgatgacactgatatattagcagctgtttgcagtgcagcatccacagccgatggaacaaattcaagttctgtactgtgcacaatatcctcaacaaggccaccaaacttaagaatctcagcccttcctgactcaaactggctgagaaccgcaaatgtatgcattatgttggtgactattcttgctgccggttcatttgctggggttgtgggctgaacaatgcacatgcaacgagaaagaagtgttgccaacaatgggataccaccatcccgtatgagctcttcgccatttaatgaagatgatgcgcatctaacaaagcatgaagcacataatccagttgatattcaatcaaagtaaacattatcttaaaaaaacataggtaaagtcagtttgtcttcacttacgtcagccaaattagctctgaagcagctatcaaaagaggggctctctcagatgaaagaaaattgctatcatccttatctacagtgactgcatttagcaacattggataaccagcatacttgaatggttccaagacatgtccatatctcttgtacaagatgcactgtgccctgagtaagagtagcagcctccaaacttgtggtccctgcagtccctgcatacttgcctgcatgtagataatatatttagtgattacccagcagtgtaaaaccatatgttaaaagggtgcattgaaaagaaaaaaaaaacttaagggactctcctttttcacataaaaaccaagagttccaactgcattcatttgtagttaagcttagctaatcaataagataattcaactttaactaaaaaaatgagtatgtgaaagattgcaggatatcatccgaggaagaaatgagtatacctgcaatcgttcgtaagccttttgcacagcaacaaacttttctcttccctcaggattcttatctggatggtattttattgccagcttacggtattggcgcttaagcttctcttcgtcaatgttttcaatgttgtttgtcaaattgcccgaacttaactcagatgactgcttgctactgccgttctcaccaaggacaagatcatcaagagagatctccagtatcttacaagcatcttcttcagatagatccattggacgacgagttaactcttcacgccacattgccaacaatgactgcaaaaactctacatgttcaacaatgggccagttaggaaacctaatctcgtcacataggttccggaggtagtatcggtggcaccacatctcatctttcagattcgggtaggtcacaggtggcataggagcataatcatacaatgaatgacaatgttgagccaatttctgaggaaagtcaccgagatgctgcaggacctgagaaagccagtcgtatggacagaacaatttgaaaattagattaaaaactcatgatctcaaagtaaacattttaacaaataactagggtggtaaatacctgacgaattagatgctccgcccgcatcttgtgggtccatataatctctggcgtgtcagaatcagacaccattgcggcagcaaaagctgaaggtccactgcgttctaagacatacaacaatgattctgggagcagtccacctagtacactgcgctttgccaaaggcaatgatgaagatactgctgcctcttcaccaccatgaaatgcctgatgagtatgtgtggctgaaaagagttgtgcgatcgataggagatttgaaccgggatatgccaatgcaaagtaaaaggcaccggtactatatagtcgaatcatagctttggggtttcttgtgacaatagccttaagtaatgaggcagctgcttcaacaatgcttggttccccagtaagcatagcctataccatttcaaatttatcatttcctgtcagtgttcgataatagaagtagacaaaaataaaactatccaaaagcaagaaagaaataatatgaaagaatgaacagaacattgaggagttaaagcatgaaatttatacatgtaagaacagcttgtcgagaatataaccaagtctccttgggactattggttgtctggcagtgccaatgaactataatttattgtttgactgcaaatttgtaaattctgtaaattacaatatatatacacacactataggagactgtcctacagtaattttccaaaaaaaaaaaaaggagctataattttcagcactgttgtattaaggaaagatacttcatcagcatatcttaattgttgcattatgcttaacatccatgcttctaaccatagcctaagctatcagttgtaaattaagggtatgaaagctcttcttatacacatggccaaataataatatagctaggtcatcatacacaaactagtccccgcatgataggggaagcaaatttggaactaagtacctgagcaacatgaggaaggcatcttggacttgacaatatacgtttcaccctaggagttggtgtcactatctctcctgcatcatcaagatcagaatgtgcagatgccatactgtgtaatatagacaatgcagcatccccaatctgtaaatagaaatacattttgcataagtgttaattgatgagtaaaataaaattgtcgtgcatgtttgcatgtcggtttgataccaggctgtagattcaatacctgactaggagtaagaacaggcactttaacagcaagtgcccaacggagttcccggatatcacgtaatcttttccagtcagacataccagaagcccaacatttggtggtccaatcaattgacttctttgaccatagccttctgatagcatccttttctagagggccaacttgtttaccgtctttgtcaatatacatccactctttcagaggttccataaatgcagttgccgcgatcaggttagactgcaaaggaatagctgtccgctcagatgcttcatgagcgacagttaacatatcaacagccaaaacacatcctccaaccaaaacacacacttcaacatttgaaaggtcgttcatcaaggcctacaaaaacatgaagaaacttactcaggcagatttctcagaaaaaaagtatgttaggtcagcaaaatcatattagttttttatagtagtctgaagtcatgaacatgttctagagctatatcatcgcgtttatgaattctggacttctggtgtacgtgcagcaaagtccacatgaatagaacttgtcgacattcccatatctagtatacttatgcccatcttatttgctgatacaaaagaaaatgggagaagtgcaaagaggtaattcagctagagtacaaccaacctttaacagtagtagcaagcgatgtcttaatgccctatcatctgttctgtccaagagaacagtaatatgtgctgtgccatcgaaaggtccaataactttgttatgttgttcataaactatagccattgcccttgaacaaagttctcttacagaagaacctcctcccccaccaaaaccatccaatcttcccaagtcacaccaatcatcagatgaacccagttcatcagggactgcaccatccacagtaagaccaatgtctgcatcgcacaagaagcggtgatacagagctctaaaaaaggcaacaggatcacgcagtgggaaatcctgtgctcggtaattgcttccactttcaagaagaagccgcagatagtattggcccacacagacttctttggacaagctagggtagctaactgaaaactcaacataattccatgaaattcgtggtaaggtttcactatcactggcatcctcagtgactgaacttccagggacaatgtcatcagttcgttctttctcaacatcaaggctatgaacttcagcttgcaatgcctcccttaattcttgtctagtgcgttcattccatatcaagtctgctctattgtgatcaagactgaatgctctccaaaatccataccagttgcacagtagcctgccagatccaacaggtgtgttttccaccacaacctgtgcagggactgaaaaatctaaatgtgcagagttagcaaggtcaccattgccattggagtccactaaataagcatgtgaatccagctgtggtgccccagtttgatgattattttcatagaaggcctcaggtacaaaaccatgtggaactgcctgagaaggatcaatacttatgcctggagaaggggtatatgcagtagggtactgattagcatgcctctgatggacatctgctccaaagggaccaacattggtgtgcccaaaaaaatccccttcattgttatttgagggcatcccttgttctggtacagccatactcttgccaccacgggacctcctctgctgaagtatccgtttctgccttctgcttaatggtacttcatcatactggttctgagaatcttcatctgatcgtgtgtgaagataagcaacaagtccagggggaagtattcttgacagcaaatccagtgcaggttgataagaatcagcccagagagcaacaagctgtcgactaacatcacgtcgctcaccagcagggtagaagaaagcattcagtaaatgcctcagaagagcaccatccttcaaggcagcatcacgcatggactctgctgctattgcatcttcttcagcaattgtacgcataataacagaaacagtctccctcacactttcagcaggatgggcaaataatgcaaacaaacgacggcgcaaaccagcgacttgacgtagtagctcaacaaatgtagcatgttgggttgtttcaccatggggttcacaaagcatagcttcaaggacttccacaatggacaatgacagtaatggtgaaactgatagtggccttaatctgttaacaaggattggaacatagactggttgtgagaacagtacagactttgcatgcatgtaagtagcatgtgactctccccttgtatccgttaacatggatgtatcaccaggaccaccaccaattagcatagccacaagtccagcagcctcagctgctactccctctgaaccatttctaagcaaacccattattctccctacagccacaggaaatgccatcacgtgtgctgacacacttcttgatgtgaggagcctccgtaagcatgcgacaaatcccattattgtcgctgctgcttttggtgatggaggtggaagaggaggagcatcagcaggaaggttctgcggtgtagctgggagaagactaattagagccattaggaccacttcaggtacttcaatattgacgggcactccagtatagggtatgcatgcattgaactcccttattctacgccacaatctgatttttgctccaggaacagtgtcggatgaaactacagcctctttagcaacagtagctaaatgttttatgtgcatgctagcagcttccatatcaacagtgtgatgggatatgtgaacacgggctactccacagggtggatctatgcgatgaccaggcatggtcaaccttggtagcactggaatggcacactggctctgagtaaggagattaaaaaagaatgtgaggtgccaatgtgagcatggtaatggtagcaaacaaatgcaagatgagcatggcctaataagtaagcaaggtgaatattttgctatcaagaagtcattatggtcgcagtcttcagagcagctttgctcaagtacaattctgagtcagtatacaatcccctaaaagaaactaagaaacagttatacaattacatattacatataggaaatagcaggattaaataagcactcattacaaaggggacatatatggtgtttatctcattacactgttcagtaaatttctggctttgacaaattagatgtgtcatgtaaattgtactcttacatacaacttctgaggtgtaactgaaattgtcgaacagaaactatgacttaaatgctgaccggaatatgtgccttcatcttctattttttaaaaaagtgcatcactaaatccatggtgaagtacaaataagacagtcatgctcgccacacaccataaatttgagcattaaaatacatcaaggtggacctcagtcattttgtatctttgcaattccatattgaactcaagtgatataaactgactaagatcgaagtcatacctggttttgtaaaacatcaagaactgttgcaagtaaactatcacgggatgtacttgcatatacctgagtgaggaaacagccaagaattaggaggcattcgtggtattgtgcatagagactatgcatgcatacttacatgaatcgggcaaccatcattgaattcgaatgcaaacatctgcggttcttctgcaaatcgcacaagggcacttactgttgagagaggtcgaacaatgatagcctgaaaagaaaatattcagagcaaagaagttagaaccctaacatgctaaagataaagggagcaaggaaggagaagcggtcttgcaaaagaaactccagaggagacaaccatgtagagggtgcaacaaaagacttacccatggcccatgggcctcatcccttgaaactacaattactagtaagttgatttggcaaggggtgtagaaagttgatgcatgttcatatgtaatcgaaattttacgaatagtttgtatgagaacaggtgaaaagaagccaacatctacctcataattctccggtcgtctttcgacaagtgaagtgtttgtaagaacaagctgtcgagaaacggaatcaccatgatctccaagtcccccccttggtccaatacccaagctcaagctctcaatgctagcagtgccatgtgcagcaggacgcaatcttgttactgaccattctccatgccgagtttcagcagctccaacagcctcgtttgctgggaaaagaagttacaccagtttaagtttctgctccctttagcgcaatagatacgggattatggagctcatacatgacatatacatggaattcattgacagttgaaggtgacatttcatactgagtcagttcgtaatgatttggaaccataaccccagttaaggtgttgcctagcatcaaaatcatatgaatggcaaggtgccatacgaagatgatgcacgacagtcacataaataggtgtagaaaaatggtagcaccaaggtgaagcttatcgttgcaagagattcaaagcctacctctctttgctatgaagtcagtagctgtcattgactgtgaattgtccacatgtagtgatactccaaccatcgagttggctgtttttgtctgtaagataaccggcattaggatgttacatcaatatgtgtaatctgcatatcatgtagaaaggaatggaacgattggacaatgggatgacagaagggtgtaccaaatatgatataatcagagtgtttgtactgcctgaagcagccataaatgctttggacttcctcccataaagggggcatagcacaaaacctcctccttcagcagtcctcttcccatagctatcccccaagagaatgatagcaggagaatccatatctctaaagtccaagcaccagcgcagatcaccagaatgtccttcaaggagctcaatgcccactgaagtaaccttgagtttctatagagagtagatcaaaaccaggaaccaagaatcagaaaccaacaactggtgattaaacaacagtatattcctttgaaacagctttgagtgagtacatttcattggagatatgctgaaagtagctatctcatctaactatgcatcaagttaataaattgttggctgcagatttcaaatatttctagttttctaccagctagttatagaactcagttttaattaataggtgttgcagcacctgattccgaaaaaaaaggtgccatagataagactataacaaaccaggaaaggaagattattgtaaaggcacattgctttgtttctaatagtagtccaattggtagcatgttaaccaaatttggtgctgtgacagtatacagcgatttgtaacacaaggacatatcataagcaaccaatttgggcataagcttaaggcttcagttcagagcgatgaaaccgctctgtttgccattccactttgtttcactaattagccagttcagctacatgaggtagcctttaattataataaatatgaggataatgcagttaatagcactgctgtggatccgaaaactagagagaggattgggctctctgaagcatgaatcattcagcgcagagtgtgatgcagaaatatttgtaagggattgaaccttgcattgcaatagtagtgcaaataatacacaagacagcagaggtgagagtacgaaggaagatcagatttgggataagacgatggaggagagcttacgaagggcgcccactcgtgggtgcggcggcggaggtggaggacggggaagtcgaggacggggtggacggggcgcaggcggtggagctcggtgaggatcccggcacggagcggcgaggagaagcgcagggccttgaacttgccgcgggcgtcggtgcggagggtgagcgtgaactcggtggcgttgccctcgggcgcggcgcggtcgaagccgtaggaggcgtcgtaggagttggtgacggcgagggtggccgggtcgagggtgacgaggccggaggaggcgatgcagaggatccgcctgtacctgcccctccacgagtgcttgacgacgaagtacctggcgaggtactcgggctcctcggcggcggcggaggaggaggaggaggcagaggaggcgcggggcgaggaaggggaagacgcgtcgggcgccggcggcggggcggaggcggcgtggcggctggcgaagtccatggtggagaagtctatgcggcggcgagcattagggttccaccagtggaaggggaagaaggctccgggcggcgggggctgcgccggggagtggcgcgagtgattcgcccccagcgcggccgatctgagcgacgagatcccccacccgatcctggccggcgatcgcccgttgggtgggtcggtcggtgcccccgctctccggcggcggcggcggagagattatcctcttctcggctttgatcgatcggattgattgcgttttcctcctcttcttcttcgtgcgatctcgtctcgtctcgtctcaggtagaaatcctttctttgttttttttttaatttaacaaaaacacatgcgccggcttggctaatgcccttctccttcgtgttggtgtcgtgtcgtgtcgtagccaggaaggaaggagaaa

SEQ ID NO: 39177 - DNA, 26860 bp, Oryza sativa
  unsure (1)..(26860): unsure at all n locations
ccgaggaaataaaaatttttgagtatcacatcggacgtttcatcggatgttggaagaggttttcggatacaaatgaaaaaactaattttagaactcgcggggaaaccgcgagacgaatcttttgagcctaattaagccgtcattagtacatgtaggttactgtagcatttatggctaatcacggactaattaggctcaaaagattcgtctcgcgatttccaccataactatgtaattagtttttttttatctatatttaatactccatgtaagtgtctaaagattcgatgtaatatttttggaaaaaaaaattttggaaactaaacaggccctttgtctaggagagacaaaaccttattcctctcctattcactcaaacttatgaacaatgtactctcctaatgtaattttgataaatactctagatctataaacttatttattgtagatggtatatttgataaaatttattctaatataaagctggtgatggtcgaggttttaccctttcatgagttgttcgtcgttttatcagtcgtataaaaaagatttttgaaacttacttttaaattgatctagatatttccccctaaaaaaattgatctatatattatttcattgttttcttcttcttttttccatccttgcatgttaaaccactaagagtaggtgaaagtttgcttaactgttcaatcaatccataatttaagggtttgaccaaatttcgttctaaatgtcaaatatttatgatgagagggagtttttggatcataaatatttggcatttatgttgtcttttaaatatggtgtttactattcgtcttattcaaatatgtaaaagtacaaggcacaccaaaagtatctttagtaataaacaagcggcaaaaaaaaaaggtactacctcaagaattatatggagtatgttcagattcgcagtacttccatccgattctacgttcttatttgacagatgtagtaattataatatggatggttaaatttatgcctaaagtcaaccatcaaagggtgtacatggagcattatgttggttcatcgcgttaaccaaggagtacatatggaaatttgggcaaaccaaaaggtactccctccgtttcagagtccctttgaaacacatgattgtcaaaagacgggaataggaaaaatatagaaatagattgtcatgttcattggattcctacagtagttgaaaacatagcaaagtttcaaaactatcgtttgatagtcacacatgaaaaaggtaggatttcaagacacaggaagaagaaaaaaacatgagctaagacatcatgctaattttcttccaaaaattctctacaatagtccattatgtacgaatttcaaaggaattggcaggaatcaatcctttgtttcaaaggatctcatatgattatttcctacaaggtatacatccttttgaattcctatcttttttcctttgtttcaaacggggtctcatattgtaagttattttgatttttttctaagttaaacttatttaagtttgaccaaatttatagaaaaatatagtagcaattttagtaaaaaaaacaaacatattataaaaatatattcaatgttagatttaatgaaattaatttggttttttagatgttgctaattctttttataaatttagttaactgcgaaaaaaggtcaaaacgacttatgatatgaaacggagccatatcatgttcacttcaaaaaacagcaatataatagagatagaagaaaggtgcttgtcgatggagggtccgtgcagaagcgcaaatatctgtcctctatgatttgctcatgtgtcgatgatgaaattcaggatgtgtcaacatttgtctcatgcatagcatgctctgcatccactgcattcagggttccagcctttcattatcagagatactacttccttatgaacctgtatctgaactttttgcgagatactatactactattaagatgacaaactgatctgatcggaataacatgggcacgacagctacagtatacataccattacagagtctttacgccacttgttcaaggaaaccttttcaaagtcaaaacagaaaagaaaaataaaaggtgaaatccttcttcgatcaccctgtttggaacttaaagggttgaaattttggatgcagcatttcacgtccagacgaatacggcccagcgtttcagaattcagagggttagttttctgcagcatatttaatttacctcagatattcaattgatgaaacaacatgaatcatgcatgtcaacacctgctgaccgctgagaacaaaaacaataacaataatgtattcgcactctaacacataagttattcctccatcttaattatttattttacagtgtggaaaacacatctatctcgtggccggcctcagcctggcactaacatactatttataagttgttggtaaatcctcctcctgacgaagaagaactaatactaatgtagtaataaccgagaagaagcaaaaaagatgcatggaaccttggatgcatggttccgattatttgcgtgaatgcgcaggcattgatcatccgatctgggttgggtccttcctaataactcaatggtacaatcatgccgcatgcatgcgtacgtggatattggcgattaatgatccgggaacggtacatccggggcggagaagacggtggcggtggcggtggcggccggcgacgacatcaccggcacgaacggggcggcgtacgcgcagagagccggcggcaggtcggaggctggtgcacgcgcgagcagtgggatctccggcggaatgaagtggtgcgtcgttggcagtggcggcgcggcggatcgacaacgacgtaggagtgggagtgggacgacggcggtggcggcgcgtgtgcgtggtggtgggaggtgttggtgcagctgtcggcgctggaggaggaggaggaggagtcgtggtgcgagtgcgaggccgcggtgcgggcgctgtcgagtccggtgagcctctgcacgatggacatgaagtcgcgtgggctcgtgcggatcaccttcggcgagtgcgtgtatataatcactggctgctgctgctgctgcttgtgttgctggcgcgacggcggccggtgagctgcggcggcggtggcggcattgttcttgttcttcgtcgtcgtcgtcagaccggaggcggaggaggtggaagagttggaggaggaggaggacgatgcggcggcgggtggctgcttgtggatgaggcgggagcccctgtggactttaaacggcggcgcggtgttggtggcggggaggggcaggcgtggcgaggtggggctcattgttgccggtgagcggccggcggtgagacgatcgacggatggaggcgccgaaggagaggggctatacgactataaacaggtgagtgaattgcgggatatttggttgggtcaaggtgcggtgcagagccataagcggcatgcgtgtagctcggacggacacctttgcttctcttctcctctcttggttgcgtcaccacggttgcgctagctcttgcatctgtgttgccatgtccaccagccacctgcaaaatgctactaatcgttttcggccccgtgggttttgcctaaacttttcattttgtacgtctaaagtatgtcgtataaactttatatgcgtaaacgaatcagtgtcctccaccttgacaaatcatggagcaaaatacaagcgaccagcaactatatacttagaaacggactcgtatagagttttggcccaacataattttatatggtgaaattttaaggttctccacaggtcttccatcctgggccccagggcgtggcctaggggtggaattttgaagtgctccaaatagtacatcgatacatcatatatagatggtgggaagattttaaaagtgacaatgaagtgtcaacagttttgtgttgggcatggcaccaagtttgagaatgcaaactattctaccgaatattgagaatgcgctatcattgaatggcatctccctgagacccaggtactgaatcgattgccttttgatggtgggagggtaaaattgtactcttgcatgtatggagcatgtacaaatgtagcgcccgttccgtcgtggcgcctagcgggaaaattatctcttaaaaaccctaattgtgaaatttgcttccttgcttgttgtctagcgtccgtgccatctcaagatctcaaatccctgatctatcgtcgagttcaattccgaatccaaatccttccaaatcgaatccctccgcaaaagtctattttgcctccccagggtcgatgggctgaatttctctcggcccatctccccctccctcccggcgctctctctctctctcttcccccgctccgcccgcgcgccgcgcgcgcgtgcgcgagagccgcgcccagcgcccctccctccgctccgcccgcgcgccgcgcgcgcatgcgcgagagctgtgccgtccgcgccgcccggccccgctgccctgccgcgcctgcagccgcgcagccgcccggccccgcaagccagcgcgcgtgcccgagccgcgccgctcaaatccgccgcgcctcccgttgcttcccgcgcgcgcgtgccgtggtggccgaccgcctggtcgccgccgtcgtcagcgcctgcccgcgcctgtcgcccgtgtcgccgctccgctccaaaccgtcccgccgtcatcaccgtcgtcatcgcctcggccccgcctctccgcgcgcaagccgccaagggacggaggcagagccctcctccctctgccgcgacgcccccgctcccctcctccttttcccaaagaagcaaggggcgagcccccctttctctccctctttttccccttttcctcccgccggcgtcatcctcctccctccgccctgtcgccgatttggacgcgagcgccgagcgccagctcgcgtcttgaccgcccaaagtcggttcccaaaccgacattgccgccctttaaagcccaggcgccctccctctcttctcctctcgttgtctcatcgcctccacgccattgccgccgcccccgtgctctgttcgccgtcgccgttcgtcgttgcgcgtgtcggaggagccggcacgagcaaggacgcggaaggggactccgggcgcgccctctccttcctcttccccggcccgaggccggagagattactcccgcgccgtcggcctctcgtcactgcgccccgcccgcacggtagtgcctccctccgttcttcctcctcgctccatctcccccccttagttttcggtggtagcacgagtagcctccccgtagctagccggcgccgccccgaccgttgccgccgctcgccgtgtgctcgccgccgtcgccgcccgagctcggaagcgccgctcgtcgccggcctcgctcggcgtagctccgcccaatccgacgccagcatcggattcccgtagccgcgtggatgctctcgccgccgggaattggcccctcgtgacctcgtcgccgttttccccttttcccgccgtcggttgccgccgccgcgattcgccgccgtcaagctccctccggcgaatccgagccattggctcgtctcccctcgtcccgtgcaaccacccggtgtgctcgttttcgcctgtatcgccgcggttcgctccgccgctcgccgctcgccgctgtcgtccgccgtccgttccggccggcgtcgtcgtctacctcccgccggcctgcgtggcagccacgtaggcgccacgtcggcgccagctcggccaagaccgggtcgagccgaccccggtcagccgctcccctcggccccgctcgcgggcgcggtccaccgcgagccgtgaggctgcgcgtgggcccgccgcatccgcgtcctccgcgaaccgcgcgcgtgcaccgcgtccctcccccaaaccctagcgcgcgccgcgtgcgcgttccgcacggtgaaccgtgtcaccgacaagcgggtcccactcaggaccacgcgaggtgagcccggtccaccggctccctctctcctccccgcccgcgcgcgcgctctgggccgccttgttgggccgaccgacccatttagctcggccgagccgccccttttctctcgggccgcgccctagcctcccgagggaagtctaattttccccctccttttcttttcttttctttttcaaaaaaaggatttaagtaaatccttttcctttagaccaaaaatccaataatcttagaaattcaatatcttcccaaccgtaagtccatttgactccattcaacttccaaaattcctcaaatctcgagatctatttaatggcacgcttagaggtcattaatagggctttattttcgccgtttgttgagttgtcccgttttgcgtatagtttcggagcccgaagacccgcagtgcgaggatttcgaggatcaagctctagatctcgagcaaggcaagccacctttgaatatcttgagcctatatttcaacttaattatgttgcttgaaagattattatgcattgataggatcgcacttaatctgcttgtcccgtctgcaaggcagattgacggacctacctaatttgttgcatttgatccttcctttgttaattgttataccatgttcccttgtaaccacccagttgcgcctcggaaatcatgcactctgcacgagtatcgacggccgccttcaaacttaaaatctgaaaaacatcttgggtaaaacttgggttttataaaagacttggaaaacccgacacctgggtcggtgcttgcgaactaaatgaatttccaaaaccgcggaccggggaacgtaccgggtgtacggtttcccgctcttgcacctaaggaccgtttccttggaatttcatccgaacataagacaagtacgaccacatgggtggaatgggacacccctggctgagtaactagcttatcaggggagccttgatgccgagagacatgtgaattcatcggggtggtgtcggggaggacccctgggcttcctggcacagtatggtctgggacctaacctgttgttggtctgggacccctctcgtcggcatatggtaaacctgtgtcggctttggaaatgccttatcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcgaatgtgaggtgattcctagcgtagttttgtttaactgctgcttgtgaaattgctgttgtggaaaggggttcgatgtttgaaaaatctgtagctgatggaatcagctaggcccgggtggccgtttgaatgttgttggcccgggtggccgtttgaaaagctgttggccgggtgccaacctcgtttcaaaatctaaagactgatacattgcacatactccgaccggacgagacgcactgtctcatccgtgtcgtttgagaagcactcacttagttgtttcagaaaagagttcaaataaaatcaattgcaaaaacaccagcctctccttgaagcctgcattaaacacttatttcccctggcttgctgagtactcccgtacttacccttgctctatataaataatcccccccagttgctgaagaagatgaagcggatcccgctgacgaggagttcttccaggagcaagccggctacgatgagttttagggtttcgccctagttcccaagtcgcgcctgtgatgtttggtcctagtcctggcttccgctttccttttgtaatgcagttgtgagctcgggatctatccgcagcccaacatgactgtactcctactctataataaagagacctctgttgctgtgatattctgtcttcctgtgataccatcactgtttcctgggactggtatcgattaacaggttaatttggagcgtcacgggctagttccggtcgggactagttcggggcgtgacaacaaattagagtggaacacctttcatccaccgtaattaccgccgcaaatcgagcgatcctagacctagaagtggcaatgacgacgaacctagcgtggcgaccttggtagaggtgtgtcgatgcgtgaagccagctcaactactgcccgattctagtacaacagaggtagtggccgtgacggcaatggagatctctctgatggtgaaggcagcggaccgttgttggcgccttgaatctcccatcctccgttgcctgcctcaatgtccttccccggtggtgcctcaattacttatcctttggtgctctctccatcctcctgcagccatcctgttggctcaatgatctcccaccttcatcccgggctctagtacaacgtcgtctccatcccttcccgaggtcactcctcgatctcgggtaattctctaatgttagcaatatcactgaaattttccaaaactcagctattgagttgatggttggcttgcttagcaaagatatactcgattcctcctcacttcttttcttttccctcttttctttggtttcttgtcctcaccaaatgattggaatgctatccatgccaaacctgcaacttcatccatggcagaccttgatcttcaaccaaaacaactttcatgtcggccatggcatctagacttagcgtgtgcgcgagcgccgacttaacttgttggactgtgatggcctagcatcgatgacaaagatgcagaaaggcagcgccaccaattttggtggatggagttgtgccctgtactcggtactcttcgacccgtaatcaaatttgttccgatcctaccccctatcaaatcaacagttatatatgaatgatacctcctaatatctcgtacctgaagtaatacgtacagtcaatgcttaagttaataactgtcacatcctgattttcgtttcaggatttataaattatctaataaattattaatagaatttatattaaatgttctttaatttacaagtgaagttaaatgtgggaaataaaatttcctaaatataaagcatggttggatttaatttttattaaattctccatgattaattatactctctgaaattttctcggatttttcggagctcaattcctaaatgatacaaagaacagtttagtaattagtaatcaattaatgatctaattataattatgttaagtgcttttcttgtttaaaaatccttaatttataaattgttgtctaaaagggaattattagaaatgatcttaaaagcctagaagagaagatctaatattaatttgttaaaatctcaatataaaagtgggctagataaaattttgttaaatacttctcttgtttctatagtttctagatttttctgggatttatttgagccaaggatttattcgcgccgccgcagccgtgccctagccgcgcgcaagccaccgcccttccaaattccgtcgctcctttccatctccggccgaatcgatagaggggaaatgatcctcgtgatccactctatcttttcccttttggaatcgtcggctaatttcgtttggaaatccttggattcgagttcgattcggatcgatctctctcctccgaaccctaatctttccttctcgtcgccggtcgccgtgggccttcgccaccaccttccaacccctatataaggacccccaagcccgccgctacccgttgccaccctcgccttagtctctcgcagccggtagagctctagcgccgtgccgcctcgcgccgccgtcgtcgccgccgctccaaccgtgcgccgccgtcgctccagtcgtggtcgtcgctcggggaggtcaccgccgtggtcgccgttgtgtcgctgtcctcgtccgccctccgccgtcgctgtcgaccgccggaacaccgccgtcgtcgtcaagccgatcgtcgccgccgctcttcctcgatgccgtcgccgtccgttgatcttccgccgttgttttggtcaccggtgagttcgccgcgtcgccctctacgtgctggtgccctccgttcgtgccgtcgcgccgtcgttcgccggcgagcttgcacgctcgagccgccgccggtggtaacgtcaccgctgacgtcatcgtcgtcgtccatccatgagccgcggtggatccgatcgatcttggccgtccgttttggataggatcgatctcggccgttcgtttccgtgagccgccgccgtgcacccggttcaccgtgaaccctagccgctgacgcaataatcctcttttccttttcaaaaataattcattattgcgtcataattcaataaaaatccatataagtgttttaatccgatttaatctttaaaaattcataactaattcatcttagctcggatttagttggttcaagtctctaaatttttctaaaattgagatctacatgttaaaaatatccacatatactgttcatgcttgtttatgtgctgttttggtgttttgctcctttctgtttagattccgacgtttccggagagttcgttttcgcaggagaagaatttgaagagttccaaggccagcaaggcaagtcacacagatcccaaacaaccctttgagcatgttgatcccgtttaaagctattgtttctattcaactattgcatttattttcgaatatcattgggtggaattaacctattgtttgttatagcccttttgttcttgattactttattccttgataccttgggttattataacttgactagttgggctatatatattggttcagctagatattagatatggctgcttagccatgcttagaaacattagcacactattgggataacttatgactcactattatttaatgatggcttaatgatagctcacgatggccaatcgtgattggttaattaattacttgccaactaaaacttgataatggtgggttgtgagcacatggttttgagagtcgtgctcatgacaattaaggaccggttcacgattttcggttgtgaaacattaaccgtgccaaccacaagccagcgtgggcaacggctttaccttttgtatagcatggttcattatggagcaccagactgagaagtggcggagataagcccacgggggtcgctggggagtccatgccttgtttataagggggtgactatgatccaggaacggtgcactgtggtggattgtgttgtgcgaggggtaatgtcacagctcctttccgaggtaccgtggtggtattgaggcgcatggtgacatgttgtggggctgtgtcttgtgggtacagtggtacacctctggccagagtaaaactattcgaatagccgtgcccgcggtcataggcgggtctaacaatgtctttcgtgattagtctcacacttctcaccataataaatgatgatataattggtaataatttgtttagctcctggtttggagatagatctgtgcagccgggtatggttgttcaggatggttgggcctgtgcagcatgggtgtgctgttcaatattgattaatattgatgattaattactctattgttttataattctcaaatgtttgctaaatgctgcttttgcaaatgagccctatattataccatcctttggtatccatgtgcacttgcatatttgctgtgtggcttgctaagtatgtcatatgctcaccttgcaataatcaatcaaacctcagttgaagacaagttgcgaaggagaagacgtttggcttataccccagttgagctgcctgtgggagtggagccggagcttcgctagaccgtaattccgctgctgttttcttttcttttttaagtatgtaacgttattattatgatggatttgtatattaaattgtcagtttgtgtacctcggctgattcctggacgaggattttatgcacaaataagttcggaaattactagtgaatttctgggcgtgacaataactaacccacatttttagtacctctttacatgtatcttctcttatggatcgttagattctaagtaatctacggctatcatgcctctcaagcaccttacaaaactggcacattattttgattaattcatccattttgaccaagaagatgtagaagaagattcatcatcacattagcttccgtcgtaactagatcatgaacgctaaaaattagatcatgaacgctaggcatgtcggtaacttcagacaaataactggttcttttttctgcctgcgaaatgcaaataaaaactcattgattcagagaaaagttgtttaactcactgctcctatctgatttttttttaccacaaaagaagcagtcggtcatacatataaattttcatataaacgaagcaattaaaagattactctttgacactacagggttgttcagattgatgtcattttaaatcataccttttttttttggtaaagttgctaaagatgtgtatacacgtagggtaaaagaaacactatcctgaggttttcttcagttcagaactgtgtgagtaacaacaattgtcggttcagaacttctcggggacacttactgaagtgtagtggtagtgtacagacacattaacattcatcttcaaactacaggatgagtccatagttccacactagtatataagcatttcgttacattgttgttctgaactctgaagagaggtatgttcggaaatactggggaacactttggccgagtttagttccaaacttttttttttaaactttcaacttttccatcatattaaaactttcctacatacacaaacttctaatttttccgtcacatcgttccaattttaaccaaactttcaattttggtgtgaactaaacaacccctttactgtacagatacattctatacatctttggtcaatatagtatgggccaatagtttcatactgctacatggacatttcattccatagcagttctgaagatatttcttttatgttcagaactacccgggagcatttgatgtactgaagatattcctttatgtacagagctacatatacagtccattacattatcgccgtatttagtttcgaaatatttcttcaaacttacaactttttcatcacatcaaaactttcctacatacataaactttcaacttttctgtcacatcgttccaatttcaactaaacttctaactttgacgtgaactaaacacagcctatatagcctatatagctctttctgaatatagtagtacgacacgctttcaaaataaaagaatatagtggtacgactttgagtaaagagctttatacattatatatcccatgctgtgatcttcactcatatagtagtactgtgttatccatgtcaatattgtcacttagacatatggccgtgtttagttcacccacaactaccttaaacttccaactttcccatcacatcacatcacatctaaaaattttctacacacataaacttccaacttttttttccaaatttccaactttcccatcacatcacatccaaaactttcctacacacataaacttccaactttttttttccaaacttccaactttccccaaacttccaacttttttcaggaactaaacacagcctatatagttaggccccgtttagttccccaaaagtttttcccaaaaacatcatatcgaatttttgacacatgtatggagtattaaatatagattaaaagaaaaactaattgcacagttaggggggaaaccacgagacaaattttttgaacgtaattagtccatgattagccataagtgctacagtaacctacatgcgctaatgacggattaattaggctcaaaatattcctttcgcggtttccaggcgagttatgaaattagttttttcattcgtgtccgaaaatccctttcgacatccggtcaaacatctgatgtgacacccaaaaaatttcatttcgtgaatgtggagattatggataccccatatctgcatgacagttatactttagtcggatatatggtaccaaatatagatagaatatctttatgaggactcggggtaggttctcaacttgtatgtcaagaaaatacccgggatcctagtcggctacgattgtattttatctgtaatcccatattccgttaggatatggactataccttgtattacggatcccttcccctatataaggagggtccgtgtgcttcttggggcaagattcttttttctcccaacatacaatcaataacacactcggtggaatcatccccggacagaagtagggtattacttctttaataagaaggcctgaacctgtataaaattccttgtctccaaacctatccattttcctagcttgatagccacccccttttattattgccgaaatcttgtttcgacagttggcgcgccaggtaggggaggcgtcaagttctcgccgactaagtacgatgggtttcgtttctggcatcaacgacttcgccttccctcccgggcaggcgttctgattcggcagcctcgacttcatcaccaacgacttcggcaagatctctttccttgactcggattcaaaccagtcggggagaaaccaggtccccgtgccgttcggtattccgaactcggccgaggcctactccaagatcatctctcctgagtcggtttcaagccactcggatgagatccaatctattcctccacgatcagatcaagacgacgggtcctatccctcaatctagatgaaacttcctgatgacttggccgccgtcttcacagccaaaacatctcccactcggagatctaggtgagctccggcatcggccccgatccagtctagatccagggaggttggcattatactccaacctcttgggacagtcttgacggaagagttggatggctacctcagctcccccggcgtcagttctcgaccaaccgagatcctcgacaatgatgacttcggctaccactacgaccacggcgacttcggcaacttcaacgacagctatgaggataactacacgcccctcttcttcggcgtattcatggctaacaacgaaacggaagaacagcgccgagcctgagaagcggaccaagatcgcgcacggcaagaagctgaacgtcgccgactggaggaagagcgacagcaacaggagcgagaacgattacagcgtgagcaacaagatcgcgaacggattgcaaaggaagctgaagatcgacggcaccgcgccttggaatctgggcgccgagcgagagagctcattgggcaacaagacgtcgacgggagagcggtctttcgcaccccccagcagaacgcggttgcagcaatcactctcctcgacaccctcctcaaggaagacgcactcaaccaagccgatcatgttgtcaacatcttgaaccagacgaagaccatgatcgctacgtcagttccagccaactccgcaagcacccgcaccccgactggtagccgagtccctcatcatcagccaagcctcagtgtcaccggcacaggatctagtcgcaggagcaggggtcacgacgaacgatctgttcactcgcttcccgaacgtcacagggagcgccgagttgaacggcctcgttctccacctcgccagcgtcccgtcgaccttcgtgacacgatcaaccagcgccgtgcagcacgaggtcaccggcattcaccaaatcgctacgacgacgacgtggatggagtagctgccttcactaatgacctgcgtcgagtggattggccagtcggcttcaaaccaactggaatcgagaagtatgatggcaccaccaatccggagtcttggctcaccgtctacggactcgcaatccgcgcagcaggtggagacagcaaggccatggcaaactatctacctgtggccctagcggacttcgcccgatcctggctccacggactaccccgtggcacgatcggatcatgggcggaacttcatgatcacttcatcgccaacttctagggcacctttgaacgccccggcacacagtttgacctctacaacgtcgttcagaagtctggagaatcccttcgagattacatccgacgcttctccgaacaacgcaacaagatctccgacatcaccgacgacgtcatcattgccgccttcactaaaggcattcgccacgaggacctagtcggcaagttcggacgtaaacctcccaggacggttaagcagatgttcgaaaaagccaacgagtataccaaagccgaagatgctatcaccgcgtccaaacagtcgggcaccacttggaagccaaagaacgacacgccgactgcaggggggagtggaagtaacaaccacaaggatcgcaagcgtaagcccgaagaacttgtggcgaccacctctccatcttcccgacaacgtccccgcgtcaacaccttcgacaagataatgaactctcaatgtccgcatcatcccaattccaaccacatggccaaagattgcttcgtctacaaacagttcgcagagcaatacgtcaagaacgcacgcaaacctgcagacggagatcagggcacatcaaagaagaaagatgatgaagacgatgccccgactggttttcaagatcatcgcaaagaacttaatcacatcttcggcggacccctggcttatgagtccaagagaaagcagaagctaacagaatgggagatcaatgcggttcagcctaacacgccccaatatcttcggtggtcaaaaacagcaattaagttcgaccgctcggatcatcccgaccgagtggtccacccggggcggtaccccctggtactagacccagtggttcgcaatgtcaagctccgacggactctcatcgatggtggcagcgcactcaacatccttttcgctaagaccctggacgatatgcagattcctcgcacggaattaaagccgagtaatgcacccttccacggtgttatcccaggattgtcagctacaccactcggccagatcactcttccagttaccttcggcacccgggaaaattttcgcacagaaaatgtttgtttcgaagttgccgatttcgagacagcatatcatgctatacttgtgtcacgcccggaaattcactaataatttccgaactaatttgtgcataaaattctcatccaggaatcagccgaggtacacaaactgacaatttaatatacacatccatcataataataacgttacatacttacaaaagaaaagaaaaacagcagcggaataacggtctagcgatggcttcagctccacttccacaggcagctcaactagggtataagccaaacgtcttctccttctggatcctttttcttcaactgaggttgattgattattgcaagaatgagcatatgacatactcaacaagccacacagcaaatatgcaaatgcacaaggataccaaaggatggcacattatagtctcatttgcgaaagcagcatttagcaaagagttaagagtagtaaaacagtagagtaattaattagaaattttaatcaacactgaacagcacacccatgccgtacaggcccaaccatcttgaacaaccatacccagctgtacagatctaactccaaaccaggagctaaacaaattattaccagttatagcatcaataattattgtgagaggtgtgagactaatcacgaaaaacattgctcaacccgcccataaccgcgggcacggctattcgaatagttttactctagccagaggtgtaccactgtacccacaagacacagcctcaacatcatgtctaccatgtgtcgcgatactggaaagtacccgaatagaggctgtgacaataccctctgcacaacacaactcaccacagtgcaccattcctggatcataatcacccccttataaaacaaggcatggactccccagcgacccccgtgggcttatctccgccacttctcagtctggtgctctgcaatgaaccatgctatacaaaaggtaaagccgttgcccacgctggcttgtggttgacacggttaatgtttcacaacagtagctcgcgaaccggtccttaattgccatgagcacgaccatcaaagccatgtgctcacaacccaccatcatcatgttttagttggcaaattaattaattaaccaatcatgattaaccatcatgagctatcattaagccatcattaaataatagtgagtcataagttatcccaatagtgtgctaatgtttctaagcatggctaagcaatcatatctaatatctagctgaaccaatatataaagcccaactagtcaagttataataacccaaggtatcaaggaataaagtaatcaagaacaaaagggctataacaaacaataggttaattccacccaatgacattcgaaaataaatgcaatagttgaatagaaacaatagctttaaatgggatcaatatgctcaaagggttgtttgggatctgtgtgacttgccttgcaataatcggtcttcaattaatcttctgaacactcccgacgcactcacgaaccttcgaaacgacggaaacgacaagctaacacgcaaaacgaggaaaaagactaataaaaaccaaataaacaatacatataaagtaaacaaacatgtaaatcataattttagatgaattatgagacttgaacggcctcattctgacttcatatgaatttattacgaattttacaagatttaatctaattaaagcccatttaaaaagaattaaataaatttaattctatttatggataattttaatatgtagatctttattttatataacttttgcaacttgaaccacattaaactgagttacaatgaattagttatgaattttcaaagattaaatcggattaaatcctttatatagattttaattgaattatgacgcaataatgaattatttttgaaaaggaaaagaggattattgcgtcagcgggtcgggttcatggtggaccgggtgcacggcggcggctcacggaaacgaacggccgagatctatcggtccacggccggaccacgggagacgacgacgatgacgtcagcggtgacgtcatcaccggcgacgactcgggcacgcatgcccgccggcgaacgacggcgatggtgttccagcggtcgacagcgacggcggaggggcggacgagatcggcgacggcttggcgatcccgatggcggctttcccgagcgacgacgacgaccggagcgacggcggcgcacggctggacgaacgatggcgacggcggcgcaaaagctcacggggatagggcgctacagatggcggcgggcgaaggcgagagtggctgcgggtagaggggagctcgggggtccttttataggggcaaggaggcggtggcgaaggcccacggcgaccggcgacgcgaaggaaaggttagggttcggagggagagacgaatccgattcgagatcgaatccacgagtttccaaaccgaattaggcgatgattccaaaggagaaaaggtagaggagatcgagaagatcatttcccctctattgatttcaccggatcgagaaaggggcgagcgaaattggaaaggcagcggcggcgcacggctagggttcggccgggcgacggctggaggaggaagacagccctgccacctgtcagcgggcggacgcgcgcgcgggcggctgctgccggactgggccgactgggccgagggagagagagagaggttttgggccggctttcggcccaaagccaaaagagactttaaaaacctttttaaattattcatgaaatgcaattccatttattaaaaatactttcttggctcaaataaatcccagaaaaatctaggaactaaagattcaagagaagtatctaacaaaattttatctagcccaattttatattgagatttagcaaattaaaattagatcttctcttttaggcttttaagatcatttctaataattccttttaaacaacaatttataatttaaggatttttaaacaagaaaagctcttaacaattataattagatcattaatgatcaaataattactaaactgttctttgtatcatttaggaattgagctccgaaaaatccgagaaaatttcagagagtatacttaatcatggagaatttaataaaagttaaatccatccatgctttaaatttaggaaaatttatttcccacatttaacttcacttgtaaattaatgaacatttaatataaattctagtaataatttattaaataatttataaatcctgaaacaaaaatcaggatgtgacaacttggacgaccggctttagccaaatttatggccgtcccacactacacctacatgatgatgaagatgcctggtcctcgaggggtcatatcactacggagcgacatcaagtaggccgtcacatgtgacaaagaaagctgcgagatggcccaaacccatgagacaactcttgctcgcgaagagatccgactagctgcaaccacggcaagcgagggagaagtgcctgcaaccaagctgacgaagaccgaagaaagtgatgccaagacgaaaaagattcccctagatccctccaatcctgataagactgctgtaataggcgctgagttagattgtaaataggaaagcgcgctcatcacatttcttcagaataataaagatatttttgcgtggaaaccattcgatatgcctggtatccccagagaggtgattgagcactctttacatgttaaggaagacgccaaacccatcaagcaacgactccgccgttttgcacaagacaggaaggatgcgatcaaggaggaattaaccaagctattagcagcaggcttcataaaggaagtctttcatctcgactggctggctaacccagtcctggttcggaaaaagacggggcaatggcgcatgtgtgtcgattatactgacctcaacaaatcttgtcccaaagacccttttgggttacctcgcattgaccaggtggttgactcaacggccggctgcgagttactcagcttcttggactgttacttgggatatcatcagatccgactaaaagaatctgactgcttgaagacctcgtttattacaccctttggggcctactgctacatcaccatgccctttggattgaagaacgcaggagcaacctatcaacgcatgattcaaaggtgtttttcaactcagatcggtcgcaatgttgaagcctatgttgatgatgtagtcgtcaagaccaagcagaaggatgacctgattgcggatttagaagaaactttcacaagcattcgtgctttcaagatgaaactaaacccggaaaagtgcatcttcggagtaccatcagggaagttgctcggatttatggtatctcagagaggcatacaggccaacccggagaaaatcaatgccatcctcaacatgaaaccgccaagctcccaaaaagatgtccaaaagttgactggttgcatggcggcgctcagccggttcgtctcacgactcggcgagcgggggatgcctttcttcaagctgctgaagaagactgacaatttccagtggggacccgaagcacagaaagccttcgaagacttcaaggaactcctcaccactccaccagttttggcctcgccacatccacaagagccactactgttatatgtgtcggcaacctcccaggttgtgagtacggtcctggttgtcgagcgtgaagaggaaggccatattcaaaaagtccaacgaccaatctattttgtcagcgaggttttagccgactccaagacaaggtatcctcaggttcaaaagttattatatggtgttttaattaccgtcaggaaattatctcactattttcaaagtcactcggtcacggtggtcacatcgtttccactcggggatatacttcataatcgcgaagcaaacagacggattgcgaagtgggccttagaattgatgtctttggacatatctttcaaaccacgaactttgatcaagtcacaagctttagctgatttccttgccgagtggaccaagtgccaagaagacatgccagaggaaaagatggaatattggactatgcattttgatgggtcgaagaggcttacaggcactggagctggggtcgtcttaatttccccgactggagaaagattgagctacgtattgtggatacatttttctgcgtcccataacgtggcggaatacgaggcgctactccatggattaaggattgcaatctctttaagcattcgccgattaatcgtccgtggagactctcagttggttgttaatcaagtcatgcaagagtggtcttgtctagatgataatatgactgcttatcgacaagaggtacgcaagttagaagacaaattcgatggactcgagctcacccatgtcctccgacataacaatgaggcagccgacagactggccaattttggttcaaaacgggaagcagctccttcagatgtattcgtcgaacatctttacgaaccgaccgtgcccagaaaagagacaactgaagccatggatactcaaggcgtaagcatgattgaaaccgactggagagaacctctcatagaattttttaccaaacgagaactccttcaagacaaaaatgaagccgagcagatttccaggcgcagcagactttacattattcacgaagctgaactatacaagaaaagtccatcaagaatactgcagcgctgtgtatctttggaggaagggagacaattgttgaaggatatacattctggcatttgtggtaatcatgctgctgcacggaccatcgtcggcaaggcttaccgacaaggttttttctggcctacagctgtgtccgatgcggacgagattgtgcggacatgcgaaggttatcaattttttgccagacaaactcatttgccagcccaagagttgcaaaccatcccgttgtcctggccgtttgctgtctgggggcttgacatggtcggcccatttaaaagggcagtcggcggttacacgcatctctttgtggctatcgacaaattctccaagtggattgaggcaaaaccggtcatcacgatcacagcagataaagctagagattttttcatcaacactgtgcatcggtttggggtacctaattggatcatcactgataatggcactcaattcaccggcggagcatttaaagacttttgtgaagacttcggcattaaaatttgttatgcctccgtggcacaccccatgagtaacggacaagttgagcgagctaacggcatgatactgcaagggatcaaagcacgagttttcgaccgactacgcccctatgctggcaagtgggtagatcagctgccgtccgtactttggtctttacgtactactcctagtcgggctaccggccagtcgtcgttctttttggtttatggcgcagaagcaatattgccgagtgaagtggaatttgaatcactacgatttcggaacttcaacgaggagggctatgaagagggccgagtagacgacatcaaccgactagaagaagcccgagaagcagctttaattcaatcgactcgatatttgcaagggttgcgtcgttatcataatcagaatgtccgatcgcgagcctttttagtcggtgacctggttctgaggaaaattcaaacaacacaggatcagcataaattatctcctttatgggaaggaccgttcataattgctgaagtcactcggcctggttcttatcgactcaagcgcgaagatggtactatcattaacaattcttggaatattgaacaccttcgtcgattttacgcttaggcatttcgtttgtatctttcctctttgactgctaacttcaagtttttcctcgaagtttttagtcagggggctactataataataatggagtgtgatttttatcaattcagtttgcttacttgatgtatcattgccctgtttgatttcttggcttagtcaatgaggactgaaagttttttaacaacttttgtgggttttaggctcaacaaggtttgacaaaaacttttaagaaatcaggagctaagctaagatatcaagcacagcataaattcatcagtattgtacaaattgtgcctccatcatcgttaatcatcaaagttatcggtacattaatcggtatcagtcttttcatcatcagaattttcaggaccagtcggtcgaagatcgttgtcctgaaatctctcaactacatcagcagcaattttgtcagccgcttttttcgcatcactgatgaggtcaagagcagcttcttcgctcgtcccgtctgcaaagccatcaatggcgtcaatatcaactctcggataaagggatttagtcatcgccaacgccatacttgctcctatacttccagcttctttgatgttcttgaaatatatatccgagcaactctcagcttgtcgaaaatttcagaaacatcaagtgcactcgggccgttgttattgaggaacatcgcttgaacaattggggcagcagtgttagcaacctcatcccgggctccttcaagttttttgatcttgccaaccaggacgtcaaattgagcttgagatttgatcttgcggtctgcatcgacagattcacattaataagtcagcatatggaggataatggattttgaggtattgattgttgataccttcaacttcctttgaagccaggtctctttgtcttgccagctctgccttgttattttccagaatttagatctgcttctctagttgagatatcttggcagcttgcactacattaacttcggttaatcaggattacagagataacagcacaaatcagttgggcagagtttgcgcaaaccttttgatgagccactcagttcaaaattggattcctggagctcagcaattcgattcctcagatcatgctcatttttcctggcaagctcttttgtctcgtgcagcagactcctggtggcttcgagggtcccgagatgagggactagcttctctaaggtcgccgttttagcttcgttcctaagatgaatcctctgcaagacagtttaattagcgcatgaattaaatggcaaacaagatggttgagatcaggtaccagagggcttacatttacaatgcgggttgcctgaccaagtgccttcttcagtaggcgtaactcttcgtcctctttttgcttatttatcatgatcccttgaggctgcatgttgtcatcccaccacttgaccagaatcggagggcgtgaatcctcagctgcttgtatgcggggaatttcttcatcatcaccgatcattggtcctaatgtatccactgacagaggttagacaattggtcagagttatttgggtcgacatggtttcagacaaagtgttttacccgtaatgatttctggacgaggacgagtgggttcggatgcctttaaaggagatccagatctctggtcattgctggcgtcttgtccgcgaaggctgtctgcttgagctccaacttctggaatctcttggcttggccctgcgtccgactggtttctagtcgggggctcctgattaaccctggcttcggcttcgaccgactgattcccagtcggtggttaatcaccagattctacattatcggttgccggctgattgtcactcggacggtcctcggcagatggcctggtttctttggaagaacttgcgtccacgctagtcgggtcagagtctttcccagacggatctatgtcagatggtttcctgcaagtttgattatcagtattattgccgcaatggatgcgcatcaatgcaagagagatcgttgtatgagttgtacctggaagacttcctgatctttggcgcggggcgactggatgttttcttccttggagtagcctgttttggtagtttcttggttgtctctcggtctccaggcctcctggtagtatcatcggcttcgtcatcactcagaaccagcttcctctttcgagagtctgactggccgactggatcaaaagcacttggttgagtttcagaccgaattcttggtcctccgctcccttgcccagtttggtggcggggagatcggcgttgagcgattgggggatccgatttcatcaaagcaaattcctgggtgcaatatctttcattgttaattgattcaataggaagacaagatcatatcttgaggaaggttgaaatgtttgagtgcataccggtggaggagggttgaatgcgttgaatggcacgacgggtagcagatgtgaatagctgacaacaatagcgtttgagaagatcttgtacattctttctttcatgaccttaaagtcaagagaatctggatcttcccgatttggatcatgcttgccatcgaactcaaaagctgtgcgggatctttctttgattggagctaaccgacacttgataaagtgccgggtgatctgctttccttgaagaccctgttcttttagctttatcatcctctccatcagttctactgcctgagcagcttcatctcctataggcaatgagtcccatgtgtcctggtaaaccggaggaagacaacagtactcggggagtgcgggctcaggattctgaacatagaaccagttcacatgccagcctttgtttgaggttttgaagggcatggagaaatatttttggctcaaggttcctctgagttggaagccagctcccccaacaacgcacggcttgcttttgtttggctggggcttgaggaagaagatgcagcggaacaaggcgaaatgaggcctaatgcctagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 39178 - DNA, 1989 bp, Oryza sativa
ccccctttctagcattccttcgtaccaaacacgtaaatagaaaatcctatggagagagtaagcagaaaaatttgcatcaccagatcatttccactagaacattagaaacactagtgacttgtccgtgctaacgctacgataattttaaataatctttcatgtatagcgtatgttatgaattaaatttaacatttgcaagaatcctatatacctatacaagtcatccccactaagtgcaattaaaactaatttcctgtgctgtggttgttccacgtcatcccaattaaatctggccttaggatcgagcttgaacgtgctagatcagtcgatggaagcacagcccatgttcctttctttcctggcccatctattcatcgacccattaattccagcccagcgagtctcctgtcacacgttccccattctcattagcaagcatgagcgccgccggtagcaacatcaattgaccaccgcctttccacatcccctttttctgacgctgcgtttccccttcctgcaaccatcgatggacttcctgaactgtgtctagaatctgattcgaccgcatggcaagccatccacacactgacgttgtgacatgaggaaccgataggagatggccatgctacgcttcgcttggtggtttagtttcatttgtgagtcatagatcccctaatgcatggatcactgtatggttatataggatttgatccctaactcacccggccaaattacttttatcttttgtgaagatgcttttcgtttgatcacttaaatcttctttcagatgttagtttattttgattgcttcgagtaatcaacgttgcaccggctaattgattttttttctctaattgctttgctttgtaggccatatccccaattcatggatccgactaccattcacaatttttgttttcttatcctgcagggttgattggatgggttcatttgactctagatgagacaatcaggtatttgtgttttagtaagcaattgatgcaaatatcaaaatgatctacttcgcatccacttagtcttgcttatgttccttttcttacatgttaatattatgtgcatgaaatgcaccttttgttgtttctgaatttcctggcctccatgtgcaccttcaatcgaattttattcagttgctatatatatgcaggtcacttcgcaatcctgcaaatacttaacgattggttggagaaaggtacaacccacattaataggagtgcaacaaggaagtgcttccataagtgctcctattatcctccaatcttgataagctccttttctgcaaatgttcctcggactttgtaagcagaaaaggtggattttttttctttggttaggctgttcgggatggagctgaaatacatgagaagaactaagagataaaacagaaaatgtagatgcgggaacaagaacaggtaggtgatgccttaattattgtcttattattcatttcagacggtgtatgcaattgtcaaacttgcgtctacctgcagctatactaatccatatccctttcatgaacatttcttctttgatcctttgattatctgtgttctttatatgtcaatttctaaatatcttggtaggttgctaaattttaatcctaatgggatcatgttttggctgcttggtgtctaaccacatccatctgttatttatgtcgctgagcagcgtgcccaggatggctatacacaagtcgacttcaagaaaatgtgaagggctaagaatgaggtatttttcttatccatttagtccgttgaatatgtttgtggtaggtcctctccatactaataaagacaaacatccttatctgatacgtactccctccatttcaaaatatttgataccgttgactttttagtatatgtttgaccattcatcttatttaaaaaatttaagtattatttattttttccatatcattcgattaattgttaaatatacttttatatacacatatagttttacatattt

SEQ ID NO: 39179 - DNA, 24633 bp, Oryza sativa
cacctgtatgtatttagcagtttttagaatatccgttgcagtgcaagaccacggattagtcttaattggaggtttagtttttactgtggctaatattttgcactgttgatcgactgtctgttcctccacatatacgagcttagataatagtagaattattggttttaacttctacattttctctcatgaactttctatttgatttttatttgactttccaattaaccgataaatttttactgccaacactaacatcaattttgtgtataagtactacagtgttttgtgatctaaaatcatgtagagaaccacagatagtatatatatttaaaagttatactccctcctttcctaaatgtttgacgttgttgactattttaaacatgtttgatcattcgtcttattcaaaaacttttgtgaaatatgtaaaactatatgcatacataaaagtatatttaacaatgaatcaaatgataggaaaagaattaataattacttaaattttttaaataagatagacggtcaaatatgtttaaaaaagtcaacggcgtcaaacatttaaggatggagggagtacaaatcatagttataattcatattatttctttatctgtgtttcatatattgtgatgcatcttatttttcgctcatatataccgcagcaacgcacggggtattatctagtttgattatcttttgaagaatcaatgcctagactttgaagttcctaaaaaaaggataatacatagaatccagacgaccgaaattctagtattagatagacgagtttctgatttattgtttacattgccaccttaaggacactattgtcaggttaaggtatgtcagaatatgagacaataggatcactgtatctagaatttctaccatcatatgtgaacaacataacagtacaatagttataattctttttttacaaaatcaaaacataaaaattattatagtaaagacttattagccataaagctcatgtcattcatcaccgtacatctacaatactcaacaagtctaaaattacaagaagctctttacaccaaacttacactttcttctatcaaatgaccacccaatccaccaccataaaaatacgagaacttcttttagtcttgaatgcccagtagaatttctatagaaaaacgcgcatctgctgcttgtcacagtagattggatttgacaaacaactaacaattctatccgacaacacacatttgctaaagcacaatacatgttaagacaactcatcattgatcaaataaatttgttcaagtgtcattgcacctggtaagagctgccagcctactccatacatgcatattttcttgcttgtagaactgaaaatagaatcgttcattattacatgccagaggttgttactatggttgcaaacctttataaataattttaccagttaattaacaaacaactttaatttggctcctagaactaattgtaattatacatgttctaattttactacacttcagctttctaaataacaatagcaaggaaattttactcacaaaatacacaccagtgaggaaatacaatctaactgtgatccttgtaagtgctatctactgtccacaaatcgtatagagaaatgcaccttttctgcaatatatatgatatatgagatcaggtattcaggtgaagaggcaagaataacaaaggagacctgcaccttactgtacattatattgtgcatgctgaagtatcaccgaagcacattatattgtgcaatatcagatcaaaggcaaagaagctcaccctcgacaaaagaacctaaaattcagaccataagttcagaaggatcaccatagtaaacaatatgtaaaatccaaaaccgatgttagcaaccatgtttgctggtcagacccaaggcaaacaggccactgaagacagactcaacgttaccatattcataaataaattttgccctttataaccttgagggtacagtgcatgtgaatattacgttaaagagcaaacgctatcaggtaatggtgggaagggaatataagcaagccatgcatcagcttgcctgcaatacatgaataaactgaatgcaggagctcggatgcatgttagtatggcaagtcagtcttatgaagctgagatgatgaatggagcttttaagtctaaaccacaccattcactttgacaaatgtgcagtattactcatgacctgcaattaacctaaacgacaatatgtggttagaactactcaaaatacagagttccttacaacctaagtgaaatgctgcatacaaacaaacaaattttctcaaacaaaattgtaataatgaacctaaaagaatttgaaagagctagcacacttatgctcctgaacctttttttttttgcaaaaagtgcagaacacaatgggtcgcaattatgctcggaatagcaagattaaacacagcatttccaatcgcatgcatagttattcaaatttatccagtacaaatgaaggcaaatgcaggggggaaaaattagcagaaattccctccgctgacctcagaaatggccttctgctgcagcctgcataacacatttcagcagcagagaatcacaagttcataactatacatctagcctaagagtctatcaatgatgaataaaaattgatgtggttgatagaaagaaccacccaagtacaaatagaaaattgcatcaactgctcattaattacagcgaaacctaaatctacgggaaatagcacccttgatctgggagcttaggctagtaaaatgcatacaagattatgggttaaaggtatatggtagcttttgtgccttgttaatgaaccagctatatacataaaatcagcgctgccaagctaatcatcaatgaaaagtgaaataaaagggagaagacatacatgcttgatgcttcataggacatcacatttatggtcatattagggatggggatcagctagaaggtggatgggtggtggagtagggtttttgtacctcttggcgttcaaggcggaggcggtggcagcatgccgatgcaggagtccgcgactcatcagcgtcgcagatcggcgaggcaagggatggagtcctggcggtgcgtcggtggagcggatcggcgaggcttgtcgatggagttatggcggcgcggacgagatcagcgaggcggacacctaggcaatgacgcagatgcagtccctagcgagctacacctcaccgactataccctgaatttaagaaaaatggagaactgaacacaactggatcaaatagcttgttctaatatgcaagatgaaacacataaatattttgtcaaatatcgattcttttaaaacagtcgtaagaaatttcattaggagaaattttatgtatctgccaatgttcatgcttatgctctaccaactgcatattagaagtcctgacccgaactgacggcaaactcaaagttcagtagacaaagcaaaccagttcatcctttaatttctccaaagctgcaagccaagaaaagccccaaattcctacctttcttgacatgctcaaggcaacagcaaacacacctttcttgcattgcatgagacctataaacctaaactctacatagcttcatggacaatgcaaacaacttggatctttgcatttctaatcgagcttatcaccccaaaggcagccatgtccggaatgggatcgagcaatgctttaccttgtccgcagcggtacagaaggcggcgcaagatagttggtggtggtggtgtcgaaggcgaaggcgactcgcgacgcggtcggcgggaggcgctcgctggagaggggcgcgggcgttggaggcttgtcgtgacgcggtcagcggggaggggagtcggaatcgacggcggcggcggcggcggttggcgtgagagggatggcgcgaacaacgcgcgcggcgcttgagacggcacgacaaggttgtggcagggaagagagaaggaggtggcggcgtgctctgtaggttgggcgaggaatctgggaaccgaaaatcacgcacgcagcgatgagcggttgaaggtacgttgcggtgattttcagtcggtgtggactgccgccgtcgcacgcattcctccccgtccacccccacagccgacgccgcacccagtaccgcggcgcccattcccccctccatccttccccctagctgttcgccgtcacgcacaccaccggctgcccccagcacccgccgacgggccgcctcgcattcgttcgcggccgtccatggaggccgccctcggactcctccgtgcgcgccaccggtcgccggctctccctcttcgccacccggcgccgcggcggacgtccaggaagcctcaggagtcaggacctccagaggggagaggcgtgcgtgattttcggtgtgcacggtctcatactgggtgaccccgcgtgcgtgccctgtcgtcggatctaatgcgctgaatgatcgtggaccgttggatatgtgacatgatgaattatgaatgagtaaaacaacttgttgaattatagagcagcaaaagaatagatagattatagggtagactagtgtatcttcctcatcatcattaatactttctccgtctcaaaatataaatccttatattccttatattttggaatgaagagagtagcatatattgaatcgccgtaccgcccggataggaatttgatccttataggtcctctaagaatttgtttttgcttaaaatcatccttgggccacttaatatgccatatagctatttatagtcaacaattctgttagaaaatatctcttttgcccttaatttgtatacaactatacactagtaaagagaaaaccaagatacataaacaacatttgtacttcccattatttcaacatgtgcaaaagaaacttgagtctaatggctattgtatacacttgcaagtatataatttacttttgttttacataaatttctatgcattatctataaaaaaaattcattacgcatttttttgtcttatatatgtgaatgagggggtataagtgtcattcatcaagatatttgttggttatgtgggtcccactatttttatcttatttgagtgacatatgggccccatatctttgttgtaattttttattttccaattttattttttcagatcaaactgtcacgtaagtgtcacgtcaacaccacgtaggacgaaggcttaatcaaaagatccacataagcgtcacgtcagccaaaaaaacggagtcaataacatcgagggacctcgtttccactggttttataagttgggaatgcaatgtatccggttttctagactgaggatgaaaatcggactagacgataaattgagggatctaaggtgaacttattcctaccggaaaacgcaggaggaaggccttcgggctactagccgggtgaaagggaaggattgaaccgtgtgattttgtgacctttcggtagttttctctgttaattctgattattcactgatacacaacgtactaatatatatcaaggtatctgtgtggataagaggaggaacttttgatctctacgagcctatctccacctcaccctcctctctctatctctcctctgggtctaaatgggggtcaacggcatagttattgagaccggaccagtaatcgaactggtgaggctctcggttcaatggttcgctggttcaaccgggtgaatagttggtgtaacccggttcaatactaatcaaatatattaatcattctattagaagtttagaacacaacaagcaaggtagcctggttgttgggagagagttaactccccatggggtcatgggttcgaatcccacccaagcgttttttccctcatttttcccccactagcgcgcgcttcccctttctatcccacattcccacgtgccgattcgaccggttcaaaaggcggttttatttccggtttgacagcggtttttcttcaaaaccgggcggtctgaccggttcactgccgattcgattgcatgccggtcttttacctggaccgaaccggcaagagctttggttccagttttttccggtctgaccgccggtccggtccggtcttaataactatggtcaacggcgacgcaagatagtagcaacggggtggacgacgaggcagcaaggagggagttgcggcgttctgaccggttcactgccgattcgattgcatgctggtcttttacctggaccgaaccggcaagggctttggttccagttttttccggtctgaccgccggtccggtccggtcttaataactatggtcaacggcgacgcaagatagtagcagcggggtggacgacgaggcagcaaggagggagttgcggcgttctggctgcagaggaaaggatcaaggagagggagccggtgagctgcggcgacggaggaggaaaaggagcgggtggggaaggcgacgagggatctctactacatggttttgtaagttgagagatgcgttgtatctggttttctggtctgagaatgaaaattagactgtgtgacaaatcgagggacctatggttttcctttccggcacaaccaacattggacaaggccgagttcaaaaaaaaggaataagtccactttgactcccttaaaaatgacaccaatctaatctatgacccctaaactgctaaaaccggtgtaaattgactcccttaaaaccagatattttgacccctaaattgctaaaaccggtgtaaattgactccctcggcggttttgaaaagcggttttgctgacgtggcgtctacgtggcagtgttgacctggtctgctattgacgtggcgcttaggtggcattagaattaaaaatatgcatgtgggacccatttgtcattcgcatggaagaaaattttgtggggccacatgtcagtctatcccttcctcatcctccccctttctctcccttatctctctctccctccccattcggcaagcggcaaccacagccatttatgccactggatgagcgctgccatggccgtgccttaccgcggtttcgtctcgtccttctccattcccagcaatgcaaccacaaccgtcaccgccgttgtgcggccgacctcgcgtggtttcgctacctcaaccctcagggcactgcccaccaccgcaccaccattcccgaccactccaacctccaaggtcccttttgggtgtgcagcaaatgaaaaggaaaacttgattccttttcgtgaaacgattccgccgctcacacttcttggtgtgcatcaattattccttttgggaaaacttgactttttttttttaaaaaaaaaaagaaaatcatctggctgtggagtgtgaacatcaatgttttctccttccctttcatttgctgtgaattcaatcccctcctcacgaacactcgaacaccatgaggactctctacaagactcggactccaccgccgcattctcgcatggcttagccgtattctcgtttatctctaatgggtcctccgtacacatgacctaaccaaatttttcaacgaattttttccacttttctgactagccgatgcgtccgttcttgattcttgtacgtattcctcattcgtgctgcatagtgagcagtagagattcagactttttttttgggtttgaggatcagagaattgaggggagtagagattgagatcagagaattcggcggtgacggcaggtctcagtcagatttgggcggtagcggaggagctccggcgagctctctcctaggtggccgccgtccccggcgccgtgaggtggccaccactgaggtggaggccaaagccgcggtccgccggcgcgcgccggtcgtcgttcgccaaagacaacccccgccggtcgacttcctccacgatgccgaccctatctcgccgagtgctgcctcgccattgtcgactcctccactccggggaccgccactccagctagctcctatgtcagctcccgccgccgccagccgccaccactccggcccatgcccgccgccggccgaaggggagagagagaaagaaagagagaagggaggaagaagaaagagagagatgacatgtggggcccatatgctagtaggccccataattttttatgtgtgtgaatgactaacgagtcccgcgtacatgtttttaattcaaatgccacctaagcgccacgtcaaccccatagactggtcaataccgctacgtcagcgccacgtcagcaaaaccgctctataaaaccaccaagggagtcaaattgcaccggtttcaatagttcaggggtcgagatatccggttttgcggtttagggtcatgaattagtcatttttcagggagtcaaagtggacttattgcgaaaaaaaaacaatggacaaggcccaaaagcccaaattgcagtgcgtggttgtggttggcccaaacaagtccttcccgtaatcgcgttcgtcatcatctatctcctccaccgcctgatcgcgccgccgccgtctcttttcacctacaaaaaccctaagcccaaaaatctccatcccccccgcccccagagatcccccaatccactcgattcgatccaatccggcgaggtacaggatgctgccggggtcggcggcgccggcggctgggagcggcatgttcgtgccaacgcagacggtgggcacggtgctgtgctgcatctgcggcgtggcgatgcagcccaacccggccaacatgtgcgcgcgctgcatccgcgcccgcgtcgacatcaccgagggcgtcccgcgccacgccgccgtcgtctactgccccgactgcacctcctacctccagccgccgcgctcctggctccgcgccggcccggagtcccccgagctcatgcagatcctcctccgccgcctcaaccgccccctcgcccgcctccgcgtctccctctccgccgccgagttcgtcttctccgagccccactccaagcgcctccgcctcaagctccgcctccgccgcgaggtcttcaacgccgtcgtcctcgagcagacccaccccgtcgagttcaccgtccacgatcgcctctgcgatgcctgcgcccgcgcccagtccaaccccgaccagtgggtcgccgtcgtccagctccgccagcacgtcccgcaccgccgcaccttcctctacctcgagcagctcctcctcaagcacggccaggcctccctcgccctccgcgtcgccgccgcccccggcggcctcgacttcttcttcggctcccgctcgcacgccgcccgcctcgtcgacttcctcgccaccgtcgcccccgtccagacccagaccgccaagcagctcgtctcccacgacaccaagagcaacgtctacaactacaagcacaccttctccgtcgagatctgccccatctgccgggaggacctcatcgcccttagccctcaggtgtcccgcgatcttggaggccttggacctatcgtcctctgcatcaaggtcaccaatgccatcgctctgcttgaccccctcaccctgcgtgtgcaccacctcgaggaaaagaagtacagggtctacaacttcaaggctgctctcaccagcaagcagctcgtcgagtacatcgtgctagacatcgagcacgagtcaccagagattaccattgacggatctcgctaccagttggcttatgcccaggtcgcccgggtctccgactttgggaaaaacgacaccatgttcaccgtgcggactcatcttggccacctgctgaatcctggagaccttgcccttgggtatgatctttatggtgccaacttgaatgatgatgacatggacacagctatgatgcgccacagtctgcctgaagtcattcttgttaagaagagcttcgccaagaggccacgcacacgccgatggaagctgaagaggcttccaatggaggaagatgctgtaaataaggccaagggggagctagagaagagggctgatgagtatgaggagtttctcagggacttggagcacaactctgatattagattccagattgatctatacaaggatgaggactacaggtcggagatggcatctactattggtgatgatgttcccactgtgccgattgaggaactaattgaggacctaagtcttggtgatgatgaggaggaggatgaaggtggggaaggcaaccaacatgctgttatggtgggatgagttaatatgtttacctgtgctgtgcttctgccttctggtgatggttgctgccaaccgcagatcataggtctgaactgcatctgtttaatccgtataagttttgttctcccctttacttctataagttataagttttgttgctaaattgtttcaacttttgctgtttctcatgatagatgttgtatcaccttatcctgtatctggtgttgcagcttggcttaaattatatttctctattcttattgtctgtgatatgttgttttcttgccatagtgtggctgatcacaacatatcttaaaatagatgcattgtttgatttccaaaacatctagtttggtgtttagattgtgccagattcatatttttactatatgtttttagtccccattatgtggtttgcaagcgtggaatatgattgtggatttatgctgagtcatgactagagaattgtaggtatgacctgaaaacgtctgccatgttgagtgtcactccaataaattgattaaaaaactaataaagataagtgtagtataatatcatacccaggagccatgatgagacaataatgtgcatttttagtgattgcaattcaactgctgctgttttatcaggcacttcattcagactatgcctacatcgtgcaataagaggttagatatgtagagttgatggacagaacagatggtgctccactaataagcgatgagtactggtttggtaaaactttaataagttaagaattttacggatcttttttttctattactttcacaaggtggtgctgttctcaaacctaatgacttataatcgtaaaaaaaaaaaacttagattttattcaaacattaaacttctgtttacccttgatttctccgcacttccatttatcatgtagcatagcaggctgtggacttgtatccaacatttctgtgtgagtagtttcttatgcttcagaatttttagttctaccagccgaaaagtttacatatttgtgccattttgatatctataattatagttctacattagagtctacataagataaaagttccactgagctaaggcatagggaatgaacgtgcacttgtctattattgacatggtgaattgagtcatataaaattcaccacccatgcccctgtgcctcttgtattttggaactgtggattgtttcattcagttctctggaatgaattgacccaacagggtgcactgtatgttttttgctcctattcattgcctcttatttatttacttatggtgtagttttattagtttcaatagtaccagtagatgattcaagttggaatgaaacttgctcagcatgaaatcctatttttctgtgattgtgaaattagaaatgttgcttggtgataggtgtacatccgttccagtcgggccatattctgtatattccaagttttgtgtagtactatatattttagcgtgtaagaactagtaatgggcccttttttatgtcatgcacaaatgcatttgtttactttgagcttttgtcaataatatacatgcgtggttggtgtggtccgattaacaatcatctgtgtttgagctcaaaggtatgatctctcggaaagcagagtttacaaatatatatagagctgcgcatgcttagctttgagtttcctgccttcctgggcctgatttgttggccttgcgcgggagtggtacgtgacttggagcacacaaacaaattgaaagctttgctgcttctttcttgtgataaaattcatttttttttgtgtcaaagtttacattttggtgtggtgtggagaaacccttgccatttggcattgcgtatgactaaccctgatgtgaagagaagttttcgtttcaaaatttggaaacatgtttgttgcaagttttgatctgattactagtactagtactcgtgctttacaaaagtaggagtattggatagaccattgaattcctgtagcagagtctattctgaaatcctggaatctggacatggtgcttgccggttcatttcatgtggacgccatatcgtcctgcatccgaaaatggtttgcttcgtaggatcgttattttgcttgttagtgtgtcgtccactggctttaacgcaccttttgtgaattgtgatgattcacttttggagtacgaaaagtcccatcattcagctaatatctacatccatcattcagtttaggtactagtagtgactcgtaaacaattgtcgcagcaaaatggaaattgataccaaactaattttctcatttatgccgtcgttacattgttcttccaacaagtattaatccgtgttatatactccagtcacggacttgctacatgaacgaaaagcagcagccgggcgatgatagattacatcacggctgacgtgtactttgtccgggagacgagtagaaaaggacaagttgtatttcttcatctttctttggctcgtgccctacagtactccgcggctgcctgccaacccggtaatcgcagaggcaggtcatcgtcggatttgatcttgacggctgacccgtcccgccggcggtagctgcagccagtgcctcgccccccttccatataacaccaacctcctccgcgatcgcaatcgccaccaaccccatcgagaagcagacgccaccaccgcgattcgaatcgccgccgtctcaaactcaaaactcacaggtaagttcccctcgcattgcttcgatcttgcctgccctcgatccctcattcgatctgtcgctttgaatcaagatttttttgatcgcattttcatcagatcgatcagatcatgggggacgtggtcaaggacctggtggcgggcaccgtcgggggagcggccaacctcatcgtcggccaccccttcgacaccatcaaggtcaagctccagagccagcccacccctgcccccggccaattccccaagtacgccggcgccgtcgacgccgtcaagcagaccatcgccaccgagggccccaggggcctctacaaggggatgggtgcgccgctcgccaccgtcgccgccttcaacgccctcctcttcaccgtcaggggccagatggaggccctgctgcgctccgagcccggccagcctctcacggtcaaccagcaggtcgtcgccggtgcgggtgctggtgttgccgtctccttcctcgcttgcccaactgagctcatcaagtgcaggtagcttttactcaccattgcgtgctaaattcctttcatctggtggtgactgcactgttcattttcactctgagggtgcctgagctttgcatcatcgtctgtacaatagatcaataggaatcccctggtaatgagcttctctgaaattgccctttcctgcacatatcattcttcaccatcagccatgttactgcgatacactcgttcaagtgcatttcacattttcgttactgcttgtcacttccactgcattgtggctttttttactcacgccactaaaagttaatctgtggacttattttttcctattgagaccacagcgctctagatcaaataattccagaccaagtttcccgataaaattgacctttttacctgaaacaggtctgttcagtgcagacttgcagtgctcccccccccccccccctcccttcagcagcgagcgatacacttctgcagtgtgcatattcaaagggaataaagacccttgtgctttatatgctcttttgtaggtttcttgtgttttctgatttctacttgatagggatatatgagttttgcgcctcagttctccagagaaaatgacaccacacccttcctgttgaacaaccatatacatatgttaaatgctgtaaaatcaaatcaatgttgtgaactgccgcagtgcagtaacttatttaggttgcgagtcgtcgtaaacttgtgcagtaggctcattcaaacactgatccttgtgctttataggtttttttaagtgttcttatgttttgtgatatctccttggaagggagatgtaaaacaacaaattgaataatttaacagtcaaaaacatgccttttactcctattctatcttgtgtatgtccttgaaagggatatatgagttttgagtctcaattctctagacaaatgacatcagactgcgttttctgaacaactgtcctttttatcacaagcatacttctaaatatgttaagaaccatagatggttgctctatcaaatcaatattgtgagctgttgcaacacaatacttatttcggttacaagtcgtcatacagttgtgcagtcggcacattcaaaaaccatatcatgtgtattttatttgcttttaagtgcagctcttatgttttttgatatctcctacctgaagaattttataacagtaaaaaacatcagtttactcatattccaatttgctttacccatttgcaggttgcaggcccagagtgctttagccgaggcagctgctgcttctggcgtagccctacccaaaggaccaattgatgtggcaaagcacgtcgtcagggaagccggcatgaagggtttgttcaagggccttgtccctacaatgggccgcgaggttcctggcaatgccgtgatgtttggtgtgtatgaaggcaccaagcagtacctcgccggtggtcaggacacatcaaacctcggcaggggctctctcatcctatccggaggccttgctggggcggtgttctggctctcggtttaccctaccgacgtcgtgaagagcgtgattcaggtggatgactacaagaagccaaggtactcagggtcagtcgacgctttcaagaagattctcgcggccgatggagtgaagggcttgtacaaggggtttggacctgccatggctcgtagtgtcccggccaatgctgcgacattcctggcgtatgagattacaagatcggctctaggctgattgattgctggttccaatggccatttctatctcttatcatggttgaaacaacaaccaggctgtgcagttgagggggggaaaaagcagcagtagcagttccaatcctgttttgcaagtttatttcatctgcaacattgtgattcaaaacattgaagtatggaagatgcaacagcgagcaagatcgctggctctgcattttttgtctgcctgtatgtataataatataagcctaacatgtgtggggtgtgggtgtggagtgagtgtagctgaaagaaactcgtcgtcttgtcggaatggttggcctggagtggattggccatctgacggcgatcccatggtgaggggagtgagtgatgctgtctgtgatggcgattgggggtgcgtttggtgagtgagtgagtgagtggccctggtgttgcttgccctcttggcatccgaatcacctctcctcttcttcttggtctgaatttttttgattccctctcaactagcatctttttaattggctgctattgccacagcccttgtattttagtactgagacctggggctctagttgttttgagccagttgagctgctgcagctttgggtgaggtggaggtaggaggcggcggccgctcccatccttccttcacctccatctatctccaagctcgatcttctgctgaatagtaatttatatttcttcttccttgtataatttcagcttcatgtttatcagttgggtcgatgatgcattggcagaaatctgtgtttcatgttcttcttcagttgttatgtttgactagcaaattggactgcagatcttcagatttgtggggggtggtaattctagcttatcatctgatctgacgtagaatctgaatgcctgtgtggtggtatttctttcgctgaatcctgtaaaaaatgtcggatttttgctgaatgataaacgaaacagatgcaaagattcatgcagtggagtggagaagagaaggaataaggagaagccttgaactgacttgcaatggtgatgaactaactaattgactgcaggagaggagatgggtgacgtggccaaggacctgacggccggcacggtgggcggggcggcgcagctggtcgtggggcaccccttcgacaccatcaaggtgaagctgcagagccagccgacgccgccgccggggcagccgcccaagttcgccggcgccatggacgccgtcaagcagacgctggcggccgaggggccgaggggcctgtacaaggggatgggggcgccgctcgccaccgtcgccgccttcaacgccctcctcttcaccgtcaggggccagatggaggccgtgctgcgctccgagcccggcgcgccgctcaccgtcagccagcaggtcgttgccggcgccggcgccggagtcgccgtctcgttcctggcctgtcccactgagctcatcaagtgcaggttcgttttcttctctcctgaggaatctgtctacaagaaagaaatggtgcctgactgactaactgcaaacgtgctgcctaattaaccatcccaaattgaattagcctagcgtttccgcaattgttatgtgctagtatatatatcaatgtgaaatgacaataaagtttctcatcagtcaataatattcagttttctttcagcaaacgaaacaaagagaagatattgttgagtgcatatttgttttctgaaaaattggagtgttgacttcataaaacagagtgtaatatctttaagcagagagcggaataagcatcttctttttaccatgtctactcccgtctccatgcaatgtttgcaacaggaatgctgcattcgttcatcgatgatagtctgattatctgatagaccaaaccccttaatgcttcctactagttcctagtagtgatcattactcaatatttgttctcactttttttaaaaaaaaaaatccatcattactcaatatttgaacaaacaattgcgtcagtacattactgtacacttacagattgagctccataatctgctgttactgcattatagagtagtaccatgtatcgaatctgcatcttgtgctgccattctcaatgtacacctcttgctcttggcatcacaatgcactaaaagtgcagaaacatacgagttacgggtgaatccaatcatcttgtactgacacttagctggttggtttgttgtggtgtcaggttgcaagcccagagcgcgttggcgtccgctgctcctgccgccgccgccgctgccgcctctcccgtcggcggaggcgcggccacggcgacggcgagcgtggcggcggtgaagtacggcgggccggtggacgtggcgaagcaggtgctgaggtcggagggcggcgtgggggggctgttcaaggggctggggccgacgctggcgcgggaggtgccggggaacgcgctcatgttcggcgtgtacgaggcgatcaagcagtacctcgccggcgggcaggacacgtcgtcgctggggcgggggtcgctggtggtggccgggggcctcgccggcgcctccttctgggggtcggtgtacccgacggacgtggtgaagagcgtcatccaggtggacgactacaagaaccccaagtactccggctccatggacgccttcaggaagatcctcgccgccgacggcgtcaagggcctctacaagggcttcggcccggccatggcgcgcagtgtccccgccaacgccgcctgcttcttggcctacgaggtcactcgctctgcactaggctgaactcatgtatcattacatcctcctccttcttgacccttaattttcttcttctgattctgattctgattcttgctgtcatccatctcatctgtggatgtaagaacagtgtaattctgtacacacaaatactatctttataaaaatttcctagatcacacaaactctctggtttagtggacttgttccgttggtgaattgttgatggtgagctaagcatggtaattctgtgatgctgttcggatgaatcgaaagggaaaaggggtctgcggagccgcatgcacatatatactccctctatgtatatccagattacagtattaggttgttttcttttgaacggagggagtacataccagcggattatataaactaggcagtgccgtagtaattaaccatcgccatcgccatcgagctcgtatatatcgtcgtcactctagtacctgtattacgtactccctccatactcataaagaaagtcatttagaacaatgtttaagtcaaaccttaagaatataaatcatgaataactcttaaattgttgagtttgaaaatgtaaagattatatgagtagatttgttttgaaaaataatttcataaaagtatacatgattacatgtatcacttttcaataaatatttttatagaaacaagaagtcaaagttgtgtagttgtttaaaataactttctttacgaggaagaagggagtacgatcgatgaatggaagctaaagctcaaacaacaatttatcgtcccatgaaagactgactctctctcttttgtggactttcttttgcgttggtacttggtaaggatgccgctcacgcatgcagggccataaattgtttggagatgactaaaaaccgtggttggctagttaattcaactcttgttgatgcagttctcacgaatccaaacggaaagggacgcttaacggcttaagttgacatctcatcagaggcaggcagctggctctgctttcgtcaggtaccacttaaaagataatatatattttcatttaattaatctagcaagacaggatggggtggtggcgcagttggctagcgcgtaggtctcatagctaaagcgagtgatcctgaggtcgagagttcgagcctctctcaccccaactttttttccgcttatttttttttgcaactccttaatccttctgtgacacaaattacatttttattttccttttctccaacttcttaatccttttatgataaaaattaattccacttaatttggaaatccttctgtgacacaaattacatttttgttttccttttctgcaacttcttaatccttttctgataaaaaaatattggccagtttgagattggtattagaccattcccaatagccatgatccgaaactgaaccagaacttccaggttaatagggaagaagtttgatcggaataaatataaattcttttcttatttctattttatgattgaccaatataaacatcaacaacttcaaattggactcgtttcccctcaacaaataaaggcttgggctaacaaaacactacctaatggagaagtcgttggcgaagtcacaaggcactccacttttcattataaaaccgataaaccagaaaaagatggattattttgcgaaagaatctttggacccataaaaagcagaatttgtgcttgtggaaattctcgagcgagcggagctgaaaacgaagacgaaagattttaccaaaaatgcggagtagaatttgttgattctcggatacaaagatatcaaatgggatacatcaaactcgcatgtcccgtgactcatgtgtggtatttaaaaggtcttcctagttatatcgcgaatcttttagataaaccccttaagaaattggaggggctagtatatggcgatttctcttttgctaggcccagtgctaaaaaaccaactttcttacgattacaaggtttattcgaggatgaaatttcatcctgtaaccatagcatttccccctttttttctaccccaggctttacaacatttcgaattcgggaaattgcgacaggagcaggtgctattagagaacaattagcagatttggatttgcgaattattttagagaattcctcggtcgaatggaaggaattagaagacgaggggtatagtggagatgaatgggaagatagaaaaagacgaataagaaaagttttttttgattagacgcatgcaattggcgaaacattttattcaaacaaatgtagaaccagaatggatggttttgtgcttattaccagttcttcctcccgaattaagagcggaacgaaaaggattttccctgagatggtaaatgaaaacgattagccccatacgaggtttgggaataagtgatgagcaaggaatatacgtctttctgctaaagaggatctattaaactcataattcattagatctttgttatcaatgtcaactaggtatcataagtaaacggatcccggttgttcaatcctttgataaccaaggtcattctttgctaaagagaaatgatcactatgagtcagactcaatagaattggatccattccaaatagcgagaattaggattctggatccctctcaatctctctttcaattcgaggatccagagaggtgttttcatagtcatctccgaatatttgccatctccgaatattttcgatttcatttttctatgatatgtctttctatatgaaaattggttatttacgatgtacgatgatccctgttaagcatccatggctaaatggttaaagcgcccaactcataattggtaaatttgcgggttcaattcctgctggatgcacgtgaaccggaacgttccataagtctattggaactggctctctatccatggaatctcatccatcatccatacataacgaattggtatggtatattcataccataacataagaacaataagaactcgaattcttatcgatactggaactcagagcataggagagaaagtcgatttatggatggaatcaaatacgcagtatttacagaaaaaagtcttcgtttattgggaaagaatcaatatacttttaatgtcgaatcgggattcactaagactgaaataaagcattgggtcgaactcttctttggtgttaaggtagtagctgtgaatagccatcgactgcccggaaagggtagaagaatgggccctattctaggacatacaatgcattacagacgtatgatcattacccttcaaccgggttattctattccacttctagatagagaaaaaaactaaaggagaatacttaataatacggcgaaacatttatacaaaacacctatcccgagcacacgcaagggaaccatagataggcaagtgaaatccaatccacgaaataatttgatccatggacggcaccgttgtggtaaaggtcgtaattccagaggaatcattaccgcaaggcatagagggggaggtcataagcgcctataccgtaaaatcgattttcgacggaatcaaaaagacatatctggtagaatcgtaaccatagaatacgaccctaatcgaaatgcgtacatttgtctcatacactatggggatggtgagaagggatatattttacatcccagaggggctataattggagatactattgtttctggtacaaaagttcctatatcaatgggaaatgccctacctttgagtgcggtttgaactattgatttacgtaattggaagtaaccaattaggtttacgacgaaacctagaaatcgatcactgattcaatttgactacctctacaggatagacctcaacagaaaactgttgagtaacggcagcaagtgattgagttcaggagttcctcatagaaaattattgactctagagatatggtaatatggagaagacaaaattgtttgaagcacgcacagaaccggaagcgccccttgtttcaaagagaggaggacgggttattcacatttaatttgatggtcagaggcgaattgaaagctaagcagtggtaattaagacccccgggggaaaatagggatgtctcctacgttacccataatatgtagaagtatcgacgtaatttcatagagtcattcgatctgaatgctacatgaagaacataagccagatgacggaacgcggagacctagaatgtagaagatcataacatgagcgattcggcatatttggattactttcctatatatccactcatgtggtacttcatcatacgattcatataagatccatctgtctagagatcgtcatattcatctagaaagccgtatgctttggaagaagcttgtacagtttgggaaggggttttttgagagaaaagaagaatctacttcaaccgatatgcccttaggcacggccatacataacatagaaatcacacgtggaagttcgagcctctctcaccccaactttttttccgcttaatttttttgcaactccttaatccttctgtgacacaaattacatttttattttccttttctccaacttcttaatccttttatgataaaaattaattccacttaatttggaaatccttctgtgacacaaattacatttttgttttccttttctgcaacttcttaatccttttctgataaaaaatattggccagtttgagattggtattgaactgctccgatttgagaattaagtttggtatcgagctgttccctgcgaaatcaccgtggcaggagtgttagggccctatcaatgatatatgcatgcatgcatgtaacctgaatatgctgggataactgaagccatgcatgagttgtcaaaggtcgaaccggttgtctattcagtgcgatcgatcgtttgttggccattggcttagaaaggagtttcagctacacatttttgcacttcatcatcttgcaacttgcaatcatccactcaaaaaaaaacgtacataagcatagttccccaccaatgtttgcatccccaataatcattatgcctttctcccactactacttccactcctacttcagaactaacctctgaataatctgaacatccgacctagtactcaactactgagagattgcacgtgcgtcggatactcagagattgctttgcttgcattgtaatctctttccttgatgcaaattgtttttgttaggccctctttatttatgcttaggtttattggcttaaacttttaagtcagtttattggtttatatgatttataagccggtggatttaatgtcctaagtttagtggtgaagtcatacatctacctcatataagccaaaaaaaaaaacttctccaacctagcttttggcttaatagtgtttgagtgtcttatggcttcaaaaaaagccaaacgaataagttgcttgtttgtttatgcttagattttttagcttataagttagcttataagcctaaacaaagagggccttaaaacagaggtggaactttgttctatttttatatttagaataagagaattaacctaatttataagaaaaatcaggcaaccatttgatgcaaattgttgatggtctcacaacatgtaatggccaatgggacatggggcttaatttgaaacataattgttgttacatattatctgcttgattatacagacaaaataaatatttttatagattataaataaacttaacaagtagtaacttatagcaagctatagtagaagatttttgttttcgagaaagaaaacaatcggttccaataattaaggctaagatgagtgagctagctcatctggctgtcactggctgagctgaaactgaggcccaggagagcagggagtcttttctggctttgatagacagtgccatgtgagggtgcaaccgcctcctatcctactcccctttaatacccttcccttatcttctctaccaccacagccgcggacacgactcttctgcgatagccgcatactccatccgtcaaaaaaaaaataatctagacaaagatttaacctcacttaggacaataaatctggacaaccttatatccagattcattgtcttaaatagtgtcacaccacctaggttgtctttttttagatggagggagtatgtagtaagagtcactgacatatgaaccctagaacgagggaggctcacatattagtctgcactactgcagttgcctaatataaatcaccatgcctaaatgttaacaaaaaacatacttcttttgtaaatcaccatacctaatgctgctttcattgactaatgaaactgccatgagttttgatcagcttgctagctgcaatgctgcattgttcattcggagtgcacatccttttttggaatctcagacaagaagttggcatcaatcgaatcgctgtgaaaagaaatgtactgttcgccattggctttgactgtagctgcggtcgcaacgcaatgttatgcgctgacgtggatgaaagcacaaggaatctggtgagagaggcgatgtatcgattcgattatgaaaggaaataagacgaatggagatgcagagattagtcttttcagtgatgccatatcgctaatgaagaagcaatgggattggttcaaaggggatccccactaatggcaagtggagcacctaaatatactttgctgctcctaagcactctctgctttccaaccaagaaatttgcctctcgaatcttttgatttttcatatgtagtaagtatcttgaactgatttgtgcgcatttttccccctccatttctctctctttctcttggaaaagtagaacaacaaacaaggaccaacttgcaagctttttctccttcattgtctgaatctttaagcatatattaacctatcgatcgatggcattacattatactactacatgatatggcttctggaaggaacacataaaaggcagaacaaatctattattaactaca

SEQ ID NO: 39180 - DNA, 1468 bp, Oryza sativa
gcgcctctcctccccggcgccgaaccaccgcccgcgcctctcctccccggcgccgatgccgccgtggacgccgtcacccgcgccgctcctccctggcactgacgcggccagccgtggacgctgccgcccgcgccgctcctcctaacgacggccgctcctcccgacgacggccgctcctcccggcgcccctcctcggctcctccccttgtttgctttctctcatccccaaagcccacgagctaaacgagctagctcgagcttgctgacgagccgagccgagcttggtttctagctcgttaggataacgagccgagccgagctagctcgttatcctaacgagccagaccgagccgagccgagccagctcgacatccagccctagcccccatagcattgtaatatgagagcaactccaatacaacttcggcgcatcatcacccttttacttttctcgttttccgacgagttcttcgcaagaggtaacccgtctcaatggcctgtgctatcggggctaacatgtcgttttagacgtgttaggctcgatatcgcgagtcattgctatcatatgtcttgctatattagattagctaaggcatctaccatcctgaaaagtgtctaattgcttgattgtctagactgcatgtttcttttcatattttgagatgcatcatacctagtcatgcttagaaccgtgcaatctagcctgcaattaagcataataaggatagtatcggggtttcggccgatcttacctaatatgcatgtttcactctccttgtttcatgtatattcgccacttatatagatagatcttttgtataagcatatcaagttttagtcagtgtcggttagattcctacgccttcatgcttgatttatgtttgatatgtttatatggatcaatctgcctatataagtttgtactaaagtattaactagtacgttatctctcttgctctaaatactgtcacattggctactttcataataccgttttaaatcaatctgttaaactctatagatagtattacaggcgattgggagtgttagggtttattattctttgacatatccagtccatagccgattggtctaactatatcggctgagaccatcaacgatatgctatcggcctatcggcagatcggctatcggtcaattgattctgcttttattctttcttgctgattgcaagatcaagggcttgtttggttggtgacctgactgacttgcctgagaaaaatccatgcctgtgtggtagaaaagctgtgttttattgtgcctgattaggcatgtgtgatgttttgttgtttggttgaaaacctacgcctgagtgaatatattatatataaacattttgtttacttgagtaagatgttgacaagtgttgatagcagtcatatcaatgaagaatcaatgggggaggattagacacatacccacgcctgactcaggcgttcatttttgg

SEQ ID NO: 39181 - DNA, 1647 bp, Oryza sativa
aagaaaaggtgaccactgccccagttctcaccttgccagatatccgaaaagatttcgagatcttttgtgatgcatcaagacaaggcttatgatgtgtcctaatgcaagaacgaaaggttgtggcctatgcatccagacagctcaggcctcatgaagtcaattatcccacccatgatctcgagttggcagccgtggttcatgctcttaagatctggaggcactatttaatcgggaacagatgtgaagtatacaccgatcacaaaagtctaaagtatatcttcacacagaccgagttaaatatgaggcagagaagatggctggaactaatcaaggattacgatcttggaatccattaccatcccggtaaagctaacgtggtcgctgatgcgctaagtcgcaaggtctattgcaacgtagctcaaatatggcctgaccaagatcgcctgtgcagagaattggagaagttgaggctgaccgtggtacagtcaggtgtccctgccagcttgacagtacagcctaccctagagtcgcaaatccgggaagcccagaaagacgacgaagggataaaagagttaataaaaagaatacaggagaagaaagacaccaatttctccatagacgatcaaggcacggtttggtgcggtccacgcatctgtgtaccggccaagaaggagttaagagatctcatcctaaaggaagctcatgagtccgcctactccattcacccaggaagtacgaagatgtaccaagatatcaaggcatacttctggtgggctggaatgaagcgagatgtcgcagaatacgtagccctgtgtgacgtttgccaaagagtcaaggcagaacatcagaggccagctggtctgctgcaacccctatcgattcccgagtggaaatgggaagagatcggaatggatttcatcatcggtttgccaagaacccccagcgggtacgactccatttgggtaatcgtggaccgactcacgaaatcagctcatttcgtgccagtgaaaaccacctttgatggaaagaaactagcagaactctacatgacccatgtcgtatgtagatttggctgtcccaagaaaatcgtgtcagaccgaggcactcagttcacctcaaggttctggaagcagttgcatgaagccctcggaaccgatttaaatttcagtacggcctaccatccgcagaccgatggtcagacagaaagggtaaaccaagtcctagaagacatgctacgagcgtgtgccttggatttcaaaggcacttgggatcgttgtttgccgtatgccgagttctcatacaacaacagctatcaggccagcattcaaatgtcgccgaatgaggcaatgttcggaagaaagtgccgcactcccttgtgcttcccggagctgctcccttaggtgctgaatctcgaggtcgagattcttgttaggggggttggtctgtagcgcctgttccgtcgtggcgcctagcgggaaaattatctcttaaaaaccctaattgcgaaatttatttctttgcttgttgtctagtgtccgtgccatcccaagatctcaatccccgatctatcatcgagtccaatttcgaatccaatccttccaaattaaattcctccgcaaaagtctattttgcctcccccgggggtcg

SEQ ID NO: 39182 - DNA, 6494 bp, Oryza sativa
ccgcccgcgcgcttgcgcgtgagccgccgcgccgagcgcccccttcccctctcctcgctctgccgcgcctgcgtaagccgcccgcgccgagccaagtcctccctctccactccctcgctgccacttcccacgcgccgtgttcgcgtgcgcacgcccgcgcggacgccgcccgttgcaagccgcgcgcgcatgccgagtggccgaccgcccggtcgccgccgccgtcagcctctgcacgcgtctgtcgcccgtgtcgtcgcgccgctccaaaccgcccgccgtcatcgccggtatcaccggccgggccccgccactccgcgcgcaagccgccaagggacggaggcagcgcccctcctccctttggcgcgtcgcccccgctcccctcctcctttttcccggatcggcaaaagggcaagcccctttctccccctcctttttccccttttcccccgccagcgtcatcctccctgtcgccgctttggccgcgaccgctgagcgccagctcgcgccttgaccgccctaagttggttcccaaaccgacattgccgccccctttaaaccccagctccttcccctccaatctccctcgttttcgcctcctcgccatagctgccgcccccgtgctctgttcgccgtcgccgttcgttgttgcgcgtgtcgaaggagtcggcacgagcaaggacgcggaaggggacttcggccgcgccctctccttcctcttccccggcccgaggccagagagattactcccgcgccgtcggcctctcgtcacagcgcccctcctcatctcggtgatgcctccctccgttcttccgcctcgctccatctcttccccctagctttcggtagtagctcaagtagactccccgtagttagccggcgtcgccccgaccgttgccgtcgctcgccgcgtgctcgccgccgtcgccgctcgagctccgtagcacccacacgtcgccagcctcgctcggcgtagctccgtccaatccgacgctagcatcgagttcccgaaaccgcgtagatgctctcaccgccgggaatcgacccctcgtggcctcgccgccgtttccctcttccctccccgccggttgtcgccgccgcgattcgccgccgtcaagcttcctccggcaaatccgagccgttggctcgtctcccctcatcacgagcaaccgcccggtgtgctcgcttttgtccgtatcgccgtggttcgctccgccactcggcgccgccacccgccgtccattcgcggccgggtcgtcgtctacctcccgccggcccgcgtggaagccacgtaggcgccacgtcggcgccagctcagcctagaccgggtcgagccgaccccggtctgtccctccccgtgcgcgcgttccaccgcgagccgtgaggctgcgcgtgggcccgccgcatccgcgtccaccgcgaaccgcgcgcgtgcaccgcgtccctcccccgcccgcgcgcatgagccgcgtactccctccgcacggtgagccgagccgctgacaagcgggtcccacccgggaccgcgcatggtgagcccggtccaccggctctctctctcctccctcccgcgcgcgcgcgtcttgggccgctttgggccgccttcttgggccggccggcccgttaagctcggccgagccgccctttctctcgggccgcgccctagccgccctaggaaagtctatattccctccctctccccttttcttttctttttcttttccaaaaaaaaagagatttaattaaatccttttcctttagaccaaaaatccaataatcttagaaattcaatatcttcccaaccgtaaatccgtttgactccgttcgaattccaaaatttctcaaatctcgagatctatctaatggcacgcttagaggtcattaatagggctttattttcgccgtttgttgagttatcccgttttgcgtatagtttcggagcccgaagacccgtagtgcgaggatttcgaggatcaagctccagatctcgagcaaggcaagccacctttgaacatcttgagcctatatttgaaatctaattatattgcttgcaaaatattatgcattgataggattgcacttaatctgttgttccgtctgcaaggcagattggcagacctacctaacttgttgcatttgatccttccattgttaattgctataccatttccccttgtaaccatccagttgcgcctcgatattcgtgcaccctgtgccagtatcgacggtcgccttcaaacttaaaatctgagtaacaacttgggtaaaactggagttttacaaaagacttggaaaacccgacacctgggtcggtgcttgcgaactaaatgaatttccaaaaccgcagaccgggaaacgtaccgggtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatcggggttagtaatgtcgtgtgggtaaagtgtaccccctctgcagaggttaacaaactgttcgaacagtcgtgcccacggtcatgggcggatgtgaggtgattcctagcgtagtttggtttgactactgcttgtgaaattgctgtgtgaaaaggggttcggtgtttgaaaaatctgcagctgatgggatcagctaggcccgggtggccgtttgaaaagttgttggcccgggtggccgttgaaaaagctgttggccgggtgccaatcttgtttaaattctaaagactgatacattgcacatactccgaccggacgagacgcactgtctcatccgtgtcgtttgagaagcactcacttagttgtttcagaaaagagttcaaataaaattaattgcaaaaacaccagcctttccttgaagcctgcattaaacacttatttcccatggcttgctgagtactcccgtactcacccttgctctatataaataattccccccccagttgctgaaaaagatgaagcggatcctgctgatgaggagttcttccaggagctagccggctacgatgagttttagggtttcggcctagttcccaagtcgcgcctgtgttgattagtccaagtcctggcttccgctttccttttgtaatgcagttgtgagctcgggatctgtccgcagcccaacatgactgtacatctactctataataaagagacctctgttgctgtgatattctgtctccctgtgataccagcactgtttcctgggactggtatcgattaacaggttaatttggagcgtcacgggctagttccggtcgggactagttcggggcgtgacaagagatggtatcagagcacaggcttggccctagggcgaaacccgacgcttaggacgaccctaaggatactaagttcaaaactacttgcgaaaagctaaggattcttttgttttctttattttcaatagtttgtttctaaaatggttactgatccttctccctctttcaaaattgtagatggcagtgaacgccagcttcagttcccacggttttggtgagggtcaccacgtcgctcagcttcgtgacctcgcccgtttccttggcttctcgtgtcccgagtacacggggtactctatggaccgtgttccccctcactgtgagctctctgtgtacctttacccccatggaggtatacacggagctggccttcgcccacaccacttcactgtggctaggcccaccctccagatcgcataccaggacctctcctggactgcgctttgtcgcctggcccacgactacagccaccgtctcggaggctccgccttccggcagcttccacgccttccttctggccactcagacgccaggtacccttgtccgtacagcgagtctcagccagtactgactcacatggttgagctttcggaggctcaggccactcagcacgacctactccttgaggcttaccgctcccttgcccgccgctacgccgctctggaggcccgtctggccgaggagggtgtcacctcagttgacactgtctcttgggactcaggtcgcctctgccacgccagccacctgtcctcccacagctcccgcggctctgcccgcactcccagtggcccgcgctcccccagctcgcgtgcgccgtactcaccagtgtactccccctacccgcacccagttagcccttcctacacccccggacacaccccagttgcttcctcccgccgtggcccacgctttatccgcactgcgcggaagcgtgttgttggttcttccaccgtgttccgtttccactacccagctcccctaccgccagcggcccgtgctgctgtcggccctcgacaggttccgccggtcccttcgcgtcagccgatcgacgtttcttcgactgaggagccgactactggaggcagcctggccgacgaggagtagaggaggcagtcttcagcagccgtccgtgtgttaggcccttttgttccgccgccaactcttttggagtcgtggcgaggtagtgcgtgcgtgagtttgttgtgggtgttgtttggtagctggttctcctaggtggtgtgcgcacagtcaagctcggcgtagctctgtgacttgtccacacccgttgtatcaggtgtttttatgatttgaaaaatccagtttatgcctagtgtgtgctatctgagttgctatttactttgctccttgctctcctaagtgcttatctgactcttcccccgcccttttctgggagtttagatggctagccgcccccgccgtgcagctcgtgcaccagcccgctttggttttgaatatggtagaaccgagccggcagcaaatcatgagtcagctaatgagcagtctcaccacagcaaccgttcacaccgtactgcttcccgcaatgcagaagttgagcaaccccgccgcagcaaccgctcgcatcgcacagcttcccgtgatgcagagatggaacagtctcaccgctctcaccgcactgccagtcacaattctggagaagaacgccttccttccccacctcatgtggaaaacaacatgcagcacttaatggcagttcagacacaaatcttgcagggattaaccacagccatagccagttttcagcataatgcgcatggaaatggccaccctcacgtgggcaacaatagatccaagctgacagactttctgaggtctcgtccgccagagttctctcagaccgtcgagcccgtcgaggctgacgattggctaaaagatgttgatagaaaactcaacttagtgcagtgtactccggttgagaagacgctctacgcctctcaccagctaagaggacctgctgcagattggtgggagaattactgcaatgcacaccctgaacccactaacattgcttgggatgagtttgctacggctttccgtacagctcatgtgcctgaaagcgctattgatatgaagaaagaagaattcaacagacttaagcaaggcaacagcagtgtcaatgagtacctaagtatgttcaacaagttggctcggtacgcccctgaggaagtggacacagacaagaagaagatcaggaaattcttgaaaggaatcgcagttggaatgagactccaattgattgctcatgatttccccacttttcaacatatgatcaacaaggcacttctactcgaggatgctagaaaagaggctaccgaagaatacaagaaacgcaagtctaaccatcagggaaattcttcccgaggcgcacctcgccctcgctacggacaacccatgcaataccaccagtcggtcactcaggctaaccgccaaccaggctacgcccctcgtcctcagatgaaccgtccggcccctcagccacagcagcgtgcccctggttgcaatactgcgccaaacagtgttacctctttcaagtcaccgcagggaccgtcagcagttcagtgtttccggtgcaaccagatgggtcactatgctagacagtgccctcagaaccctaccaacaccaactcagggcatgcgaatggcagcactgccagaactcctaccccagcggcagctcagtctcgtcctagctctcaggcaagtggacaaggttcacgtgtttccaacaactttggtcgaggccgggtgaaccacattcaagctgaaaccgctcaggatgctccagacgttgtgatgggtatgttctctgtcaactccgtacccacaatagttctgtttgattcaggagcttcccattccttcatatcacaagcttttgtgaaaagaaatggttggaaaacccaaaatttacgtgtaccaatgat

SEQ ID NO: 39183 - DNA, 20689 bp, Oryza sativa
aggtctcccgacgtggctgatcccacgggctgggtgatccgggttagtaatgtcgtgtggtaaagtgtaccccctctgcagaggttaacaaactgttcgaacagtcgtgcccacggtcatgggcggatgtgaggtgattcctagcgtagtttggtttgactactgcttgtgaaattgctgtgtgaaaaggggttcggtgtttgaaaaatctgcagctgatgggatcagctaggcccgggtggccgtttgaaaagttgtaggcccgggtggccgtttgaaaagttgttggcctgggtggccgttgaaaaagctgttggccgggtgccaaccttgtttaaattctaaagactgatacattgcacatactccgaccggacgagacgcactgtctcatccgtgtcgtttgagaagcactcacttagttgtttcagaaaagagttcaaataaaattaattgcaaaaacaccagcctttccttgaagcctgcattaaacacttatttcccatggcttgctgagtactcccgtactcacccttgctctatataaataattcccccccagttgctgaagaagatgaagcggatcctgctgatgaggagttcttccaggagcaagccggctacgatgagttttagggtttcggcctagttcccaagtcgcgcctgtgttgattggtccaagtcctggcttccgctttccttttgtaatgcagttgtgagctcgggatctgtccgcagcccaacatgactgtacatctactctataataaagagacctttgttgctgtgatattctgtctccctgtgataccagcactgtttcctgggactggtatcgattaacaggttaatttggagcgtcacgggctagttccggtcgggactagttcggggcgtgacaaaccgggtatcaggtaccagagagtacaagtggacataccaggtatcaggtaccagggagcacacggggacaaagaaaaggaaaagggacagtcacttaaaatatcccgttgcaacggtatcccgttgtgtaagcactatggtacattcaaggaattatcacctatgaagcactgatacggcaaagcaggcgcgtgtctgtgtccgacacgggatcggatacggacacgtatcggacacggccggatacgtgtccgggacgtatcggtatttatcctgattttaaaataaataaagtaattcatgatacatttatgagacgttccgatacggtcccgattcgtttaaccctaatatttcgtcggtatcaaaacccgcgtgcgtgtggggggcatcatatccacccagcctgcgccgcctctcaactctcactctcgcctctctttcccaacgctccagcgccgccgccgccccatcagccattgccgccgacgggctgtgccggcgccgccacactgctctccacctccgacgctggcccaacactgtcaccaccaacgcccctcacgcgctccagtgccgtcgctgctgccgggctgcctcgtcaaccgtcgccgccgccgagctgcaccggcgccgcgcactgggctgtgcctcgccgcctcctactctgacgtcggcacagcactgtcaccgccgatctgttttcccgttcgtttattgaattgaacttatagtcttgaacaagtctatcggtctatcctaattattctatttgtggctgtgaacttgttatttataaactagctatgtgcctgtgccctgtgggctggatgtgaacttgttatttgtgaacttatatggtcattgcgatgtttggatataccgttgaactattaatttgtggtctatgcactatttgtggtctagcacttattcacaatctatttttaccctgttcaatttactacttttctgtatttttattttttttatatatattagcgtatccccatatccttaatttttggaaaatgtcgtatcgccgtgtcgtgtatccgtgtccgtatccccgtatctgggtaacatagattatcacaaggtaccatggtactggtacccatgatatttggaggtaccacgagatatcatagtaccatataggtttcatgggtatcgtctatatttaatctgtataatacatattgtaggcgtatccagggttaacacttgtagaaaaaaatctaaatttcagcaatttcaagacttttggaactttttgcacgaaattatttagaattttaacaaattttgattaaattttaataaaatttgaccaaattcgcaaaacaaattgaagaaaaaccaaaaaaagggcgagatatatatcatatagatacatatgaataatatctacaagcaatgaaagtcgagaagaagataataggagaagagttggtctgggatggttgcaactattttgcaggtgatacttagaaagaatagtagctaggacactagcctgcacactgctgccctctagttagctttgaggttggcacaagcacatttggcgacgttgctctccccttcgctagacaggtacgcacgcgtcgtgcgatcttctcagctcggcgcaccacgcgtcaggtgtaatgatggatgaacgtgattaactacattgtccctccgacgggacaccgttctatagtttttctgcgggaattatgctacccagctataacctcggtgatgggaagacgagtttcgttaattactccctcgttttgaaatgtttgacgccgttgactttttaagcacatgtttgaccgttcgtcttatttaaaaaatttaaagtaattattaattcttttcatattatttgattcattgtaaaatatatttttatgtaggcatataattttacatatttcacaaaagttcttgaataagacgaacggtcaaacatgtgctaaaaagtcaacagtgtcaaacatttcaaaacggagggagtagttccttgtcccgttgaaattgtaagtagaattggcacgcgcagtagagggtcaggatcagcagtagatacaagactatggtcccctttgtttcttctttaacaagtggatgaaaatttggatactcatagcacactcttcaaattattaaatggtgcatttcatataaaaactttctatatgaaagttgttctaaaatatgagattaatccatttttcaagtttataataactaaaactcaattaatcatatgttattaccacatcattttacgtgaaccacttaatctttatcttcatcttttagaagattcaaacaccacccataaaaaacaattttctagacagtcaaatggagttttcgcagaaggatctgagcactgcctataaccaaacgactcttagaaatcgttactacctccgtctcaaaataagtgcagccgtggatatccgtgcccaacatttgaccatccgtcttatttaaaaaatttgcgaaaaatttaaaaatatttagtcacatataaagtactattcatgttttatcatctaatagcaataaaaatactaatcatataaatttttaaataagacgaacggtcaaacgttgtgaataatgcaaaactgcacttattttaggacagagggagtaatttttaaggcgtggaaacagccggcggtgaaaatcaaaatcacaggcgagagcgtactaggacacctgtcagtggagatgcatttccacatgcaggcatattatgaagctcgtctataggatgcattttcagcaaaaaaaaaagtccctaaattcaaattcacattcaaaatccccaaaattcttgtacttcacacagcaattcacacaaaaaaaatccccaaaatttcacctatattcaccacaaaattttgcctaaaactgccctgacctgccgatagcgaccccacgccattgttgtggtcgtcatcacggtcgcctagccaaaggactcactgcggcaccaagccccaccactgacagacccatagctgcagacctactgaggtactcctgaggatcgccactatcggatctgacgctcctgtggcctgctcactacagcaggaaggggctttggcaacacgtacatgtggtactacatatcagtataggtgttacaagcgttcccagtaacacaatctataagtgttcttgtaggccatgttactggtacaatacgttgcaacatataacatgtattactatataactaagaatgtgttgctaccttgtaacacacaaatatcacctataagaacacatattatgtgatactgcatagtaccccaggaatacataatttgagttgtagtaacataaatgtaatatgattagcaacatgtttccttattccaatacattttgtgggaacaaactttagtatatacatattcacacacacacacgatcaggttaaaggaacaaaatttaattgacattattattttctttcaaaagcaccacatatctcacaaaatactcacatcacatttagtgaaaataaagattgcattgcataacaaaatagttaaaacatccttcccatcattacaaaacataaatgataatccatttgagaaaagcaagtcttcagaataacagtctttcatactaaaatataacaaaatgataatctattcgtcttcttcttcttcttcttgaaagtctttgccggtttatcaatccatagggtgagatggaagcgaaatcaaccattaatcttccaaacctgcacgtagcaaacattactttggttgttaagctagaatgtacagcaaaacattaagttacatgaaccaaggtagaaacaactaacatacacatattgaaggccacgcaatcaccactcctttggcatgggcatcattaattgtcttgcaatgatccaatggtcttacaagctcctcatttttacgaataggatggttgattcgtactttccaaaaatggttgcctatctcaacaccacctacatgtgaatatgggttgcagctcaacaaattagcatatgccacgccttctttatttggatattttgctgtcatgagtaatactgtggaaccaacctatatttaacatttagtcaacaacctatatttaacatttaacacacacagtaatgcaaaaggaacacagtgttattacctccattggtgaagggcgcgtcttctttgaacgcacacggctttgaatcacttgatcatgtgcattgtccgtgctctttacgaacattttctgcccttctttagccatctacagtgaaataaatagtatttgtcacatggtatcagtatggatactcaaaaaagtcacagtatggtattttttttatatctacaaaaatatgtacctatgatgccatcatttggctatcttcaagatagtttattttgttcatactggaaataaaattggggagtttatatacatagagattagttcataaataggaacaaattttgtgtacattatgatgtagctaaactcgtaatggtagacaaatatagaaaagtaagcttgtattcaaaatagataaaatactataaactaaccattatataatttattgaagtgatacagtagaaaattattgaacaaatagatctattaaattacaatgcctgcagctttgttatattttttcaggtatttaaatgcttaatctgaaacaccctagacaaaataaggcaattaactagttccaagacaattgctagggtttcatcatgtcgtatccttacttctagagagtgacaacaaaatattttatttgacgcatatatatcacactatatctgaaaacatttacctcttcttgtcgaaaggaatgagcggaccatggtgatggtggtgcttcttgataatggggttcttcctggtttgcatcattatgatactagaattgtcataaaaatcatttatcatattgttatagtctttttgttgctataaaataattgtagtgccctttgctaaccttttcagtagagaatgacaagtcatcgtcctcatatatgtcctgttagtcgatcagaatttgatgattctttagttaaatgtagacacaatattttttaattagagttaatggttgtgtttccgcacgtgcgtacatatgagtactatgaattatggggcaagaatcaatttagtaacaaatattaccttgaatggatatctttgctgactcaggaggtcttctcgatcagctgcgtcgcattggactctctaaatttaaacaaaggtaagaataatacaaccaaaataacattattggttggaagctataacaattacctttcttttagaatgtactgcttgtagctgagagttgctatgatatccttttagtcgattgacctgaaaaagatatcaatttagaactaatttttgtatgaaggttcagataaaatttgtacctttcttagctttttttttttcaaggacaccttttcctgtttgtttttcctatcagtcttttctttaagcagttgttgaataagctgatcttgcttctgtgcatgctcctttaacttctccacatcatcaataatatgtatcgctacttcatgtggtgtaccctctacggtagtgatattaatgttcctgagatggtgtgatgtttggccataaacatggttgggaactggaagtagtcccataccatgcacttgtccaggtttctcttcacctaaaacttgatgtaaggcatcacctttccatgcaactcttccttgatcatcttcatccagctcaggttgttcatccatgaggctttccaactcagcctaacagtttagaaaaattggatcagatcaaataataatttgtttttaattgtagtagcatattatgtgtatagcataccaggtgttcatttctatcttcggcccttttcttgtgggttgctaagtaaaccatggctctatgcggctgcttcttttgaggatcatcttgtctctgaaaataatagaacatacaccagttatatgagtgacttatataggacaacattgaataaaacaagattactcaccatgtccttagcccaacgagcgtagctctttgtccctgcggtatgtgttgtcttcatcatggcacgactgcttttatttttctcacaaagggcctattataaacacagtgcactattaatgagaccatatcatacatcattaatttagattggcagagtattaaattgtaagcgaaataatgtgcagttgtatcacctttcccttttttgacttccaaaatttgacaagttcaacccattgatcataatcgatatcttctggacacaacttatacaaagcagatcttttctttttaggctgaaaataagctgtctttagtgatgccttgaatcgcctccaatctctccctgttgacttcaatatccattgcttgcacgattgagggtacaagaactttgtctaaaatcagtaagatatactaagtaaataaatatgttatgttttttatgttatgactgctttatgtaaattatattcatgtgggaaagagataaaaggcagagcagtaaatttaaaattcagagcaatatgcctagatttttgctcagtcacacatacctccacaagttgaagtattgtttcagctccaccattctttttgaccaatctccaatccttcaagtcaaatggacagtaagacccatttcttgccactgtgcctaaaaattttcctaacagtccaccttctgctccaatgggctgtccaagcttgttgcacttcactactatgtgattgccttctggaaggttccaaatatgtgttaaagttgtccttccacgtttgtcttctttggcactctcacctgtaaaattaaacaagaacagtagtggctaagcccagtttttcaatataaacatttagttggtcctactagttttagctttcttcattgtattcgtacctgacatattcaaggagtcatcatcttgctgctctagttcgatctcatcatcttctagtgcttgtgactcatgcaatgggttatgttcactgatattgccatctccactcttgtatttggcactgatttttactacattcaaccttttcgttcttgccatttcacctggaaattggtgcaatgtttctggaaaatatgctacaaaatgaagttatagtaattagtgcttttcatgcaaagcccataaatagtcacagaatatggagaggaaaatgataagtgatcggactaccctgtgatttatatccttagaaccctatagtccctcaaatcctcagaataatttacaaataaccgagcaagagaagaaaaaaacacttacatattgtctcaggaagtcacaagcagcctagcaacatgtcttcatggtgaagctacagggcatgtgcaggagacgcatagttctggaggacaggagaagccatgctgtgtgcagtgctcttgatggagatgggggagtttgttcaggtgggaggacggggaatgaggaaatgtgagaacgattgggttaaggatacgaagaggcagcaattatttatggtgcatgggaagttgaagggacacactaattgcttgggatttttggagggaagctaaggtttcacgttagcgggaagtattttgagagggagatttgtgtgcaaaaattcaagttctggagatttttgaaatggcatgttcaaacattttagactttttaaaattttaaatttgatccctaaaaattactacagcactctaagtactcactacaatataatgcttatctaaacaagaaccaaccatgtagcatattaatattgttttcttcagtttaaggtacatattaatattattttttcttttttcttattttttagacttatgtggataatttactttagttttcataccgatgtattatattacaaattgttgttttattgaatgcgtactataaattttaaatttttgaattagtaaaataaatcggtggtcctatataaaacaagtagctcaaggcaaccgcgcgagtgcgtggcgatgattggtgcatcgaactttagacttggcctgttttagtagccattattagagataaaaatgattcatatattttccgatattcggacacattttcggaaatagatagtctcggatagataattttctaacagtagcggatatgaaaattaattttgtaattgtttttggaaatggaaacgaatacggtaagaccattgtccagcggaaatcaaaaatggttggaaactattcgaagttctatatttaggaagctcaatttgagggggttttatattcacaaaattggttctatggcatcgaaagttctctttttttgttttataattctgaaagttcctaatttactttattagcaccccaaatcttccctctgttcctgtaagaaccctttccgtccaactcatcccgtttcctgtttctctgaccatggttgacttacattgtgttcggctacttgagatgggagctatcccctcgcgcatgagataaactttcctaaaacataaaaggaaaataataaacttatcctaaaattaatcgataaatagcattgccgtactttcttcaaactcagtctcctttcaacattcaccactatcttttccagaaccaagtccgacaaagagtgagctttcagccatcatccatccctcgtcgtctaactctatcatctcgcagccgatgcattccatccgatatagacccatcagcctcagctgatacaatcttagaccctaaattcacgctgtcgactttgctctacgttttccttaattacttaatggaatataccaaatttcacggttaacacaagcttgtcttcatcccacttgatatgaaaaggttatgcatataaagaaaattagttactatttgcggatatccataaaaagaactccggatagtttccaaccatttcctatttccgatggataatggccttaccatatttgttcctgtttctgaaaagattatattagtattcgtttccatttccggtaccatctgaaaattatccattttcatctaaactagtagggtggcccgctcaattgtgtggttagcacccatacgaaattatctattcattcttctcggatctattttaattaatcttgtattgtgttttatatggtctcttttaatattcattatttttattttaaatttcagttgtttcaaaattgtatttctacttgaactttcttttttattttctaattttggatttattttttattttaaattttaattaatctcgtattgggtttttatattgactcttctttcaaatttgcttatttttaatttcgaatttcagtagtttttaaattttattcctacttaaacccttatattgtttttatttataattttcgattttattttattttgtattccaaattttatttaatcttgtatgggcaagaaagagaaagaaaaagttctcacgggagagaaaatttccctccaacagtccaagtccttttgactgaggacagataacaaagaaacagtcttaactctcctacctcctcgattactgcatctctgaaaagctacaagcactgaagcacctctgttctcacaccacccacctaccagtacaccatatgcttgctaggtataaggaaaatccccaaatcttgtcttatcttagttcggtggacaccacaacccaacccagaagatcaacggcagtttagctcttcttcgtcggtcctctgcgcaggtgaccaccggagcgaggcggccaagggaagtgggctgcgcagcagcagcctgcaagcgtgggcgcgcagcgcgtggccgtgcaggcgtgcaggtgtgccggccggacaaaccagtaggcaggagccaaggaagagctgctaccagcttgctcgttgccccaacttgactcattgcctgccacattgcttcttgcggcatgaggcttgcttgcatccagtgagtgagctctattctgttctttattgtatagtgacaaatgaggttgtgaggagatttgtatatgatttactggtatatttgcaaattgcaatggagaagaaaatagcattgcttaattactttacaaaggattttttatgctttaaattttttattcattcatatctcatttgctaggcgccaactctgaatccttagtttctttgggtaaaccatttccctgaagcccgttggattgagcttctagacaagcctgctgccctgcagcttgtctggtcctgttatggagacaagggctaaaggatccaagcaccaatccaccaggtatggtttccctccccatgtattcttgcatttcgatagtcaacaagaacactggttcttcatctgtgtttggatgcacttgttggtttttctaccacgcttgccctatttgaataagtactatatttttttaaacacagggaatgggtcgatttagccactattaagaagttactactttcccctagaccaagtgatgactatttgactggtgtagatggttttcttgattttgcatacaatgggaaaagttctggagagaaaatccgatgcccatgtgtcaaatgtgctctaaggtggttacggaaacggaatgaagtgtatgatcatttagtttgtgatggaatgctaaaagaatatacaatttggggctgtcatggtgaaactgcagcattcatctctgctaacagagaggcacagttgcaagaaaaaacaaaaactaatatgcaccagttagtcatagatgcttttgggcatatggataatggacatccaatgaattcatctacttgccaaaattcctttgaaacaggaccatacccttgttacgtcccaaaacgaccctaaaatatatcctttaaattatgcctagaataattaaaatccgtgtgaaagcgtccaaaaattaaaatgtgcaaagtaaaagaccaaataaggcttagaggatttttgtatatttcctaaaagcctaaaatgtgtaaataaattttagtggaatttttagagcacaaataataattgttaagaaataaacaaagttaaaaaggttttataaaaaagaaaaaccctaaaaatccccttccctctcttgggccgaatccggcccatttccctccccctctctcctcttccccgcggcccattcggcccctccccgcgcgcgcgccgttgacgggcgggcccgcccgccaccctcgctgacgggtggggcccacctgtcatctcctccctcccgccgctcccattgcctcgcccgcgccaaacgccgagcgcgacgcgaatcccgtcgcctcccgccgtccccgcgtgcaataaagtggggggaaatattccccgtgatcccctctccctttccccccattttcccctctctctctcgcattcaaacgggcggatttgctcctgcaaatctcgccggcgccattgatggcagccggacctcccggccggtttccttcctctcccggccgccctctccccttccaaccctatttaaacccttcccgcacctcccgcgcccgtttccgcccctcgccgcaccgtctcctcgccggaatcgagctcgcgccgtcgccctctctctcctccatcgccgacgaccttcggccggctctccccgctcgccgggaccgtttcccgccccggcgtcgccttctccggcttcgccgcaccgccgccatccccgtccaccccctcgtcgagctcgccgaccgccggagcgccgccgaccccgtcgacccgagccgcgctgccgccttcctccgcttcggcagcctttttcgtcgtcgccgtcgacctagggtgagccgtggaccgccgcctcgtttccccctttccctcccctctctcggccgccgttccgccgtgcctatggccgccgccggcgaccataggggcgcgggcgcgccgcctcccgccggctacgccgatgtggccaccttcgggcgcgtcgagcggctgccgcgtggggcccggccgtcagccgcccgcgccctcgggtgcggctgacgcgtggggcccacggcgccagccggtgtgagcccgggtgcacccggtccaccgtggaccgtgaggctgccgcgtgggccccactcccgtggacccggtccgcgcgcccctccccctcggctgacgcagtaaaccaatttttaaattaaaatttaaataaagaaattcgcaaatattcatttaaagagcatataaacttcaaatggccataacttggccatttgaactcggaattggaccgttcaagtctctaatttttccttaagaagtcaagaacccatttttgtgctttgttccttcttgttatatggagtttattagagtaaaagcctttttcctttccgttagtcgtgtagacgctgcagcttcggaagatccgctcttcgtggaggttgaagccgacgtttgggaaagcgagcaaggcaagtcacatcatccttgaacatattgaattccagtttataaaattattttgatttaaattattgcattatcgctttatttaaattcccgcgttatcactgttttatttagccatgcctatttacctttgttatgatcttattattgttattgttattattaccttgtccaccctagaataaacaaaacccccaactagtggatactctattcatggtaccactagtataaatttaggtagatgcttcgctggttaattaggcaacattaggtggttttacaactctagactttgggaatattctcatcacctggacactatggaacggttggattattgtggatttggattcacacctccccctctattcaaaatcctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctagggcaaatgaaggctacacgagctgcggcccggtagtcgagatgtcatggcacagggccggtgtcctgctgctaagggctcagtcctgcctacctgtcccggaggttccggccgtaggtggggttgggtcggtactcttgtctatggctaggatgggttggaaactatgtcacgtcctccgtccgtataccgtggtggtatgtggcatgtggttacacgtgaggaagatgtgtcttgtgggtaaagatgtacacctctgatcagagtataatctattcgaatagccgcgccctcggttatgggcaagcctagcaatgtacccaagttagtgttttaattcttaaaacctgcttaacaactaaaatatggaatggttggcctgggttggcttgggacgagctgggacccagggtcgggttgccagttcggtctgaatcatcgtaggccttgggttaaggcaggttcgtgtgggttcacggccttgattaataatattgaatagctctaggatcgtgtttacaaaatagctttgagcaactaagtgtcttttaatgctgtttactgcaaaccctaaccccctatattataagtcccttgtactcccttgcatttatactgcacttgtgggtgtgtcttgttgagtacggtggttgtactcagtcttgctcaatttttcccaaacccagaagaggagttcctggaagatgaaggctttggtgtctagctcgtgcctgccgtcaagcgcctgtggtcatcgccctagtcttccgctgtttttcgtttgtcttcctgtgtgctgggccttcgccgcccatgtaataaattaattatttacactttcgcttattaaactctatattgtatcaacttttggtgtaccttgcctcctgggacaagaaataatacacgcacgtaaggaacgcccgttgggttatttccggtcgtgacaaccctgaaacccaagctttctttgacttaattagagaggccgaccaacctttttggccgggatgtgaactttcaaaactttcattccttgtgcttttgttccatagaaaatccattaacaagtggagcaataaatcattgaatgatttgctagcaattttgcaacaagcaatcccaaatggtagcaatatacctagaacattttccgaggctaggaagataattggaaaacttgggcttagttatgagaaaattcatgtttgtccaaataattgccaactataccggaaagacaaggctaatgatgacttttgttctaagtgtggagcttcaagatggaaaaacaaaaaggataaaactaaattaactaagaaggaaagaaagaaggcagcaccaaggaaggtgttgcgatactttccaatcaaaccaaggcttaagaggcttttcatgcacaaagaaacagctgcagcattaagatggcatgatgagggacgtgtaaaggatggggcattgcgtcatccagctgattcagaggcttggaaggcaattgattctgagtttcccgagtttgcatcagattctcataatattaggtttggaatggctagtgatggtttcaatccatttggaacgatgagttcaagttatagttgttggcctattgtcttaataccttataatttgccgccatggttatgcatgaaagcttcttctctaatgctttctctaataattcctggtccatcttatcctggaaaggattttcatcttgcatattctcgaacttcaactctaaagaagatacaagaagttccagattttgaaaagtcaaaaacatggaagggtattagtggtctattttctttgccttactgggacattaatttgctccgtcacaaccttgatatcatgcatattgaaaagaatgtatgtgataatatatgtgggacacttttaggattggagggcaaatcaaaggacaatttacaagctagactagatctgcaagatatgaacattagatcgtagttgcatccacaaagacgtgctaatgacaagtattacttgcctcctgcttcttacaccatgtccaaaaaatgagaaacaacaattttgtaaagtacttcatgacataaaggttccagatggctatgcaggaaacatctcaagatgtgtaaatgttgagcaaggaaaaatttctggccttaaaagtcatgattgccatattcttatgcaagaacttcttcctcttgctttgcgaggtgtacttcctgataatgttacagctgtcttatttgatctatgtgggtatttcagagaactaaatgcaaaagtacattatatagatgagcttaagaagttagatgagagaattaaattgacattgtgccatatggagatgatatttccacctgggtttttcactattatggtgcatttggttagtcatttattagcaactggggcattattaggtggtcctgcgtgttttcgtactatgtactttgttgaaaggtatttctctctttcaaatattaggatgtattctttattttacagcaacatatttaacacaattttttctttgtgttgcctgacttcctgtaggtaccttggtgtgctgaagtcatatgtgcgtaatagagctcatccgaagggatcaatggctgaagcatatttggcagataagtgcatggttttttgttcacgatatcttgatggttttgagactaagcataaccgtccttcgaggaatgatgatacacatgagctagatagttatcctattgtgaaacaaggatcatcaatattttctcatgttggaaaaccacttggaaagcctagcaactatgttataaggggtatggctaaagtacaagcacatcgatatgtgttgttcaattgttcagatgttaataagtacttgcggtatgacctgcaccttaaagcatgtttagttatcctttttatgataggaaggttgattataaatattttgcagagctcatgctgatcagattgcaagtacgtatcctcgacgtggtgtcaatccaaaaactattgagcgtgtacaaaatgagaaattccatgaatggtttagagcacatgtaagtacagaatttcagattatttatatataatactcaagtcatcacctaaatgagttctcactgtacagataatggatctggagcggaagaatggcttgcacattgtcaacgaagatgttagatggctagcccgtggtccacttgatgcagccaaacgatatcgtgcttttaacactcgtggtttcagatttaggcctaaacgcttggatggagtgacacaaaatagtggggttgtgctaactgcaaaaaaatctagctacactaaagcaagtgacgctaatccaattttaggtgatgttacatattatgggaggataatagatattattgagctgaactactctggaaaattttcagtggtcttatttaaatgtgaatgggtggatgttatttctggaaaaggaattaaaaaggacaaatatgattatacacttgtcaacttctcacatcttatacatacaggagaaaaaattgagcatgagccttttattcttcctaaccaagctgatcaagtgttttatgtggatgacccaatgaacccagggtggtctgtagtaaggaaaatgaaacccatggacatatatgatactggcaaagaggaatggatagatgagatggaagctgagccttttcatgtttcacacctcggggagttattcgatcaatcaaacaatcaacactgggttagagctgatgttgaaggaacaatggttgatgctaataatggacttggcactgaggtactttggtactttgttagctccattcaaggtacttatatgttttcagtgtactagttcaagataattttgtagtgtctgctcaagataatcttttggttctaaattcaaatttatatatagaagatgtactaaaaaaaatctatcagttgctccttttcttttgttttcctgttgtggtctgaaatttttatattatagtacttatgctcattggtaccttctctctgcagtgccatgcttcttgtttcatatggaggaacaaatataagcaaccaatcctggattatcagaatcattaatttcaatgtaccatagcctttttcatttgattaagattttgaatgacacaatatacatgcagtgagaactccaagtattagatttcgtataggccgtgtttggttttaataaatatcttaatacatttatgcatcaccaaatgtcataaagccaatctatcttttttacatactgcaaaacccaactagaatgcattgagttgtatgtgtggaaagtaaagactgtttttttaatctaattttagctgacactaaaattgaactctatagctttgttatcctttttaaatgcaactgaattgaccataatgtttttctctaggaaattaaaaccgcgttgtcatgcacatgctcctacaggtatggaaaggaataaacaatacaagatgctggaagagaatggtaaaaacttaatagttatccaagtcagtagagaacaaatgaagttttcacatgtggcaaggcctacgtcaagcagtctattggttacctagttgtagctgtgattttgcaaggcttgtactgttgcaatgcctcatgttattccccctttacctgtaggctgtagctttgttctagttctatttaagtcttttggactgtgcattcctagactgtgaacatggactttgagaaatgagcaattatattgtctgatggtaaatttattttcttgttacaaaatgtgagtggttacaggagatttctaacttgtatgatgcatatttatataatgactaaataagttggatgatttgaactcatagaaaggaactaacctgaatattgtctgtataaagaatatattctagaactctacgtcaacttgtaatttttgtgacatttgtgacataaaaatagaaaaggtgctccacattttttttctactcttataatttttcaaatctttttgtttttttccacaaatagtaccaattttttgtttcaatatctaggacaaaattagtgaaatttcaaggatatatatttcgataattttgctttatccccatgctttactctttaccaacacgatcaaattattaatctatcaatattgaacaagaatcacagccaacactatttttgataatcatatagtgtgttattgtaagattgataaaccatctacatgtaacatatttgtgcaactcatatattatgtgttacgaggtgctttgtagcacatgtttgtgttactgtctgtatccttgtagcacatttattcaccctactaaaaatgtgttacgggatctgctaagaacacaaagcatgtgttactggtttatttccctgcaacacagtttagaatgtgctactgccatgtgttgccatagctatattctgtactagtggctgctgctagatgtgcagaacgattatgcgcagatggtacaatctccaagcgatatgcgatccagaaagttatgtttccccatggatattatatattctcgaaaagataatcgagtctactttcagttccaacaaacggctcatcgtttttacttaccatgacggagtaatgactattttactatagctacacagaagctgaaaaggctacgtgaacctcctcgggaatgattgtaggaggcctttgagctagcccagttcaccgaattacattagttgtttcatccccatctaggatggttattcttagtataaatatcccctgtgttttatcatttcgaagacttttgacaataaaaaaaatgaacacctttagttcagctatatgctaacaaattgagatactgatctctacctcttttactcttgtggttttcctgtgggattatagaagcgaccactttatcggctcccaattgttgctcctactgcctttgaggtttttatcgatgaattgtgggttgtgttggtaagttctttgtagtggtggggcgatccctgattcaggttgcttggtaaaagacggtggttagctcagagttttatttggcaggttgcactacgtattttggctgctcgcagctagttattttggtctctttgcagctagttatcctttgttgtgaagactaggaccacaccccatatcaactcctatggtcccaaattgatatgccattttataactatcaatgacaaagagcgcagttttactttacatagaaaaccctcctctctcttctccatgtcaccctaaaatcaaaatcctacacaaaatgccataagtgacatcacaatattatagatgccaatggataattaagtcgagcaagtatatattatcagcagttaccaccccatccatgaataagccaactaagaagtttcttgattaattagaaaatactcaggctaacatggttttaaaaggccagctgcaagttaaacgtatatcaaacaacgcaaacagaagggaggtgaggtagcataagtgagatgagagagtagccagcactactggaggaactatctttactgggttgaccaaaaaccacattagtcctggtttgaataggaaccgacactaaacatcttttttatcccggttaaaaagcccaaccaattttttttaatccttagttccggttggtaacctaaaggtcatttttattcccggttcaatagttg

SEQ ID NO: 39184 - DNA, 2594 bp, Oryza sativa
ccagtcacgtggtgctggcatctttaccgtgactaaagatgtatcttagtcccagattcgtagtcccggttgcataaccaggactaggggggttccgaaccagttataagcacttattataggatcgaatcacaataactaagtcaactagaggggggggtgaatggttggtatacccaaaaactgaaaaacttttagcggaaataaaagttaccctcgaattcgacggatcgcggtctgaccgaagttgtcttgccgatctgatcgcatggttgccgtcggtctgaccaagattagatctccgatctgaccgccgagatcagctgctattcgctgtcgtcgccgccggtctgaccgccgcttgccgccggtctgaccgccgcttgccgccggtctgaccgccggtatatcgccggttggaccgtcgaaacccggtaaacacaaatcgaagaactcttaaagtggatgacgactttattgattctctctctgtgtttacaaagtgcacaatcagcactccttacaaaaatttcgactaaactcgaaaccctaactcaaaactcaactcaattgctctcaaaagcgataccgggaagcctcatgctccccctctatttatacatgaggtaggcagcctaaagccacgaaccaaactcatactaagagtcctaaacaccttaggaaaccctctagtacaagaaagaaactttacataaccaatcgtaccaaatttggactccttctaaatttgactccgcatcccatacgcacacaatacctccatcgtatgccatatggaatctccatcaaccacgtgcatcaactctagcctaagtattccacatgatctctgaccaccacggacgtcgtcttatccccaagccgactcccggtccgtcaccgcaaatactctcccaaggcatcgagtcacctacacatggaataaacaaagaaaccatattccgagaccaagctatctccaacttgactcattagtagcaaacaacagtattacataagtatagtatccatctagaagccagaatcatgaaataatcacggatatccaaactaataacccgaaaccgaaaccgacacagcgtcggccggtcaaaccgtaggctgcactggtctaaccgcgtgatacacgccggtctgactggctaccagagcccggtctgaccgatcacataaaataatagaacctgcgattcacctgtaaatccaatcatctccaaaaccactttgtgaataaattccaaataacaaaaccaataatctccaatgccaattgttcatcatagaataataatcaaaaacacctttgattttacacttataactagggggtgcataaccacttataacacaaggtggtgcactatgctctgggctggccttgggtgctagctgctgtgcacagtattctatctcctcatgaagaaaattataagtgttctttcggaacaaatggttcttcgatgaatttaggaggatttcaggtctatgaaaattttccatatgcagttcattctatccagcaatcttaaaaattcctttacattagctcaaagcacaaggattttagactaattttaacatgaagtctaacctcttgaaaaaagaatcttttgtgtctatgtctcttgtgatttatgcgtttttttctatgtgctccatatcgatctttgcgtcgaattggagcaatcggtacatgtaccgaatctacaacggctccatgtcagtgcatggagcggcaattatttggatcagtgataggcaccaatacaagtttcagatgctaattctatatttcaagagtacatatgaacctacagggtcgcacgcttaatgggccggaataaggggattggatagagatccaatatgagcttaattcggatagggatccgaataggagtcctacgggccttggaggcccgagtgatggatcctatatattcgtgaggggtgtgaccggcggaggcatttgcatcacgtaagaaaccctacccgtcacttttggaccttggggcatagattggttgaacatggagatgtcaccaaaacagcacaagagtcacatatgatgtgattagcaaggcgttgcttacctattttgatagttgtctagctgtgattccaaagctcactagacactaataataaaatgaggatcttgactcactatgttactagagggaattttgtttcacaatacatagtgggagtatcttttgttaattggtttaatcaaaggttaaatgtaaatatgatgctgattttgcatacatatatttctattgtagatcatggcagctcctgcaccatccaattttaacttgtggtctattcttgagaaagagaagttgactagaacaaacttcatggattggtatcgtaacctaagaattgttctcaggtaagagcacaaaaagtttgtgcttacacagccttttccagctgactttcccaacaatgctcctgccgctcaacgtagggagcatgaaaggcgatgcaatgaataccttgatataagctgtctgatgcttgctactatgtcccctgagcttcaaaggcaatatgaggcattg

SEQ ID NO: 39185 - DNA, 1297 bp, Oryza sativa
caggtattaatgttatagaaattaatcttgctacttcctctactgattcttgggtatttgataccgggtcagttgctcatatatgcaaatcgttgtaggggctgaaaagaagtaggagcttagcaagaggcgaagtggacattcgcgtgggcaatggagcaagagttgctgctgttgcggtcgacactatgccattatctttaccgttaggattagttttggagttaaataattgttattgcattccagctttgtgtaagaacgttatctctgcttcttgtttgcaagcagagggttatggttttagatctatggacaatggttgttcagtctattataatgacattttctatttccatgcacccatgatgaatggcttatacattgtgaatcttgatggatgttcagtctataacattaatgcaaaatggcaacgtcctaatgatttgaatcccacttttatttggcattgtcgcttgggtcatataaatgagaaacgcatggagaagcttcatagagatggacttctacactcgtttgattttgaatcatttgagacatgtgaatcttgttaacttggcaaaattacaaaggcacctttcacgggtcaaagtgaaagggcaagtgaactattgggaccagtacatactgatgtatgtggaccaatgagctcaactgccagaggtggttttgggtactttattacctttaccgatgactttagtagatatggttatgtctacttgatgaggcataagtctgagtcctttgaaaagttcaaggaatttcaaaatgagatacaaaatcatttgggcaagacaatcaagtatctacgatctgatcgtggtggagagtacttgagccttgaatttggcaatcatctaaaggagtgtggaattgttccacaactcactccgccaggaacgcctcagtggaatggggtgtctgaacggaggaatcgtacattgttggacatggtgcgattaatgatgagccaaactgatctgccgctaagcttttggggttacgctctagagacagctgcgttcacactaaatagggttccatcaaaatcagtggataagacaacatatgagatatggacagggaagcgtcccattttgtctttcctaaagatttggggctgtgaggtctatgtaaaacgtttgcaatcagacaaactcacacctaaatcagataaatgcttctttgtggggtatcctaaggaaacgaaaggatattatttttatcatcgggaagagggcaaagtgtttgtcgcccgacacagtgttttctt

SEQ ID NO: 39186 - DNA, 46422 bp, Oryza sativa
  unsure (1)..(46422): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtcggcacatcataacggaagtggaagaagatggacgtcctagtgccccggccgaagccgccaagaactatgtacgtcacagcggttgggttgtgcgggataacgtgcctgtcagtgcggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgatcgaagttctggtactatgctcacggtggaacgctcaacccagctgatggctcactggtcttcggcgatcagatacgagaggctgcgcgacgactaacagatgcagtggaagcctcctctcagggcacgttccgaccagacagagatagggacgagctgacactcgccctgcagactccagagcatccaggacgaacacgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccaaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccattccaacggacccttcaggtacttaccactgcaggccgattccagcaggatactcgaaggtcgaagttgagttggtcgaaggcgcgtacgaggaacttgagctggattaccctggaggagacggtgagacgcatctacgagacacatgccatgccattattctatggcgcaggcggtacatcatcctccctgggcgacaagcggcgtctcatgcaccatctcctccggctccgccatctcctccttaggatcctgcaccgtctcctcctcatgctccgccagcaccgtctccacctcaggctccagcatcgactcctcctcaggatcctgcaccgactcctcctcgtgctcctacacctactcccccgcaagcttctcttccgacaccttcaaagtcaagggcccccccagctccaccgcctacccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcagggatatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtaaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagactatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacatacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttggtcatatatatatctatatacatatgcatttgcataacatatatatgtataaatacatatatattatgcatgtatatacatataatataatataatatatatatatatatacatatatatatgtatgcatatatatgtattgaaacatatatatgcatggtttatatatatatatataaaccatgcagcaacagggccatgcaaaaaaaaaggtcagatctatctttagtcccggttatttcatccgggactaaagatagcgatctttagtcccggattggtactcccagtttggaaaccgggactaaaggggggttacgaaccgggactacaaagggtttctccaccagtgatacctcctcactaccacttggtaagttggtacatgggtttatcaagacgatgtgaatgcacttggaagagagatttatgtatatacaaactgtcttggttcatatttatatgttttatgaaactagaaaaattgtatatacaatataataaagctagcccatctctttcagttgtttcattccgttattgtgctattttgttttttgacttaatattgtgccattttgttatgcgacttcctgccttatcgggttctaagtgaaaaactaaatgaagtcaaatttctctcataccttaatgcaactttatcgctctctattgttcgcatttattttactttggaaaaaatctgtacatcttataaaacataatccaaagagcaattgtacaatctttagtatcttttggtacctaggtactatgagatatcaaattttgagatttactccggtccagcaaaaagtatcttgaggtaccggtacctcaaggtatcaaatagttttcgatcgttggatctagctgggcaggatgagcattgttagatccaatgatagcaaatgatttggtaccgtgagataccggtacctcgagatactttttgttggaccgaagcaaatctcccaaattttacactaatttttttggacaattgcaaatttaccactactttaaatcgttattgtaaaactgccactagaaaattgcaaaaatgccgctagaactgtcattcgaatggcatccttgcaatattgaaaaaacaggtggcaaatttgcaaatgcccctttttttacctcatggtacctcctcaagaatcgtaagattgctcttttattataaatttggtacctcttgctacctagataccaaattttacattaaatttttagtacctcatctaggaccatacaattgctctaaccaaaacatcgaggtacctaaattttacactaaaaattttgataccctcgagataccaaattttatataaaaaatgtaatacctcttctaatactttctcaagaatggtaaagattaccttttaaacataggccatgacgagatatatactggccattattgtagaagtccagacatgcatgcaactccatgctattggactaacatgaaaggtgaatggagggtacgacaacctctgccttcaccaggcaaaagcagagggtatccttctagttctagactagatacagcacacgctgtggagccataccatgaatgtaccaatgcgcgcacaacctggatccaaaataattttctactactccctccattccaaaatataaacacttttagacttcgatacagtcttcgagatgctactttgatgatatctataaaagtaaaatgctttaaataaaagagttgcatattgtgatagtttgtttaatgataaatctagtaacatcaattttacatgtttgatcttttctattttttttgctattattagtcaaagctacaaatatttaacttcattgacactatgctaaaagtgtttatattttaggacgaagggagtaactcgtaggtgatttcaactgtatcaggattcgtagacacattaccacatcagaacacagtccaaattatttgctctctgcaaagctttaggctttacctgccatagatagtcaagctcgatcatttagtgatttttatcatagttgagaaagtatcgagagataccatattttctatcgtatataaaacttggtaactttaggaactactcttaggggcatgtactattattgtggttgggaatttgagatccttggctgagaattggagctacgtagtagcagtgctcaactacatctacattatattgctctgtgtactttcatgagtttcatgttgaagcaatgagcaaatgcatgtgttctctcgtcagcactcagctaagctaggtggggcatcttctagatttgtaacgactcccttcctcatcgcttggccggcaatgtgttgaccagggcaatgtagtgattgcatccgttttgagcaaatgtctggtcctacagcttgcgaagcacatgatctcgtgagaacgctagaacgcttaaaccatcagacttcccgacacctgctactcctgaacgtggtgaggtggtcaaataggtggcctaaaccataaggtctcgtatatcaaaaatgctagtggtcggacgtccgatgcagcaaagaaaaatcggacgtgatatgcacacggcttacatgcatgtctagctgttgtcttatcttttctctcaggttactacatggctgttcattctctctctctcttacttttttccttagtacatcactctaacatataagtatatgcatgtatgtaaaaaaaaaagctatgcatgtattagttacttcaaactatttttctccaaaaataattattaaatttacattccgattacactattatatccgttgcaattaaatctttacaacaaaattttagttaattatattttgataaaaaaaaataagtagaataaaacactgttaaatcctaattgaaacatttttattccatataagaaacattgagttataagtgttgcaacactacacctatttattgaaacactcaaacaacaccagtgcaatatttacattgaactagtgaaacattagaaaatacttattgaaacatataaataatatcatgtgcaatatttataaatatctactgcaacatagtcaaattctaattgaaacatttatttctcacacgtgaaacatccaagttcaacggttaaaacatttgcattttttttcatcagaatataatgatgtgatatattgttataaagatttaattccaatgaatacaatggtgcaatcggattgtaaatcagataaatggttttcgagaaaaaatgttttgaagcttgccactaccattatacctctctcatttgatactatgcatgtgcggtcaactttttgttgctgttgctcttctctatatgtataggtaatagttttttaatcagatggacataaaaaggatgaatgtgtatccaacagtagaagaggcgtccaatgaaaacaattgtattggacgttcgatccgtagtctctcctccatatatatacacacacgtgttggaatcccacgagcagctacctgctagcagagcatgcaccatttggcgtgatgtatatatctccttgcctgattggcctcctcgcatatatggaagcagatcctcctacgtgaagtttcccctgacatggttactgacaggtgggtccacgagtggtggggccacatggcagtcaccatgttcatctgactgcagcacaatgatctcgccgatttgatccggctgcaattagtcatcagagctaacagtcaaaactctgcgttcaattttcttcgggaaaaaataactcagcctttaattttggaagagtacagatgaaagtactgcttaccaaccggggctgactctttttaacaaggcattaccccgttttagttagatgtatgtcaatttaaaattgtgcagattaaggatttgctaaaatggtatatataactggcttgcaattgttacccgttgaaaatgattgctaaatgagacatgagtatattgaaaaaaaggtatcaagtatttgagtatactgtagaacttacatttagacggggaaaaaaagagaagtatgaaacaactgctatcccacaaatcgcctctggacttcggactgattacaagtaggaggatgaccaaataaatatttctgccaattatactgtgcatgagaaactttgacacaacaaatttgcaaggtttactattttcgaatacataattataccagggttcactgaaattatgagattttcaacaaaaaaaaaaggaacctttgaacaatatttttcaaaatttggacaaattttgctaaatctaaaccaacttccgttaaataaaaagaaaagttttaggtggtagaacatcctaccgggaccccctgaagtttcttatatttcgtcccgaaattgttagccctgtaaatttggacagtcgtcagatcgtgaccgcgaggtgcggcaacagcagatggatgaatggcagtgacgttggtggagcacacaaacaaaatcttcaaggtcggcaacatcatcatgcgcaaattaagatccttgtttaaactagtaatttgggaaatttgaaatgaaagaaacagcctggtcgtcagagatgtggaggaggcggcacaacgcatctcatcggcaaacatactcgacgatcagctgataatctagagcatggcaggcgattgttgtgccggggagataggcggttctttgcttggtctaagcaggggcatgtccatctcccatgtgttgaggagttgaggctaaggcattctttgttctgttttattttttctctttctatttaaacaatctacagttacatgtaatctgacagagtaactagctacaaactaccattttttatgtcaagaaaagctatgcacgttgcatttttttcgtgttttataatttctttaatcagaaaagttattatcgttcatccgatgaacacacttcctctctacaagggaaaaaaaaagataaacacaaatgtaatactactgcctacacttagactgcgttcgttcgggtaacattgagggagataacagctcgttttccacgcgcacgctttccaaactactaaacggtgtgttttttgtaaaaatttcctatagaaaagttgctttaaaaaatcatattaatccatttttaaaatttaaaataattaatactcaattaatcatgagctaatggctcacctcgttttacgtatcttcccaatctcctcgatcaccttctccttaaattcacccttattgtggcaaatagtttggccaaatgtagccacgactcatgtgtcaatatacgtacatggaaatttaagagacaacttttatttcaacatctccccctaaaaaaaagaatatgtgcgatccaaatacttggcatgacatgacattatgcaggcaatctatataggctataccagtaatattaagactgtgtgtttatttcacagaagagggaaactcggggagacaactttagaggataacacaacatggtggacgaaacagcgggcaattgatgcacgcccatctctgttggctttccagccaaaaagatctcgtatggcgcctgctttctgctctgtgtactgcatagcacccatgatagcgtactggatgaacacatccaggagtaatctgggagataggccacagctggatttccggtgccttccactcctatgtagtcaaattgtatatggaacaggtacatcctccattcaaaatgaatccatttctaagaatatatttggataatcgtttgtccgaatttcctatcagatgttggggtttttctatgattggaaggaggatatatatgagtatgttggttagtccttgttgctgcagactgtttactctttagctagctagctgctttggaacatttttctttttctgacgtttttatatagggttgcagcgtaaacatgttacacacaactgtctcgttagatttgcttgtcaactgaacacaaatgagattagcatatattcagcagttatctcccttgactaatttatattgacaaacatcaaaggggaaaaaataaatccttctacgtacattattatcttcacattatttcagtaagctgactttctccataagatacagctaattaacggtaggctaatacgcgcgcagcgcttgaaatagtagttcgagcgccacacctgatctcctattttcctcttttttttttcttcctcacccctttcgatttttccatgccacccacttctctatttttccgttcctactaacttcacgtctcatccctttcacttttcccttctttttccgttaccatccatctcattatctcaaggaataaattccattaccacccaccttttcatctcatatttcatatttagtaaatgagttactatgtattatgagcttcaaatccgtacactcagctatcttacaaataaacaaaaatggattaaacaaaatactggcttcaatagatagatcagtcttattaagcggagtaaataaaaattgctagcctaattttacgcatggcaagagatcagtcttataaacatatatagtaaataaattactaacactaaccgagagagacggatcttataaaagattggagagtaaataaattactaaaagaattatccatcgactccatcggtaaaagaattactcacccattggttgccagaccatagtagtaataatgtttgcagttgaaactttactcccatccagtaataataccgtagtaatacttttgctactggagtttcatatccggaatgacgatcaacatatttttaccacgtattgatacactaaatatcgatctatacatgtaaaagaattaccacgaataaaatatttacaacacgctcatttgacaaaaaaaaaagaagaaaaatgccagccgacgggtgaggatgtgaggacaacgaccacgatggctgcgaagtggcgatgattggacctcccgctatcccagcaagattgccacgaggattcagaaccaggaggtggtgacgaggagcgacgaagccggtgcacatctggagggagcacgaggagatcagagcacgtggactcgcagatacgtcgtcgatgacctcgactcgacctcccctttggtcgccctcatggtagaactgtccgcacggtccgccacctgctgcacgccgggatctgctctccctgtcgctggcgagaccgcgtcgtcgcgcgctctcgatgcagagctggagctcgtcgtcacccgcgccgccaccccggaggctggccaggattgcgccctcgacgagagagaggaagacgacatacgcgttgtcgccgccgccgccatcaactagcaggaacaactacataattacctatctaacactcgacctaatttgaaagtacatccaaagaaacggatgaagtacatccaacgaagacaaacgctaccagaaaagtgattttttttacgagacctcataaattttgcaaatggaccataactagtggcgtctgtaaaaatcgagggtcatttttcccatacggctgcttaagtggcccgtatgaaaaaatccaagccacttgagaagccatatgcgaaaataaaatttgaaaattttgaaaaattggaaactagtgtatctcactcatatgaactccaaattggatgattttctttctaaatgtttctaaaatcatgctctatcatattattgtgttcttattggtattattttggctattttttcttgtgactttattttatcaattaaaaatttgaattttaaaacttcaaataatattttgaagcaggaaatgattttatctaaaaaagtcatcaataacaaagttgtataactcatcaagatctataacttctattttggacatttcttcatccgacaaagtgatttgtaagattgttcacaaaatgtgatacagcatgatttgttattgatgactttgtaaatgatagagcatgatttgttattgatgactttgttattgataactttttcagatgaaatcatttagtatttgaaaatgttgtttgaagttgtcataatttgaaaatcatattcaaactgttcaaacaaagtcatatataaaaataactaatacaaaagttgtagatcttgataagttatacaacatttttttagacaatttttttcatttcaaatcatttactacccaaaaaattatttgaatttcttatattttaaaattcaaattttatatagtctaatcaaactcggatggcgaaatgaccaaaagaaaaatggtagatctcaatgagttgtacaactttgcttttgataactttttcgcatgagttcatttagcatcttaaaattcgactcaaagttcatttaataccaaattaatatttttaataattatttttgcatgcggtcctcttaaatagccacatgcaaaaatctattttcgcatgggacggttaggtggtccgcatgtaaaaatgcccgcatttttttagtcctcctctctctctttccctcctcaccatttcaaaatttttcaaccacccatttatttttctctttctttatctcctctctctccctctctctctctcctctcctctcctctctctttcttctcgccggcagcaggcatgggtgcaaggcgatggcgtcggcaggcggcgagggcagcggatctggcggcgccgtactcgggagggccggatccatcgctctagggaggagctcggcgctcgacggcgggcggcgtgcatggcgatggcctgcggcggcggatccggcggcgccgtcctcgggagggccagatccgccgccgtagggaggagctcggagctcagtggcgggcggcgggcacggcgacggacgacgccggcggatctgggagcggcggatccggcggcgccgtccacgggagggccggatccgctgccctacggtggagctcggtgctcggcggcggatctaggggcggcggtggcaacgacggtctcgagcggcgacggtctcggctggtggcggcggtggtctcgggcggctgccgacggcggcgacgggaatggaagcggcggctgcgacgagctctggcgggtggcggcgctaggtttttttttcgtttttttaatttttggaattttatttttttctctcgattttttctctttgcttaagcgtccgcatgcgaaaatccggattttcgcatgcaggtgccctggccgcatgcaaagatttgcattttcgcagacgatttggtccgtttgcaaaaatggtttttgtagtagtgaaagtctcaacattgataattacaaatttgttttctaatcagttcaaccgatttaaatatttcaactttcaaataacagagagatatatatctctttaaggattggagaaaatattgtgctcctaatttacataaaagggggcacaccattccacagagcactatctcgttaaaaaaaaacgaaccaaaacactcggcgcaacgagacacgagagccagtagagccaaggcagcatgcatgcaccaacatatttgtagatccgcaatgtcgcccactacatcgtgaactgctctgaatccgtggtaacacatgttctatgagcaccggaaaattcgagatacgcatccacaccaacacgcagtgaccaaagcagagtgaacgggatttctagtgccacccatgcctacatacgatagaattgggcatggaacatacgtcttggttcttatttgtatgagagaatgaggaggttatggattaactgaacttagagcaagcaaattttccttgtacatgaagggtctagattttgtgtgcgttccgctgctcggccttgtatgtgaaatatatactccctccgattttttttatggagtttcattcaattttaaactaaacgatcgacgtcatatattaaaggttttagtattagttggtttattaattctctccgtccatgcagctgtttggctactctccatcactccccagtgcgcatgcgcatactaattggcaccatttggcacaggtccatcaaatagagatgattaaaaactccagttagacaaggttacatgaaacgttttgatgcatatattcgtgatagttcagatctatacgtacggaaggtcttttttcccgtgttcgatcaccaccacataaaccatcagtgcaggttaattattaaaccgatattaaatatgtattcatatgagtatatttgcgcatattgtgaatgtttatgtttgtattgtgtttcttaataatgtattgctgcgagttattgtgtttactgatggtcaggtttttgtattttcttggggtcatattcttcataaaataattaaaattttaaagctgcatatacggatgtgatactcttctattccttcctgctcacggaaataatctcagcgcgcgggagaaagctattggcggtgtttcttctcttgagaaatcattcaaatttctgaacaattatgccggtcaggtactagtgaaaacgcatacttcatcgaaggaaataatagaccgtgcaatggatcaattccaactatgcatataatctaaattggacaaagatagacctccacagatgttcttgactttttttataatgaaaacggtttacattttcggtcttttgcctaaatatttttgacgtaaaacatgtacacaagcagacaagctgttgtcgtcaccaggaaagtgagcttgcaaaatgcagcgaccaagaccaaatcgaaccatagtgtagtcgtatactgatgcccctcatgtactattctgctgctatatgatcgttgttgcactactgaataaccgatctttgctgggtgatgtaaaaactacattagttccaatttgaatagaaatcgggactaaagattatttttagttccggttaaaaagtgcaacgggactttatgatctcatagtccaagttggtgttacatatggatctttagtaccggttatttcatcggggactaaagagagccatgtttagtccctgattcggggtcccgatttgtaacccggcaatgtagagggatgcaaaccaggactatatagggttttctcagcagtgttggataggtcgcaagagaagaggtcttcattcctgatgccttccatgcccataacctggaaaagaacatactggacgacggacacaaagatattttgttgtttttatgatccacatatgtattttaacgccctcaagttgatcacgagcttttctagtttgacattttttttctccagagtttctttttcaatcgagcataacgcagagcagtttaattctggcaaaagtataaaaacagaaggggctatccatatttataatgtagtgcatattacttgtgatcaaattttaaggatgtatttatactataattacattacaatatttattggcttgttggcttgttggcttgttggctgttgctaattccttggtcggttcatccaacactcgtccacttgaattagcaacagccaacaagcagcggattacaatttacagataggaatcatagttacaatttttcatatggcaatggtgttgctgctgctgtctagatcagtgaagtgaatcagtgatcgtcgcagtgattcagcaaatcagcaccaacaagacatcaatcaggcatcagtagaagtacaaaacaatgagcgacggcaacggcaagaaacctgcgcggctcggcggctgcgcctcggcacctcggcctcgcatgggcgtcgcgtggccgcggcggaagagaaagtgcgtgaaaacggccagcggacggcggcctcggacgagatggctgcggtgttgcgacggcgttggtgccagcggccgcgatctcgcgtgaggacgtgaggcgtgagcggcggttgggcgtgaatgtgatcgcgttgatggcgtcgggattctcgggaacctaccatccgcatacatctgtttctgttgggcgagagaggggtggcgggtggagaggggcccctacgagtcgggggcccagagcggccgcaccgctcacccccctccagggccggccctgattgacagcatacacaaaccatgcccgtcgtccaaacatgccagctcacatgaatccagctcgtacttaattaccacctctcatgctcagatctgctgattcccagcacaaatttacatgggtaagaagccgtgacatcaccatgttgatcaccccatctgcaaatttcgccgcgatcgtgaaattcatggatgcccacagaaacacccaaggccggaacaaattaagcaataggcagctgttgcatactgcccatctggtgttctgcggcctctccatccatctgtacactgggcatcgacacagcaacagctgatgtatgggacggaactatagcgttgtagtgaccatgtcgctgaaggaggggtgtttattcctagtgccttccatgcccatatgatctggaaacgaacacggtgtgctagacatatctgcatagtgtaggtgctctggtttgcactctttcaatattgtgacctcgactaccctctactcgacattctgctagctcttttgacatcaatatagtttacagtgcaaatatctcatcgttactttttaactatatatttctacaaattatttagaaaatacaacaatgtgaaagcatttttcatggccaactaagacggggagaactagcgaaatccctaactggcagccgcttgcgccccccccccccctcccggcggcgcaaccgtgtggagcatacgtagagggaaagggggatcccgtgcgcatctccttcccctttttcctttttttttctttttttgttttttcccttttttttcttgatttctttcctttctaatatgtatatatacaaagtttgtatacatatgtatacaaggtttctatatgtggttttttcccctttttcaatatgcacttatacaatacaaactttatacacgtgtatatattttttatacattaaagtgtacacgtgtgtatgtaatgtttgtatatgtacatgtaaattttgcatacgtacgtatacaaactttgtataggtgtatatattttgttttataaattaaaattgtatacacataaaaaactatacttatattgtatatgtattatgtatatactttatatacatacgtataaacttcatacataaatatataggtacgtagaggagagactagatcaggagggcgactgaccgcgtgggcgcacggctgatcgcccatcagcgcccccgagaaggagacgaggcagcgaggggtgacgggaaaaggaggtggtgccaacagcgcgagaatgagaggcgatgtcggtggcgcaccagagcatctggggtaaaatgaaaattgctaactttttctccaagagacatgaaaggactaaaaacaaatagaagattctcaatgggacaaaacgatatttcgccaactatacgatttaacagcctgaaactcgcggagtagaaatcagacggtatatatttcttcaacgacgtggcacatcctccttccagaaagcttgctttcacctatccagatatctactagcaccattctttcatattaattaaatcctaattgttgaaaatacaacaatatgtgtgtgagaggcagctgcggataacttgctctctttatcaacggcacttcattattgaatgtgaaaataaaccacaaataaactgtcgtcgcggttcggcagtgcgaaatcgtgacgaaatcgcaagacaaacgcgtgatactgatgaaagggtgatgacacgggtggtctcccaaggtgaaaatgcaagatcggcctcgggtgatacatgacgaagggtgatgacatggcggtctcacaaggtgaaaatgcatgttcggcctcggtgtcgctagttcgccgagcgacagggctattgagcctcggtctcgtttgatggccgagcgagatggccacaccggcagctaataacacaactaatcatactaattagtgatactaataacattaattaatacattgctaatgatgttaattaatttattaatagcgcgagtttgtgtggtctcacgggctcgcctcacgagaccgcggtatcgcgcactcgcctcccggtctttcacttcaattctgtgataatggtatatttatgtcatccccttctaaacgtgtatattcttataaaatcatcggaaacaaggtatattttcaattttttttctttcttcaatacgtaatgcggatgtgtggtgtaggagactaggagttcaaaccatgtataaagattaactttgaaccagtctccgcttcattccaagttttattgtgaatgttacaatcgagtgtccattaggaatcgacagcattcgcgttttcttttctcagctcataatctcactatggacagcgctgcccgaacaactcttggatgccatatgcatcgctggaatgccaatttggtcgcaatctaccggtttgtcgttgtgcacccagtttagctctttgttgaaccatgaaggtcgagtgactgcccactctgtggcgcgagcaactgagcacgacgctgtcctcggctctcacattggctgcaccgaccaacacagtgttctctcctctgcccttgctctaaaatcctgatacctccccgtcctatggagcatgcatgcacatgattaatgcacacagatgtggacaacattttctggacggattctgaatttgccgcaactcgcctcggatcgatcgatgctcccaactcccatcatatcctccgaatttttagcttagtggttgcttttaaggcccattgatcctttcgttcctctattttgggttcaatttaccagctattgctgccagcacaaaatggtaaatgctcatatatatatatatatatatatatatatatcaactttagagggcacacatggactaaatatcgagcctgagctgaattttgaattccaatttatacaacattttctcgtgttgacatgaattagaacttgtagtttgcaacacacatctccgtcaagtctgtgatatgtccatcaaatgctagctaggtgctatatgcagcgccatagttataggctaattaataacggcaagcttcgctttgatttaattgccgcccaaaatactcattgtaaacatgaacttgatgatatataaatatattatatgtaaattacaattttattaataaaataaagaaatataaagagttgcatatcaactccaattcactttgacctaaccccacacaacgttgcatgggacaattctctagtttctagtgcgctatctctcatggactcatggttggcagagcaaacacgatcgatgcattagtgtggagtgtggattatacttgctggatgccctataactttgcccccactgttgctgctagctgtgggatcggtacactcccatcttggattatatccttgaaattaatttcctcaatgtactggttgcatattggtaaattgctctactttttttttagttcaatgtgtggagaagctagattgattgggaagcgttaaaccctggttagggggccgcacctttgtttatataggcaggaaaagcccctgtcgtggcttgtacagagatgatggaccgatctcaacaaccctgagatcaatccggattatagagataaggataaaaggttacacgtgataatatcaatcttatctctacaaactaacaacttatctattctaacacaatgtactagctacttaatttgaggaaacaatttacaaatgacttatcagtgctgtctcaaaactgctaaatgctcataactcaattttagagaggagagatcagggtggtggattctaacaaaaatatacaatagatacttcttctgaaaaaatgaaagatgcatgttaggaggtcccatgatgatgtcgtgttttagtcccatgaaaaagatacggacattttatgttttgccatcaatgagaaatagttccaaaaaaatactatcctatcgtacaagcaaattgtttaaaaaatgtgtcattaccattcatagattcaggttatgttagcccaatccaaattaaatgccctcagcttgaattggtcactcctgcaggaagattctcctcatttcacagtagctgggttgccgaatgctatgtgggaaatgacatccgttgagtctctgcatctcacgccaaatatccaacaactcgcacaaaccgtcatcaccaagggattcagtcttataacctaacaagctgttcttgcgcgtagaaaactccattggcatgggcaacaaaatgaaaccatacaactatagaatcaacggagcaagagtattgtccggtctgtccggacgaacgcgtatccaagaggcagccacaagtgcactgcaggtgggcacagcgttgagcggacatagcagtggccgtgagctcagcacaccgtgctcgatctgtcgtgcggcgtccgtggacatgccatacagtgtgcaaaaccacagggaagttctctgcagccattagacatgatgcacttgtacttgatagataccaggtcgatccgcattcccggcattgaacactgaagttgatatttgtattcttgttacctcctattcccacaatcaggaaaagaatgtagtggctcagggtctcatgagcagatttggtgtgtgtgtgtactactctttgttctatggctttatgcactacctcacattctcacaacccggtctttttgtgttttcttgatacatatatatttggtactggcgttttaaataaaagcaaagtaggtagactctctaccaatcgagggatcgaagtatcacatcaatgaagatgtatttgtggcaattgctagttataagtaacttgctccgcttaactcagaagtatatgcatgccccatgtaagttctaatggagagtaccaccaatgtgtatgttccatacaaaatttaaaaatgtaaagtgtacataccaatgtgaaaatcgtttaagtatccatggcccaacttttcctttcattttttttccacgaaaacagtccctgaggcactgttttgttaatccccaagaggagggtattgaagggatttatctgacacctattgtggtgtggaataattctccttaatctccataaatcccctccaaactgaacaaggcccgatgtggagaaacctaatctaaattgaaaatcataaaagtcccacctgttcttgatgtcatacaagtgtacaaaccgaaaccatgttcattgttccacctggtcagcgtgctcgaatgcagccttttcttgccactgctcatcctggagccaaccaattcctagtaaaaatctaacggacatatgcaaccatgctatagcattactgttcttctagtccccaatatttttcatggtggtagaattcacaggcatgcatggcgatgcccaaggctgagccgatcaaagcataaagcagccattcagagatgcctatatggtgttctgcaaacagtgagaacagcagcagaacaccatagaggaatgggaaaaaacatctctattgccgtgaataggtcacacgaggaggagctttcatccccggtgcctttcatgcccatgtttggctgagcatggactaattaaaattaaaaaaggaacttatcatttgccaggcatgtgtgcatatgcatgtgtggtagctgctgataatttgcgcactctacctgagcaatagtgtgacgtttgctatgttggagatttgtcaatgtaggattagagggttgcatagagatttgtcactcatgatatttttttagcgttatatttagattttagggtgacatggagaacagaggaagattttctatgtaaaataatgtacttcatgaatgatactccctccgtttcacaatgtaagtcattctagcatttctcatattcatattaatgttaatgaatctagacatatatatctatctagattcattaacatcaatatgaatgtgggaaatgctagaatgccttacattgtgaaacggaggaagtagttataaaatggccaatcaatttaggaccattgggagtagtatgagaggtacatgaattgagatggtcatggctagatagctgcctcttgataccacagttgcagtaaaaagactctgcctccagataaagttttaatatgctgatcattaactggcgaatttgtaatttggcttatggagagaaagacatatcctatttgttacggccttaaattccaatcagctttcccatatctatgttttctttttcatacgaaagcatcaagtcatcccaaccattatgttctctaatacacagaaagaggaacccgctcaatgtagaaaaactttgctagaaaagggtgaaccaaatttatcggagtaatcagagtggtagaaagtccaaataggccatatcaagaggccttttatagtaccttccactaggaggtggtagtagtgtagtaggaataaatatcgccgctgatttcgatggtcaatttagtcatttgtttaaattaggtgaaagggcaattaagtaatcattggcaggccctaagagcctgtttggttggagggagttagtgatgggaatgggagtttatgatatctgggagtttaagtctataatttggttggaagacttggaaattcgagggggtttgggatagggaattaagaggtccaattcccaccacggcttgtttggtaactcgagggaaggggattgagagtttacacgagggaattgatgatgagattaagatgggaatttgatttttaatcccaatatcttgtttggtagaggtgatggaaattcatagggagtttatttggagattaggtcattaataaaaacggatggctgagatttgcttagaaaaagtaaaggaggaattccctcccaattacctgcccctacctagatattgaaaaggagggagttccttcctcaattccccatccccgtcccaccaaaattcccatgtctcccaaccaaacagaacaattaatagcctcgtccctctaaactcctagtccctcccaaaaactcactccaactaaacgggccactaatctcttacctgggggaggcctgttaattcgtgagacttgtagggaattcgatgtgaaaccaaacaatggaagaggactaaaaatataactcctatgaccaatcccaccatcaactccctcttgaaactcccattcctctccccttctcttgccaaacaggccgtaaggaggacggctcaaacatcagtcaatcgttcccatggccaattcgtcgggcacggcgcacggcgagcacgggcacgcgccgccgcctgttcgccgttcacccctttcacttccaaccccgatgtgcgccgtcctttcactgccaacagccggtgcgcatccttgcgcaagccaacactcgacaccactcgccccgtccgcctcctgacgccgcgctgccacccgtcgacctaatgcgcccgcgcgccggcgccccctctcgctctccttgcgcccggcatgaagtgttgattttaatatatccagaattgcggcatcaagtgctgatcttgaacatacatgttttgctcgcagcttcatgatggataatcctcaaaagctatgaaattcagtcttcataatataccaattgattatcttgactagtcgcaaacaaaacctgaagattctgaaacttatttgtttcctgcgattctgctaactaatcacaagggatctaaaccttaattattttctgcaactgtgctttcagtttaattaactctttcattaacgaaagtattaatgatcccgcaaaataattaaatctgaatctttaatgtgccctcatggttgacggtagtagaatttgtgtaagccaggcgtcaaccatgcctcaaatcagaagtctgaatttctgaactctggcatgacctgaagaaagtttcatagaaaaaacaacctcaagaaaaagcagtacggccggaagggaaaagaatccgacgagcgtgctgcctccggaggtggcacagcagtgatggcctgatgggagcagcggcggtgccagtgatgggtgtagggttcaaaaatcacgatctaaagctattgattaattatttttctttttatttcataagtggactgcatttttatagacccaagaacaaatcacaccctctgccaaacctaaattttcaaaaatgtcacaacaattttttcttccagaattaccattctactacactcctgcaccctgttacactaggtgcagtagcaacgtacatcctccgttggatcccatccttgaacggcccacattgatccatgggtactttaaaaaaaaatcccaaattaagcgctgaacaagaacggtagaatagtagcctcattcttacacaagtataccatgccaacttctgccgtacatcttgtgcagtagatccaccttggtgactgatctagattcatgatatcaacagctcatgtggcatgggtaactagttttacacagatcgagtcaacaggatttctagtgccacccatgcctacaattgaattggaaatggaacattcctttgttttcttcattgcagcacacaagaatatggattatttcaacatagagcgcatgcggaattttgccttatagtagagggggctggactgtgcgtgctctagtgctcgggcaagctatatatatatatacccgataaggttgtagtatatagttgttggtatattattctttgcaaccagccaaccacacacagctactcagctcccctgctcttttctcctttgtgcaactagcatatactccgcacatgtcattaactaaagacgtactcaaaactccatcaaaggtagttatacgtacttcatgtgtttgtggaaagtggggagcttagttcagatcatcagagagttctttaattttcccgttttgtgcagttattgccaattatgagctgtctctggtaataggctatcacagtttcagcaaatcccacgcactgtaccgggagattgttttatgtcttgaggtgatatccacttattttgttatgttacctaaatagttattaaagctttttgaaaaaattgataagataggttaatatgagatatatcactatgcaaacatgtaagcttaaattcgacttctacaagttctaacaaatataactgtgaatttacatcaactaattttaattaattttcttttattataacttgtaggttctaaatttgaccttgtatgtttttttagtgatatatctaatattccactatcttgttattttttcttaatttttataactatttaaacgcatgtaagatatgaggggatgttgaatagtataggatattccttcgagggatgaaaaaaccatctcccccaatgaaaaatagttttggtctatattttttaataagcgcaattgattttactaaatcttaaatttttagatgctttcaaatcccctccaaattgggtaagaccttgttaaatttttcatgactttgataaccacaaattttgttatgcttttgatcccagcaaaatttgctaggagtattaaatttgctttgacttggatgtccaaaattttgtcattgttagagagaaaacagggatgcattagtgtgcacctcattgctcaaaaagaattttccagcacgcaacttaattgtaataggatatatatatatatatatatatatatatatatatatatatatatatatatatatgcactacacaagcagtacaaattccatccgatcgatcgagccatccaattttacatggatgtatgctagattctacagcagatcacaattaattaattgttgtgtgcacgcatccgtttcatgagattgcttcaaacgacgaggcttcccgacgtcctcatgataaagagtgtaattagctcgaggagtatatgtatatatggaggatcgaggcaagtagaaagatgcgatccaatggtattcaaaactcttctggccgtaattctggatatgtatcttcaatagatcgcaagatcagctaccacagggcacatgtgtattggtcctctcaaaccaagcaaaataacactatttttctcacctatttgtaggctgcagcagttagtcatcctcactagtctttaactcatccttcaatttgggacaatagatatttagtactgccaactaaccagcatcaccttatagttgcccgcacttattacatatttgtacatattagaaatggtgtataatatagtggtgtagtatgttgcacttttactgtccaaacaaaagaatggaagtgctctcacacaaatgcttgatcaattctagcataaaatggctagtgaaggaaacctaatggtggtggcgaaaacaaaaccgcttgtacaatgccgttttataaattaacttgtgtatagggtacacatgtaaatgatttgctctacacattttgcaccttgaagattcttggccgcactcctctgcagaaaaaagctggatgaaaaacctttcatttcacaatgctgctgctcttcccaaaccgagtttcacagcacataaagccagattcatgaaagatttgcgtagtaatttctgatagagtaaattgcactagcggttcttaaactgagctttcacttagatccacgaacttacaaaacgcgtatcgagatccctaaaattggtttaatgtatcatcccgatccaaagtctcatttgactgtaatcttgcctacatgacatgacacgtggacaatgacatgtaattttgaaaaaaaaaataatgtctcccttcttccaccctcatcccctccccaccaccttttctccccaacgccagcagagggccaaacgccaccgatgcctctcctcctactccgctcaccgcaggcggcagcgccgcctctcccatccccggtggtgtggcctctctctctctctctctctgcagatcaggtcgcctctcccttcctcgacaaacacccaggtggagggcgacggtactggtagtgtcgagctctcccctctcctcacgacggtcgggggaccacagcggcgacaaggatagcgagctcaccggatccggccgcaatcttgctggatccggtcacaacctcggcgggtaggtcggccagtagaggcgatgagttccgtacagtggaggttgacgtgattggcagtagcgagctctgtaaggcagaggaaaatgagctgaagctctctttcctctcctcacgatggttgggggaccgcaacggtgatgaggataacgagctcgccggatccagccgtaattttgttggattcggtcgcgacctcagtgggcaagtctgccggtgaagtgaagggtgatgagctccgtgcggtggagggcgatgagctccacgctgcataggtcgatgtgatcgatggcggtgagctctgtgtgatgggggatgactagattggcggtgacgagctttgcatgggggagtgtgatctcattggggagccaccacaccgctcgttgtcactgtctccgcgccattttcgttgtcacccaatgccactcattctcaacgcttgagttggaggcaaagaccgagccccgccactgccgttggtgttgtcgttgtccccccagcctctgctccgacgacgagcagacttcggcagtggcgcctctgcctccggtggtaggcacagtctctccctctcttcctttgcctgccatgaatgcatccagaggtggaggaaggagagaaaaaaagggaaagtaaaatttgtgccatgtcatcacccacgtggtatgccacataggtaagaccacagtcaaacgaggctttggaccagaatgatacattaaaccaggtttagggaccttgatgcacgctttgtaagttcgtgtacctaagtgaaacctcgttacaagtttaagaaccgctagtgcaatttactctttctaatacatacattgtacttgtattttatggatatcctgtcccttagcattctctgcatatagcccttactgcgcagttgttctgatgatgcatggcaaagatctatgcccatatcactaatgaagaaccagtcagtgaaaattgtaaatctctcggatctcttacgaaccgggactaacgtggccttccccttcagtgtatcttcacctcatgaataggtcctaggagcggacaccaggattccagttaccttccattctcacgatcaggaaaaagaatgttgttatgactcaggggctagttgacatgttgtatgcatatatgcttatactgaatatatatgtgataaagtgatctgttctttgtcctctctccttatgctagctcgcaacccattttgctatcttgatccatattttgctgctggcatttttaataggctgactcagcatgtatgtgtgaccaaaaagtgtgagacaactaatagaagatgtatatgtgtgagcatgtggcatctgccaattataagtgcatgcctccaccagaaatttaaaatttcgaagcctacatatatactattccaagtgaaagctcttgtgaaatttcttttaattgagagttaattattaagttcaaatttctaaacaatgggaccagggtaccagtaaaaaaaaacaaaaacaaaaacagactgcatgcgttcaaagtgcacgtcagcactgatcaatgtgaatgaatgcatttactcgtggtccagctcgcagtgtaggatctgcccttccacaaccaatgtgggactattcaacaatctctcccttcacaccaatttggtgtccctcagcccttcaccgtatccgggccccaccagcctacggtccatcaggtatacgggccccgcaggtacccacggtccatcgggccagagatgttaaactagccaggctctgataccaattgtaggatcgtaaagggcctttcccatcccaaaagctagctgttgaggtgggaggctcccccacttatatctttggttctttaaccttccacaaccaatgtggaactattcaacacgcatgagtttagctactctagccactgctggctaatccttgttctggtgcgtgccaattctaagtacaattttaatgggataagaaattaattatcgatgctcgtcttcccaagttcccatcaccggagttcgtcgtgatagaagaattcacggataagcacggcggcgtccaagaccaaacaccggcgtagtgcacggatgccaatcttgttctctggctgtccctccatctgtgtacagtgcgtccgccatgccacggctgatggccgcgagagaacagcaaatttgccctgaattgatcatcggaggaggggttttcattcccagtgccttccatgcccatatgatctagaagaaagttagatggtgcttgagatatgtgtgtacgtagctgtgtgctctggtttgcactctttcgctcgtgaattaatgtgcctactctctttgttctgctatctcgtaaacgccctttggttggtgcgctctctagatctctctgttccatgtttttcctgctgtccattgtgtcagcattaactaagagcaggtacaatagcaggctataagtcagctgcaaacatattttaagaagataaatcaggagagagaagagcaacgggttacagatttgtagccagctgtagcaaggactccaagacgcagtgtttctatcacaggtgggactaggtattaatagtgtagtatgtaactattgtatgaatgagctattagattggctatagatgaattggagctagcagttggctatactattgaacttgctctaatactccctccgttctataatataaggcacagctacttttttttagatgtttcataatataaggcatgcatgcatgcatataattaattatgatttttttaaatcctccaccatcaagatctctaattctattggatgcatgcattatatttattaggatgattcaaactaggagatgataataattatttcttagtctttgggttaagggtggttgtgccttatattttggaacggagggagtactccctccgtcctaaaatataagcatttttatcctgacacagcctccgagatatcactttgaccaataatatctataaaaataagatgctttaaataaaaagagttgcatattatgatagtttgtttaatgataaatctagtaacatcaattctacatgattgatttttttaatttttttgctattaatattttaagttaaaaatgtttgacttatcactatgctaaaaatgcttatattttgagatggagggagcagttaactactggaaaaacaattttgtagatgaggtacttctatttttctagggggagaaaattttttcaaccaccagcccacctgtgatgatatacgtactaaatcatcgctcttaaatcatttccaaaagagatgtgatctatgatgttcaaagaaaaaaccgcacagattttaaagaaaatgagaaacccagattaaaagttagttaacagcataaacatcatttataaaggattatttcgtgcatgagggagttttaatctctgatcctatcagtccgaatcccacatcaaagcttcggcaactgtttcctgctcgccgccgtcacaatgatgaacacctggtgcctggccatatggcatttggatctatcgcgctacaaaaacttggccgttgagcatcccaaactccaatcattctctcgcttacaatcatccagctattgttggcactgcaccatgtgatcgagaagcaagcatcaatgagttcattagcttttcatttatatggagcatggcgacggcttatgtcactgatcttggcagcaaaattgcgccatggccgctgatagcctgccactaatattcaagaaacaataaggagccacaactgatatgctaggcgcctaggcctcaatgttttaaaaagcggactaaggtatttagcggttagcttgtcaaacagctatagcgggctaaatggagctataacggctaaattatacatgagagtaaatagctagaacctttctaaaacagctatagcgggagatagcggcagctatagcgggagatttaaaaccatgctagtcctacgtgggcgggctagcatcggaggcggagaagaacgagagagaggatgaagggccgtgactgaatgaatgcatgcgggcttgagacaaaattacccttgataaaaagttttaggctgttaattaccatctaatctgggcctctcatatcatttaaaatccatgcagatttttctttaaagagcatagaagcacaaatcttttcaaaatattttaatccaaatccatccatcgcttatgcaacatttaaaatatattcattatatattctgcagcaaaccacgacgagccatgtagttaacaaatattttcatgcaaacacgtacataaattacacgagggtctttccagagatcaagaactaccacgctttttcgtgctaaattattaccctgacattaaaaagtgtccgaactacggagagacactaacgattacactagaaaagtttggtacattcttgatggaaagaaaccatcgtatacaatcaaatattttgtcgaaggctgctgcgaactgttggtttacaaaacaccatcaaagtacttgcgcattcgcacgatgaagatcacctgtttagacaccctgtggagccttcagctgatgaggatcgcagcacggaccggagagccaagaagccttggatgtcgaagcatcctagagaggtgtcgtcgatcttgttattatacgctctcgtcgttgttgtgcacggccaagaaaagttaagccccattagcttgtcctgtgtgtagaaagggatactctgaatctacgagcttgcgaacccgtcaccaattatttcccgattactctcaatcccacaatccaaaactccaaatccccagcaaagtgaagatgtgtgtgtgtgtgggttttttccctgtggacttctttctttttttgcaattgtagaatatttactttccaagtaaatcaactgcagtagttctcgtgccgaggacagcactaaaatagccatgcggtaaaactcaaagtttcactgaatttgatctcttatatatgaggactgctatatataatggcacagtaactctgccataattattaatgtatgtcttttttttgtacaatgacgtactatctccgttttttatatactatgacgccgttgacattttaaccaacgtctaactgtcttatttaattttttatgctaatataaaaatatttaagtcatgcttaaagaaaacttgataataaattaagtcatagtaaaataaatgataattatataaaatttttgaacaagacaaatggtaaaacatatctcaaaaaattaacggcgttgtgtattaaaaaaaacacagagagagtagtatataggaaaaagtacaaattaccccccaaattatcatggttgaccgaattacccccctaaccacagttgcaaacattttatacctagaacttttcaaaccagatgaataacccctagcacaatccagagcagttttgatcttacgtggcatacacgtggtggtctactcaactaaaaaataattaaaaataagtggactccaccggtcagctcctctatctcttctcccacctcctttcccttccatctccatctctctccacatgtctctcgctctctccctctcacgaaaagccagaatggcagcggcggcggcggcaggtcgttgggggagatagcggcggaggcggcatgaggggaagccgccgggctagggcggcgagcagcaacgctgctgcgtgcgttgcccgggcgccatcaccatctcgagcttggtgagggcgttggaggcagcagccggtgggacacgccaaggaggatgatgaagcagcgttgcggggagggcgtaggaaagggaaggggaagggggtggctgcaacagcgctagcgtgtccaatttcttcaactccgctgtgcccgagctctgcgcccctgcgatggtggagaaggaggatcccgccgccgtctctaccgccgtctctaccgccgcctcgctccacatcccaccgcccttgccactgccaccgctgtggccatcggagccggccgagcactgccccggcgtgtagtatgccgcgtcctcgtcgggcgaccagcctgccgccagcagctgccttcgccctctccggcatgtccgagctccgcgccgccatgatggtggggaaggaggatcccgctgccgtctccgccgccgcctcgctcctggtcccgccgccctcgtcgctgccgttaccatcagagccggcgtgtatcgccacttctattcacagagagagagggggggcagagaagaaggagagaaaaaagcgctgataggtaggccccacctatttttatttgtttttgctgactgtatcgccacgtaggctgaaaaccgcttcgaatcgagttagggtggtaatttatcaagttttaagagtttggggtgtcaaatgtccggtattgtagtttagggggggtaaatcgtactaccacaatagtttggggagtaattcgtactttttcctagtatataagagctcaatagcttcaacttcattgtgaagacaagctaaagcgaggtgcctatttatgttgactctccaccgagtgaacatcagtcaaagttaatttctttaaacaactataattgacgatgtaggtgttggacagagaataacgccaaggtatacagattaattatccatcatgaaaaaaaataatttaaagctacaatgtgacaatcttgtataattttggatgaccctccatttccttgtcgtgaaaataatctcagcgggagaaagctagctttttggtgatatccggtctcttgagaaattaccttcaaattttgtaacaacgagacacaatctaaaagaatgagacaagtgtaaaccgccaggcgttcttgacgtgtatggcatacacaggccgtgttcgttgtcaatctgcgcagctcgcgaaaattaatgtaccttcttgcaagagttctaacaacatcatcgttccaacgtgcagcagtgaggggtggcaaaagagcggcgaacgtaatcaacatgtatgattgagctgcacgccaatgtctcaacacgacgctgcttgctgaactgctacaagtccgttgcggcaaacttcctgcctgtgcggagaaatattgaaacatagtacttctgacaagggagagcatgatagtgggattcctagggccacccatgcctagctacagtcgaattggatatgaaagacgtattggctagtcttctgtgccgcaaagagtctctctagctagctgctttcgaatttgtttgcaacgctggtcagttataaggaccgagtcaagaaactatccagaaaacaaatagagtacgaccacatttcccgaatggatatagacccagcacactaggtaacttgagtggaacggcagcctagtcatggttggttctgtttgtgatgttgtggagaagtgttgtggtaattaataacatcaaaacctaaaatgcaccctaatataacctagataccccaactggacatctcgcacagtccatagggcgactagctagctaatgaggttcaacgatattggtggattaacttctacgtccaagtcgtcgactgtcacaccctaaagtttccccttcctagcctttaattgaataactaataaattgctacaacaaattgattaatttaacctagagctaatcctcaattaaaagtcctacttaataagtggaaatggcttggtgggatttttcttgagttcccctttctaaaatacattatcaggatttgtagtggaattttcacatcaaagaaaataatttaaataaatcaaaaacgattatcggaattgaattaatttgaaatccttttctttctcttcatcggccgttgggccgcttccggcccaactccctctccccgacctacccacgcccgacaccgtgcccctacttgctaggctggttgaaggttatggcccagcaagccacccgtgccgcctccgtacttgggacgccgacaggtggggcgcacctgtcggggttgtctccaacctctagccgagaggggcagggatgatgtcagccacgccgtcgtctctggcacacctttcgcgccccaaacgccgacgttctgcacccagccgcacgtgcgcaccccactccgtgcatcccactattgcctccttgtttttgaacccaaaatcaagctcggcgccaccatttttcctcctcccactgcgccgcctccggccactactcaccaccactaaagctgcaaccgagccacaccgtcaccgccaccagcttcgtgaggtcaaggagcccctcggccgccacatgatcgttccattccgccaccggaacccgcctctcccaagatgccggtgagcctcgcctttcctttccctctccagccgacaatgctcgctgccgcgcaaccccatttcccctctaaactcccccttcgtcttccttaggtcacactggaacccatccaccgcctccaccgtcctccccatcactagattaccgtcgtcgatgccatcccagaaccgccgctgtttccaccttgttgtcgtcgttctcgcgctgcatctcgccgtcgtgagccctcggtgagctgcaccttcccttcctcttcttccactgccgctccgcacgctcgcctcgggccgcatgtgctgccgccaccaagtcgggacggcaagccactaattgccacttcactagagtccaatttgcccctcggcacatcggggccgtccacctcgctgtccgtgtggctacctcgtcggtgccacgtggtgcacctgtccccgacccgatggactcggtccacagtgcaccgcccgccttgcatcgctaacgggttgggctcacttgctggcgcccacctccctctcgatttcatcagccatcaggttttaatgcgcattaatccattaatttttttctattattagtaaaagcacaatgaatatttgataattcatccgagctccgtttaagcccattcaaattgtagtaaattcataaaaatgcatcgaatccattaaaaatggttttgttctatgttttttagacttgtagcttatttttctttgtgtggtttgtatgtcacttagattctgttggttcaaaagttcccgtttactttgaagtggttgtaggggttgcagcagcacttgagtaaggcaagtcacgcattctcgttgaacatatcgtacctatttttcaaatgtcccgctttctattaaatttgcattggtttataatgtcacgtggggtggtttattttatctcagccatagcttgatcaccttgtatcattgataacttgttagtatgactagatgttaatttaggaaatgcttagtcatggtcagatcaaacgctcacaattggaatctctcatatatcttatatcttaggttaatgatgactttggacatggatcaccatggtattaatttaaaatattttctttttttagcaccgaaatatgctccttacgaaagattctaacacctgaaattacaaggtagattaagcaacaagaacgagaaaaaaaatcagaacccaaatttcggactatggatggaaacaagaagacctaagggagtcagcatgatgcaagggcaaggcgtgtgtgtcctgctggccgccactgctggttgcatgtcatcgagatgggagacggcgcagatgggacttgggagatgcaaatcacggtcagggaggaagtaggggagaaagtgccgatgcggaacaagatgaactgtgaaggaagagaggaaacaacgcgaacgcagcgtcgccctcgcagccccgcctgtctatccacatagaaaccataccgattggccgaggatgggagttgggtgggattagtgatggcccccctctgcggtcttaggcggtcgcacaactcacctaggcctagagccggccctgataatgaatgagttaaagttcttttctttgtatgaataaagaattattatcactagttttcagttatttgtccattaaaattattttcttcttaagagtgtggtcattgagctgaatatataaccgtagttaatacaaataatgatgacataataatacggttgttaataaaataacgatggtagaaagtctgggcgctttatgaaataacgacagcagaaaaacaccgtctttcataaaataatgaccggaagaaaattgcatgcgtggttgttaatactataaacgacgtaacctttagcgaccactgaagatcacattttatgatcgttattgacctttaacgactacattcgaacttttaacgatcacatttgctgtcattaataatcgtttcaccagttgtgcgatgtggtaggtttttattgccctgcatgttggctgtgccgcctaacacaatgccatggtttttgactcttctgtaaatttccgacgcctctcgatcctaaggagcatattcacacgatggatgccacactagtgtggactatacttgctggatgccctgtaactttgccccaactgttgtgactagctgtgggatcggtggatactcccatctcccattatatccttgtaacttgttgcatctatgtattggttgcctttaaggccattggtccaggcattgctctatttttttagttcaatttactagctagtagtttggaggaaataatttactaccgacttattagcgctgtctcaaaatgctaaatgctcataactcgactttagagagatcacgtagcgtgttctaacaaaatatacaagagatacttcttttgaagaaaaatatatatgtataagaggtcccatgatgatgtcgtatttcagtcccatggaaagatggacattaagttttgccctcagtgagaaacagttcaaaataataccatcgtatagtacaagccaattgtctaaaaaaaagcttttcgtaaatccaacttcgttagccctgtcccaattaaatgccctcagattgctcgctctgcagctggaagatcctcctcctttcacggtagccaccaccggatgctgtgcgagaaatggcatctcaatggaacctctgtatctcgggccaaacatccaacagcacgcacaaaccttcatcattaaacgggtttcagtctatctccaaacaagctcttcattgcacgtaggaaatgccaatgacatgagcgacaaaatcaaaccatacaatcgtaggatcaatcaagcaaagagtactctgtacagtttgcaagggtgaatgtgcatccaatacgcggtggtcgcgaggtgagatcagcatcaaggcgcacaaccaatcggtggatgtgagctcacctcacccagactgaacctgataggtggtggctcagcagccgcaggcgttggaagggcggcgagcgcgcacccaagaatcggtcatgagctcaccggatccagactggatctgacgggcggcggccgtggacatgccctacaacgtgtaaaaccacagggaagctctctgcatccattttgacatgctgcatttgtacttgacagatgcccggtccctcgtcagtctcagcggcgctccaagaagctgatagatgtattcctgtgaccttccattcccaacatcaggaaatgcatgtggctccgggcctcagaagcagattaatttggtgggtgtgtactactctttggtccctggctttgtgcttgctcacaacccttttgtgttttcttgatccatatatatttggtactggcgttttaaatatgaaacttttaagacaagctaggttgactatatatccaccgagtgatcacctaagatgtatatgtggtaacggctgaatattaaataacttactccacctaactttggctgtgttctacccccattttccccaggccgccacctctctcttttccgtgcgcacactttttaaactaccaaacggtgttatttatgcaaaaattttctatacgaaagttgttttaaaaaatcatattaatccatttttcaaaaaaatagttaatacttaattaatcatgcaataatacgagtttcgttttgtaccatatagtagtatatgccccaagtatattctgatggagagtacaccgcagcacctagcctttttgtaaaaataatgaaggatacgcaatgacatgcaccgtgggactttacccctaggggcgtttttttatcactatattcaaggaaagagcacaatttcatactgattcctttaaaaagaaccatcaaaaaataaaattgtaaattaatcttttaattctccatgatctcctccttttccataaaccctttctcccttttttaatcaaaataatccccggtagggagaaactcaatctaattaaatcgaaaattaaaaaaaccaccaccttttcttcatggcatacatatgtacaaccgtgctcatcatccaagctgtccagtgcgcactaatgcggccttttcttgccactccacgtttccaactcaacgaatcaattcccagtacaaatctaacgggcataggaatacatgatatagcattatatatatatggctcttctagtctccaaatttttccgtgttgcagtggtagaattcacaggcatgcatggcgacacccaaggccgaaccaatctaaggcctaaggcagcatccgttcagagatgactctatgttgttctgcttctgctttggacgtgctctctccatcaatagaatttgtgtcggtccgccagcagtagctaatggatggcaaaaatcatcgttgttgcggtgaataggtcacaagaggaggggccttcatccccggtgccttgcatgcccatgatctagaaaacaattaatgttgtgggtgacactttacaagctagcgatgtgtgtaccgtgccagtttgcacctctttgctggtgaccttgactacattctctgtggtccttaaaatgttgctactccctccagttctagatatagggcacaactactttttaaagtggttgcatgcatgtaattaattagcgcattctctcccctaaattattattattttaaattctatactcataagatttttaattctattgattgcatgtattatattaattggggtgattcatgacaaacatgagatattaattaattcttggtctttgggttaaggatggttgtgacttatattttagaatggagggagtagttcccaagagatcaggaagagaaaagcaaatgattggtatttaaacttattcggttggttgtgtcacttatgtctctgtagtatgtactctcttggaatgtaaatggttggtccttaaacttattcggttggttgtgtcatttatgtctgcgtattctggaaatatagaattagcatctcaaattttttttagcccatcactgggtcaaacagttgcagactcactctgcgcgctgacgtggagtatgcagaatttcggcacaccaattgctctaattctatgcctggaccatcggctccttcgattgcatcggtgctatgtatgggtgctcgagttcatcgactctggcacggccttttggtacatattgatagtgacatcatgttgttattgaaatatttaggagttgcatgtttatgtgttctggccaatataaattcaatagagatttctgctctaattgtttagtgacctcaggtatacaatattgtcttttgaaaaaaaagttttatcaagaaatgtcaattgaatagaaaattgaacaattgaaattatcttttacattttcttggcaaagccacactaaattcaggtcgaattgatgatgactactaaaatctttatcggcgcatggaacaaatcggtgatcgcttttagactagtgattcacaccagaaactaatataaggtgctaattctatattttaaaaactacggggacctaagtgacagaactgaagagctaactctgtgtggtctattttcccagtcacatgtaaaaaaaaaaagtagtatcccggtcattcaacgaacacatttccggaaggtgtaattaatatgtgtttctaactaagcaataaaagcttaatgaccgcaactgtaaggatgacagagaagcatcgatgttgtccacctctgcgtttcaactaggtacatctcttggggccgtacctatgatttgtggattgctcagtattcatggtagcacacatgcccactgcacacgctgcaaaatgaagatgaacacgctttaggctttcgcgtaagacaacaggattcttagtgccgcccatttctatagttaaattggacataaaacgcgtatgagcatgttggttagtcccttgtcagttgtcaccttagatttctagctagcacttcaaccttattttgctatgtttttatatagatgcaaacacaactgtttctaactttttattactacttgcccactagttttgtacgtacgtccttcaccctccagagtccagagtaagttaaatactagcagtcttctcacctgaagcctcccagctaccctaggtgggaaaataaaacaatttttcagtgggggacgcaaccctaaaatttacaaaacaaaattaatatatgtaggtcacatatatatatatatatatatttaattagatctaatacttcattctcaatatttttttctcaacaaatatatttttctagactcctggatcacatcacttagtagtcaactacctcaagtctacaaactctatcccactaagaacaactgcaacagcctctatatcccattcttcaaccaaaatttgacaagtttaggcaaatttccagctccaatagatttgtcaaccggatggccaaacactaggggggcaacgcttgtaattgttaagtgaatacttagccttgaaattttgtgtccgcgccactgctttttttacgagtgctcccatgaacttagagcatcttcaggggagacccaaaacctgcccctaaacaaaattttaggaacagtagggtacattttagtagaatttgtctgtgcagatctctaaccacttcagcttttcgtgaatctatctatagttagtttggtgaatgtgaattgtctgcttggctatgaatgcactatcaaattactatgagcaactctgaactctgaacaaagttgctgattaaatttgcattctgaactcagaacatctctgaactagttatgcacactgtgtttatttttagtttctcgtacagagattttaggtcagtgcttgtgatattgacttcttatatattgacttgaggagttactcagtaaatatatttataattcatatcaattcgtactttaattcaacaattttaaaattcaaacctttttcaactgaaccattatatcccggttccagatggtcatatttattgaaccttttctcctctttacaaaaatttattgaaagtttctaattcagtaattatgtataggagcacagattgcacgcagaaatgacttgtgcacgtgatacaccttgaagactcaaggcagcactctcttcacaaacctagatgaaaaaccattcaacaaaaccacggcttgtccttctccgtcgctttctccatcgagccggcgactttctccgacgaggatggcgccactaggcgacaagctcggcggtgtggagcacgaggacaaccacacatccctctcctctcctcccttctctctctcccttccttggtggcacggagcactagtttggaccatacctgcaaacactgactaggaacatgtggtatagtttggctatgcggtcttcgctttgctcctctaatggaggaggtggcaccgaatatttggttccgtctacccaggccaaacgtctcatgggtgcattgtgaatggcgtaagacaacaggattcctagtgccacccatttcaatagtcaaattgggcatgaaacgtgtgagcatgcatgttgcattggttagtcccttgtcaccttagattctctagctagcacttcaaccttgtcatcttacattagacataacccttccttttttttcttgcctctctgatatggattttcatctctcgaggggacataaggggatgtcccctcgtagttggcatgttatccaaatagttatcaaaaaataaaaaaaattgacaacatagattaatacgaaatatatctgtgacatcctggctcaattgggatttggcctgtgtggcccatgtgagctgtgtgtgcatgtttagtactaccttgctagtttattacgagtggtaccaacttataaggcctctaccctccaaccatatcactcccaggttaacccttttaaacgatgcgaggatgaaagtgtaagtggggtgttgtgtgtaagtgggtccgcccgtcggttgggctgggctacgtggttctggagggagggttgttacaatatcactccacaaacatataaggtcaaatttgacttctacaagttgcaaaaaaaacaaatcaactgaaaatagttactgtacattcgtagttatatttgttatttttgttacaacttgtagaagttaattttaacttgcatgtttgtggagtaatacatttcatattaatctatcttgtcaatcaatttgtttctaattttttgataactccatttcatattataagtcgtttcgactattttccttgactattatagaaaaatttaacagtatcctcaattcaaattagtttcatgatacataacattgaatatattttgataatatatttgttttgtattgaaaatattactatattttctatacacttggtcaaatttaagaaagtttgactaagaaaaaagccaaaacgaattataatatgaaacggagggagtatttagatgacatatatgaaacgtggggatatccccttgagggatgaatacactttcccttgtctttctatatatgtgcaaaagtgtcacataaatacactataataaatattgtacttcatatatattggctcgaggagttcctcagtgtaaatatatttatagcccatatcaatgcgtactttaattcaacaattttaaaaattcaaacctttttcaactgaaccattatatcccagttccacttatatacaaggtcatatttattaaaccttttctcctctttacaacaatttatagggagtttctaattcagtaattacgtttaggagtacagattgcacgcagaaatgacttgttgtgcgcgtgctaccccttgatcaactcctgggccagcactctcttcacaaacctagatgaaaaaccattcgcaatgttgctggccctcgaccgcgctttggagtgcagtggagcaaccttatatgcatgacagtgcagtaagccaaacggatgctttccgcagcatttcgggcatcctacagtactatgtatttaccctgcaattcatgaccgcgttgagatcagtatacaccttacttgagccgatgcacgacaagacgcagcggccttatcctgcaatagctgaagcaccggagatatgtgttcccgatcccttccattcccatgatctggaaaacaaatgtggtggctcacggggaaatctctggacttgtaaatgtactgtatggtaaactagtctttggtctcttcttaatgctagctagttctcagtcacaaccgctagtgttatctagttccatattttgctgctgccatattcttaaattgagaccaccgagtgatcactcaaaagtgtcgcgattgctgattataagctagtaacttgcttctctacgtaactctgaagtacaccatgcatacatattctgactgagagtacgtatatctgctggaagaaagctctcgggataaagtcgatctttgtaccctctggtttcgctctctttcttcttaatacaatttgggcgacctccttcggccgtcccggcaaaaaaaaaaaaagaaagctctcgggatagttctttcaagttttctctttacctatggagttacattacttttgacttttcaacaatgagatcaaattcaagtgtgcataatctgagctggacaagtgcaaattatatagccccgtcaatccttgatcgaatataaaaaccatgcttgtcttccaagcctgcacgaaagcaacctgttcttgccgccgctcatgcatcctccagcttctttcagggtgctactcagttcctagtacaactaactgtaacggcataagaaactaccatgtactcagtccccctcaaaataaaataatttcaaagagttaggaaaaagatctctttcaatcacctaattggtggatatatttttagttttgaattgctgacatgcatttccctcaagcatttggttggctgaaaatatatggattctcgagcatgtaaatcaggagctagaaatgcttatatcgtggaacatattttaaatcctataattgcttatattttaggatgaagagagtagtatttttgctcttgtcttcacatcttacggcttctttggaacacatcattctcaaaatacgggtataaaataatgcaggcttgaagtgccgtaacacctcaaatactacaggtagaccatttggatggagcacagaaaatacgcatgaatcgtaagagaaatagatgcaaacgatctatctttttcccaagtggttagacttcatttaaaatttcctctaaaatccttatgttttgagccaatccaaagaatttcgtaggactttttgttagggttacatatgaaaaaatttcgtatgattgaagtcttataagaacactctcttgaaggaggccgtagattcttcttcttctagaggtagaattcatgggcgtgctgttgggatacgcgtaggctatgatagcataaatcaaaattttctatcgcgtaaaccaggaaccatgcaagtattagatcatagatcgttaccactagacgcgttgagcagcggaaaaagacgttgagaagtcgaaggaactctcgcgaagtagcgcgcgtcgatgtagatgaagtagtcgatcgcaccggctcgaccttctcctcctcgtgcgttctcctcgccgtactcccacgctgatcagcaccgcaaaccagcggtgcctctaccggtatccacacgtacagggacggatcgccacgtgcagatgtgctagcacccgcgcgcggctagggttttgctcggggagaacagtgacggctagggtttcttacgtgatgcaaatgcctccgccggtcacacctctcacgaatatataggatccatcactcgggcctccaaggcccgtaggactcctattcggatccctatccgaattaagctcatattggatctctatccaatccccttattccggcccattaaccgtgcgaccctgtaggttcatatatactc

SEQ ID NO: 39187 - DNA, 1520 bp, Oryza sativa
atcccatcttgattattcatatcccactacatgtttcatagcatacccgagaactacttttataactacccaattatggagtagcgtttagcagtccctaagtaagctactacacatgttgagaaccatgataatctcaggtctaaggattcaatagcaacactcaatgagatcactgatgacacaacacatatggctcttgcagtgtctcatgttgggtctatctaacaacatgttcaccaacatgtgtccacattattaatttggtatctctataccatgatcaattaatacatgtgctgatcatataaacatatttgttccacatatgatatttgatcagggatcctttagaaatagtaacaaacaacataaagagtctcatgaaagaatcacatattcattaaccaataaggagttatctatttcaaggaacaatgtcggataaatatgtaaacatagtatgtgatacaatcatctctatgattgcctctagggcatatcactaacagtctcccacttgcactagagtcaatcatgaatgtatattacacccattgccctagtttgtgcctcatgcttaggctgagggagtggctttgtcaacggatctgcaacattcaaatccgtatgtattttgtgtatcttcacatctcctctacccactatctcgcgaatgaggtgataccgccgtaaaatgtgtttggacttttgatgcgatctaggcccttggcttgcgcaatggcaccactattatcgcaatagaggtccatagggctagaagcactagtcatcacacctagttgagaaacgaatttctttatccaaacaacctcctttgctgcttcagaagcggcaatgtattcggcttctgttgtagaatcagccactgtatcttgcttggaactcttccaactcacagcgcctctattcaggcagaacacaaatccagactgcgatctaaaatcatctttgtcggtttggaagcttgcgtcagtgtaaccatttacaacgagctcttcctatcctccatagactaggaacatatccttagttcttctcaaatacttcaggatattttttacagttatctagtgactctcacctggatctgattggtatcggcttgttgcactaagtgcatatgaaacatttggacgtgtacatagcatagcatacataatggatccgattgccgaggcatatgggatcacactcatcttgtttcactcatcagtcgtctgaggacactgattcttgccaagattaatgccatgtgacatcggtaagaaacctttcttagaatcttgcatgttgaacctcttcaacaccttgtcaatgtatgtactctggcttaatccaattagcctctttgatttatctctatagatccttatgcccagaatatatactacttcccctaagtccttcattgaaaaactatttttcaacgatgtcttaacggattcaagcataggaatatcattcccaatcaataatatgtcatctacatataggat

SEQ ID NO: 39188 - DNA, 19694 bp, Oryza sativa
  unsure (1)..(19694): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagccgtgtcttacgcccttcatttcaaagaagaaaaataaaacgaaaccaaaatttctgtgtgcagcacaaacgcacttatttaatactcagtgcggatacagaattaatgtacatgaacacgaagtaaaagcgacgacgtatgacgacgaacaagaagaagcaaattaagccatcaaccacatgcatacatgtaattatggggagaaagtaattaagcatataaaccgttcgttcttgcgttcattcgatcgggatcgatctagtattggtcggcggcgtgcttcttggcgtccttcttctcgtggtgctcgtggaaggcgaaccccgcggcgcccagcgcggccaccgccgccacctcctccttcaccttgtgcccgtgcgcgttctccgtgtccttcttcgcctggtgcttctcgtgctgcaacgacgtaccacaaataaattctccgttaattatctcttaattaatcagctatggctaggtagttatcattagatcatagttcaccactacataatcgatttttccaagcggctaaaacatataggttagttaaagtgggggatgacatatacgtctgcgaaaatcgattttcttgtaatagtggtggtcaaatgtactaattaatgacttacgagagcgtaggcgccggcggcgatggcgccgaggccgccgagctgctcgaggtgcttgtggtgcttcttctccttgtcgtagtccaccacgccggagctctcctcctccccgtccttcttgtggtggaacaggtggtggtgcttcttctcctcagccatggctagctactcactgattaataatcttagcttccttcagacagagttagtcggttgccggtgttgatctgtgcaaaagctaactagcaaagcacatgtatttatagcaaggagcggctagcatcagctacttgctaataacattagtttgggcctcaaatctcagtttagagggggagggcgtacttgggcgtgtggtatgtgttacgcgcagttgttgttgcaggtatgaactatgaaccctcaaaagtctcaaggaatcaagagagagatatactgtttgggataatggatatatccatctaattaggttaattagctaatggcctatttaatttgataaagactcgttcatggtcactcaccgcgtaatggcgcgctcgatcgatcatcaattaattaatcagagccagtcagccactgcaattatccgaatgggacgtgccagctggtgacctaagatgcatcatcaatactactactaattaactggcatgattattcagaaacctagttactgaaattaccgaatacgtttagttgtttgtacacagtacaatggtgtacataggagttataagtttgccattaatttgttactgcttgaattgtctttcagaaatgaagcagtgtgatggctattacagctcatctgctagatcttcaccttaattggtggaaggacatgcaaacaaagtcaagattcatcagctaagcatcgacatggacaatggttgttagcgtcgaccaaggatttggaaatgtaatcaacacgcggattggccagttgggttttgtcacactccctcggttcttatcagcccggatagagacagcccgacaggacaaagtaggttgaactcggtttcttgatttcttcagagctaaggatacaaaaattaagattcagaaaatgaacggtaaaactgcatgagttgttcaagcacatccttttaacttgtacctgtgggttcaaacctacagatttttctttcgtttgaaattacttgttgttctacctttatcgtgagtaaaatattttcaccgaaccacttttataccttaacccctagcaaattcgagtgcctagttcattggatcaaggtttcaaaaaagttcattagatcaacaactcatggccccacggtgtgatttgggccaagcggccaaccgtcctattttccgttgatgacaacgtgaatttcaagacttttctgaatgagccctttgtaccaattctgaaaccagagatcatcatgcagaccaggcagatcgaaagcgtgtcaggtatactccctccgtcccagaatataataagttttagagttgaacatgattattaaaaaagtaggcagaaatgaatggtggagggttgtgtttggatgagtagtgaaggtaggtgagaaaagtggatggtggagggctgtgattggttgggatgatggataagttgatatattttgggacaaatcctaagtgctaaaggttgttatattttgggacggagggagtactacataccatatgtttagattcgttggtgtagtataagatacgtagatcaatcctaaattgctatgtcctgggatagaggtagtacaaactagtactccctccgtattttaatgtatgacgccgttgacttttcgaccaacgtttgaccattcgttttattcaaatttttttgtgcaaatatgaaaatatttatgtcatgcttaaagaacatttaatgaagaatcaagtcataataaaataaatgataattacataatttttttgaataagacgaatggtcaaacgttggataaaaagtcaacggcgtcatacattaaaatatgaatatggaggtagtacttcatagcgaagaattggaagaactcgcggcttcagaaattcagagcgctgatttggaagcgctcagtgctggaagtaaccgcgggaacgatgcaaaaccacagaaccgtctatgtaaaacacggtatacgcaatctgatttgtacacaagaattttcttgccctttatttgatcgaattgactatattagaaaagaagaacggtgtatttgtgaggaggataacatttatttggcaaaagcaaatatacaagaaaagattaaagaaagagtttaaacaagatttacattttacatctaggaaagaattgagaaggctaaagtaacttacatttggattcagagggagtagtagatatcatttgtccatcccttccctggttttcgttttcactttgaggcgctgtcaagggtctgaatgcacgccttgcgcacgtccggggattaattgtccaaaagaaaactccactagtttctgcctgtattacgatcaatagataacaacaactcacagtaaatatatctgaaacttgacatttttcagttgtaaaatactctcgtatatatgtatgaaatcatctcccgcgcgcatagataatatgtgtatcagtctggcaatttacaagttaactgcaacttatccctttccttttccttcaaaatggttcacaaaattcatcaccagaagcactacaattaatacttgtctgacgatgtagaaatgagctgactttcaaaccaaattacgatcaattgacagagacatctccagcttaataagagtctagaaataaaatttccagcttagcttgactaagtctagaatatagcatatatttccaaatcatatttttagatgattttggtgacaagcgggccacattctcgtggagtcattggtccatttccatgttccagctcaggctgccatgggaagaaccatttctttggactgaaaaaacaaattaaaatgcattattgcatcaatggttcacatggtttcccatcactaattctctaacacatccaccaccattatcgtcataaccatctcatctcattagcaaagggcttctcaacaactgtaacacaggagataatccttattttcctcacaagtatctagattttgtttgctacagatatcaacaaaaatttagtgccaagagagagcacccctgaaacaagtttcactgctaattcaactactaggtaagtagcatcaacgtaatctctcaacctacactacaaaaaaaatctagagctgggatcatgtaaaagtaaaactcaatctgccaatatgaaactgaaagtatgaagcctgcgaagaaatcatccatcgctggttagtgtgaatgctaggagaacacatgagagggtgaaaactatcatagcagaggagaaagacaagatgacacgctgcgagaagcccttcctctcttggccagccagctcaacttcgttcagcagaccccttatttcatccatgtctgaatcttttgcagcctgaaatagtctgttctgaaccttgtcgagctttgcaagccttctggcatgactgttgtctatcgcagaccaaatgaaaccagtcatcctccacaagaggattccgacgtagattgccacgatgcaatcaacactgtaatgatggcgctcccgtatctccctctgagcgctgtggaggacaagaaaccatataacaacagagatccatcccccatatgcttcctgtgacgatggaaaaaggatctattatgataattgaacagtaagtaacagcccaacacagaaattaatcaagatggagttatcatcaggaggaagggccatgcctacgaaaagaaaatagacaagggtaaactgaactcttcaccgcaagagtcctagctgtcacataaatgtagtgcttgattgatttaacaataattatcacagagcatgttagggaatgcttaaaactggttcatgatgtcacttgcaaagaaataaatccaattaatgatgcattgacacaggccatgaaactataaaagcaggcataaccatgtgcattttttaaaagaacatatagcaaggatggcttgatgagtgtataacattctttcgatttaacgtgcagccagttaattccgttttggttttagcagggcataaggagaataaatgaatgcatcttggtcgtgacttgtgacaatctggaagacaaaatagccatagcttaccgtccatgccatagcggtgaggacagcaacaagcatgtggccactatacataagatcactgcagccaccacttgccttcttcagaaaatgataccatgaggacccctcttcaacagttggcctcaaaatgtctactaagaagctcatatgtccccacttaggtctatactcacgagggtactctttaacgaaagctataattaggaaggaagaacattagctactgcaggccaataaaagaagccatatcagtaagggttataagttggatgtgctgaccatatggcatatcctcttgtatgaccctacggatcgcatctggatcagaggcatatggagcatagtatttctgtgcccaaggatgaggatgatcaggtatttgatatcgagcttcagcacaccaaggcctcgcggatggtagaatcgtagcaagaaatgttacagtccgcagcgaacgtccaactgccattgtgaacatatatcttgcagctatgccaagtccagggcctttgatgcagtcaaacagagctgaaaaccccagcatgataaacaacatcagatagtgatgaagactgatgatgggtgctctgaggagatcaaccacaatttgcggaagtttctcattcaatgctagaagcagccactgcccagtgtcgggaagaggagctgtagatctgtggagaaaaaaatggaccagtcttagtttatctcttgttaagatttttatggcacaaaagtgcagaataaacagtgcagtcaaataagcataagcacaaagggaggaagttggtcaggacaaaaagttgtcactgcctcactactagtaatatcttctagtggtagttcaatttcatgggtggagtaaaaaacataccattaatggaaaaaaaaaagtgaaggtgctaacctcactacatatttaactaacaaggcgaaaaaggttatatatggaacaaaatgttgcataaatgcacataaacagttaatagatttctgtgttttccccctaaaggaaccattctatttcctatccaaagcaccactaggatccttaaaaagtttccaagcattgtggacttgagttaatcatccaaataaagtgtgagcaagaactaagaacagattcttaatcttcacgaactaatagaaatgcactaacccacaattgttagatttcagaaacaattgatgtcttatctacagttctcagttctcacaccaatccgttaccagaggtaaaaagtacctgtcttgcaaatcatctgataaataaaatataaacgaaagcaaaacccaatcctaccagcaagcaattcaccgaaatggttttgattggggggtaaccaaatcaagcatttgaaccacagttaatcaatgctcagttttacacattgctacgagtaaccgctgcaagagcattcttcttcgaaaaatcctaatcacaacaaccgcgatccacaggctccacgatgattagcgcaagaacgcgaacaaacgatgtcaccaagcccccgacatttttacccgaaaccccccaaaaaaagaaaccctcgctgatttcgctgcggccggctagaagaagaagggactgaccggtgccaatggaggccgaggacggtggagacgaaacggacggagacggcctcccagaggaacgcggcgagcatgagcgccatggcggcgaagaaccgcggcgcggcgcggagctcggcgtcccaccggcggtagaagggcgcgcgcgcggcggcggccaacgccagcgccccccagagcgccggctgcagccggtcgtgccaccgccaccacgcctgcggcaggtggcggcgcgcgtagtccacgcccacgtacgccgtgggcgtcaggcccagncctgccgcgcccgcgcccgtgggggtggatctgcggtgagcccgtggcggcgtgggcctctttgccttgggcttcggcatggccgggaattccgggttggggggctaggctcctcgatcatgggattcatgggccgggacacgttgggcccgatcgggagagatgcacaaactgttctttgctattaactagctgggtgacctgcgcaattgcgcggctagcatccatataaaattatctatttttctatatttgatattacttaaaatttgttaaatagccattatgttgtcttataattttaaaagatcgaaccttatcatccttaaatttttatagtttttatttaaaagtcacaccagtcgttacctcttactcttttatcacccctttatctgtttacccaatctatcacggatttatttatcttcctttaaacctttaaaaaatagaccttctagtttttagagtccattgtctcgtcaagttcccttattataatttttaggagtgttgtcaaacatcaatactgtaattctccacgatccgtctgttgtctcccacatttattgttattgggattttgaaaattgaacataactatcgttggggttcatcttttactttctagaaatctgcccaaccactgtcggctttactatactcatatatttttattatcattgagattttaaaaattatattattaaaacagccttgaaagaaggtaccacgttcgctgtggggactagaaattcccacattaatcggagaaaaagaaaaggagagtccaagtagaaatacaatctaaaaataaataaaattcggaattaaaaataagcaatattaaaagaagagtccatataaaaacccaatatgtgattattcaaaatttggaataaaaataaaataaaatccgaattagaaaagaaaagaagagtccaagtaggaatacaatttagaaataacggaaattcggaatcgaatacgagataaattaaaattctgaattaaaaataaaataaattctgaattagaaaagagaaaaagagagttaaagcaggaatacaatttagatataactgaaattcggaattaaaaataattaatatatgaagaagagtgcttatataactgaatacgagaataattaaaattcaaattaaaaaataaaataaattctaaaaatagaaaaataattataagagttcttgtaggaatacactttataaataaaaaaaatatcagaataaaaaaattgaaattttcaaaaaattaatcaacctagaagtcaacggtgacaaataacaataaagaaagaagagacaagtaataggcccgtaaaatagtaagatggtgaacagttgatgagacatttacaaattataaacaaaactgcaaatagaacccccaagaacgattaagaggtggaacgacagacatgacgttaagcagtatagtcacaacggttggcgggacttatataaagtaaaaaaaaataaaacacaataacaatcatgttttttttagaatctcaatgataatagataggggagataacgggtataccatataggagtataatggtgtggagccggcggcggttggcgggacttctagaaattaaaaaatgaatccttaaaattcaaaataaaaaataaaataaatttcaaaaatagaaaaataattctaagagttcaagtaggaatacactttacaaataagaaaatatcggaacgaaaaatatggaattttcaaaaaaaaagtccatctagaactcaaacatgacaggtaaccataaagaagagagaaacattaggcccgtaaaggagtaagttggtggcacttgatgcgacatctaaaaactataaacaaaagcacaaatagaatctcaatgatgattaagagaagggacgatagacaagccgttaagcaacatggtcacgacgggtggcaggacttctaaaaagtaaaaagtaaatcacattgacaatctgatagtctatgcataactttttttttttgtagggaagggtatttttcacccggtctctatatctaatcggatatatgtagtcttttaaattaggaacttaataccttaaacaatccaatttgaaatttgctcctacagagatttaaactcaggaccttgagatgctactcatgtcactccaatcactatactacatgcgttttcacaatcactgcataaatggagtagtgaatttcggatatctcagctcagtgccatttcagcctaaggcctaaccgccttatacttgtggcccaagtaaactcgcaaactgagatccggtccaattattcctctcaccgaatgtagtagtacaaaaagcccacgcggcgtcgcctccagctcatctcgccgcctccaccaaatcccccccgcaaatctcgccctcccctttcttcctcctcttctctccttttcccaccaccaacggtcgtttccacccgcacccccatctcgcctcgtcggccatggcggacaacggtggccacgaggatgctccgccgaacggagaccaccacccaccggccatcgtcgcgaacggagacgaccaggagccggcggcgaacggagacgaccaggcggaggcggcggcgaacggaggcgaccaggctgcggcggcgaacgaccaggctgcggcggagaacgaccaagctgcggcggagaacgaccaggctgcggcggagaacgaccaagctgcggcggcaaacggaggggaacacgaggaggcgaacagggacttgccgaatgtagcagggattcgtgccccgcgcgaactgcggcgcgtcgaggtggacgcgctccaccaggtcctcctccgcatgccggccgccgaggtggcccgctgcagcggcgtctgcaggcggctgcgcgacctcatcgccacggactccttccgccgcggccaccagcgccaccgctcccgccaccccatgccgctcttcttctaccgcctcgaccactgggccttccccgaccgcgtccgcgtccacctccgcgccgtcgacgtcgccgccaacgagacccacccggtcatctgcttctcccacgccgacgccgacctccgcagcgccgacccgcgcgtgttcacgatcgagggctcntgngacggcatcctcctcttctcttaccacaccaggctatacgcctcaaacccctccacgcgccggtggcgccgcctcccgccgctccacgacgaccacgtcatcgtcggcttctacggccacggcgccatcgacgagagggagtacagggtgctgtaccacacggcgcgccccggctgccgctactgggtcttctccctgagcttcttcccggaccagccgccgagggacatcgggcgccccgccgacctggagaccgtccgcgccgtgctcgccgaggggatctccccttcctacgagatgccgcccgtcgccatcgcgcacaggctgcactggcgcgcgcaggcggccagcctcaacgtgctggtgttcgacacggtcgccgagtccttcgggtggatacctcccccgaatcaacaggaaggtaatcagatgatcccggtggagggagaccagctgcttgagatcaacgggaggctcgccatgacgctcgtctcgcagaccaccgtggatgtctgggttcttcaggaaggggaggcttgggaacaccattaccagatctcgctgccggtggatctgctcaacgttttcggtggctacgacgacgaaggcttcgtatccgcagcagtgttcgccgtgtcccaggagaggaatgtgctggcacagtgcccggcgatgatgctccagtgcgacaccgaggggaacgtgctcatgttttactccctcgccggccacctcaccgtcctgtccagatatatgctccaggaaagccttcttgcgcatgcgttccttccgatgcggcaggaagatgcaatcgacggcgacccgccgttcttccaaggtccgtaatctgctagatagcaaccaggttttgcaatctgctgaatctatgctttagatgtgtgttcaagtttccgtagatgtagaagaagcttgaaattgcctgtggcaatcaattcgacagaattggtttgttgctgttgctaagtcatttggacattttgtatttagtagcaagcatgctggttgggattcatgttgatacagatgctctctgttaatttctgaattttcagttggactgaaatactgaatgaaaaagctaaccactgttcaccacaatatatagtgttgcatcctttgttgtttgtcttgtttgtttatcataatctgcacaacagcacaagtacataggcagaagctactagttatttcaggcttctgccatgctgactgagtttaccaattagtatgaaatgtatgcttcatgaaatttgcagtgatttatcagttgcatagcacatgatacgtgtgctttgaaaattgtcaagcccaagctttagttgtgtgttccaggaaagtagtatcaaattttgatttgattattagtctgcacgttcaatgcctgaaatatgtaaaccaaagaattgaaaaatgattggcatgatagctctattttattgtcaggcagtcctgttgtactcaattctgaaaccatgttgcgatattgacagtgcacatttaggaatgaataggcatattaatcttcctcagttagtatttgtttactgatttttgttcctagatgctacagtgtttgaaccaactgcatggtttctatgtttgaacacgtgtaaggcatatctccagctccacatagctatattagtagtgcatttgtaatgaattggcaatttcaaatttggacttccacagtttctaatttctggttaatcattatgattatgtgggttctgtttgatttactcccattgtatgagaaatgcatgataatatgattctcaaagttgatcatgcaaatagcttatccaaatggatggtgcgtgcatttgacttcaggtcacagagcagtgatataattctggtagtactttttcgccctttatttctcatgttcttgggtttgcggtgattgttttcacctggtgcagacaattgatactctacatcaatgcttgaaatatgagaaccgaaaatttgaaaaagattggcatggcagtttcatttcgttgttaggcagtctgactgctgtagttaactctgcaaacaatctgttgatactgaaaacaatgtggaaagaataaaaaagtgttacctaatctttgccagctaattgtttactactagatgttacagtatttgtgaacctactacatgatttccatgttttaaaacatttagggagtatctccagctccacatatctatatttgtcgtgcatttgtaatgaataggtaatatttcaaatttggattcccataatttctgatttcaggttgttagtactggtaatccttttggtggttctggtaagggttttaacactatgttccatcatccatgggtgtatctctggatcttactctcttgattaggtttcaaaagattttgcatgactgaaaccgatagttcgtcagtatgtgaggtcaggttattgctgccgtttatgtgaaatggttatatggtcctttaagttgatcatgtaaagagcttacgcaaatggatgcatttatacactttgtagtccaaacataagtggaaattctgtagttcttagaatttacgcgcaatacaagtttgctaagtccaagttgatcatcataatacatactggaattttcttttgacgctttatactggtagcttctttcaagtgccttttctcccgttcctttcaaaaaaaaaaaagtgccttttctccccataagcatccaaatacttcatcaacttgaagtactgaactagtattaatacattagtgaagatttcttattaatgctctgatgtgttccaatctagtttgcaagtttaccggtagaagtttaacctagatgataccgtattctagttattgctttattggggatctgtcttctgtgcaaatgaaaaaaaaaaaatcagagcggaacgataattttatctgttcaatcaattcacgctgaaaacctttaagatatgcacattgaggacttttgcataaaccatgttatgtactacagcacgttgaaattttgttttgtttgttgcaaagagacaatggatcaaccgcataattgttgcagtaatcgcaagaaacgatactgtacaggaaccggcaagacggcctaagcagaaagagcagagaaaacaccattgcaggaagttaaaaaaaatatagcagggtttcttctcttcataaatacacccaacccacaagattatccatccgtacagctgacagtattacacagaataatccaacaatttcaacgtatatatacaggagtttccggcaaattaccatcttgttgctactcttttgtcatctgattgtcacctatactatacatatgtcactataaaatcattggtacatcaaaactgtataatcatgtaaaatgatgcatttttggtacatcaaaactgcacagtcatgtaaaatgcatacttggttttggttgtatactaacatatctcaatttaccaggacaaaacaacaggttagctcctacataccagtaaacataactatactttcttagctaaagttcgttgtttcgtgccatactcgacaattttctcttcaacgtgcagtccctttcttcgcctcacagaattcatgagcttcgttgccaggtttgggccaatgtttgagccatctccgaattcttcaatctcctcgcgagttttcggaacaaagaagggatcctgaggaacagtctcccagtgactgaaggccagaagcgcgctggctgcacctgcagttgcattcctgagcttcttagagaattcagagctctcggcaactgacaaatacgcatgcaccgtgaacaatgaggttccctcctgcatctcttccttcagcaccctcgcccgacaattgccaagaacagcatacatggaacctaactgctcagtaggtgtggtcagttcgcagaagtacattggctccacaagccttggtttgctctcaaggatggctgcctggcatgcttctcggaccgctgtaatgatctgaccactgaaggtgctgtaatggtcagattgattattgctagcatctgcactatccggaagtatgtaaggtttaacaaggaatatcaagccccaagtaggttcaccacataatggtcctgcattggttgcaagctgaaatcctgttgcaatgctgttcttcactgtttcaggatcaagaccatctactgctgattgactgccgtcgatgccaattgtagtttttgcatcagaagaattcacaagccctaacctctcagaaacatggcatgtaccgcgcacgagaataccttctcttccatcttggctggtcaccacaccatcgcttgatgttgcatcaggtgagaggaggagatttggtccaacttgcagaggaccaagtgcccagattctctgaaggtacccaatcaacatctttctgtaactctctgtcttttcatcatccaactgagcagagagcgcttcgagatcactgtctatggcattgatgaggagctgcctaagtgttgatgcagaatcaccgccatcctgcgaaaaccgtgaatccaacacaccattactatttcctgaatccccctcgattacttgagcaagcaattctttgctatcctcaatgaccttagtgacagcattgggaagcctgaagaccttaactctgacagtgaatctcccatttggagtagtcctctcaacaaattcatgtgaagctttcaggctctccattataccggcaccttctccttggatggtgtccttgaacgacaccaatggcttggacacctccagctggactcttgcaaacctctcctgcagattcttgatgcaatgctccaaatgtatctcgccagctgcagcgaggacatgctcgccgcgttccgagacggtgtactcgatgaacgggtcagcctggttgagaagcttgagccccttgacaagggcgcccaaatctgacggattggagggctcaattgcgaccttgagcatcggggacacctggaacatcatgcccgagaacggctggcagttcttggtcgacgacagcgtggcgttcttcagcacgtgatgcccgagcccttcgatcgcgagcacgtcgccggcgcgcacggcggagacgatctccaggtcaggccccatcatctggtacaggtgctgcagctccacctcctgcagatgcttctgctgcattgcgtcgtcccctcctctcagtggatcatacatgggggacaggacgaacaccttgtggccagcacggaggacgccgctgaacaccctcgcgaacgccaagaaacactcccctgattcggcgctggatgatgatcccctgtggttcaggggctcgccattgacgcccctggatggcaggaacctgtatggcacggcgaacatcttggacacgaacaccaccaccggcgcgctggtgctcgcgttgcacgtcgccacgcacctcctcaccttctccacctccgcggcgacagcggcggggcacggcgcggccgccgttagctgctccgtcttggcggccggcatgagccttgccaccctggtggcctgcgcggcgatggggttgggagtgcactccacgaccatgtcgaacaccgcctccgcgagccgcagcttccgcttcatcttgtggtactgaccccagagcggctcgaggacgtacttgacgaacatcggcttcgggttcgggttggccgtcgccgccgccatggcctccttccccaccaccgtcctgctcctctcgtcgaagtacttctgcccccataggcctttgagaagctccgcggggtcggctctgagcttgggggctagtagcttggccagcgtgacgaggcggaagccccagccctcgcgcgcgcaggcgaagacgacgttgccgttctgcggctggaacgcgtcctcctcctcgtcggcggcgtcgccgttgtcggggagttcttgcgagagggcgcaggcggcgtcgagggtggagaagtaggagcgcgagcgcagcgcggagtagatggagttgacctcggacacgatgcggcggaggcgcgcgtgcgcctcggcgggggtgaggcggagctcggcgacgaggcggtccaccttgttgaggacgaggcaggggcggaggcgctcgacgaacgcctggcgcagcgcggcgtgggtctggacccggaccccctcggcggcgtcgacgaggacgagcgccgagtcggcgagccgcgcggcggcggagacctcggagcagaagtcgatgtggcccggggagtcgatcaggtggacgcggtggccgccgccgtcctccccgccgcggcggagcgcgatcgaggccgacttcatggtgatggcccgccgctgctcctcctccaggtggtccatcacgcgggcgctcccggccatcctctcgctcacccggcgctcgctgccgtacgccgcgatgaggtggtcggccaggctggtcttgccgtggtcgacgtgcgccaagatgcaggtgttgcgcacgcgccgtggccctcttcccctccgccgccgccgccgccgccgccattggattagttttggccggtttcgtctacgtcggcggggctctccggcgtacggatatacggatggatagtagtagtctgggcctcgggggaatccgactcgtacacggtacacggcccatgggccagcccaagttgggaacccgtcgccgtttatatctcaaaagaaaaaaaagaaaaaagaaaaaagaaaaaaaagaatcctagttcgtcaccgtcaccgacgccgggaaggaggaggaagcgggtagatggcggcggcggcggcggcgcggctgccgcggacggaggccagggtgctgtcggggcacgagggggcggtgctggcggtgcgattcaatcgggacgggaactactgcctgagctgcggcaaggaccggatcatccgcctctggaacccccacaccggcgccctcgtcaagccctacaagtcccacggccgcgaggtccgcgacgtgaactcctcctcgtaagccacttcgcttcctcttcctcgctgcgattccgtccccccaacaccaacttcccctgtctgatttggaggagctgagcaccagtggggaatttgaggatcctttgcttgcagggacaatgccaagctggtgtcgtgcggcggggacaggcaggtcttctactgggatgtcgcatctgcccgtgtcatccgcaagttccgcggccacaacagcgaggtatggaccccaattctcactgtgatgatgaccgcgctgttgtaattgtttggtgatcgcggttggattgagcaagtgagaagtgctcatgaaaaattgtactattaagcagtttcagcaccatactatcagtgtgttaagcgccgctgctatttcaatactagtattgattttatctatacagagagagcacggttgtttatgataggattagcagtagcctgagattgtagtggaatagagcagttggcactgtttataatcaaacaacgtctgttccattgtgctatgtggagaacaccacgaaatcagcactctagcattatcgatctagtcacaactagtcaattgcagggtgaattgtgtgaaaatgagtgtgctgtaatgatacctctgtaatggtgttgttgtacttccttttaaatctagcactgcacatcgtcaatatgattattgggatactgaaaacagatcaagaacaacctcggtgacaggtttttgatccttgataatattgcttacatacctcaattctgtcttccatagatcaattcagtgaagtttaatgagtttaacacagttgtagtctcagctggctatgatcgcacagtgcgtgcatttgattgcagatcacagagcagtgaccctattcaggtattcttattattgttgaagaacatggacccattgattttagtagtattatttcccctttgtttctcatatacttgggtaactgggtttctggtgatttttttcacttggtgcagacaattgatacttttcaagatagtgtaatgtcagttaatttaaccaacacagaaataattgctggcagtgttgatggtactatccgcacatttgacattcgcatgggtaggtaagtacttttcttatttcacaatcaatattcaaccaattctcatttgttatcttagctttcctaaatggaactttgggtgcttctctttttgaatagaagtattcagatgcttatccatgcttcaacagattatccactgtgtctgatgcttctgttaccctcttgctgataacagggagactgtcgacaacttggggcatcctgtcaactgtatatctttgtcaaatgaccgcaattgcctattagctaattgtttggattctactgtgaggcttctagacaagtaagtattctctgcaagctgactttatacttcaacatcggcagtccctcctctatttcaagagtgacaaaacaacacccttctgtcaatttttaatttggaagacgacataacagcattttctgctaacactaatttcacatattagttacttttctcaccagttagggagctcactccattcctttactggataacatgctgtttcccttattaaattagtcaatccgtgggggctttcttgctcggctctgatacaacagtgatctcatctgccatcttcctcttaaacatgctagcaaaatttgctttccaagagcaagtagaatgagtccaacaactatattttgcatctgtgctgaacattgttggtgttgttgcctgtggagctacttcatttttgcatctgcagtttcctttaaagaaacaatttgggagtttgtattgcaaaatctggttagacactacttttgttttgtggaaaagaaagcttcaagttaacttgtgttatggaactgtttacctttttaatgtcaaatggaccactgtccttggtctttgcaacaaatgtcaagccaagtgaagttaatgtgccattgttgtgccacaccatgtattagtgaacaaatccataccaacagcatggtttaggagccatagtttgcttgtggtccacgtgacctggctactttggatgattttgttgtgcacttgtgcttaactacttacagtgtctgcattatgattgtctgtctgtcattcataggttagacctgcttctgttatagtacaatatggaatgtaagaggttatggttgttttgttttttgaagggagaggctatggttgtaaagggtggttttttctatcctttaattattttctagcaagtccttagagtgcatcactaactttaatgccgtggacttgtggtacatgctgccacaaaattcaactctgactcagaccaaaagaaaaaaaaaactctaccatgtttccattatgaaaactgactgaacaggggatgttgtgactctgaccatgttattttgtagaattcgtgggtgttgtttttacaaaatgctatgtggagggccctaacccactgcaagtgcaccttcatcattaaattgtttcttttggtgattgatccatttatcttttgttgcattgattaggtccactggggaactgttacaagagtacaaagggcatatatgcaaggtatct

SEQ ID NO: 39189 - DNA, 7387 bp, Oryza sativa
aacttcatctgttgatggcaccattcgtgtttggacctaaaagtgggaattgctgttgtgctggactcatatcctgacaacattgcttatgtggcattattctccaattcatctatttttgaagcagagaggattgaaaaggatagatgttcgcaagttcaaccctaactggaaccaaggagctgggtgttaagataagattgtgctacttggcagtagttctggacacggtcaaggcagcaatttgctagtgaggatgaactatatccaccaagctaagtcttctgcgcagcaagctccgacatgtgaaatacagtctgccgatgtaccatggccattacagctagttcaatcgtgagaactggaccagtcgaactgagtatccgtttggaactttacgatctggaacgagtgtacccatttgttactacggtcacctacgggtaatttttaacctgagattgatgatgatataatacggctcttttggtcataaataacttagttcttttcctctaaaaaaaatttaacttagttcttttcgtattgtcgatgacgtcttcaaaattgcttcccataatcttcaaccgacaagtcgtcttgcttgaaatactgaagagagccaagatttacctcaattggcaaaacggcaatttcaacaatgttttattactcgactcggcttatccattagcctgagcgtagtaaagagaagaattcaacaacttaatatcataagatttggcaaaacttctcacttctttggacataaaagaagctcctttagcgtttgaggaataccgaatctatgaacaatatactccaaaataaagtcaattacctccgcacaagtaatattctcgagcggcacggcttcggcccacttagtgaagtaatccattgctactagcacgaaccaatacccttttgataacgaaggataaatttgaccaatgaaatccaaagcccaatctcggaacggccatagtttaatgataggattcaacacagcggtacccgctaattgaacattgccgatccgttatcaagcttcattccctctatagcatttgaaacaatcatcaattattttcggccaatgaaaccccactctcctaagcaaccaatttatcttacgggccgattgatgaattccacaaatctcttcatgtactactctcctagcaactttagattgatcattatctaagtacttcaacaatacttcatctatttttcggcgatataatatttgaacgcttgccgtcgaatctcccgatcaaccttaagtgtaggatctttcaaatatctaatcaaaggaattctccaagctatttctacctcatgggcacaaacgtccgaattcacaattaattcggccttttaatcaatcgtaacgtgcccccagcctcctgtctgggatcggtcagaccagccacgcaatgccggtcagaccgccctgtctgcacggtcagaccggccatgcaaagccggtcagaccgccggtaccaccggtcagaccagccatgcaatgccagtcagaccgcccctggtctatggttttaccaatttcgtccaaagttttgaaatcaagcatcggccttcagtatataatttttcttcacataatagccagatgcttggtgtatcaaattattggaccaaaatttcttctctctagacatataaaaaactataacatccaactaacatatctagatgaatactaattcaaatggcttttgaaacaataatcatcatggcatcaaaacacttagccaattgaagtatgatcaataatgaatcaccaaagtcatatgcctcacacacatgaattccaataaactacaaatgtaaataatcggcttgagcatgtatgcaaaatattaacaatgccaatgtttctaaagaaaacaactgtagaataaatcatcacattgaccattgacattagccgaattactaataagcaaaactttcatggtgcaataaatatgaaatctatatcttatatagtgatccataaaaacacatacgatttggctttaaataaatatcaaagagtcacgagccaaatcatacttgaaacaaattatatgccaacctactaattctactacttagaactggcatttgcaacatgtatgtataatatcaatttgataagcaaaaacacacatgtgctagatagcaagcaatgttctaacatgacataggcatataatataacgatgaacaccataaacccataccttgccttagcatccaacgaacggcggctcgaagatgtgatgttgtatccattgccattcttcttctcttggttccctcatgagcatattaatgtcttgccccccaagcaaaatcggctttcttgattgcacgatttcgaaggcaagatgaataccgcactaacacccatagcatcatgtgaaggagacttatctttaatgaccgatgattcttctctcaccaaattgaatccatcactactctgtgaaagcaccgatcttttaacttttacttctttaggcctacacactcgcttaggtgtcattcgaggctctaaattattacatgttttgttctccacatcttcggcctctttttcttttttacctatggcccgaagacgttgtagcctcttcttttgagagcgagataagccagaaggtatccacttcggctgtggttgttttccaggagctaaataatgattcttaatatttttggtcgaaatagaagctcctgtgttgctctcgattttcccgctcacctttaatgccccttggtctgatcggcctctgggcccggtcaaaccggttgcaagccgtcggtcagaccggccaggagggtcggtcagactggctgtagacaggcggttagatcggccagctgtctcggttagaccgccaatgttgacagttatggcgtcagcttcgatgtcctttgcttgcatggtttccacggcatctccagtaggtacatgaacatcttgagactcctccttgacaacaacgacctccggagctttggcttcttttctcacccacaccttcttcacctttttcaccttttgtcgcgaccgagaaaattaccttttcccgaacgctactgtattaatccccgtcccaggaaaagccggggtacaccaaacaaacatgatacaaaaggcacatctttattatatcgattatatttacattattacaaaggcactttaggcctgacaatcaaaaataaacagcagcggactagcgggcctacggctccatcttcacaggcgctcaactgggatataagccaggactccacctaagacttcttctccaaagcttctcttactgaaggggggaaagattgagtaagaatgagtacaaccaccgtactcagcaagtcacaccgggagatgcatgattaatgcaagggagtacaaggggtaataatataggggttaagttttgcagtaaacagcatttaaaagtcacttagttgcccaaagctattttgtaaacacgatcctagagctatacaatattattaatcaaggccgtggacccacacgaacctgccttaacccaaggcctacgatgattcagaccgaactggcaacccgaccctgggtcccagctcgtcccaagccaacccaggccaaccattccacattttagttattaagcaggtattaagaatttaaaacactaagttgggtatattgctaggcttgaccataaccgagggcgcggctattcgatagattatactctgatcagatgtgtacatctttacccacacgacacattttcctcacgtgtaaccacgtgccacataccaccacggcatacggacgaaagacgtgacatagttcccaacccatcctagccatagacaagagtaccgacccaccccacctacggccggaacctccgggacaggtaggcaggactgagcccctggcagcaggacaccagccctgtgccatgacatctcgactaccgggccgcagctcgtgtagccttcatttgtcctagagatgtccttcggcccccgacttcgtccatctccatccgtgtacttttgtttataaccagactgagccacaaactaagccttacctaatgtctagagttataaaccacataatgttgcctaattaatcaacgaagcatctacctaaattcatattagtggaaccatgaatagagtacccattagttggggttttatttattctagggtgaacaaggtaataataacaatagcaataataatgtcataacaaaggtaaataggcatggctaaataaaacagtgataacgcgggaatttaaataaagcgataatgcattaatttaaatcaaaataattttataaactgggattcaatatgctcaaggatgatgtgacttgccttgctcagagagaacggccttccgaaccttcggcgacgaccgcgaaccacgcttcgggaacctccggaacgacagaagctacgcgaagcacacaagcaaagctacaagcctataaagaagcaataacaatacataaaaagaaagcacagggttctttaggttataacaaacattaggagacttgaacgggtcgattcgaggttcgtatgatcaagatatgatcatccgaagtttaatgctgttatatggagatttgcggattattataattaggttttgcaactataaaacatgtgtaagcgctagcctggaaaagacaggaaggctgcgccgttgacatgcggaccccacatgtcaacctaaaggaccgcggtagaccgagtacacagagacggtccacgggtcgacggaagcggaccccgtgtgtcaaccgaggcgagtggccgacaaacggactccactagacaccacacgggctgcacacgtggaaaccacgcggctaccgagcgggcacactaacacggacactacacggtcaccacccgcacacgtgaacgactaccgacaccggtacgcgggtaccggggtcgacaaccgcacaacgggcacgggcgacaccgaaaggacgaggacggggcagcgaaaggagagatccttaccaccacgcgacgaggcgtgggaacgacaacgacgaacgagcgcggcggagacggctcggggacgacggaggcgaacggcgagggaacgacttcggcggcgatccttggacgaagtcgagacgcggccggcacgaggcttgacgacgcggagccgaggacgaagacgacgacggggctgccgcggctcgcttgacggacacggacgacggacgagaacggctcgacggagggacgaacgccacgacaaccgggaacgacgagaggacgacgacgacgacgaccggggcgggcgaggaggcgacgagggcagccggtagcggctgcacggagacgaggacggcgtggagacgaggctttgggccgggcggccgggcccaggagaagaggagggagaggtggcccggggagagagggaggaggagggagtgggccggggaaggagggagggcggcccaagggagagagggggaaggaaaaagagagggaggagggaaggactttgggctgggctcggcccaaaggaggaaggaggatttatttttagtttttctttttagtaaactttgataattgtttttgttgcttaataaatatttccggtgctctgaaaattcaagtaaaatttgagggctcattttagaccaaggagaatttaacaaaaattctccgggccacattcgaatttttcttgtatgtattttagtgtttgccaatttcttttcgaattttaattaattctattatttcttttagaaaataaattttatttcgggatgaatttatcaggacgtgacacctttgatccaccggaccgattcttttcgtgggaaacggtcttgtcttgagttaaaatgagttggtaccgtcctaggtgattgcttccatccttgatgacacggcataggtggttgaggcatccatggcatataatacataaaaggataaccatatagtgacattggatatggataccatggcatcacaaccggaggtttatatggagttggtatagttgatggctccgattgctttgatgtttgaccaaatctcttcctacgagatgatcttggtcttttcgaatcactagtttggttatcaaaacgttgaccggctaatcctttcttgtacttagccataagcatctcaaaagtgagtttcggctttttagtcttttgggaactagatgagtcatcttttgtaactttatgatcttcggccttcgcattttttgtcctattcttgggccgaggatccccaataataacacatttccctttctttttgccaacatcaatagaactaacagggagatgatcactaacgattccggtcttaggcatagatgtaaccgaaatagtttcacaagtgaccgatgaagtatcaatcggtctttgctccatcaagcttgcatctttgaaataaccatgaaactcatgctccatttgtgaccatgtagaaattgaattaggagcaagtaaactataccatgtagatgcaaagtttgacaacgaaagaggaaacaattttaacttaagcaaatcatcattactggccttaccacattgatcaataaattggccgatatgctccattgttgttctagcatcctcacatatgaatttcgtgaagttgggcacctcaaatccttgcggatatgagatcgaatctacgtgctcaggatacggcatttgatatgtatgcatagctacattggattttatttcactactatcccgcaagacattatcatcatcttttccaacatccacatgactgatttgtgattcggtcttaggtgataatgctatttcactttcacttgtgatgcaatccgaaccgtcatttagttcggctatatcttcaatgatgctattgtccaagctagcaacacaatccgaaccaccacttggttcggctattccatcattgtctaaactagtaacacaatccgaaccaacacttggttcggctataatggttattgcataatcatccaagctagtaagacaatccgaaccaacacttggttcggctataatcgttatggcatcattgcacaaattattaacacaatccgaatcatcgcttggttcggctatacatgatattgcactatcatctaaactagcatttaagctattgtcatccactcggctttcctgagccagagcttcatgcaacacatgatcaacatcaagaaatatttggccattcaatttctctttattagaatcaagcaatccatcatatgcaatgttggccaaatctttatcagttattttcaaactaaaacatcggattttaatatctctaaacc

SEQ ID NO: 39190 - DNA, 6444 bp, Oryza sativa
gcagcagtagatacaggaggatcaaatgttctaagatgatacaaataactagcattggtcattggatctatcccctgaatcggtatgattgcgccggtctgaccggtccagagcctggtctgaccgacatccagaggcgcggtcggaccggcctgagtcccgatctgactgccggggtaatacccggtcagaccggccgtttggccggttggaccgacggcgaagtcgcggtctgaccggccatcaggcctggtcggaccgtctatatgcgccgctccatcggttccactgcttgtttgatctataggagcttggctagcagtggtagaggctttatctttacaaataaaatcggccaagagagggccaactttaaatcttaaaatctcatcaaatttacctccaaaagttgcatctaatctatctttaaaaacaatcatggatgaatctattgtagatgctacttgttgttggatagattgtgttacctctccattgcgtaccaaatcgggagcgagcttaggaagtggcccgggcttaatgatcacaccttgacgagtcctagtgcacgcccttatcaacgcctcctgtgtgatctccttgatatactcctacatggacttgcggtcttctccttcgaaatcatccaatgagatcggcatgatctcgttcccgctcatcatggttgatgaagaaattccttgattaattccagccatatagctcatagccgaaatatttgaccgaataaattaatatccggtcttgatttttcctttgaatataacaagcgtgtgtgcaagtaaaacagaattgcttctgtctcctcgtgtgtaagcaaaaattcagaaaatcgatctcacaataacagccgaaacaatatgaatcggctttgatttttttttaattctcctcagtagatgtgctaatgtatgtactaacagattgatgttgcttctgctgcttgtgacccggtagatcggctctaggagcctgatctttttctctgttgccgtgtgaaacaaaaaggaaacgttgccaagccgtctgctgcttcctgataatgattttcgatacacacgacatggcaagtgcttatatgaatttgatgaacgaccaaatagcttcgccgccgaatagattaatccagcgataagaacagtgcagcgactaattaaggtatagattaatttcggccgtttggccgaaacaaactattcgacgagacgactagattaaacgaaattcggccgtgatatggccgattagatcgttccccagcggagtcgctaaaaatcgtgttgccaacttttttgacaagtcgacaagcatgatcgcaacacctaaacgccttgcggtggtatggagtcgctaaccacctcaatctagctaaacggccaaatcaagatgggttttgaggaaaaacagctaaaccggctagtggagccgatttagagatcaaaatcagcctctaggccgatttagatcgatatgaggataactacccgtctcgtgggcaaaatggaaggttttcaggacaaacctacaaagaggtgtcgcactctcgcagcggcggcagacggtttacggcgcaaaccgataaagatggactaaactagggtaaaatagaaaaacatagtaaaagaacgattcaagtaaattgtattaggggttttacaataaaccggccttttcccttaaatgagggttggtcttgccctttacaagcccttctccacatccaactcgggatagaaaccaatagaaacacgaaacatgccttcccaagcaaggaaacccgagacccgacgaaaacagactcggactcggaccctgacagtctgaccgcccacatacctgcggtcagaccggccctactagccggtcagaccgcccatatacctgcggtctgaccggccctgcgaaggaaacccggtactttccaaactttgacaattttcccctatttcgtccataggtgtcaaatttgggtgtaaacaatgcctattaaaactagatggagggagtactatattagaagtcaagcaactctaattgagctactactccattattgtgagcttaattaagcgtggttatctataccacatgagtgacaggaaagctctgatagtcgtggtgcctgtgcacacgcacgccggcgtgcgtgatcattgcccagatgtgggtgatgaactcgccgccgttggccagcgccagcgcgtgcccctccggacccgccgacggcctctgcgcgacgacgacgagcaacgccgcccagaactcgagaagcatcgtccacacctcctcgaagccctcggtcgactcggaggcgcggtcctcgagcagcttcccgagcttgacccccctggccatggcggacggcgcctccgcctcccagtcgtcgccgaaccgcaccagcttctcccgccggcccgcggtggcgcagctgcagctacggaagaagctgccgaggcccgacttcacgtcgttgtacgccttctccgtccactccgggtcgtcgggaagcagcccgggctcgtaggataccaggtaggcgcagtacctcgacagcgtcaccgccgcctcgcccttgcgcggcagcggctcgccgtcgcagcgggcctcgagcagcgccgtggcgaggtgccacgccaggatcaccgtggcggcgcccttgctgctgtcgcacgcccactcgggcccgtggtggaaagaacccgtgcctgcgcaggacggccacgcagctggtgaactggaggtcgccgccgtcgccgccgtcgctctcgaggaaggccttgagggccgcgacgatggccaccttggcctcggcggtgacgacggcggggcggaggccggcgagcggcgcgagagaatgcgcgacgcgagcatccacacgcggcgcgggtgcagctggtggagcttgagcatggtgacctggtgcgccttgatgacggggcgcgaccggtgcctcacccagaggccgctccggatggcgcgctgggcgtggcgctgctgcgccgcctgcctgcgctggtggtcgcggttgatccgcatccgggcgtagttgcagagcatggaggcggcgaaccagtcggagagcaggtacagcgcgagctcgtaggtctcgacggagaagagggtgagcgtgaggaggaaggtgacgatgaggtcggaggaggagcacaccatgccgacgagcgccgacacctggtggcggaagcacctgaactgcaccaccgtgtcgatggagatgccgatgaatccccggaacagggagcccagcaccctgaacatgttgccgttgccggtgacgagcagcacggcgatgcagtagaggaggatgaagacgacggagaaggcgaagttggcgatgaagatccccggcttcggcagcgccagcgggatgatcgcctggtagtactccaccaagaacctcagctccatctccaccacgtcgaacgccctctcggcgtcggcggcctcgccgccccggtcgccgccgccgagggcgaggaggcccctgaggacgaacgcccgcgcctccggtgtgcctctctccgccatgtggcaccgctctatcctccgccggagcagcttgtagagcgctatgcccaggcagatgtcctccagcttctgcctcctccgcacgttgtacttgaacagcgggtcgctctcggcgagcttccagatggtgctcactcggaccagctgctcctccgtcttgccattgccatcgccatcgccgctcgtcccgccggcggcgaggatgtcctcgaggccgtcgatctcgaagccgtgcggcgtccggttgatcttgagctcgctctcacccatcaccgtgtagttgcatgctctcatggtgcggttgccgcggacgtcgcctccgtcgtcgacaacctgcaggtccagctggcggtgctccccgacgagctgcgccatgtagccggagacgagcgtggcgttcttggcgaggtcgaaggagcccttggcgaggtggatgcaggcggcgcgcttgcagagcttggcgacgctgaagatccagaggatgacgaacagggacttgacggcgaagccgtgtacgtaggagtagacgaggtagccgatccagatcatgcgggcggcgtcctcgacggcgtcgaagaggctgtacctgccgacgccgcgggagaaggcgtcgccggcgggggcgaccatggcgaagaccttcttgcggaggagctcgacgaggagcatccaaaggaggatgaggtaggcgcggaagggaaggtccctgcccttggcctgggagaacatgaaggacatgaaggggaggaagagcgcgaaggaggccctgaagaagatgcgcgtcgccgacgagtggcccctgtgcctgccggagaagcggccgaggacgccgacggcgaacagcgccgcgccgaggaaggtcatgagcaccgtcgtcgtcaccatgaacttctccgtcgtgcgcaggtcgggcgacaccgcgaacgtcgccaccagcatcggccccggcgtcgtgcacaccgtcttgttgttgatgacgatgtcccgcatcactacccacctcccctcgccgccgccgccgcctctcgagtagtgctccatctctcttgcagtagtgtcttgccaatgcatgcagagcgcagtatttgtaggcggctcgatcgtatcgtatgcatgcgtaccggagagcttgtcaggacagggtggtgaagaaattaggcggtgtttaagatcaggggttgaaagtttttcatgtcacatcggatatacggacacacattttaaatgtattaaatatagactaataataaaataaattatatattttgcatgtaaattctgagatgaatttattaagcttaattaatccagtcattattagcaaatgtttagtaccacattatcaaatcatgtagcaactggacttaaaagatttgtttcgtaatttacacgcaatatgtataattaattttttttatatttaatactataatcatatccaaacattcgatgtgacggggtgaaaagtttttgcatggaaagaccttaaaatactttgctcgcaagagaaacaatgctgtgcgcgctgaggggtgggagcatatatgcgatcgatcgacaggggtgaaatctagtgaaaagctgtgtcgggtcgagaggctgctgaacattaacgtacctagctagccggcacacgcaacgtgccaagaatcgaatcggtccttctttttcctgcgatcactgcgtgcagccagccatgcattcaggagtgtgtgcgtcaatggcacgtgttctaagcgagcgggcagggtatatgaataatctttcaactagctagctgtttcacactttcactaatcactcggtggagagaaaaactcttgtccttaatgacagcaaaatatggattacatagtatagaatgggttgtgaactagcagaaggtgagagcacactagtacacacaagatttttccaaacggtcaaaatgcatttttccgtgcagaggtccggtccatctgcacccatgtgtcaacgaaaatccatattttcgcgtgcgggtggccaaccgcacgggataattcatcttcccatgcggtccgattaaggggaccgcacaccgcatgggataatcaattatcctgtgcggtcaaattataccgtcctcacacaaaaaaaatgaaaaaaaatcgaaaaccctaaccctaaccctagaatcgcccgacgccgctgctcgtggtcgccaatgtcctcgtgttgtcgccttggtcgcgccgccaccgccgcttctgagcccgccgctcccggccaccaccgccgttcccgagcccgcctatctcgacagccgctgctcctgagcccgcctccgtcgcaactggccgccatcaccactcccgggctcctcctcctcctcgttgtcggcgcgacgtggatccggccagtcgcccgccgcgccgcctccgccagtatccgctcgctcccggccatcgcctcgtcggtggcagcggtggcgagccgggcgcctgccgcgtcctgtgcgctcggtgggaaggggaggagctagaggagaggagaggaaagggagagagagggaggagtgattgagggagaataaaagggaaaagaaagagagaagatgaaaattttgaagtgagtgagagggaaaagaggaagaggtatttttgtgtgcggtccacttaagaggcccgcacgtgaggcttatttttgtgcgcggaccgttaagagtcccgcatgcgaaaatcaatttttgcgtacgggcctcttaaaggtccgcacgcgaaaataggaggccaatttttgcagacgcacacgaaaacggttcgtctgggaaaatgggagctccttgtttaggaaaatcttttgtgtaccaatagcaccgagtagcacactatgcaccaacccctgacaaatatgagt

SEQ ID NO: 39191 - DNA, 3423 bp, Oryza sativa
  unsure (1)..(3423): unsure at all n locations
cagtagtcaactcacacctcaacgcatctacagcacaacattcttaagtttgagttgcatttaacccctaactagaatttgcacatcccatacataccgacgttcgtggttcgatcgctgcaattttagaaaaggtccacgggcaaaaaaaaaacacatttttcatttgttgtcgttctgctaatcatatagaatctctagctaagaccgaagttggaacttattttattttctggaaaatcattggctgggttctttttaattgatggggatttggactgtgggattgagagtactcgggaaatagttagtgtcggggttgcttgttcattgattcagagtatatctttctacatacaagacaagctaaatcagtacattttgtctttgccttgcaaaccaacgagagcctaagcacttgacaagtgatctctacagcatgctggatatccagggttggaaattcaggaacgaaatttttgaaatttcggtcattttggacccctccggtacgatattatttcggtcggaattttttaatttttttcgtgaattttagtaatatttgttaaaattcaactaaattttgttcaaaattttggaaatttttggaccgatccaggatatccaaggcttcttagcagtccgtgctgccatcctcatcagctgaaagctccgcagggtatcaaaacaggtcattttaattgtacgaaggcgacttattttgagtatcactgtaatcaacagtttgcagcacagcagcagcctttgtcaaattatttgagtgtatacgaaggtttcttttcatcgagaatgtatcaagtttttctggtgtaattgttggtgcctctccatagtccgtaccttcttaatgtcagggtaccaggaataattccaaagttactaaaataagcacggaaaagcattgtagttttttatcccttcaaaaaccctcaagctgatttacgtgtttggatgaaaatatttgttaatgtccaaagcatagtgaaagttaaaacagtttgactttgaccagttaaaatagtttgactttgaccaaaatcaaaacgtcttataatctgaaacgggggagtatgatatatgcgtcgtcagtaactgaaaattgatctaattatgttggttccaaaccgaaattagtggcctttaatcaaaccatcaatgtgatgaaatgccactgataattagagcaagctattactagtgaatgctgacacaaccaggctaacatggctttaagaaggacacagcagaagaaaaacatggaacgaaagaaatcagagcacgaaccaaagagagtctgtgagataagagcaggtacaatagcaggctataagtcagctgcaaacatattttaaggagataaataaaaagagagaagggcagcgggctacagatttgtagccagctgcagcacggacttcaagacactatgtgtgtatgacaggtgggaccaggtattaataatgtagtatgtaactattgtatgaatgagctattagattggctatagatgaattggagctagtagttgctatacttttaaccttgctctaagcagaaggaagatcagagagtagtcacattcacaggcgaaagagagcaagcgagagcaccaaattaaacacgcaagcacagcctactttctagatcatgggcatggaagacaccgggaatgagaacccctctactcggaatctacacagggcatacntgctgttctctaccatccatcagccctagcatggtcgacgcacagtatacagatggagggagcacccgaacacaagaggtacatcgatgcactgccggtgttatattaggtcttggaatgctgccgtgcacgtccgggaattagacagctagcgcacgggattccgttggatatagatgtcacgggatagattaaatgagccagagattaatgtctctcttcacaaggtgctgatttcccactccgtccaagatcttcctcctcggtatcgcgatacctcgtcggcgccggcaagatcgagctctgtatcgcgcgcggagcgcgcgacctcaccggcgacgagtccttgcggcagcatttggcccgaagcagcttgctctccccacccctagctccccccgcaggaaggtacttgatacctcgccggcggtgactcgctgcaactaaccgaagcagttgtgctctccgacgccgtccacaaagtttctcttcacgctctgcagaccgcagctctgctctccgcaccagcatgaggttacctagcaaggtatcatagcatggtttggccatctgttggatttgggctgtgcaaaagcacagttacgtgtcaccggtacgtatgtgatagctataaatggttctggatttgttggaaatagctatagctactactacaacttgttagctgaataatacaacattatcgatacttaagagttatttcatggtactccatgatgatacgtatgtatatgtacaagttgagctactgttaattgggttggattataaaatcttaatacttgactggtacccatcagattcatatgcatgggttacttgactccctcgtcggtcgggtgtgccccggggagtcgtcgccccagggagggcagaagcgggagctcccctcatcctcgccctcggcctcggcgtcaccgtcgtccccgctgcggcctgccactttgcgcctccgggatggacgccggcagcctgtgtcaacctgcagcaggtatagccgtcaacctcctcctcggctcctcctcgagacttctcgcgctctctggctcgggcctcgaccctcacctcgccgtgcctcctcgacgccatcctccaccgttgaagccttccttcccccacatctcctcctctttttgacagtaccctccgatactccacaagtatcaggcttgataccttggtaccaaggtttgatacctaggtaccacctggtaccttaggtaccaggcatcaggtatcggtcgatacctaatcggtaccaaaggtaccaggtactaggtaccaatcggtacctaaggtaccaggtactaggggagcacacgtccctcacctcgccgtgcctcctagacgccatcctccgccgttgcagcgctccctccctcacgtttccctctcttttttacggtaccctctgataccccacaagtatcatgcttgataccttgtaccaaggtctgatatctaggtaccacccagtatcttgggtactaggcatcaggcatcgatcgatacctagtcggtaccaaaggtaccaggtaccaggtaccaaccgtgtagcgcccgttccgtcgtggcgcctagcgggaaaattatctcttaaaaaccctaattgcgaaatttatttctttgcttgttgtctagtgtccgtgccatctcaagatctcaatccc

SEQ ID NO: 39192 - DNA, 874 bp, Oryza sativa
tagcttagagaatccttaatgaatcttcgataatatccagctaagccaaggaagctgcggatctctgacacattcgtgggcgggttccaagcaagtacagcttcaaccttgctgggatctacttcgacaccgttggaggagatcacgtgtccaagaaatgctactcggtctaaccagaatttgcatttcgagaattttgcgaatagttgatgatctctgagcttttccattatcagcctcaggtgttcagcatgttcttcctcattcttggagtatatcaggatgtcatcgatgaacaccacgacaaactggtccaggtattccataaagattttgttcattaagttcatgaagaacgctggagcattggtgagtccgaaggacattactgtgaactcgtatagaccataacgcgttgagaaagcggtcttcgggatatcttcagatctgattttcagttggtggtaacctgacctcaagtcaatttttgagaaaactcttgctcctttaagttgatcgaacaaatcgtcaatccgtggcaacgggtacttgttctttatagttacttcattcagggctctatagtcgattaccattctctcagagccatcctttttcttaaccagaagcactggggctccccaaggggatgagctaggtcgcacataacctttactctccaattcttcgatttgtctcttaacttctgctaactcattagctgccattcggtagggtctttttgcaattggtgcggtgcctggcgccagttttatggcgaactcaatctctcagtctggtggcatactcgttaattcttctgggaatacgtcgggatattcacagactatgggcaccgactccaaggtggtga

SEQ ID NO: 39193 - DNA, 715 bp, Oryza sativa
ccaaaattttgttgtaagttgatgagggagaaaatttgtgtggggaagaaagaatatatagaaatttagttgatttgctaaacaaggttttataaaatagttgagaaggaaaactctagtgaaagttaatcttgaatactagaaaacaaactaaaatgaaaattaaaaaaagtaaaacacattaaaattagtttaaaactttagaaatagtttttaagaattatttggtgtaatattttatgatttttgtatgaataaagatatcttataattattgtatgactgtcattattgtaagaataattatttgtgtgcggtttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtacgttggatttgaaggaaatcaaacgggcgaggaggaaatagctgctgatggtaacgacgttgcggatgatcttagtcagatgttcctttgtta

SEQ ID NO: 39194 - DNA, 1427 bp, Oryza sativa
acttattggctatatggattcagattttgctgctgatttggacaagcgaagatcacttataggttatgcgtttactattggtagttgagccatgagttggaaggcaacattgaagcctgttgttgcccagtctaccactgaaatagaatacaaggctattactgaagcatgtaaggaatcagtttggctgaacggattgtttcctgagcttcatggagttgattcttgcattaacctgttttgtgacggtcaaagtgccatatacctcactaaagatcagatgttccatgagaggataagcacattgatatcaagtaccattatgttcgcgatgtagtcgcacaaggtaagataaatgtctgcaagataagtattcatgataatcttgctgatatgatgacaaagtcagttcatattgctaagtttgagcttttctcaagcttagttggtataatggtttaacccaatagattatttggcgtcgaaagtgtttttctttgttgtgttgagggtgaaggtttgatttatgctacaagaaggaatttgtctcaaggtggagtttgttgagttttaatccaaattcatttgcacacgtataaaggctaacttcggacggagcgaagcggaggcccgtcgccggagacttgggctggagcaaagcggccgttttagggtttcacctttatatatacttctggaatgtaagctgccgttcggcgttctaacctcatccgatatatagtgaagatatttgctagctggcgcctatggtttttctctcctaatttaagaggggttttcacgttaaatcttgtgtcttctgtgattggtgtatcattttttatcgtttatttgccgatcgttttctaaatatatttgttggcatgcagcaagtaatcaaagacagtagttgtagtacgtacatattctctctgtacttgtgctgttaagtcgccgtagtaccttgattgtttatttagccttatacagacttgacgtctcatgcatgtctcatgacagagggagtataaatgatggcctttccgattgtattttcatcccatagttcatctatttataaaagacaatgctccacttctaaagctgcgtgacacacatcgagagctggagcgaactaaagagctggccgggtcagtgtggatgttagcatgtatacacgtacacgcatccgtagcgactctattgatttgttgaaactaattaagatcctagcttagatatgggaggcatggggaattatttagccgccatggaactaaagcttcgccctcgcttgtttctgcgcttcttgtgcaaccgcccatgaacatacgagcaatattttcgctatgaagagcacggggaggatgctggctgcgaggcccgttctggcctggccttctctttgtccagccatgtcgggatgg

SEQ ID NO: 39195 - DNA, 1732 bp, Oryza sativa
agagggattcggcccatcgaacccgagggaggcaaaatagacttttgcggagggattgatttgggaaggatttggattcaggattgaactcgacgatagattgtggatttgagatctgagatggcacggacactagacagcaagcaaagaaacagatttcgcaaatagggtttttaggagatagttttcccgctaggcgccacaacggaacgggcgctacagaatgatagtaaattaaatgttaaaaactctaattaacatatgaaattgccacctgcgtgatttaaaacttttaaaaattgtaagtatcgcatataactagctacacatgatttaaacttgttaaaacctctaataatcgtgcgtaattaacatatgccatacatcaattgatttatatggataatcaatacatccaaaatagtttacatcgtgtacacaataattacggcaatacatcggcggtgacggttgaccgcacatactttctcctcactattgttccctccttgtgatcgctatgtgagtgaggggtgtctttatttgataggaggatgctagggtcaatcgtcaccgtgaaagggggttgcccatccaactgatcgtaatcctcgtcagtcttgtcctcaactccgatgatttttcttttgcctgggagaaccacgtgacgcttaggctcgtcaggccctctgcccttctttcctttgctagacatgtccttcacgaaaaagacttgcgttacatcattggcaaggacaaaaggttcgtccgagtatccaaccttgttaaggtcaaccgttgtcatcccactgtcatcaatcattatgcctccaccagtcaacctaacccattggcaccggaacagagggaccttgagaggaccatagtcaagttctcatatgtcctagatggcaccttaatacgtgccagttgttccatcgtgtcccatggcattgacacgaacagcactgttttggttcatgctcatcatgtcttgagctctcgtgtagaatgtgtacccattgatctcatacccctggaatgtcgcgatcgatccagacggtcccctcgccaggaaggcaagttgttggttgatcgacttgttacccatgagatgttgtcgtatccacgcggggaaagtatcaatgtgatgccgtgtaatccatgcatcggacttaccgatgttcctggcgcgaactagagccaagtgctcctcgatgtaaggagctaccaatgaagattgttgcagaaccgtggaatgggctttacggaataaattgttgtctaccgtcattattgctttccttccgagagttccctttccctgtagtctcccttcatggcgtgattcaggtaccccgattgggcgaagatctttgataaattctacacaaaattcgatgacctcctctgctccataacccttggcgatgcttgcctctggatgagcacggttacgaacatacttcttcagaatgcccatgtacctctcgaaaggaaacatgttgtgtaggtacacaggcccaagaatactgatctctttcacaaggtgacaaagcagatgcgtcattatattgaaaaatgaaggtggaaatatcaactcaaaactgatgagacattgcaccacatcattctgaagggtttctaatctatccggatcgatgaccttctgcgaaattgcgttcatgaatgtacatagctttgttattattgcccggacattgtctggaag

SEQ ID NO: 39196 - DNA, 1464 bp, Oryza sativa
aagcttggaggtctcccgacgtggctgatccccacgggctgggtgatccgggttagtaatgtcgtgtgggtaaagtgtaccccctctgcagaggttaacaaactgttcgaacagccatgcccacggtcatgggtggatgtgaggtgattcctagcgtagttttgtttgactactgtttgtgaaattgctgttgtggaaaggagatcgatgtttggaaaaatctgcaactgatgggatcagctaggcccgggtggccgtttgaaagctgttggccgggtgccaatcttgatctattttaaagattgatacattgcacatactccgaccggacgagacgcactgtcttaaccgtgtcgtttgagaagcactcacttagttgattttttttaaaagagttcaaataaaataaattgcaaaaacaacagtccttcccttgaagcctgcattaaacactatttcccatggcttgctgagtactcctgtactcacccttgctctatataaataatcccccccagttgctgaagaagatgaagcggatctcgctgacgaggagtttttccaggagcaagccggctacgatgagttttagggtttcggcctagttcccaagtcgcgcctgtgttgtttggcccaagtcttggcttccgcttcccttttataatgcagttgtgagcttgggatctgtccgcagcccaacatgactgtactcctactctataataaagagacctctgttgctgtgatattctgtctccctgtgataccagcactgtttcctgggactggtatcgattaacaggttaatttggagcatcacgggctagttccggtcgggactagttcggggcgtgacacattcatatgctaattataattgactagagaatttttaaaagtttcaaatcatgcatgtggcatttacatatgttaattagagtttttcacaatttaatttactatcattcatatgctaattatatttgactattcgaatttttaaaatttttaaatcatgcatgtggcatttacatatgttaattaaagtttttcacaatttaatttaatataattcctttgctaagtatatatgatgattacaatttttattaattttaaatcatgccgtatgtatatacatatgttaattagagcttttaccaatttaataatatcattcatatgctaagtatatatgattattagaatttttattaattttaaatcatatatttgcttattaagttttatccacttaatttattatagacaacaataatttttcgaagtaattgtcattaatctttgtactttaaataattgtaatgcattatcttctattttagaaacacatatgtaatggaaaataatatttagtgtgcttatcagtagtcccggttcttaaccctaaccgggtttaaaaagaatttggaaatagcgggaaaatatctttagtcccggttg

SEQ ID NO: 39197 - DNA, 2127 bp, Oryza sativa
agcatacatggctatttttgtcttagcatataagattatttgagttttaatataagattgttaaaacataaatgtctcatgactaagcagatatttcctgtataaacaggtggctgatcgcgatgaggaacagatattgtacgattcaatcgcggagggaagcagccagtactggaacgaagaagaggggaacgaggatccaaaccagtatttgaacgaggaagggaacgtggagagggatgcggaggggaaccaggaggggcacgtggaaagggatgtggaggggaaacaggaggaggaggctagtggaagtcaaccctccgttggacagaagagggcacgcgggcaacgaggtgccgcgaagaagcttgagggttggcacatcataacggaagtggaagaagatggacgacctagtgccccggcagaagccgccaagaactatgtacgtcacagcggttgggttgtgcgggataacgtgcctgtcagtacggtgtactggtgaagaacaagggcacgcggagatcatgagagctttgtcctagattcggagaaagagatgctgtggaccacaatgctcgagacattcacccttcccgtgggtacagaggacaaaatggaaaggtggactctaaagaaaatggcagaacagtttcagagcttcaagggagagctgtacaagaaatatatcctgaaggggcagacaccgaacttcgacacattcccaaagctaagggatcaccgggacgagttcgttgcatataagacaggtgaacaagggcaggcgatgatggaaagaaacaaagaaaatgccaccaagaagaagtaccatcaccacttggggtcaggcggctatagcgtcgcgatgccgaagtgggaggagatggaggctagcttgcttgagaggggtatcaaaccggccaccgctaattggccggaacgatcgaagttctagtactatgctcacggtggaacgctcaacccagctgatggctcactggtcttcggcgatcagatacgagaggctgcgcgtcgactaacagatgcagttgaagcctcttctcaggacacattccgaccggatagagagagggacgagctgtcactcgccctgtagactccagagcatccaggacgaacacgaggcaaaggggtgattccttggaagattgggttcaaggaggacatccacacgtacaggagtcggatgaggagcaagagagataccgaggcgaagattgcagatcttgagttcagggtatcgagctacgagctcagcatgcaagaggaggtggcaaggaaggttgatgaacgcatggccgcacatcggtccactgatccccagccgaccattcctcctgcaatggtgagcccgttaggaaaccgtagcagctgcgcttcaacggggcaggtaggatcacagagcatggacgccatgcaaacccaggacgaatccacctgccccgttgatgacatcactcaacggacaccatgtgagctacatattcctttcaagaacttatcaataaaggtaagctcgtagtttatatattttagatttgcccattccgctagttgctgcttatatatgttgattactaataaataacctctcaccacatgaaggtggtgtcgggcatggccatcccaacggaaccttcaggtacttaccactgcaggccgattccagcaggatactcgaaggtcgaagttgagttggtcaaaggcgcgtacgaggacctcgagctggattaccctagaggagacggtgagacgcatctatgagacacaagccatgccattattctatgggcgacaagcggcgtctcgtgcaccatctcctccggccccgccatctcctcctcaggatcctgcactgtctcctcctcatgctccagcaccgtctccacctcaagctcctgcaccgactcctcctcgggctcctgcaccgactcctccgcaagctcctcttccgacaccttcaaagtcaagggccccccaagctccaccacctgcccacacaagggcaacgaagaaggcgaaagttgacgccgccaagaacaaggacccggggtacgattgcacgcaagaggagcttgacgcttacgtggcatcagaagtcaagag

SEQ ID NO: 39198 - DNA, 1843 bp, Oryza sativa
acagcgtcactgtgagatcatgtctttgaggccggatcgattcgtcgtggccttatgctgtcacattggcaatgtgtgccctgcctgcatgcttgtcttcaccatagatcaccttcgctcaccctgagcgctcgtggaggttcaacctggtaggacgttgggagcaccacagagcagttgtgattcatcaatcaaacgctaattccagcgccctatcatggcaatgtggccaattggccaaacacatggcttataatttggatcatgaaccacaaaggcatgcaatggaataacctgataaattaaccaagcagccatatggaaatttgctgaaactaacatgggcaaaaatgcaacatgcacgtgcgcattataggcctgagaggcatctggagctatgtttctcccaactcattttggttaccgtgatctccgaagcaagtgaccaccagatatcaacaattcaaccctagtccagggttgttttccagtgtctgtcatgcatgtaccacactgtcgcgttcgtcttacctctcccgccttagttttttttaagggaaaacaacactagattgtgccttttcattgaatatagcggtagaaaaaacagctcctaggggcaagaaaagtgaaaaatgttgtacactttaaatattatacatggaggggtagaaggtcccgcaaacgctttgctcctccatcgcccaagtccacgcctcttccttgatctgggcgaacaggaaagatgatatggcattcttgtgctgtcgttgattcctttccttccatatctcccaaactatgaggaggacgagggtgcacaaacctctcttaggaacacctgccgtgttagctagtgtctcccaccaatctttgatagtttgggtcgtctcccaatgcctagggtcgagctgctggtaagccacctagtcgactaccatgctccatattcctttcgtgtatctgcaactgacaagaagatatgggactgtttcgccttctctgcagcagagtgggcagagcccattgttttgccatactctagtcgcgactcgattggaggtccaaacccagttttaaatgactagccaagcgtggaatttacacttccctggcgcccaaactctccagatgagcgaatgaaagttcatggatgtcatgctgaagcattgtgcctgctaagccgacaatgctgattgctgagtattctccatggtttgtgaatttccacacaatttggtctaactgcttattgtttaagtgaatgtctctcacgacaatccataaagagactagttgttcaataaggtccaccgagattgctgggttagcttcaaagtctaagttgttgatccaagcatcattttcttttccctgtcgtagggacttgtctttttttcttcgagattgcacagactagtggcatgaggtcctttgatctgcgcccatctatccacacggaatcccaaagcgcattgtgtttctgtctccaacggttatttttgttgacacagcgaagagtacctcttttgccttagtacttgctgttagcatggagctagctagcttgtttacaagagtaaattttagtttatgtggcatgagtgagataaattggtgttctctcctcacaaacagcagtgactggtgtagttgaaattaacagattactaccaaattattgtcactgatttaattaatacttgattagtggttgaattaaatattttatgaaatgaacaaaacaaatatcttatagcaagtgttatagacagtagttttattgaagaaaaaaaatgaagatgcagagaaaaaaaaatctgtgccaatagttttattattt

SEQ ID NO: 39199 - DNA, 1556 bp, Oryza sativa
actttggttattgctttaactgacatgaaccatgaattgcttgtatgctaattattaattgtaacctctttactgaaatatatatttatgttggaatgtgttgtgctcttgtgtgcttgttggtggtttatattgtgatggaaataagctttgatggatatagtaaacaaattgcaaatagcatatttttttattaacacgttctcttaccgggtgcttcaaacacggtaacgcaccacatgttaccgggtgtgaatgaaacacggtaacacaccaaatgttaccgtgtgtgaaggacactcggtaagccaccgttccgttagaagctccgttacacaagagtccagctacgcacggcagccttaccgtgtgattcagcacacacggtatgtgttttggccttcccatgcgcataattgtaaaacacccgggaagtgcgcacggtaaactgatgaagccgccgagtatctgttcccatgcactagcacccggtaacgtcgttaccgtgtgtttttggcctgttaccgtaggttttgagcacacgagagccttacagtctccagtagtgaaatttatatctctgttaagacccacgttatgtttacggtgtggcactgaatcggaacgattttcgcaggagaacttaccacattcaaagcagggtgggaacgaatacgttagctaaatttatttattcgttctcatatgtgtgtggacatatcccattcccatcacacaatagcatgagagtgctgaattatgagaaggaaaatgttacacgatgacactgaagacatatacattccgtacccttctgaagttgtttttttttattaagattaaagaggtagatgaaattaaatgagacatgattacgattggtggatataaatatggtgtataccgtcgtgtgcgcttaattaatgcgatgatcacaagatcaatcttttcaaaatggagggagacaaccggcaatggtgtctgctgcttactgtttttagacgacaacaatggcggctacatatatagttgatgcaaagcctaaaccaagtgttcaacccatctaacccgctgaaacagcccaactcaaacacaggacttgggggctgtttggatgacggtactttgccacaaaagatttaacaaagtgtgacaactcatatatatatatgcgtggccaaaattttattggtcatactacttgtagaaagcagggtaacaaatcctatggtaagtggcttatttagtcaaatagttaccatcctcaaccaaataaccccatagatactcacagactggaaatcctaatcggcgatcgatcgcctgggatgggggtagcgatcaattcccctccccttccctccctccactggtttccttttttggcaccgcattactttttattttcgtaaatttagccccttaaagtttaaacccctcaagtttacccatataaagtttaaagacccaaagttcccacacataaagtttagagacccaaagtttacacatctaaagtttagagaacaaaagtttatatatccgattggggtgca

SEQ ID NO: 39200 - DNA, 1819 bp, Oryza sativa
aatcactaagtgatttattctttctaagtttgggccgaaaagagacttgcgtctcgattcgactttaagagatgtttttcaacagctcatttggtaatgtaccgacctcccgggtcagatcattacttctcggctctcagagccattccacttgattaatcagctcccagagcctttttcattttctcggactcccagagtccagctgcccagcagcacaacaatccgcttccactcgggaagcctagtctatgatgcccgcagacatcccgaatcacacagattcgtttctgaccactcaggtcgtccatctgccacataggctgattctggttacgattcccacaccacaacaacttttcacaaagcacaggcaaacaaatctacgcagcgggaaccacctcacatccgcccatgaccgtgggcacggctgttcgaacagttagttaacctctgcagaggggtacactttacccacaagatacgaacttattccgaacacccgtcggtatcggaggttcgcaacaaagcctttcccaagccgacccagggttacctcatgccacatagaaggatcaaatcctcacataaacataggccattttaggcgttcacaaatcaaactccaaccaccttgatcggtaagtgagcaagcttctcgtccttgccttaccaggaacccggtttgtccgaccccgccccggtgttcccaacaattggcatacgaggtttccctgaaccgactagttacttagccagggtgtcccattccaccttgtggttgcactttgattatgttcgatgagtttcccacaggaatcggtccttatatgcgaatacgggacagtgccacataggcacaacccccgcatcgcgagttttcacaattcattttattatcaaacacaccgacaccacatgtcgggttttgaaggcttcacaaacccatttcccaagttttcgacaaacaacggtgtatgtgggatatttggtatacgcgctcagagagcacgaataccgaggtaccacaagggtggagcgacaaggaatcagggtagtacgacctacggaaaatagtgcgactactgggtaggtccgccggtttggcacgcaaactgaggccaagcaagttaagtgtgattctaataatgcaagttgtaaacaaaataataatgacttttcaattataggggcaattgatcaaagggtgacttgccttgctcaaggtcttcacgaagcttcacgaatcatcgagaaaacccgcgatcgacgaaaatccgataaccgcaactatacgcaaacaattgaaaacctaaacaaaggaccaaaagaaagatcctatttagactaattagtagtgccaataaatagatctcaattttacggaattattggaagtggaacggagtcgatcggagctacggatcaagggatatgaattttggaggtctaaatggattttctggacaaggaaatgttttgtcggaatttatggaaataatattctcaagaatattattgacagtcacttaccaaggaaaatgattcatggaattttggaataaggaattgatttctgaaagagggaaaaatgatttattgaatttatagaaaagagaaatatttgtggagtattggaaaagatattctcaagaatatctttgactcattgacaagtggggccaacaagaagtgagagtgagagaggatagatgggctgcggtccaataggtggcggatgtggtagggggaggacgagggagcaaagttagactttgttccacggcagctggtttggaagagggaggcaacatagact

SEQ ID NO: 39201 - DNA, 2528 bp, Oryza sativa
  unsure (1)..(2528): unsure at all n locations
atttccaaacccgattcctccccacaagcacgatagaactacagactcacggccaaactactaactcaagcaaatctaaatgcaacttcaaaactgaccgacagaaacttctagaaactacaaaaatagaaccgtggcagcgagccgattccattttcgtaggtcccgacaacaacagagacacggtggcagcgacgactgtggtacaaaacgtgaccagaacttgaaactctaaacgaactagacgctaagaccagcaacacgacgtgacgatgcaacacaaaattcaacaaagcaaaaattgaaaagaacaatgcaatggcacaatatggttaggtaaatgatacgaatttttttgtatggctattttctggttataggaagatgaagactcaccgagcaacgaaagctctgataccacctgatgaaccctgagttccactcggcactcaagactgttgttggcccgatctttcggtgagttgagataactatgatttgggagaaacattgacgatccgactacaaccgtacaagacgttgtgttgcgcctttgcgatcgatacacctctccgtgggttgttgatcttgccggtgcagatcaaccttattcctacaagtaaatcgaagaaacaagcaagaacaagataaaagcaatctgaattgcaaataggaatgaatacacacgataagttggggtttcgaatacaagcagacggatggtctagccgacacgcgcgctgcaaggaagtagcaatggctaaactttcatctaaacaaaacccaataaaccctgaaggggtacctagctatatataggggtgggaggatgacctagggatgcctaggggcgtgctccacctggttggggcgcaccccacatgggccccacctgggccggggtcccaaatgaagttacaagcccataggcccattataggtgacgcagcaccttgtgcctgtgattccggccacacgagatggaattcggggatgaggctggatccgttggaaagaggctctgagagctttccatcaagtactcacgggctgaaaacggaggtcgtatgcagattcggtggccgtttgaagtcagcagtgtagtaggtggccgaatcagattccagcacttggagtacttgatctcgatatcttcttgttcatccatgatgtgagcaatggttgcatacatggtagccatggtcacatcatcctccccttctttaccgaaaaccgtcctcggtttttccatatagtgctctttgcgtagtccatttacaacaacctgtntcttccaatcaaaacaaggcaaactcgagacaatntggttagcaataacattntctctagcttgcatgtttaatccacatgtccaggatgttctaaatctgagcagatgtaaactctatgcacagaatatattccaagatcattataatcgccaaagatgtgaaatataacattacgaggacttggctaatcagaatgagcaaatattttgtccttcaaacaattgagctcacaagaatcatcaaacataacatagcccaatgtatttaaagaagattgcaattgaagttcatcattctcgctggacgtgtgaataacatacttaaattcagtacatggagaatcaagattaaaagtagcatgttcattcactagttgtggaatggatataagtgaagtactatcgcacaactcttctttatcacaaggaacagaatgcaaatcaacttgtgacaaaggcaattcagaagtaggttccactaaagtttgctctagatcagcatggaaagtggaaaaatgtaattcatcagaagcatactcatcttgagtaatttctgcaccatttaatttaccttttatgccctcttcagataatgtaggtgcattagccttctcctcattcgcgagtgaaggaagtgacatctcaaacatatcgttcttctcattttggggactgttctgaacttcctgcaaaacatcagtgataggaggcacaagcatagcttgttgctccgttgggttctccaaaattttgcgctcaacattgcaagcaagcatgaacaattggcctatatgattatatgtcacattaacaagcccagcctgaatattggaattaagtcatctgaaaaatctagtcattgtgttctcattagattcttgtaaatcactataagtgataccaattttaaaatcatgaaagtactccctaacagttttgtcaccttattttagatgttcaaatttctcaaggagagcacgtctatagtatgaaaacacaaatctttttctcatcagtattttgcattcatcctaagtttcaagcttatttcccacagtatgccaccaaaaagacacagaaccggtacacttattactagcagccttaatcatttgagcattagaaaaatcatactcatcaaattgtttttctactgctagttcccaattaacataagcggcggaatcatacttaccatcaaaaccaggcaatttagattctacccttgtaagatcat

SEQ ID NO: 39202 - DNA, 1400 bp, Oryza sativa
gaaacacaatttaccggtccttagcttctgagctagcagcgagtactactacgtcgaaatcgtagctagctaggacatataatggattgtaattaatacatgactacatatgtttctatatgcatgtgtacacattttctataatgtaaatatattttgttcatatatatatctatatacatatgcatttgcataacatatatatgtataaatacatatatattatgcatgtatatacatataatataatatatatatatatataaaccatgcagcaacaggggcatgcaaaaaaaaaggtcagctcgatctttagtcccggattggtactcccggtttggaaaccgggactaaaggggggttacgaaccgggactacaaagggtttcttcaccagtgtaccgtgaagtaccgatacctcgagttattttttgttggatcggagcaaatctctaatttgagaagtttattgttggcgtcttctcgtggtactgtggattgggcagagtctattttacatgtcttttctgagttctgatccactttaagcttcaagcttcaagatacttctgtttcacgtcgtttcatattacatataggcagcacgattgcaaatggacatgttcgaaggaatacggttctatactccttaggagtagataattttaccattctttaaaaattaccatgaggtactacgtacactttatactataaaattggtacctccaaatactaattatcttgagatataaaaaatttagaataaaatttagaaaccttgaggtacttttttaaagactataaaatttctcctaggagtaggtacacccgtacacctgatctcatccaacatccatcaaacccaagcccgatcaaacggtgtttatatttacccgtttagattttgtacaggaaaaacctgaccgcatgtaccggccgagtgcatgcatgcagaaatttgaaaataaaggaatgtcattttcttcctgtcctttcagtccaaactatttattagtatcaactaacggatatccaataagaaggggagtacgtatacatggtagtacaaaatggccatccttcgacatccttgttggaattgtgctagagaaaagcttgattttttacttccaaataaccataaaattattgctcaattttccttttattttctccgttgtgtaatatcaatacgaaacaaatgcagccagaatacaaccacagaatacgagcaattgaccaaaagatagaacagctgacagctcagtccaatatcgccaagtagtaggactaggctccttaacatctatacagagactgagagacccatacttggttggaatcgtggacatggaacaagatgaccatttgcatcacaactagcagtgctctgcgtgt

SEQ ID NO: 39203 - DNA, 3435 bp, Oryza sativa
  unsure (1)..(3435): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtcccatgctccactaaaatcaagcgcacaagcccttaacatatcctccaatatttgattgacccgctcggtctgaccatcggtctgcggatggtaggctgtgctgaagttcagccgggttcccaattcctcttgcaatttctgccagaactttgaagtgaattggctccctcgatcagatactatctttttgggtactccatgcagacacatgattctcgagagatagagctctgccaaccttttgcctgtatggtagtatgcacaggaatgaaatgagcaactttggtaagtcgatccacgaccacccagattgaatcgtggcccgatgatgtcctggcagacctgttatgaaatctatcccaatttcgtcccatttccattccgggatctgaagaggttgtaacaatcctgcgggcctatgatgttctgcttaactcgctgacaaacatcgcagagcgcgacgaattcagctatttccctcctcatgctggcccaccaaaaattttctttgagatcttggtacatctaggtactaccccgatgaaatggagtattgagtttgatgagcctcagtgagtaatcagatctttttagttttttgtcatcaggcacacacaatttttctcccatgcagattgtgcatggttcatctttaaggaaaatccgggcttttccaacccacatattcttttcagttcagctatctcaggatcatttacttgagctgctctgacttgatccacgagcgtaggacgtgcctttagagcagctacgaacccgtgttctacgattcccatgttgagacgttcaagctcttgctgcaattccttacacatgccttcggtgcataaagcattgtagtagctcttcctgcttaatgcatctgccaccacattggctttgcctggatggtagtgaatgctcatgtcataatctttgattaactccaaccatcttcgctgtcggagatttagatcaggttgggtgaagatatatttcagactcttgtgatctatatatacttcgcagtggttgccaatcagatattgcctccagattttcaaagcatgaaccaccgctgccaatttcaggtcatgtgttggatagttcccttcatgtggacgcaactgccgcgaggcataagcgaccactttgccgttttgcattagaacacatccaagcccgtggcgggacgcgtcgcaatagacttggaagtcctttgtttggtcgggcagaatcagaactggagcagacactaatctcttcttgagctcctcaaaactcttgtcacactcggccgtcatttaaatttctcatctttcttaagcaactgagtcatgggtctagcgatcctggagaaattttcaatgaaccgacggtaataacctgcaagtcgaagaaaactccgaatctatgacacggtcttaggtggggtccatttggtaactgactccacattcggtggatcgactgccacgccctgagctgtaatgacgtgacccagaaatttgacttccgacaaccagaagtcacacttactgaacttggcatataactggtgctccttcaacttctcgagtactagaaggagatgttgctcatgttcttcttcagactttgaatagataagtatgtcgtcaatgaataccacaacaaacttatcgagaaattccatgaacactttgttcatcaggttcatgaagaatgcaggtgcattggtaagtccaaaagatataaccgtgcactcatacaacccataccaagtggtaaaggctgacttgggaatatcctcttcccaaatcctcaactggttgtagcctgatcgcaggtctattatggaaaacaccttggctcctttcagctgattgaacagatcatcaatccgcggcaacgggtatttgttcttgaaagtgacctcattgagtgtgcgataatcgacacacattctcttcgtcttgtccttcttctccacaaaaatgactggagcaccccaaagtgaagtactcggtcgaatgtaccctttctgcagctgctcatcaacctgcttcttgacctctgctagctcggtggctgccattctgtacggtcttatgtaaatcggagcagcacccggggccaaatcaattgtgaattcaatctctctcttgggtggcatggtagtgaggtcctcggggaacacttctggatacttgcagactatggggatatcttccaacttcctcgaactcttctcctcggtgaccactggaatttccacctcaatctgattcaaggagaccccctgctttggtgagactggagatttgtacactactgtttctcccttctcattggtcaaggtgactgtgcgattcacacaatcaatgacacccttgaacttggttagccaatccatcccaagattgatatctaggtctttggattcgagaagaatgaggttggctagaaatggtgatctttggatttctattgttatagaagggctgaattgaaccgaagtggagctattccctagggtatgaacccgcattggtgtactaagttcttcccttattaacccatgtatcccaacaaacttctttccaatgaacgaatgcgttgcaccagaatcgaaaagtactgttgtagggattgagttaacaggaaacgtacccagtacgacctctggtgctacttgcgcctcttctgcggacgcgtggttgacacgagcctgggcaaaccttggcccggcacgccttggcttcgggcatttgtcagcaaagtggccatgctcgccacagttgaagcaggatcctggctttgctccagtctccttcttggcttgggctgatggagctgactgtgctggtgccaatggtgggcgtggagctgcactgcggttgggctgacctccctggtggttctggctgccactagcgccctggtggaagctgctcgagttgaaagggcgatgttggcggacgatcatggtggtaggtgtttacacccaaatttggcacctaggattaaaataggaaagattgccgaaaattggaagtctaccggtttcctccgagtgggccggtccgacagccatgtcttggccggtcagaccgccggttgagagccggtcagaccggcggtgtgtggccggtctgacgggc

SEQ ID NO: 39204 - DNA, 747 bp, Oryza sativa
caaacagaggagcatgtgactctcatcataatagaatcaaatggaactcaatagataggttcaggtaaaaaggacacaataaaaaagctaaatggaagtatagtctgtactgtaccatgatgcataagaaactcggttatcactctcaatcctaagcaaacctaaaagaacctgtaaaagaaaattatctgtcaactaaaatacaattgcactcaatatataaatggcaaaaataactatatgggtaacgaaaattagcacagcgttttgtatagagcagttagtggagtgtatggcatggttgagataatgcttgtccagtatcaaaagaaaagtcaatgctagtatgaggttgatctgccttcccaatctgaccaagtggaaccaactacagtttataaaaacaatatggtaagaacagaaataaagcatacttttatttgacagctgcagagaaacatgtctgtattgtttcatcacttggaaatgtttttcaataatccagtcaaagaaccgcagtgtgttgatttgtactcgcactgctcacagcaggattgaagtaattggataactctcacacatctgggaaagaaacaagcataaataacaagctgagtcatatatatcccattaacttacacagtaaggtgattctaaaatcatacacacaatattaccttgcagcaccgtttaaatgttcaatcatactaactccaatcaactttagacaataaggggtgcaggaat

SEQ ID NO: 39205 - DNA, 3309 bp, Oryza sativa
cagagggcttggtcgaaatgctgtgtcccaattgagcaggtgattgtgggacaccccggatctttcttcttctctggaagtcggtggagtaaagcgttgctacactccttcgtcagtttcaccacctctgtggttgctacactccttggtcagttcctcctttgtcagtctcttgttgtttagaatgtccttcaggtagcaagcgtgtgtgggtacttgcatcacatccaaaagtggcacgtttatgtggatcttttgaatgacttcaacaaaacgagaggactgctcgtccacggatggctttcgatatcattgaggaaatggcagcagattggtatcacgatattcctgaggtgctatctcctctgtccctgctgtgctagattgagatgtatcctcgctgttcctcctagttcatgcagtgttaagatacggtggatcctaagtcgattttcctcccctcatgatgattgccttaacattttctatggagggttcgggttgccctggaatcctcccagtctcattagcagggactagagtagctagttgcgtcagctgagtttctagcattttattaaatctcagctggttttggaaagcggaagcaaagccatctagcttaacatttatgttttctaagatcttgtcattggcagctagtttcttgcttagagcaccggtagttttagcctgaataaaaacaagatctttcaaggaggctggttgttgaatgtatcgttattgttgtcgctgcctccttggtagttggagcggaacttggttccacccctgacctccttgtggacgagcaaaggttcaagcttgggggggattattgacagtcgttatcgacaagtttccaccatcaatattatccaatatatgaatactagctatgctcgcaatgcataattcccaaataaaattattacttccactatatgctttgctactaacatttatgcaggagaagcattcataaatgaagagaacgaggtggaaatatatcgatcaatcagtcaaaagtctgccggtgatctacaattacacgagaaggcccaaaagtccaatttaataatcacaaatgggcctagaatgtatgtcactgattcaggggcccacatggaagtctcctgaaggaagctgggggctagaagagccatagggggtcggccgaccccttgttgagcccaatccagtcgcattttggccaggacaaaagggaggccgaggagaaagcagcaggccaaaaaccaggcctgttgggcaattcccctttggcgtggacgctccggatgaactcctgatggcggttgcggggcatttccgacaattcccatgctctacaaccgtcattgggtgctataaaaggacctcacctccttcactttcaatacacactcaagcaaggataaaagctctctacaaagttagtattagtgttagtagagtagagttagaatagttccaagtccgtggaggcttcggggagttcggtaaaggttctatagcttttcctttcttctttgtaagacttccatttatcaatataatattcttctttgtacaagttcggtactttattccaatcatagagtatgagtatcagtcttagtttattcataagtagtataatctgtgtggttaaaccttctgggatttccattgatgctggtataatgtctgattactgggtcataagtctgctctggctaggccgagagctatggctcggggactcagatgctctgcaccgattgcaaggctgtagagtaataagtagtaacttaagcatagggtttaggttatcacttatcattatttggaggtatattctttgggtgatttgcatgccgctgatggtgacagctcagtacgggcgtctcccccgcagtttatattcctacatacaatttcctggggttggatacaccgccgtatcctacttcgattggagggttatgacaggttgtcataagaaactcggcaacccggggtaactttgcgatgcatcgggagggcatagctattcttgggcttagttatgttgcattgttaaaggggttatactacatagtgtatactagttagaatatactaagatgttgtatactagaagtataggaatagaacttatctaaattactaccacttagctataattaggagaatgtaggagttagctaaatccttagctgtgtgtcactcaacccttaagcttaacttacccctgcatagaccttgatgtatacatgtaatatataaactattaacatagtactctcttatcatatcttcccttgggataaaataaatacgataccttggaatactcccgggtgaaatgctacaatggtatatccgtgcgcttgcagatcacatctgtaaccataatatacctaggttatttctagtgctattgctgggaattatatttccagcagtgtcgctaagaaataccaatgagtatttctagcgccgttgccggggaagataaaagattaagagtttactacatgttaataattttatatgttacctccgtatagttattgtcctttgttggcaaaccttgtttgttttctcttttatatgaaaacagggtagtacaggactggttctgatctgccgaccaatttcatatctggagtcactggtgaagtgaagccgaccccgtgtcgttcatcctcaaggttactctatcggcaaccagaccagccaattccgcgccaccagaattgcacgatacggctgagaagtgtggacaccctgagtattataccatccagtgtccaacgcgaccaccacatactattggagaagtgggatccatacatgcataaatagccactcgtcctcaatgtgtccatgatcgcggttgacaaccttctgttataataaccgaaatgtcgagtagtgagtgcaagacataaccgtaagatagcttgccagtccaccacgtcatatgcccgtcaaccactcgaaggtggcgaccaaaagcataccccagtgactcgctatccccaattatttcaagcgatcaaaacccgttactcatgcttagctagtccccaggaatacgactatcctcacactttcatcgcaagcaattaataaacatagcaagtaccataatagggttaaagtgcagcgagatacatgacacataatagggtccgaggtcccaacatacaacacataaatatagcagcggaagtctcaaatagagttcataagcaaaagataaaaccggtggtgccacaaccccactagggcaaactaaccgggcaagagccaagttgcaag

SEQ ID NO: 39206 - DNA, 8284 bp, Oryza sativa
tcacccgtccaagtccaacatatttcatcaaccattatttagtgtaagtgctcaagttttatgcccaataatgcaagttgtctatatacaacaattaatagcactgtccatccctacagttctattagcactaagcatggctaagcattaatgaataagacatcccaagtaatcccaaccagtggtaatagggtataaggacagcaatattacaagaactaaatgcataaataggttcttcccatacaccataaaccggcaatattaatatctaggaatgcatgcatatatatacgtatagattgcaaccaaatcatttttagagaaagcataggttctatatgtttaggtgcttgccttgctactgagggtagtcactatccttctcgggatatggctctttactctccggaatctctgaatctatcgaaaagaagcaatatgcgaataagagccaaataaacatgcacatgcaaaatgatcaataaattatgaaataaatacagtgggtagatcatattttaacttgaatttaggtgaaagaatcaccagattatcacttatggtttgggagatatgaaaatgacaagctcttaggtgctgaaaatggcagttctgtaaatattaacgtttcctttagtactttacaagtaaaatgcatttcaaaccaagatttcataataatgattatttttagagtaaagtacatcactcacagctcctaagaaaaattatttcacagctatatgtgttgtcattatttatttatggattttacaagttaaaaacataggaatgataaataaactcctaaacatgatttaagaggtagttttgccaaaaacaacaccacaacagaaaagagtactaaaatataagctcaacaaaattggtttcacaattttagcttttaccaataatttcttacgaatttattaagagctagaccactcaagggatacatatagctatttatatttttactgggaaaaccagtacaaaagttggtcatttttattttacaacatagaagatcacatttttcttaatccacagaaatttggttcactgaattcagagttcatatgaattagttatgaatttttaaaacgcaaacctctttcagctcaaaagctatctcagaaatcgatttctattttcgctccccttttctccaacttccaccggacatccctcacatggcagcaacctggacgtagggtcatgcgaggctaaggcctcgggctgatggcaagagacagagcaaggcctcggctgacggtaagagacgttgcctagggctgcttcaaccgaaatcaaaagagattaacaccggatgagctgcagccacctcctagctgcaataatggagatggatgacctgttgaatgttgctataaatgttcaacatggagagaattcaaaagaggcaccatggatgaaaaggaagctcaccaaatagaggaaaacacaatgctgctgctgcagccctacaggctgaaaccaccactctcttcttccttctcgatctctctcaactctccatgcatgtgcaagatgttgggatggattgaaagcttagatgatggggattgttatggtctaacatgcagagcttgagtttgggttctttgatgggatttgggggaggagaagtgagttgggagctcagcttcagaaggaaaagaaagaaagcaagggaagtgaaaggggaggaagaaggggttttcctttgcccaccttatgtcttgaggtggggaaaccacccaagggtggtttttgggctaaaaaggcccccaaggttattaccaattggccccaatcctggtggtcttaaaaggtaaggcctgaattaaagttgaaccaaaatttggggtaaatttccggattttcaacaattttacacctttttcaatattacacttaattaattcaagaaataatagtgatattattttatcctttggtgtggagatagacctggacacctattttccatttttcaaagtttcactcaaaaattcaaaatattttaattctggtgaaaagatgaaattgttaggctgaaatttttaggaggccaaaacagagagtaaaattccacaaaatttatatttgttggtgataaataaactagtatttgaataaattattatacatgcgcatttctgttcaagttattgttcaaatagagtggtttcaattttaccgattagagttaactttgtcatcgcctatgatcaaattgcaatatagtaaatatgaaatctaaaggacacaaaagcacttctaaatacctggttatgatcctagggctgttacaagaagtccctttgcaagttcgctgctcgctttgttggtaacatgctaattgcaacccaagtcaacaagggaaatggtgactttgatttaaagaccaacttaattaacgattgcgtaagcttgcttgttccgtggccagggttaggaagatgcaagtgctcattttcagtaattcgtggaaagtcgtagcacgtataccgtcagaagaatcagactccaattattgccgttctccctcctcgagagagcagaacagcggttctacatcaaccgtgcaacagtgaatacccgaaacaattgctcaacggccttcctctcaagattcttcctgatgggcaaggccaacgctcttcgtggaagaatatccagcttttagcaaacgagggatgaaaccattcttgaagcctgggaaaggctgttggaatgcgtcaccgcccgtcctcatcatgggatggccgagtggctcatccaacagagtttcttgaacgaattaacccccttgtcctgggatcacctggatgctgctgctagagggacattcttctcaagtacagtcagatgccaaccgattgagaagatgctctcaaatatggggtggagcgaggaacgactccaaactcgtcaatgcggcatgtacactatcaagtggatggaaatgctagcagctcagttggatctccttatgaatagagtggacaacaacgagaaggaatccaagcagggtaccgttaatgctctgggctctcacacgacatctgaggtttatggcaatgccggtcactctgggacggatggtccgaaaacccgtaaagacgtcatgctcatgaacaacagcaacgggaaccgtccacaaggagaccaaggatggagcattgctccatggggtagatcaagaacggaccgaagcacaaggaggtcaaagtaaaaccccaaaggacggatagcctcaacaccttcatgatgaacttccgggaacagggagaaacgaggaacccaccataccttaagctggcatccaagaagtcgggaatacaggctggtcaacctgagttcctagttacgaagaggccgcagcctacgcctaagacaaagaaggtgtggtgggttaaggagaagacacccattcctgtacctccggaactgggtgcctcatcgagctaaaacatcggaggtacggtcgtgctcgtcggacctgaaacgacgtcgcccttgccaacaggtaaattggtagttatctcatatttattttccattgcatcgaaacatgtttgaattttcaaaacgcacattgagatttgaatttgaggaaaattattcaaatgaatttttgtgagcaaaataaaataaattttttggcaaaattctacacaaccaccttcacactagtcgttggaacccaacaggtacttgtggggccgattgggtccaccaggggtcgggccgaactggcctagcaccggctggctgcaaatttttgcagggtagtggctagtggggcccacatgccatgactagccgttatccatgcactatatatgtagctcggctgggagagggaagtcacaccactttaactcattttcactccctctcaaaaccttgctctcaaaattaattcattcaaagttttgcaagtttgcctcaaattcacacaatttactgcatttagtttagacactttgcatgtacaagtttgctttagttcggtgcaaggttaatcggcgggtatttgcttaacccccgtccgagtagtcttgtattctttctctttgttatagctatgaagaaacgactttcgggcatattcaagagacgatcaagctcacggacaagtcgacacaataagccaagtacaccttcttccgtggatgcatccatggaggaggcgtatgttccaccgaggctgtacgacaactccgatctcgacctcgtgggcgaccgggaattgcaaagcctactacatactgaaaaaccgaacgtgtgctcacacctgagcatacgactcgaccttctgaaaatgataggtacggatgctgagtttcatactatttagcgtgctataggttgggataaatttgcatgtgtagacgagctgggttcccgtttgcttaccatgcagtttcatgtgccttgctagaggtgggcgatggtgttactttccggttattccgcaaggaatatcacctttcttggaaagactttagcttgcatctaggctttgacaaaacatgcaaaattaatttcaggatgcatttcctgattttaacaagcgtatgttttggcaatgtatttcgggtctgtcatcctgtaaaaagcctggaactagggacatccataatcctaccttgaggttgttgcataggttgcttggtttcgtgctgtttcctagagctgatatccagatagtacgaacttatccttttgcatgccatggatagaaaaatcaagtttcacccgttcaacccatgatcaagcaatggttagaaaatgtgaagttgtctggtcctgttaagtgtatttctttggtgactcatttagcatgaagagttgggactatgcttgatacgcaagtatcttgtattcctgttacccgctcttatgttgatgaggcctatctgattcaaggtcacatactgaaacatggtctaaatgattgtcacgcccggaatttctatccaaaattccaaacgcttacatgtgtgttaaaccctcgtccaggaatcaaccgaggcacacaataacaaattgataatagagtactattaaatattcgcaaataaaaaaaaattattacagaggtagatagttcctctcaaagaataacattctacgcagcggaaaaaaaaactataacaaactacggaacagctatggcaactccactccacaggcatcttaaccaagaacaagcctaatcctccagatcatcaccttcactgagatactcctcttctgatgaatgaatattgcaagaatgagcatatgacatactcaacaagacacacagcaaatatgcaagtgcacaggataacaaaggatggcataatatagatcatttgcagaaaacaacatttaataaatatttaagagaataataaaaacagttgaataattaatcaacattaaataaacaccatacaacacacccgtgttgcataggcccaaccacatttgaacaaccaaccccagttgaacaaattaaacctccaaaccaggaattatccattccaaaccaggagtcaaattaattatcacattattaacattgatgagtagagtgagactaatcacgaaaaacattgctcaactcacccataaccgcgggtacggctattcgaatagattaaactctgatcagaggtgtaccactgtacccacaagacacaaccccacatcatgtcaccatgtgcctcaataccaccacggtacctcggaaaggagttgtgacaataccccttgcacaacataacccattacagcgcacctttcctggatcataatcacccccttataaacaaggcatggactccccagcgacccccatggacttctcgccacttctcagtctggcgcactataatgaatcacgctatacaaaagataaagccgttgcccacgctggcttgtggctggcacgataaatgtttcacaacagtagctcgcgaaccggtccttaattgtcatgagcacaaccatcaaaaccatatgctcacaacccaccttaaccaggttttaattatcaattaattaacatcgcacgattaaccatcgtgagctaccattgaatataaccttaattaataataataataataatttatatttaacccctttagttagctaatgtttctaagcaaggctaagcaaacttacatatagcatttagccgaaccaatccaatatataaggttcatgctaatcaagttataacccataggaaaacaaagtcatcttcggccattaattaattgggaaaggttcaccacccgattgacattcgaaaacaatgcacagttgaaataaaataatagctttaaacgggatcaacatgctcaaagggttgtttgggatctgtgtgacttgccttgggcttccgcaaacgcttcggaaccttcctcaacggaaacgctctcctccggaacgtcggaaactaaagcaattaaacaaaaaccaacaaaactgtacaacaacaagcataaacagtacatgtggatatttttaacatgtagatcttgattttagaaaaatttagcaacttgaaccactcgaaacggatctacggttatttagttatgattttccgaagttttaatctattagaaaattggaaaaaaaggaaaagaaaaggagatgatgacgtcagcatgacgtcaccccacggtagccggctagggttggcgagctcgccggagattagatggtcggccgcggatttggagggcacctacgcgtagaggacgacgaggcgaacccaacggtactcaccaaagtgccaaacggcgaacgatgacggccggcgactaggaagcggcggcggcggctcgggttggacggcgacggcgagctacggcggtcggcggcgaagggggacgggcggtgtcacgcccagaaattcccgaatagaattccaagcagaatgtgcattaaaatccccgtccaggaccagccggggtacacaaacgacaatgttgacatacagatccacgtcttacaaacatcataaagtcttacataaatgcagcagaaggaaagaaagacaacaggagctaagccttgactaaactgcagcgggaacaccactccacaggcatcctcgacggcacggacgaagcctactcctcggagaaaccttcatctgacccgaactcgaactctggggttgggaaaagtagagcaagactgagtactacccactgtactcagcaagtcataccggaatagaggtatgatgcagggaatcatcaaagaaaagctaaagtggttcatttgcataaagcgggcatttataaacagagattgaaagatttaaacagttgtaaaaattaagcagtattagtcatccactgtccaacgctacaccacgttgcaacaggcccaaccatccacctaaactatccaaattaaaggattacactaaggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggaccctctagccaagcacaccacacctcaggtttcacccccgtccccggcgggcaacgggcagtcccctctcgtgcctaggtgaatccggaagccgcataggccgtcgcagggcccatccaaactccatcacgcccacccttgcctggatgcgtcgactagagaaaagctacactacaagcccagccgttgcccacgctggcttgtggtaagtacgataagttcttccagggcatcccgcgaaccggtccttaattgccatgggcgcgactagcaaaaccatgcacccacagcccaccatgtgatacattttatttaaccaacaccagcgcggtggtactaatccaacattatcatgtaaacctatagtctaggttttaaattgagatttccccattgtgtgctagttgaactaagcatgggtaagcaattcctagtccaaagtctaatcaagttatgacccaagctaacaaaggagcatggtatccaaaaggcatggctgtaacaataggtaaccatccccagtattattatgaaacaatgcaatatttgaagaaaagcaatagaacatttgcaatataggatcaacatgttcaagtgacaagcatgacgtgccttgctgtgctgctggaggaacgtcggcgactatttcaaa

SEQ ID NO: 39207 - DNA, 1619 bp, Oryza sativa
acaatatttcattcagccaatatgtgggcctaatgatgatccaaactttttgatggcccagaacatttgatggttaaatgtttgataaaatgtgacatagactgggatcgaaaccttggctgctagctagtgcatgctagctagagcaggaggtgatgttggctggaaagaacaggaaaacaataagaaaagttgataccaatatttgagaattgagatccaaaccttggttactgctttttctgtttttgacatggaattggagagaatataactgagtaaaggtggtgcagcgcctatttctctgatcggttctgtctcttcagggtttgaaataaatatttatgccatgctacggaatattttgtgtagccaccataaagccagtatgtttaaagctagtttgcagtttaggaaaaaaatctgcttatcttatgacaatgcaatacaccattacagtgcagaatagctaccaaccctctttgtcctgaactttttgtaatttagcactttctggtttcttgggaaaactaattgcaggaatgtaccctttgctcagatccagcctcaaaggcattgagctataatgcctcagtgctggtgagctctttctgtgagtttgtcatgttatcagaggtcaatgccaatgcttggcactgacctctgcaccactcaaaaatgatgtggaagacattacctcacaacaaaacaatgccaacaaagtggtaagggttttgcttttcatccaagagagcaaggttcaaactgacgatatctttttacggacctttctcctatcaatcctacatttgtactcccctaattttcattgaaaagtgaaaacctacatattttatatgtaaattcatctttattcctaaatgtgaaaattatcaatttgtaagctctctaggattgaattttgtcacacaatataagcatttctggggcactgagttcattgcatgaaaatccatacattttcagctagtcaggtgcttgggaagggaatctaagcaattcaaaatttgaccattgaggtgactgaaagggaatctttttcattaaccttagtatttgctaagcaacctcaaaatgcttatattttgggatggggggagtactttctatttatagctataaagttaaatgtattatataatttatgttgactattattctcccaatattattttaaaactacatgttccattttttaacttgaaacatatgaaatgatatatactacatgttctgtttttttacatgtagtcctctttatttgtagatataaagttaaatgttagtatgtaatttatgttcccaaatttgtaagacaacaataaaatatattggaaagggaaaaaaaaagtaagagccaaggggtccattcctgcaattagttttctcagggatttatttgtgaaataagaatctgaacaggactaaactataaacagttcagctctttctctgcgatattgaggcagcgatttttcagtcatcgctgaaggtaactgaagatgatcgtttacaaaaaggatagctgaagatgaactgcaggctttgaccggcttatattgcagggtattagctgtcattgtgcactaatcctatac

SEQ ID NO: 39208 - DNA, 7935 bp, Oryza sativa
ttttgtagggaggtatattataaccctgtctacctaattatttatattaatttaattcatattttccttttcgcagttagaggttgttcgcgggatattgtcagaatcttttgatgaccagagtcgtctgggggcccttgtatactcagctatttatctgaaggtttctccttacaattgttttatgtcaatggtcctataaatctaattttcctctctaggattatataatttggagttaataagaccgtataacagtttattcatagctttctttgattttttttatattttatttcagtggatttatacaggtcagatatcgtgctttgaagatggtggccaccatcggcctaacaaacatgctgagatatcgaggcaaatattccgtgaacttgaaatgatgtattatgggaaaaccacatcagccaaggttaattgcccctttcatcgtagtaacaaaatgttacatcagcatcagcattttcaagtattgtgattatagtcagatcacaatgcctttaatcaagatgaactactacaattttgttcccttaaaaagtagagtgaatagtgtccacgacgtattgtagcaggactctgctgctttattttagtgagagctattattttttccccttaatgctccacccaatcatatctatataaggatatcctttgattaagcaagcaatatgaaataattaatctagtctctcatgtaatcatgttcttcgtcccaattgatagcctccttgacctaagatcccttatatttctctgtgctgtccttggtcccattcgtatcgtagttatcccaattaactgaggctaagcacatgaaaatggtccaacttttatataattgctattaaatgattgctctgctaactatgtaatgcttgactgttagttaaatcttcaggtggatataggagtagggcagctagggctagagccctactcctatgcccaaatattcattgaaattatactttaaaatttgaaaaatggaagacaaaagacaaatttatgtagattatactagttcagccctactctcgagcacattctggctctgccagactaacatttgggaaaaggtatatctattatttgccaacttccaattatgtttgtgcaggatgttctcgtgattcgcaaaattcatccctttttaccttcatttaagtcagagtttacagcctctgtccctctaacacgaattcgtgatattgctcaccggaatgacatcccacatgatctcaaggtggtgatccctttctgcagttttgaacaatctcttcattggattactttacttagtttgatcttttcatgtcgacagcaagaaatcaagcatactatacaaaacaaacttcatcgtaatgctggacctgaggatcttattgctacagaagtcatgcttgctaggattactaagacccctggagaatacagtgaaacatttgttgaacaattcacgatattttatagcgaactaaaagatttcttcaatgctggcaggttatctaatttacaattttccattttcctacttccatagatataagttttctgtttgctgaaaaagctaacaaaattgtcactctctttttgaacttatctatcctactgtgtactaaaacatccttatgccagttatagctttccaattcatgactacttataactagaagcagtggtaattttacggtgatagagatagacagatggtagtcccccatcgacccatgaattcacacaaagaaagataaatcaaggtcttaacttgtgaaaaacaccagactggtgctgctagtatatgcacatatttcttgcaataatgctggtattaagaatttaatatatttattcagggcaccagtgaaggtaaggctgtgttcttttggaagggttgggaacccttccggccttcccctctggcacacaaaacagagcggtggattagcacattattaattaagtattagctaaaaaaattgaaaaatagattaatgtgattttttaaagcaacttttatatagaattttttttgtagaaaacacaccatttagtaatttggaagcgtgcgtaaaacgagggagtagaagttgagaaaggggataaaagaacacacccttaggctgtgttcgaacctgaggatttgtaactcattcatcccgcatggaaaacgaggtagctcattagtgcatggttaattaagtattagctaaaaaaacttgaagaatgaattaatatgatttttttaaaacaactttcctatagaaattttctggaaaaaaatgcaccgtttagtagttcgggaagcgtgcactcgtaaaacaagggagtagaagatgggaatttgtagttctgaacgagccttataatgcattcaacttcaacgcagtgacatggaatgaaataaggaattaaactttcaatttatattgtcaattctgggtttcatgtaattgttcaccagggttagaacttctaagttctagtcaggcaacagacatgcttaggaggccgtgtgctgcctaatgcctatgtggctgcccttttagatgtacactagaataaaaaaaaaaagttgccatgtactgctaacctgcaatcaaaccttaagaagtaataacagattactacaaaataaatttataaaacaaaattgaaaaaaagcagatgtttagtgtgttagatattcaaatgcctgttggtcatatagtgtccatgtaaatataaattgtctaacctgattaccgatttcacagcctatttgagcaactggagtccatcaaggaatctctgaacgagtcaggcttagaagttctctcatcctttgtggaaaccaaaagggtaaactttgctgaaaccagttaatttttctttatatgtatgatcatcaattaattatctccttatttcctttgcattggagttgcggataatgctctaccagggatcactctcaatcagacacttctgtgctctggttacctaacataacataatcaaataaacttataaatacgaatttatgtcaccttgcattgcactatgtccttgttatttctatgttttgacagttgataccgacatttgttactttctggtatttcaatagaggaacaagtagtactggtctggcatcattgcttatcattgtcatgcctaactcatattcctttcgtgtttatcttccttttcagagtttggaccaagtggatcatgcagaagatttggataaaaatgataccattcaaattttgatgactaccttgcaatcattatcttctctaagatcggttctaatgaagggccttgaaagtggccttagaaatgatgcgcctgataatgctatagcaatgcgacaaaaggttatcttgtctaacataattgataagtggttgaaattggctgcatatatcacaagcgatacttgattacgttttgcagtggcgcctttgtgaaattagtcttgaggattattcatttgttctgttaagcaggtaactgtcctagtttcaactaagtgattttaattggtgctttctcacaaaccttatgaaattgtacttttgaattgccttttctttccattctgaaatgttagtttcgcccttcatttgtcttactagtcaatagtcgtcactttttgagattttatgttctttgttgattagtttgtatgcacttgtaaaatgcatcagtgctctctaaaaaagcacatacctttccaaactagtgggcaatcgaaaatttattgacactaacatgccataatcaatctttaaataaagtatttactttgggtatatatgaagtgggggctgctctggtgaaaactgatggctgcatgaattgcaattttttcttgattatgtcagaacataaatttgattgcatactagatttctctttttgatccagaaggaccatattggattaagtaaacaaattgctaggggtttgatagaaacgttgtatggttactgtattagtttgagttatcccaataagatcaactaatttaccactagaattctgcaatgagaaaccaagaattgcttgaagcctctctatcatgataggaaaaagtcattggatagatgtggacgagtgccctacctctttttgacccctgtttcaagcttatctatatcatgtggtgtggagtcttgttgaatacaaatattaaaggaaaatactgacgaatatggataaaaagtgaatgtagaggttgcactctcatgtgatgtagtcatctttagtgaagccatattatctatgtgcatatatagagtggatattgatctattcgagggcatgcagagtcataattgttaggtgaatctaatgcttaggcatcaaatttgttaaataaaaccagcagcttactcatgtgtacaaacaatagattgtaggcaactgttgtcataggtagtgggccgagaggtggaggtcctagtgagccgatgggttgaggccctagggatcagttccatcatcctatggtagctcagttggatagagttggttggataggattagactgggtctttccctccatcttatccatctatataaggatggattgtatcgtcatttggaattttggattaagcgatgaatcagtctctcccaacctaagtccctctctcatccctagcagccgtcaccatcctcccggcggtgtttacccctatgaaccctaacccataacaactgatgtctgaacactagaaatgtttgtaggctgctgggctaataagtttcctttgacaagatagaagtcaggatagagttttcctgctctaggatcagtagtaatcagagacctgcagagattgcaagcagctgtagtatatgttggttttggagcagaatcgactgaaacatgttctctataattggtagtaatgcaagctagcagaagtagctattgtagcaaactgaaaacaccttcagtccatcacctacttgtgtgtgtgtgtgtgtgaagtgagaagaacagtgtatttcacttgttcgacttttgcaacagtgaactaatttcctttgtgctttagtgaaaagatagactttgcagtctgtttttccaaataatgctaatgcattgcattgattaaaatggtatcaatttttgctgacttatttgttatgatttataggttaattcactccatgactctatgttatcatttatagcttcaaaataaaatcgtagctaggcaaacttatattactcttggcggtatcagtgagcttatgtactttgctctggtactataacagattcatcaatactcttgaagccttaggtggatcagcttcacttgcaaaggatgtagctagaaatactactctatgggatactactcttgatgcccttgtcattggcatcaatcaagttagcttttcaggttggaaaacagatgaatgtattgccatagggaatgagattctttcctggaagcaaaaaggtctatctgaaagtgaaggtgctgtttcttctttaatatctatctattttatatgcccatgcctaaatacctttattgtagtcaagactcagaaataccctgactgtttcttgtcatgtgtgaaggttgtgaagatgggaaatatatttggtcactaagacttaaagctacactggacagagcacggagattaacggaagagtactctgaagcacttctttctatattccctgaaaaagtaatggtgagtgtattaaacgaagctagaggaccttaactccattaatgaaaaaaaatgttcaatggtatacaactatgttcatattgtttgacgtaggcttagtttgctgttatcatggtatggtttgctcttttcaaaacagaaaccattgtgtaatattactgcttggtaagtcaggttatagttagataaatcatttttttccccatttcttgtcacatttcatcttaaatggtctgaaaaaaataaacccattcgcaacttgattaagaaaaagagtagctagatggacacgggaaattaatagcattttaactgctaaactgaacgagattatcacaacctgcttcagactcaaaccaaaccttcgtatggaaaattccttaatgccatataaattttcctgtcctagatatgccactgaaatttcgattatttatttgtcactgctttagtctaacaagataaaatcggtagcctacaagaggttttaatccttgcctgaaaatgtgactgttgaccaactggtgttaaatcttggtgtgagaggtgggaaatgccaaatttacccttgctttgcaagtgagggaagtctcgtattcctgttctgtcaccatgttaggtttattactcgcatttacgccattgtattaaaactaacacatgttgcagaaatttgttaaaaatatcccatagaaattaggggtttaggccaggttggggtttggttggcattaatgaaaatcccttctaatttctccaggttctgcggcaagaaggcatatatcctgatcagcatgcacaactgtatgcatgcagttaaatgaaacaaatatgaagatacaatgttgtcaatattattatccaacaaacttaaacgcatagtataataagctgctgagtacaacctgttggtgtggttgactgccattatggcaacacacatccgccaccccaaacccactcagctcaaacacctgtgttgtgtgagctaaatcctggatactgcccaccacctctgcccttctcctttctactggttgtgttgtccatcacctgagaaggatagaagctaagatggaataacatggtgaatggatgcctagggttattgtcaatccattttcacatgttgagtaaagcaagggtaggactgccatgtcggaacaattgttggcacgtcagctgagctgatcccgcaacattgacaatgattgcaatttcaggcatgaattaaaaagcagtggtaaaactggaagaaccaaaatttcaggggcatatctgggatcagacattttcagtggcatgtaagcatggaaaattggttcatggacaactttactcagatggtcgttcctaaagatttacattttttttgtgatatttgaccatacaagttttgcactcagactttttgtcttgtttggttatgtttcaaacttagattctgtgtggctgtcttgttaataggttattgggaaagcccttggaataccagataacagtgtgagaacttacacagaggcagaaattcgtgctgggtaatccttttctgtacagagtctggaaattgtggttttctggagctgtaatcaatctaattattctgaacctaactttttatatatgtctagcattgtttttcaggtatctaaactatgcacagtacttcagaaagcaattcgagaagtacttggatcaactggctgggatgttcttgttcctggagtggcccatggaactctgatgcgggtattttctgtaactaagcagcagactttcttgcattgaacttccttctgtttgcattgccttgtttcctgagttgccaccataatcctaatatgaaattttgtgcatatccattgacacagcccagggactgattggggtaatttggcaaggtaggtggctttgccctcagttctctctggtagagagagagagagagagaggaaggagggggggggaggagggagggagggagggcgagtactgattggggtaatttggcaaggtaggttgctttgccctcagttctctctggtcaagggggagagagagagagacctcaatttttttttccttgtagtgttgctgcagtaggaaacactccttgacatcttctgttgcaccaacctgattacttacaatagagcaagggaaccttagcttagggcacttcagacaggggtgcaggaa

SEQ ID NO: 39209 - DNA, 3417 bp, Oryza sativa
ctgatggagatgaagaggtactttgggagcgccaagttcttatttgctgatcttatcacccccataactgataaaccatggttttgctcattatttgataggtcaaagctgctggggataatatagttggtgttattcttcttcaggaactacctcacctttcacatcttggtgttagagctcgtcaagttagtcttactacactcatttccttttacttataatggtgccgtttctaaaagctacttttgatatatttacaggagaatgttgtatttgtaacttgtgaatatgatgacacagttacagatgtgtatttgcttgagggaaaatatatcaggtcatgttctgttctaatgatttgttctcatcggaaatgttatttcttttgctttgatcttttgaagtttctgttttatttgttcaagtgacaaatatgcccatgattcttcctgtgtgttgtgcaaatattaatatgagagacgattaagtgacaactatgaccttgtttgcgactttagatttgtatgtggtgtacactttaaaattgctctgctagaaattttgaatcgttgattgaataacaggctgaaattttaatctcgacttgtgtggttgaatgttttcagtatcttgttaaaagtttcgaatatctagttgtgctatttaaaccagctaactcataaatgctttatatcatgatgtaatccatatctttatctccactattataaaaattgatagcatttctgccagaaattttggtccgtcacctccgtagctgtgctggtctcaaacacaactcaatcgctgggagatgcccttacactgtgtgagggagcctcactcctccctgcccccacatggctggctcctcagctggccatgacccaccaaggccgatgagcctacttccgtaagccaagatctcatcacctctcccatgcatgatgtggtgaatagttccacaggaacagtagcctaagcagacaaagcacatatgatgtcccttgtgatttgaaaatttgatttcttctcctattctctttccatttctctagatattttcttctcgttttttgccacttataaaaatcgacttacacccatcacatcaatcgtgatgtaaggtgtttgtttgccaatgtgttttggctcttctcttagcgtaataccggtagcaaggttaactccaagcctcctacgtatcaatagtccaaacaaccatattgggaatagattcttcacaagctgacccatgttagtcaacacaggcaccaccgcaccactacatcaaagcattgcacttcgtaacttcaaaactaaataccattcacaaatgataacaatttttcattgtaattcatcaaccaagcacacatgtcttgtgatgacgactaccatgtacatgcattattgatacttcattttttttcacttcttttgaaattgttttctccgatggcaatgcatgggcattttgctagtaatctttatagaaaaatatgacagtagggaatcatgagttgtacgatctacaggttttgtagataatagaagtataatttctggttactgtgccaactgcgagcctagtgggtgaaggactgcaccactgcaacgttggtgcttcctccaaagaaggataacttgcagcctctccaactagggatgcgcatatccatttcattgtgggccaatggtgcttccctccctgctaactacataagatgtcatgactctccaacttactgagttgtgccaaaaggaacgaatggggatagaaaaggtgcaggaataaagtgtagaagaatattccagcacacgccatgaattaggctttattcttggataataagcataaactaaatctaagagaaatatcacttccaaaaatggcctcagtttttatttaaatcagattgaactttgaactctgaattttcatctaccattgtaacagacttgcgatttaaaattcacttgtgtatttgggttagcaaattccatagatgctttctcgtccttaatgagaattaattggccttgttctctcaacagtatatctctaggacttctcttttcccttttggtggactgaaattaacttagtttcttacagattagaagcatcatccatcaatgtcaatctctcaatagtttcagaaaaaaatgacaatgctgtctctacagaaccaaatagtacagggaatccatttcaacagaaactccaaaatgaattctctctaccatcggatatcgagatgccactgcaaatgtctaaggtgatgcttcatttcttatctttgatagggatcatccagaaagatgcatcctgcattcttgttgcagttgctcttacttatttttcattccgtgggcattgccacagcaaaaaagcaaatcaggagtgaatggtagttttgctgctcttgagctttcagaagcttcagtggaatcagctggtgcaaaagctgctgcatgcagaactctttctgttcttgcttcattgtctaataaaggtatcaagttttcatttaaatttttttttgtctaagttcttttgcaaatggaactttacaaggtttgcaagatatcgagggactttaagtttaaacaagtatttaaataagctccaattattatcaatggggaagtcgaaagttttgaacagaaaatactaggatatattacactgcacgattttgtatgtaatcaaagtataaggtaaacaattctgtgcataatttggtggatcatccaagtgcacgtatcattgtattttctttattaaaaaaaacagtttgccaagacagttaaaatgtagtgctatccatggtaagttggtaactgatggaaagtgtacatatggttcacaggaaaacaattgtagtgactctagtacagggttgatattatagagttgtttactgctaatgtttgttgaatggaaaacttctaggtgataaattcataagagaagacttctaattattattttctgatattttttttactgctgtgtagtctatagtgatcaaggagttccagcagcctttagagtcccttctggtgctgtgataccatttggatcaatggaggatgcgctcaagaaaagtggatcactggaatcctttacaagccttctagaaaagattgaaacagccaaagtcgaaaatggtgaagttgatagcctggcgttggagctacaagcaataatttcacatctttccccaccggaggagactattatatttctcaaaagaatcttcccacaggatgtccggttgattgttagatctagtgctaatgtggaggatttggctggtatgtcagctgctggtctctatgattcaattcccaatgtcagtctcatggacccatgtgcctttggaactgcggttgggaaagtttggg

SEQ ID NO: 39210 - DNA, 1381 bp, Oryza sativa
agtaattcgtcttactgttgattacagcaagaagccattgtcggttgatacaacctttaggaagcagtttggtcagcgactggctgcgattggccagtatctggagcagaagttcgggagtgcacaggatgtggaaggttgcctggttgggaaagatatttttatagtgcaaagcaggccacagccatagcatggatgtgcgccaatatcagtatggttaggtaaataaagtttgccgcatggatcgactgttgtaatgcgaatagccttcacgcaaaactcgaagggttgtcattagtgtttctttactattttttttggaagcaaggggaaaaaataatgcctaaattctaaaggaaatagaagtttaaggcctaactaattcaaatctttcatgccatggcctgagaatgctaatattagcacaaatcgtatggaaatgtaactagtattcaaacaactagatctcgtacggcttgttggaaaatccgttgtaattgatgtagaatttggcataacatgtaataactacaatgcgatgtttgttactgtacacttcaaaccatcttactgcatattcacaaatctattattatattattatgcgtacaataaaatcaccattagaattatatattactgtagtaatatgagacaacaccattgtttagttcctatgagtaggagctaccaccacgttattgattgattttaatacaactaacctttactcacacgttactgtgccaattgtattatgtgttacttgagacctgtagtaccatcatgaaatcaatatagtaacaatataactcgtgtgcagtaacagcgtaaatatatctactttgtaataatatctttcctttgaactgctttagctgttaccgacccacgccctagcccgtatgcatcgtcctctgtcctgttccagagactgtgccttctccccaatattgatatcctcttcctatgcatctcgatcctgatccctaggggtaggcgtttggttttcctagtttaaccggttcggtttttgtggggacacgggataaaattaggtgtcccacgaatacgtaacctcctatgcatctcgatcctgatccctaggggtgggctttcggttttcctaatttaatcggttcggtttttgtggggacaccagataaagttaaggtgccccacgaatacataacctcctaggaagttcagttacgcatgaaatgatataaaatcataaactttgatatatgatcattccatatattacccataaaaccttataaacaaataaacagtccaactccaccacaggaactgcctgagcatagaatgacctagaaatcataatcgtcccactctaacgagtcacgcgatctccacg

SEQ ID NO: 39211 - DNA, 7640 bp, Oryza sativa
ataataacataataaaatgcaatataagaagttgaaaggtttaaacccaaaccttatcagttatttcatagggtctgtcctaatacacatttaatataagcaacataattaaacatttaatttaaacaatattaataagcataaaatatactacctctgtcccaaaatataagaaactaggaccaaatggaacgttgatacgttgtattaggaaatatctcatccagtcctaggttcttatattttggaatggagggagtaattgtttctaataacttaaacagaacatgagctaataacaaaattaaccaaattaattattagccaattagtttaacttgtgctcataatctggaatccacccatagacacaactccattaaccgggagcacaacgcattcaaatactctatgactctgcaacgtctacctagctttttacccacacgatacccacagcagaccaggctaaaaagtaacaaggtgtaatattgctccacatctctcttttttctgcctagtaagttaaaggacgcttgggtcattgctcggagtgatccggccccaagtgtgtaccaacttacctccgcatccacttaacattgttcgttactcgatgggcaactgagaacttcttcggcccatagggcagttctgaactcttagatgaacctttaatgccatcagcttcctatttctagtcagataccttgaatgcttcttttgaaccatgggtcgatgactccaacattacttgatatctctatgctgaccggcctagatacaacctctttcatcaacatcgtaagtttgagaacaaagtgcaactataagttggacaccaaaggtggaggtggttggtcagggtatatcaccagacattccaaccaaggttgtcagtatcccgattcgtattctagtatcttacgatactacgatcctaccaagcagaaacgataccgatcccacctctcgatcctactattcattactacacgatcctatgaaatcttaggtggtatctcgattctacgatccctacgatattacaaaatattatttaaaataagatggtttggaaataatgtaaacgaatatgctcaagtatatatagaaatcagttaaatatatcaaaaccaatgtgatttctcatgataaatgtctatatttgcataatatatattattactatatatttttatatagaatggctatatataattaatataaatattaattaaacttttcaaaaaagaaaatctcatagtatcccgatactatgatacgatcctacgatacaatactactttgagcaaaacgatactacctaatatccgatcctaacaacttgattccaacactagggctgttattgagaaggagcatgtagccttcttgaatctttggctggacagatttgttttctgtggaactaagttgtggaccaacagctaatatgccgttgctttagggcccgtttagttccccaaaatttttttcccaaaaacatcacatcgaatctttgaacacatacataaagcattaaatatagataaaaagaaaaactaattgcacagttatgaaggaaatcgcgagacaatcttttaaacctaattaaccataagtgctacaataacccacatgtgctaatgacggcttaattagtctcaaaagattcgtctcgcggttttaaggccagttcaagaattaattttttcattcgtgtccgaaaaccccttccaacatccggtcaaacgttcgatgtgaaatccaaaaattttcttttccccaactaaacacacccttggtaaactagaggatggggcgccgttgcgcgcgccgcctgtatgaaataccggcacactataccacaccttgctgatccaatgtgtataactgataattgaccgtacgcaacaaggttaccgaatccagtggatttctgagattttattactaaactgtttggtccaactgccctgccaacatcctcgcatgcttccgatatacgtacataaaattcaacgaaatagtttcagcataacaaacacatgtacagtctagcagtgaaatagactaagactgtttagttcagcgcaaagttttgattttggttaaaattggagatgatgtgactgaaaagttatatgtatgataggttgatgtgatggaaaaggactgaagtttggatctaaactttagatctaaacacagcctaacacaatggctaagtattgtctcccaccgatggaaaggggtcagaaaagcttttgtattgcaccaatatcagggagcaattctgataatttctcgatcccaccgatggaaaggggtcagataagcttttgtattgcaccaatatcagggagcaatgctgataatctctcgatcctgcttcaacattaagaaaaacaaatatatataaattgatgcttgctgaagataatgattagaggattgacaattaagacatcatgtgctgagatttcctctattagatcaaagcagaagtaattgcaaatatctgacatgtagctagcgtatgaattgagttatcaatgctcaatgatcaccaatgcaataccgatcacacactgttccatgagattttgggtctagcagaagtgtatgaatataaccaacacatgtatagtagatattgcaggagagtagctgcaggctagatgaactttccattcatgcataatatagacaaaactgtagaaaaatatctatagggatagaactgaaatgtaatacctgaaaaatgtctttgtggctaaaactgaaatgaatcgagatgagaagtaagagcaagcatgaatgtaatacctgactacatgagttatgtgggccattgaagatcatggcacacaaacatttctcatgtaaaagcatatgattagttgtttaaaattgccatacaacttcataattagttgcataattggtgataactttgatccaaattaagacacaaccgagaacacgaagtatatatgaagtatgttctaccacctgtccacctctgtatataagagtacttacagtatgacatttttttatatataagactacttaaagtatgacattttttttctttatactcctgtatcgttattgtgcctctagataatctgcagctcttatgcaatcttagttacagtttggccttttgggcttgtacaactctaccatggccattcccatgcatataatacatagggttctatgtaagaactatgtactgcactgcttgcagcaaataccccaatccgaatactacagagtaaattgtagttgctctaaaatttttatatataggaaacccatacagaacatagttccacgtgatttgatcgctagtcagctaaaacctttttccatgttattcatactcacctatcgaatttattttctttagcatggcactataatactattcatacataatgcaagaatcaaacttgctatataaacatgtaccaaatgaatcaagccgatttgatagaagcaaaattagcagataaatgcaatgtataatacctcacagttgtattatccagctgctttttgcatcaattgccacaaatgagcattgcgtcctctttctcatattagttccaaaatttcttcaaacttcatgcatccctctaatcctccaaacaaattagacctctcttcatagaaacaaccacactacaaacgaattcatctgaatattgctttttttcaagaggaatgcaaaagaaaaagtaatctatcacttcaacctctctaacatgagaggactgtaaaaaaggaagtggggcaacgttgctctggtgagcatcagcaacaaaactggatagtggatcatacctgagagcatcaagctgctcaccgctgattaattttaccctccgccactgccaactgatctacaattgctatagatcaatggatctggcattaatatcgtggatcaatcttatgtagccaagaacaacctacgaatgaatgcgtgctgatattagtatattggatttttattcatgatgaacaaaaaggtattcatgcagttttaactaataacacgaggtcattaagctttgacaagctaagtgcaacatttaggaaatcttatataaacttaagcctaaggccttctttgaataaaaggttgaaagcagatctcacaagtaacttgaacatattaattttgtcttaagatgttaagcatagtagattagatgttctttcagtatagatattaacatgcatgatcaaagctatgagaaaactgaaaagtatagttaagcacccattgtatagtgaacaggtagaacaaccataaataaattctaggtgttaagaacaatctcaagatttctccaaacgaaaagaacaatctccagatactgatgagacataatgataaaaaattgaaacaaatagtgcacataatgatcgaacactcatgtttttccatataactgactatagattctaaataagatcaaataatttgttatgttacaagcaaaagcattgtaaaaggtacggggcatttcctgccaagaacatcatatgcacatttacggtattggcaatatgatcaaacaggttgtaacaagaagaatgccttaaaataaagatgtgtccattagcagcacaatgataatataggtagatagcatatatattgatgccaggacgtatatagcacaatacaagtatataataatcgcacctatatgatagtattctacctctggaaatgtacagtttagctggcaaacttacaaaatgcactaaccaggccaaaatagcgatgcacttaattaatcactttagcgacttggttgcggccttgtgtttctgagtaaagtcacaaactgcacgcagcactgaagaaaggtaataaaatgggatagttataaacatcagtaataaagtggtttggttaaataaactattttcacactgaggaaactaaaaacggcatacctctcttttttcccttcattatatagaacaacatgatcctatgactaactaagctattttttaaaggcacatcagcatttttataagttgagttctaaacaaaaaccttaagaataataaagataatgattggctgttcataggatgacagatgaattacaatgtagcacgcttaggagagcatgacatagtgcctacaatggactgttactgactgagatttatgtgatccttagttactctcctattatgggaatagatagctcagctattaatcttaaattctctagcatcctttaattatagagatatgcttactattagccagctctgatatgcgtgcacatttccgcttagaggtgttgggttccaaagccagcttcctggatgagagcaaaggctttaacagttgtcaaatgtagcaatatcattagtatatcatgatatctgttagtacaattgtcagtatgtaaaaaggaaatgcttacaacttgtactacagctcattgttgtttgcactgtcagcctcatctatatcgaaaggaaatacatcagatcctaaactacattagttattatatttacattggagaatggagaataactccagtgtagatcaattattatttgaccgaacaaaaaggtggttgacaaatagaaaacatgtctagttagacttagtatccagggcaatgggtgtttaaaatgtactgcaaaatatatatgtcttgttagtttatgtttaaaaaatttccccaatgtacacaaatggcagcaacagctgtacctacaggaattcaaccaaacaactccaactcattttcgagaaatacaactaactaaaaacttgaatcattatattattcagccatggtatacttaatgtaaattacaaaattctgaacgattataattccttcaggttaaaatgcatcgatgtcatgataattcaacatggttagagataataccaagtgtggtgtatatagatcaaagctcatgtatgagatgctaacatcctataggaatatttaagaatgtcattgatcagaaaaataggacatatgcaaattacaattatttaggtcaaactgaagatcaaaataaattgcactaagatgaaatattgcatctaattgggacctgagactaacagatcaaccaccgttggtggaaaaaatgctctatttttcaaatgcacaatactggtagctatacatatatgctctagtatagttgattggaaatacaaaaggtttctcaatgtaatttaggatctaattttgtataagccacagtaaattggttagatatatttacatacaaaagttcatatacacacactcactgcaatggatcttacttaaataccaggactaaatgaatatgtatatatgaccttaaattttgaacagagaaaacatgctacgtattactctgtaggaagtacacaccatagagggtttgaggtgaaaaaacaaaattctttacatataaaggtacatgccagttctaatcttaaattaaccctagaaaaaacctgaaagataagaagcctaattctagcatgcatattctcaagtgataaaatccatggcaaaatgatgcaaccatgtatgcctagaccacactcaatgaacttgaggaaaaaataagtatccaaaaaatttcaatcacaagaatagtctctaaaaggtgaatttaaactaaaaaaatctgcacataattatagagctaaaggaagtgttaaactcgttggagtgcattaaaccatattcacgaaggtgttgtttgtatagataatttaaagcaagaagtaactaaagtaagaaaatatatctcagctacaatgataagtgataatttgaagtattcagagctaggattacttgaagatactctcttgattcaacgagtagaaagaataaatgccaaactctagcataagtttttgtatattctaatcttgtagttctctcatgtaaatattgttctttatatatatattaatataggacagaaggagtttctcctgctgtttttggtcaaaaaaaaagggatatagtaacttgtatatgccttccagtaaaggtaacaacttgtaaattgtaacttgtatatgccggcagtagtaatatataaatatgttctcaaatagaatgaatagggcaagaaacatggtgatgcatcaattattttgacctttcaaatacaacctgtaagggtatcattcaatacatagaagtccacaaatttggtaaaccagagagcatcagttagatagcatgcacatggatctcacctctaaacctaagaacatttacaattcctgaaacaaatgaagaaaaatgtttctcgccttaagtggagatgatcagcgacatacttgtcccatactttacccagcttctacgctgaaatgcttcaagttatttaacccaaaaaaactatgagcatgccatgtggcttgtcaattactgattttaataggcgacactccgtagaaggcattgaaaagggcaggtaaagccatataatcaggatagaagtacataccaaatatgcatgtgttagcagatttcatgtggaacaattgccatcatatcttgtctgaaagcaaataaaatatgatgcagtgaaattcatcacca

SEQ ID NO: 39212 - DNA, 1385 bp, Oryza sativa
aaataatcggtcgcaacgagtatgaacttatgccccttgcttgaaggtggattgatttggccgatcatatccataccccatcctctaaatggccatggcttaataataggattcatagctgatgctggtgccctctgaattgccctaaacttttgacaatcttgacaccttttataatatctgaaataatcttccaacattgttggccaaaaataccccacacgccgaagtaaccacttcatcttgtgagctgattgatgagttccacagattccttcatgtacttcgccgattgcagccttggcttgatcggcactcaaacacttgagtaacaccccatcaatcatccggtaatacaactcatcatccaacagggtgtatttcaaagctttatttcgtaattttcttgaagccaattgagacggatttcgcaaatactgaaatacatcatatctccaatcatcggctgtaatcgtagcaacctctatctcaacatctctcaacatcggcttatatcccgatgccccttgagccaaatcattagcttcaatgttttgctctcttgacacatgtttcaaagttaccagccgaaatccactcattaattctcggcacttctcattgtaaaccatcaatgtatcattcttggattcatattctcctgccaattgactgattaccaataaggaatcacccatgatttcgatagcgtcggcttcaacttccttaagcaattgcaatcctttgagaacagcttcatactcagcctgattgttagtcgcataaggtttaatagtgcaggcaaactcaaaacttgcccctcgaggagaaattatgaccaagccaataccacaaccatgagtgcataccaatccatcaaagaataaagtccatggcacaatttctaccgagtcgattgagtcatctcgatgatccacaataaaatcggctatagcttgtcccttaatcgcctttggtgactcatatcgaagatcaaattctgtcaaagcaaatatccacttgccaacccttcctttgaaaatcagagccgatagcatgtatttcaccacatcggccttacatatcacaatgcattcatttgacaatagatagtgccttaacttggtacaagagaaatataaacacaagcacaacttttccacaggagaatacctcgtttctgcatccaagagccgtcgacttaaataaaaaacaactctctctttcccttcaaactcctgaatcaaaactgaaccaatctacttatcaccagccaatagatataatctgaaaggcacccccttttgtggaggaataagaactggtggagaactaagatattccttgatactatccaaagctttctgttgttcgggctgcaggaa

SEQ ID NO: 39213 - DNA, 4974 bp, Oryza sativa
tattacgtttccttgtatattatgtaacggcctaaagtcctggtttgataagattgtaaagtagatttaggaaatcaataccgtattggttaaggtttctatcttgtaatcctgccccccgtcctatataaggtgggcaggaggccctctagggggcatatgagcacatatgatcgtcagatctaatacacccggcggattcaaatccccaaacaggagtagggtattacctcacattgagagggcctgaacctgtctaaatcctttgtttccgcatccatccacttttaggtctcgtgcgctacccccttttattattgccgaattcatgttttgacagttggcgcgccaggtaggggttgcgtcgaattagccgtcgaaaagtgtgatggattcaactccataagaaacgccaagatcaatctcaccggtttcgacgactcaaatcttctatcgggtttgtcgttccaaataaacttttattagattaattttcaatcattatttgatcttcttacatttattggtttttttcatgccaactgagatcgtgacgaagcagtcggcgacctcgtgaatccaaccgacgtaaatttgatcacgctttgtgctgatctatacgccggcacatggcccggtgacagtcttcatgcatggagcatcgccggttataaggaacacacgtgcttatgttgattcaatcaacaagcacgaccaacttaatcatgccatatatccaatatatatgagtctatatgtttctttgtttaataacagattaatctactaatcgctttcttttgcatgttcgtatatgccgatcaagagcaaccatctgtccatgacagcctttgactgctgccacacgcgcgtcaactagcgattgttctggccgggatccatgtccgcgtgcacccacctgtcatggcgccgtcaatttaatcctccatgccagcatgcaaaagcatgcatctttcgatacatgtacatctgtactttttattactactaatctcagtttgatgtgtggtttattttttgcatgcaccctggtttcccgagtccgattccctatgacttggtttgatctggctggactcggacctgtgacttgtacgtgctcatgacatgcaggagcatgaatcggtttaatgatctgcttgtgtggacgcatctaatgttcatgctacatgagatcaatcggccaaccaaataatatatgcatgcttcatatatgcattgatatatgcagacatacatccacaagattaattttcttgatgctaattagagatttcttttgtctctttacatgtatcgccggccgtctccatcgccgctaactggtgccctcgcctacgcgattggatggtcacaccaccattgttgggcatctacgtcttcaccgaccggccgcctcgtccgccgccgactggtgtctccgcctacacggctggcctattatgccgctgttgttgggcgtctatgacttcaccgtcggcctgcctccgtcgccgccgactggtgtctccgcctgtacggctggcctattatgccaccgctgttaggcgtctacgacttcaccgccggcctgcctccgtcgccgccgactggtgtcctcgcctatacggttggttggtcacaccaccgttcatgggcatccacgtcttcaccgactggcttgccttagccaccgccgactggtgtctctgcctacacggctggcctattatgccgccgttggagggcatcttcgctttcaccgtcgaccgccttcgttgccgctgactggtgtcttcattgttattgatggacgactttgttcccacattggccacctctgccatcaccaaggggaatattacaaagttgagtcatcatttatttcattctttatatgatattttccttttcctctgcctcactatatcaactggttcgccgttgactagtgagtcgggggctacagatgttatatcatattttttaaacaatttttataatatttatcttgattgcttgcgatataatctgagtacaaaagtgcctatcgagttatggagttctatcttcctatgctttttgtttggtttgccgatggatagttgcctttgggccgattcctagcacccgggggctcgttggatggaccgagtaacgcaaggtgctaagtattattcggaataaatcaaaagcatagagataagataaatttattgtttgctcttaacaattgcaaaagtacccgagtagtaaattctgatccgtgaaactttgttccattaatgacgaactcatatcactcatatgcatgtttgggaagtgcctaggccgacacccgatgcttgggggctatgactagtcgggcagagtgtttaaacgtaatgagtcatctgctcggggaaatcaaaattgacaagaggagaaaaacatatttataaacattttaaaatgcttgaattttcctctagtattgtatttacatcagatactactcatcctatatgtttgttctgtaggatccagatccagatatgcacaatagggattcatggctttaagcttatttcctacgcttcaggaataggtcagtcagaacatcaccaccggcttgccttcgccgccgccgactggtgtcttcgcctgcacgattggcctattatgttgccgttgttgggcgtctacgtcttcactgccggcttgccttcgctgccgccgactggtgtctccgcctacacggctggcctattatgccgccgtttgttaggcgtctacgtcttcaccgaacggcttgccttcgccaccgccaactggtgtctccgcttgcatggctggcctattatcccgccgtttgttgggcgtctacgtctttaccgcgggcttgccatcaccgccgccgactggtgtctctgcctgcacggctggcctattatgccgccgttgttgggtgtctacgtcttcaccgaccggccgcctcgtccgccactgactggtgtttttgtctatacggttggttggtcacaccaccgttgttgggcatctacgacttcaccgctggctcgccttcgccaccgccgactggtgtctccgcctgcacggctggtttattatgtcgccgttgttggacgtctacatcttcatcgaccggccgcctcgtatgacgccaactggtgctatcgtcttcacggctggccacgccgccgccaccacaaataggcgtcatcaccttcaacacaagctgtctacgtctgttgccgactggtttcttcacttccatggctgcatgattctgccagtgttgattggccttatagtcttcaccgccggtcatctcgtctgctgctgactagtgccctcgcctctacggctggtttataccactaccactactgatggatatcatcgtcttcattgctggccaccttgtctgatgccgactggcttgttcgcctccacggctgcgcgtcttcgtcatcattgactggcgtcatcatgatcgctggtttgccttcgccgccgcccatggtttcttcactttcatggctgacttattttcgtcgttcaaggacgtcttcattttcgtcatcattctacttcttccgtcgccgactggttatgccgccgccgactggtgtttttatcttcacaactacgcatcttcgctaccggtttgcttctgttgccgccgactcgtgttcacttcatcacgactattcaactttgtcaccatggtggagcgacttcatctttattatcttcggcaccggcagactctattgtctctactttgtaagctttgctacttcaccaactacgacgtcttcaagagcctcgacatcttggtatgcgtcatcaaatatgatgccgtgttattttactacaacaagtggtgttccaatattcaagatttctactcggacatgttcaacacgtatcttcactcaagtgatggctactcgatgacaagaagctacaattcttgactctatgttcagttgtttctcaactaaccaaagagtctagggctacacaaataccagactcaaaattcgacaagctttatgtcaagacaattccccttgggcaaaattctccttagctatcagtaccaaattttgaacaatgcatcagctaagatagccgtcggttcgatggttggagcaggtgggccatggtggtttctacagacttggctgaacttagtagccatgaaagctgtcaatcggccatcagtgatagaagtagagttcccaagactagagccgattacagatgatgatggagaagagcgaacccattgcaggtgcatgtcttatggagaatatgcatccacaccagccgattctggagcaaagctatcggctgaactgctcaaagactggttctgcagtttctatgaaggcttccagagagatgctcgggtttggttcccatatgaggactcaatgaatttcgatctcccagcagatttcagatttgaggatatcaactccgaaaaatttgataagtctagagaagtcttttcagctgctattagtccatgcatccttccagttggcatctatcaaggaagaaacattcaagtttcttatgaattttatcacccaatgagttcagctaggcagttcggaatgggacaattgccgatcggcttgtactttgccgataagatccagtgcaggggtgatatatcttcagccttgatgatggatcggctgctgaatatcccaggacctcaacttggcagtattgagaatatagagtttgcaaggttcaggagcaaagcctttgacaaatggtggggtgaatggaaattgcatctgttccatcaatcggcttccatgtatatgacatacctcttcccagatgccatccctcaagtaagtcttttcattatcaattttgtaaacataactgttagccgattgataccttatctaatttctcttctttcttgcagacaacagaatcctc

SEQ ID NO: 39214 - DNA, 2323 bp, Oryza sativa
tgccggcagaaaaaggaaaaccaagacatggctattgatccatcggttctggctccaaagaagaaggccaaaaagaagaaatccaagctagccgatgacttgcctgccgtagatccatccattgaacaagctttggatgaagaagaacttagagaggatgttgatcaagctgcagccgaaatgagtgaccagaagataaaacaccatcggcttctccaaaacaaactcctccaactcctactgctccagctcattttaggagggtaaattacttgtttcaatcatccctttttagaataatcaaatttgaacagccaattgcttactagtcttgtacttgcagaagaagaaaactgccgtgaagaagaaatcggcaacaatagcatcaaagccagctccaccggtaaggttctttgtatctttaagtacaatcaaagccaacattatttaacacttgtctttttcagcttcctcctccttcgcctgctgtgcagccgatgtctagcgaatggactctatcggctacaggcagccacaacgttgaaggagaagaacaaccaactgttctgttttctttcgcaggtcttaaccgatctgttttcttttgacatcaaggattaccttgatgaagaagaagaagacaccactagcaaagcctcagctactctgtccgatgatgtgaagagaaatcttgaagacatatctcatcagctagggtcatcattaaacagcttggtagctgattgtgcttcaatccgggcaagatttaaggaaattcaacctctaatcccagatgatctagccaacgttattactctagctgcttatcttgagcaacaccaattcaagctgaagaaaggtaagcaaagattagtcgatcgccgagagcgtaaggatatcgaaactactatccaagccaatcgacagcttgtacatgaagtgaaatccaagcttgatcagctatctgaaggcccgatcaagtccaatattgatcggctcgaggctcggaagattgagctcttggcactacttcaagaatgtaacgctgagctgtctttggagcaacaaaaattggctaacctaccaaaggctattgaagagcagaagttgaggctgaaatcggctatcaggaatattgccgatatgactaagtccctcaaagtcatccctggaaccgatgctcaagacgcccaagccatagaagaagtaaagcaaattaggcaaagggctatatcggctattcagtaatatttgtctcaatgactatccatgtaatagggcttagaaaattcttgtaattggctaagatattttggtacttcaccaactaagtaactgctttgataatcctttatgccgattaacataacttctgaatttgcctcaaaaatttcaaaaatatccaactttgtatatatatatgccccccctaattttgtaatgacgaagacattgataaaattataaattagtctgtgggcgatataaccatatcggccatcatacaccggcaaaacacagccgattatgaagataaaacagctaagggcgatattactatatcggccatctcaaggcgatgcaaacacatcggctctacatgcatcggcaaattcagccgatcatgaattaacccatacacttgggtaatatttcttcaagtatttgccattaagggcccgtccataaacttccccatcaagtctttgcaacatataagctcccttggacacaacattgtggatttgaaacagtccttcccaatttggcgaccacttgccgaatttattatcacaagttcctatcggcaagatcaacttccaaacaagctctccttctgaaaaatatttaggcaccaccttcttgttataatgtcgagcaaccctctctttatcctaagtaactttttcaagagcccgcaatcttgattgaaccaggtcctcccgttcatcgaccatgagattgtaatactcatcgactgtcaatccatcctgtaaatctgttcttcttgagccgattctcacttcccatggtaaaacagcttcatgcccataaacaagcttatagggagaaacttgaatcgatccatgacaagccatccgataagaccataatgcttcagccaatcgagtatgccattgccgaggataatcagaaatctttcttttaatcaacttgatcaaacttttgttagatgttcggcttgcccattggcttgtgcataatatggagaagaaaacttgatacccatgctatcggcaaccgaacaaactcatcagacacaaatatcgaaccttgatcagttgtaatcgtctgaggaatg

SEQ ID NO: 39215 - DNA, 1260 bp, Oryza sativa
aactgatcctttacattgctcatcatctgctcgagctcatccctttgctcagtcgtcaatttatccaatgtgattggaacaataatactaggggccagttcggctgaacaagaaataaagacaaagaaacagtagttaaatccataatgatagccgattagccagccgccgatgacatatcatttatcttcgagccgatgtcatatgtgaatcgatcggcagttataaataagtaattaaaactaaatctactcgatcgggtatagacgttaacaatgcataatttttatgtcgatatatacttaaatcaagtgattgggatagatcggtcgccatgccgagacagtataaatcacttagatcgaaatatatattaacaatgagattatagatgttcacagcataaccgattagatagatctagcgcgtatcggctaatacaccgataccactctatattaagatattaaagcgagtaaaatatatcaaacaaaaagcttaacatatctaaaaaaagcaataagatctcaatataaagggcagatttagcatatcaattaagcacatgaaatataaggctaaatcaggtaagatcggctaaaaccccgatactactctaatcgacaaccaagaagcaggctagagattatagttctaagcacgacttatgaggtcaaacctaactgatgcagccataagtatgaaaagaaacacaatatctagacaatcaagccattggaagtttcgtagagtggtggatattctatataatctagatcaacatcggtaattaacctgatcggctgcctcccagtaacagatgttagcctattagaggttaggtaacaatgttgccggagattatatagaatatatgataactcgacaacttacatgcacaggattagagtgtcataatgatgcaagcactaatcccaagaacgcaagccgccataacaagtcgtacctctagttgaagatcgaaaccgatgcagctcaactcgaaagcaagaactcgtcgaaacaaaacgaaagtaaaaggtggcgatgcgccgagattgtatttgaacgtgtgttaattgattacatagggctcggggtctatttatacccgagattacaaaatatgtccttgtcggacacgactctcatctctaacaaactctaagataccataagtctttgcggcagacttttgcccacacttatctctaaggaaattacataaaatatcctaattaatagatacaattgccttct

SEQ ID NO: 39216 - DNA, 11163 bp, Oryza sativa
attttgataattaatgatgatgaaggctcaatttgtacaatactgatgaatttatgctatgcttggtgttccatacttagctttgatttcttaaaagcctttatctagccttattgagcctaaaacccgcaaaagctattaaaaaccttcagtcctcatcgactaagtcgaaagaccaaatagggcaatgataaataagtaagcaaattgaattgataaaaatcacactccattattatcatagtagcccccgactgaaaacttcaaggaaaaacttgagattagcagtcaaagaggaaagatacaaacgaaacgcctaagcataaaatcgacgaaggtgttcaatattccaagaattgttgatgagagtaccatcttcgcgcttgagtcgataagaacctggccaagtgacttcagcaattatgaacggtcctgcccataagggagataatttatgccgatcctgtgtggtttgaattttcctcagaaccaggtcgccgactaaaaaggctcacgatcgaacattccgattatgataacggcgcaacccttgcaaataccgagtcgactgaattaaagctgcttcacgggcttcttctaatcgattgatgtcgtctacttggccctcttcataacgctcctcgttgaagttccgaaatcgtagtgattcaaattccacttcactggcaacattgcttctgcaccataaaccaaaaagaacggcgactggccggtagcccgactgggagtagtgtgtaaagactaaagtacggacggcagctgattgacccacttgccagcatagggatgtagtcggtcgaaaactcgtgcttttatcccttgaagtatcatgccattagcacgctcgacttgtccgttactcatggggtgtgccacggaggcatagcaaatttttataccgaagtcttcacaaaagtctttaaatgctccgccagtgaattgagtgccattatcagtgatgatccgattaggtaccccaaaccgatgcacaatgttaatgaaaaaatctctagctttatctgccgtaatcgtgatgaccggtttagcctcaatccatttggagaatttgtcaatagccataaagagatgcgtgtaacccccgactgcccttttaaacaggccgaccatgtcaagcccccagaccgcaaacggccaggacaacgggatggtttgcaactcttgggctggtaggtgaatttgtctggcaaaaaattgacaaccctcgcacgtccgcacaatcttgtcagcatcagatacagctgtaggccagaaaaaaccttgccggtaagctttgccgacaatagtccatgcagcggcatggttaccacaaataccagaatgtatatccttcaacaattgtcttccttcttccaaagacacacagcgttgcagtattcctgatggatttttcttgtacatatcagtttcatgaataatgtaaagtctgctgcgccgggaaatctgctcggcttcatttttgtcttgaggaagttcttgtttgctcaaaaattttatgaacggttctctccagtcggcttcgatcatgcttacgccttgagtatccatggcttcaattgtctcttttctgggcacggttggttcgtaaagatgttcaacgaacacatctgaaggagcagcttcctgttttgaaccaaaattggccagcctgtcggctgcctcattgttatgtcggagaacatgggtgagctcgagtccatcgaatttgtcttccaacatgcgtacctcttgtcgataagcagtcatagtatcatctagataggaccactctttcatgacttgattaacaaccaactgagagtcccctcggacaattaatcggcgaatgcctagagagatggcaatccttaatccatggagtagcgcctcgtattccgccacgttatgggacgcagaaaaatgtatccacaatacgtagctcaatctttctcaagtcgggagattaaaacaaccccagctccagtgcctgtaagcctcttcgacccatcaaaatgcatagtccaatattccctcttttcctctggcatgtcttcttggcactcggtccactcggcaaggaaatcagctaaagcttgtgacttgatcgaagttcgtggtttgaacgatatgtccaaagacatcaattctaaggcccacttcgcaatccgtccgtttgcttcgcgattatgatgtatatccccgagtggaaacgatgtgaccaccgtgaccgagtgactttgaaagtagtgagataatttcatgacggtaattaagacaccatataataacttttgaacctgaggataccttgtcttggagtcggctaaaacctcactgacaaaataaattggtcgttggactttttgaatatggccttcctcttcacgctcaacaaccaggaccgtgctcacaacctgggaggtcgccgtcatatataacagtagcggctcttgtagatgcggcgaggccaaaactggtggagtggtgagaagtctcttgaagtcttcaaaggctttttgtgcttcgggtccccactgaaaattgtcagtcttcttcagcagcttgaaaaagggcatcccccgctcgccgagtcatgagacgaaccggctgagcgccgccatacaaccagtcagcttttggacgtctttttgggagcttggcggtttcatgttgaggatggcgttgattttctccgggttggcctgtatgcctctttgagataccataaatccgagcaacttccctgacggtactccgaagatgcacttttcagggtttagtttcatcctgaaagcacgaatgcttgtaaaagtttcctctaaatctgtgatcaggtcatccttctgcttggtcttgacaactacatcatcaacgtaagcttcaacattgcggccgatctgagtcgagaaacatctctgaatcatgcgttgataggttactcctgcgttcttccatccaaagggcatggtgatgtagcagtaggccccgaagggtgtaataaacgagatcttcaagcagtcggattctttcagtcggatctgatgatatcccgagtagcagtccaagaaactgagtaactcgcagccggccgttgagtcaaccacctggtcaatgcgaggtaacccaaaagggtctttggggcaagacttgttgaggtcggtgtaatcaacacacatgtgccattgccccgtctttttccgaactaggactgggttagccagccagtctggatgaaggacttccttgatgaagcccgctgctaacagcttggttaattcctccttgattgcatccttcctgtcctgtgcaaaacggtggagtcgttgcttgatgggtttggcgtcttccttaacatgtaaagagtgctcaatcacctctctaggaataccaggcatatcggatggtttccatgcaaagatatctttattattttgaagaaaggtgatgagcgcgctttcctatttacaatctaactcagcgcctattacagcaatcttatcaggatcagagggatctaagggaatctttttcgtcttaccattgctttctccgcttttgagcatcttggttgcgggcacttctccttcgcttgccatggtcgcagccagtcggatctcttctcggtcgagtgtaatctcgcgggtctgggccatctcgcaactttctttgtcacatgtgacggctttcttgatgttgcttcgtagtgatatgactcctcgaggaccaagcatcttcatcatcatgtaggtgtagtgtgggacggccatgaatttggctagggccggtcgtccaagtatagcatggtatgctgtctcgaaatcagcgacttcgaaacaaacattttctgtgcgaaaattctcccgagtgccgaaagtgaccggaagagtgatctagccgagtggtgtagctgataatccagggataacaccgtggaaggtgcattgctcggctttaattccgtgcgaggaatctgcatatcgtccagggtcttagcgaaaaggatgttgagtgcactgccaccatcaatgagagttcttcggagcttgacattgcgaaccactaggtatagtactagggggtaccgccccgggtggaccactcggtcgggatgatccgagcggtcaaacttgattgctatttctgaccaccgaaggtattggggcgtgttgggctgaaccgcattgatctcccgttctgttagcttctgctttctcttagattcataagccagaggtccgccgaagatgtgattgagttctttgcgatgatcttgaaaaccagtcgaggcatcgtcttcatcgtctttcttctttgatgtgccttgctctccgtctgaaggcttacgtgcattcttgacgtattgctccgcaaattgtttgtagacgaagcagtctttggccacgtggttggagttaggatgatgcggacattgggagttcattatcttgtcgaatgtgttgacgcggggacgttgtcgggaagatggagaggttgttgccacaagttcttcgggcttacgcttgcgatccttgcggttgttacttccactccctcctgcggtcggcgtgtccttctttggcttccaagtggtgcccgactgcttggacgctgtaatagcatcttcggctttggcatactcgttggctttttcaaacatttgcttgaccgtcttgggaggtttgcatccgaacttgccgactaggtcctcgtggcgaatgcctttagtaaaggcagcaatgatgacgtcgtcggtgatgtcggagatcttgttgcgttgctcggagaagcgccggatgtaatcttgaagggatcctctagacttctgaacgacgttgtagagatcaaactgtgtgccggggcgttcaaaggtgccctggaagttggcgatgaagtgatcacgaagttctgcccatgatccgattgtgccacggggtagtccgtggagccaggatcgggcggaatccgctagagccacaggcagatagtttgccatggccttgctgtctcctcctgctgcgcggattgcgagaccatagacggtgagccaagactcagggttggtggtgccatcatatttctcaattccagtcggcttaaagccggctggccaatccactcgacgcagatcgcttgtgaaggcagcaactccgtccacatcgttgtcgtaacgatctggtgaatggtggcctcttgctggacggcgctagttgatggtgtcgcgaagatcgatggggcgccttcgatgtggggagtgtggtcgttcaactcgacgctccctataccgttcgggaggtgaacgaacagaccgttcatcatgtcctctgctcctgtgactagatccggcactggcaatgctgaggcatggctggtgatagtcttgagatcgaagatgagggactcggctaccagtcaaggtgcgggtgcttgcggagttggctggacccgaggaagcgatcatggtcttcgtctggttcaagatgttgacaacatgatcagcttggttgagtgcgtcttccttgaggagggtgtcgaggagagtgattgctgcaaccgcgttctgctggggggtgcgaaagaccgctgttccgtcgacgtcttgttgcccaatgagctctctcgctcgcctcccggattccaaggtgcgttgccgtcgatcttcagcctcctttgcaatccgttcgcgatcttgttgctcacgctatagtcgttctcgctcctgtcgctgtcgctcttcctccagtcggcgacgttcagcttcttgccgtgcgcgatcttggtccgcttctcgggctcggcgctgttcctccgtttcgttgtcagccatgaatacaccgaagaagaggggcgtgtagttatcctcatagctgtcgtcgaagttgtcgaggtcgtcgtggtcgtcgtagtcgaggatctcggttggtcgagaactgacgccgggggagctgaggtagccatccaaatcttccgtcgagactgtcccaagaagttggagtataacgccaacctccctggatctagactggatcagggccgatgccggagctcgcctagatctctgagtgggagatgttttgactgtgaagacggcgtccaagtcatcaggaagtttcatcaagattgaaggataggacccgtcgtcttgatctggtcgcggaggagtagattggatctcgtccgagtggtttgaagccgactcggaagatatgatcttggagtaggcctcggccgagttcggaataccgaacggcacggggacctggtctctccctgactggttcgaatccgagtcaaggagagagatcttgctgaagtcgttggtgatgaagttgaggctgccgaaccggaacgcctgcccgggagggaaggcgaagtcgtcgatgccagaaatggaacccatcgcacttagtcggcaaaaacttgacgctgcccctacctggcgcgccaactgtcgaaacaagatttcggcaataataaaagggggtggctatcaagctaggaaagtggatgggtttggagacaaggaattttatacaggttcaggccttcttattcaagaagtaataccctactcctgtccggggatgattccgccgagtatgttattgattgtatatattggaaaaaagaattgcgccccgagaggcacacggaccctccttatataggggaaggagtccgctttacaaaatacagtccatatcctaacggaatatgggattatagataaaatacaatcctaaccgactaagatctcgggtatttccttgacatacaagtaaaaaacaaacccgagtcttcataaagatattctatctatatttggtaccgtatatccgactaaattataactgtcatgtagatatgggatatccatattctccacatggagtgtactgggtgcgtccgtgtcgaaaattcactctgtgattcgcgcagcgaacttttgtcacttaatgccaatattggcctatattagcatacatgggtgcgatgaattttagcggaataaaaaagttcagaaagcaccaaaacatgtttttggacatactgtagagaattgggtgcgtccgtgtcgaaaaatcactccgtgactcgcgcggcaaagttttgtcaattaatgccaatattggcctatgttggcacacgtgggtgcggagttttacaccggaaagaataacttcaaaaagcaccaaaacatgatttttggacatattggaatatgctgggtgagtccgtgtcgaaaaatcactccgtgactcgcgcggcgaacttttgtcaattaatgccaatatagatatatattggcacacgtaggtgcaatgtttttcaccggaatgaaaaacttcaaaaagcaccaaaacatgatttttggacttattggagtatattgggtgcgtccgtgtagaaaaattaatttgtgactcgcgcggcgaacttttatcaactaatgccaatatctttggacatatttgagtatgttgggtgagttggtgtcgaaaaatcgctccgtgactcgcgcgacgaacttttgtcaaataacgccaatattggcctatattggcacacgtgggtgcgatgtttttcaccggaatgaaaaagttcagaaagcacacaaacatgtttttggacatactgtagataattgggtgtgtccgtgtcgaaaaattactccatgactcacgcggcgaagttttgtcaactaataccaatattggcctatgttggacacgtgggtgcgatgtttttcaccggaatgaaaaacttgaaaaagcacgaaaacgtgattttttggacatattggagtatgttgggttagtccgtgtcgaaaaatcactccgtgactcgcgtggcgaacttttgtcaattagtgccactattggcctatattggcacacgtgggtgagttctttttcaccggaatgaaaaagttaaaaaaaaaaccaaaacatgatttttggacatattggagtgtacagggtgcgtccgtgtcgaaaaatcactctgtgactcgcgcggcgaacttttgtcaattaataccgatattggcctatattggcacacgtgggtgcaatgtttttcaccggaaagaaaaacttccaaaagcaccaaaacatgatttttggacatattggagtatgttgggtgagtccgtgtcgaaaaatcactccgtaactcgcgcggcgaacttttgtcaattattgccaatatagacatctattggcacacgtgggtgcaatgtttttcaccggaatgaaaaatttcaaaaagcaccaaaacatgatttttggacatattggagtatattgggtgcgtccgtgtagaaaaatcaatttgtcactcgcgcggcgaacttttatcaattgatgccaatattgccacacgtgggtttcaccgtaatgaaaaagatcaaaaagcaccaaaacatgatttttcgacatattggagtgtattgggtgcgtccgcttcgaaaaatcactccgtgactcgcgcggcgaacttttgtcaattaatgccaatatagatatatactggcacacgtgggtgcaatgtttttcaccggaatgaaaaacttgaaaaagcaccaaaaaatgattcttggacatattggagtctgttgggtgagtctgtatcgaaaaatcactccgtgactcgcgcggtgaacttttgtcaattaatgccaatactggcccatattggcacacgtgggtgcgatgtttttcaccgaaatgaaagacttcaaaaagcaccaaaatatgatttttgggcaaattggagtatgttgggttagtccgtgacgaaaaattactccgtgactcacgcggcgaagttttgtcaattaataccaaaattggcctatgttggcacacgtgggtgtgatgtttttcaccggaatgaaaaacttgaaaaagcaccaaaacgtgatttttggacatattggagtatgttgggtgagtccgtgtcgaaaaataactccgtaactcgcgcggcgaacttttgtcaattaatgccagtattggcctatattgccagacgtgggtgagttgtttttcaccggaatgaaaaagttcaaaaagcaccaaaaacatgatttttggacatattggagtgtacagggtgcgtccgtctcgaaaaatcactctgtgactcgcgcggtgaagttttgtcaattaatgccaatattggcctatattcgcacacgtgggtgcgctgttttttcccggaatgaaaaagttcaaaaagcaccaaaacatgattttaggacttattggagtttactaggtgcatcagtgtcgaaaattcactccgtgattcgcgcaacgaacttttgtcacttaatgccaatattggcctatattagcatacgtgggtgcgatgtattttaccggaatgaaaacgttcagaaagcaccaaaacatgtttttggacatacttgtagagaattgggtgtgtccgtgtcgaaaaatcactccgtgaatcgcgcggcgaacttttgtaaattaatgccaatattggcctatgttggcacacgtgggtgcgatgtttttcaccggaatgaaaaagttcaaaaagcaccaaaacaagatttttggacatattggagtatcttgggtgagtgtcacaccctgagatttttctcccaagcctaaattgaatttataaatggtctcaacaaaataccgctgcaaaagcaagagagaaaccctaaaataattgatgcaaataataatcggaactggcatgtgggattttttcctgagttctacatgtcgaaatacgctaacaagattttagtggaattttaagagctctagaaataattttaatcaattaaaaatgaccacaagcaatatttaattccctagaaattcttttccttatttttctttctttttccctcttttcttttcggaatggtccgccggcccattctctcctccctccccttcccgctgggctggccgcccgagcccctcctctctcccggggtcgccgataggtggggcccacctgtcgagtcctcccccaacctccagccgccgccgcaccctcactaccgcgttttccgggccacgtcggccttgcccgcgcgtgcgcccacgtctcccgcgcccactccctctctctcccgcccgcgcccgcgctcgagacggccaggattcgattttcaaatcccgcctctctctcctctcccactaccccacgtcggctggcgattcccgcctctcctagccacgttcgagctccctctcccctatttaagcatccccactctcccctctctctttttctccatttcgcgagctctcccgtgccctctatcgccctagcgctgtcgccctcctttccgccgccgccgccaccgctccggtcgctgctagccgccgctagccgctgcgccgagccgcgtcgtcgacgccgtcacgttcgccgtcgtgcaggtcacccccgtccgcccctctcccgtcggattccgcctccggaacccactccgcgccttgcggcggtgagcacggcatggccaccggcttcgggcggcgtcctcgccctcttccatcttcctctctctctaacccctttcatcgtgttcgctaggtggttccagagctcgtccagttgcagtcatcgccatcagtcgctcgcagtcatcaattgccgtcggtgagacacctcctccccttcctccctctctctcccacgccgcttagtcgccgcgctgccgcctagctgcttagccgccgctagcatcacccgcgccgtcgcgccgccgccgcttgccgtcggtcaccgctgtctgccgccgccgccctgcggtagcgccgctgtgcaccgtggccatcgggccggcttgggccgcccgtgtgtgccggccgcgtgctccccgccgccgtccgatctactctcgggtagatcggggccgtcggttggccacccgcgtggcgtgccatgtggccgccacgtgtgcgccacgtcggcgccacgtcagcgccacgtcgtgtgcctcccccttttccggtccgtggactcggtccactgtggccgccacccgagtcactgccatgtggggcccacatgttggcgccgcccctctttcctagggtctatttattgcgcaataaatcaattaaggatttttctgtttatagt

SEQ ID NO: 39217 - DNA, 5921 bp, Oryza sativa
gtgtggtgtgcttggctaaagggggttatgcgaagagtcctgtcacggcctctttccggtatgtcgtggtggcatgtcggcgcacggaaacgtgtcggggggctgtgttttgtgggtacagttgtacacctctgatcagagtaaaactatttgaatagccttgcccgcggttatgggcggtcaaccagattcaccgtgattagtctcaccctagtttaatatgatggaactgattagttcaggtggttggttgggcctgttgcaacgtggtgtagcgttggacagtggatggctaatattgattaattattacacctgatttcctgctttcaactactgtttataaatgctcgttttacgcaaaagaacctctctagctatcctttggtaatatcctgcatcataccccctgttccggtatgacttgctgagtgtggtggttatactcagtcttgctctattttccccaaaccccagagtttgagtatgcgttagatggtggtttctccgaggaataggcttcgttcgtgccgtcgaggatgcctgtggactggtgttcccgctgcagtccaagtcaaggcttagctccagttatcttttatttttccgctacatttatgtaagacttttataatttttgtaagacgtggatctgtatgtcaactttgtcgtttgtgtaccccccggccggtcctggatggggattttaatgcacattctgcttggaattctattcgggaatttctgggcgtgacaacttggtatcagagccaaccttgaccgtaggacaagccaaatgggaaaaaacctaagagccctctgaatccttttcattgcatatgttctttgcaattggatttgttccgggaaaattgggatctgttcttgtggttcaagggaaaaatcttggtcgctcgtttaagtgagatttgtcaaattaggtcagtctagggtttgatgggaggaatgcattaggtcctaactcaggaatatgggttgcaaggtattaatgctcttattattattattagtatgtatctaatttctcattattttatcgctatgtaagtccgtcttatttattcgccctcatgcaaaaatggtctatgcacaaaactctgctctcaattgttcattttaattgagtcttttactactttatttaaattggatttgagcatgcattgatcctacccctttgtcttctctagatggccgaccacccacccaaccaccacggagaaggcatggatgattttgtggcagagttggctcgcatgaccctggtggtgggctacctgttaacaaccgaatttggtaacatcagcatcatgaaagaagattagatcgaagcaaaattggaggcggagatcgagttcggaaacagggcaggaatcgctggagtccaaatcggctacgattaggatcggctgggtctgagtcagactaggtaagccgatacagctgattccgacaatgcagcttgatgtatgatatcgggttggattgaggtgcttcaaggtgattgccgcacatggatagagtcctgagaaggcaattgtatctattaattagggtgttttatgtaatctccttagagatacgattgggcaaaagtctgccacaaagacttatgctatcttagagtttgctagagatagtagtcgtgtccgttatgtacatatcttgtaattcagagtatcataaagctgcatcggtttcgatcttcaacaagaggtaaaacttgttatgacgacttgtgttctcgggattagtgcttccatctttatgatactctgatctcgtttatgtaattcgtcgagttatcatatatcttacataatctccggcaatactgctatctaatctacaatcggctaacatctgtctgtagaaggcagccgattaggttagatatcgatgttgacttagattgtataaggtatctaccactctatgaaacttctagcggcttgattgtctagatattgttcttcttttcatacttaatgctgcatcagttgagtttgatctattaagtcgtgcttagaatatcaatctctagcctgccttctggttgccgattagggtagcatcggagtttcagccgaccttatctgatttaactatatttgctctatatgcttcattgacatgttaaatctgcccattatgtcaagatattgctgtatctaagtatcttaggcctttgtttgatatattatacctgttttaatatcctgatatagagtagtatcagagtattagccgatacatgctagatctatctgatcggctatgctataaacatatatagccctgttattaatatatacttcgatctaagtgatttataatgtcttggcatggcggccgatctatcccaatcacttgatttaagtatatatcgatataagaactatatattggaaatatctacagccgatcgaatagatttggttctttattgtctatttacaactgccgatcaattcacatatgacatcggctcaaagataaatgatatgtcatcggcacctagccgatcggctatcatttatagatttaaccgcggtttctttgcctttatttcttgttaattacaggatcaaatcaactggcatgctagtacacccgaaggcgagctttggacctgcactggagttaagcagatctcccaggcctcgtgttttctctcaacactaccccaacgtgccggagtactcgaccgttcctccactcagtggcgagcttccccaccattttcgtctggaggttcatggctatgtgggcacctgcctcgctaatacggtggttgaggcatctggaggctccgcagatcacgcttgtcaggaggcagcatatctgatgatggctagacttcgtgatcgccacaactacatcttctacaacacggcgtaccgcttccaccctcgccgagcaagtggcgacgacgccagcaccttccgcccgacagccggcgagaacaacaccaccttcggccacatgtgcgccgtgatgaggggaatggacaggatgcactctgacctgcacaaggcatccaaggccttgaatgatgggaagcttgtgaggatcatagctctaaaggatgagatagcacgcctgaagaaggagaacgctcaattgaagggtcttccagcgccaggaggagttcggatccgcaccacgccccgcaagtctacgactgctcccgtgcgcattcagcttgcacccaagaacccacctcttcccgcagctcctcccgcagcacccgtagctccagctccagccccagctcctgtgccagtgtcagctcccgcgtccgctctctccttcgctccagcgtcagccgccaggggtccagccagtggcaacggaggttggttgcctactactcctagtggcagccgcgaccatagcagcagcagttccagtggctcagagctgggcagcggtgagacgtatctgccagactccaggagccgctcagaggggcctggcgacgagcaggaggacgccttcgactccaccgactgcaggagccgttccgagcattaggctcattttcccttagtttatcgactgtttagtaattgcctgttagtttgtgtgtttaggattgttcgcttgtgggtcagtcgacagtcgatatcatgtgcctatgatatggctgtcttaataaggatttgcttgctgttttaagtgttttaattcagatcaaaacaattgcagtttaaattctgtcacgtcctgatttttcgctttctgttcttctcgcctatttgcgaaatttcacatttggtttattcgtctaaaatagcttaatgaaaatttcgttaaatcaaacggttttaaagtgattaattaattaattatgttgttcgctttgtgattcttaattggagttagttggatttaatttgtatttcggaagtggagctcaatccctaattcaaattccatccaaatccaatattccttttcaaatcctaaatccttcccaaaaatttcaaatactttatatttggaattttccagagaagtccctgtctttttccctttttccttcctctctgtttctctattctgcccttattcttctttctttttctttttcccccaccttcttctacctccagctctctctctccttcttgagctgcaggcccggggaggccaagccccgagcccacgtgccgccgcggcccggcctcctcctcctctctatgtcgccggcccaagccgccgccgaccgagcccgcgccggccgcgccgcaagcccacacggccgacgccaaatcccgcaagccgcgccaccaaattcggagccgccgcttttccaaagcttgcaccgtgcgccctaaccctagctactccctcccctataaataccatcggccaccgcccctttttccccctttttccaaagccgccgccatctccaccgtgagcagccgccgccaccgttgcttcgtgccgccgtcgggagccgcgccgtcgtcgtcaccatctccttcccgtgccgccgccgctggtaaagccccgaggctgagccctctctccctttcgagccgccgtttctctctccacctcaactccggcgtccgcctctcatcgccgtgcgccatctccacgccgtcccggagctcggtgctacgccaccgcgttggcctccacctcctctgcctccaccactatttgctgcagccgccatgcgccatcgccgacgaaagccgccgatgccgccgcgctggagccgccggtcctgccatggccagagcacgcccaggccgtgtgatggagcagctgctgcttgccttctcccctgtgacaccgacgtgtgggacctgccatccaaaatcctcaaataaatctaagccgtccaaatccctagatcaaatcccagcagttggatctacataatcccttctttcgccacgtcagccctatatccatccatgtcagtgccacctcatcgccttgtgtcgccacgtgtcgttccacgtcatcgagtccacatacaccgagtccacccatacactatgccaatgacagtgggcccacatatattttttcctatccaaaattaattcaatttccgaaattaaatatccagagaatattcttggaatattcctttttcttttatcctcggattttccccgaattcaaacttcaggaggccataacttttccgtttgaactccgattcgatccattcttcctcctaaattcttctaaaatcgagctttacctcctgatttaattggttatttcatttgatgttatttagttattttttctttgtgtttatttgtttttcgtttgcaatcgtgtagacgttggagcggaagagcagtttgcttcagaagacgctgtgcaaggacagtactaggatcaaggcaagtgcactctttgaacatattgaacccatttgtgaaatgttttgttttgaatacatgcattgttttgtttataaaccatcgatgggtagcgtgacctaattgttattattatcctacctttgataattattgattgcccatgattccttgtcaccctagtctttgtgaattgaacattgggctgaactcatggtagatcgtggcacaaaagaagagagaattccgagccctccaccagggcaacaggacagtgtctgagtatctccatgagttcaatcatctagcgcgatatgcaccggaggatgtccgcactgacgtagagaagcaggagaagttcctagcaggcctggatgacgagctgaccaaccagttgatctctagagactacgccaactttgagaactaggttgacaaggcaatccgtcaggaggatcagcgcaacaaaatggacaggaacagaaaggcagcgtagttccggtccaaccaaggaaaccaccagcgatcgcgcttcactcc

SEQ ID NO: 39218 - DNA, 6358 bp, Oryza sativa
tctcaaccggcggtctgaccgaccaagacccggcggtcagaccggcccactcggaggaaaccggtagacttccaaattttggcaatctttcctattttaatcctaggtgccaaatttgggtgtaaacatatgcccccctgcctttttgatgaacaacgtgaatctaaaagcatagaacatgttttggtcttaggacgataaatcaattaccagccatagtacctcctaagcgtcttgccaaacgctcgggaagtatttcttcaagtatttcccgttgattgctcgctgaaaacgctccccttgaagtgtctccaaaaaatatgcgttccctcgaacaatgccgcatacttgataaggaccctcccaactaggagaccactaactgaactccttggatcgagtacccaatggcaaaattgtcttccaaaccaagtctccaacttgaaacaactttgctttcacccttttgttttacgccttggccactctcttcttctctttctctatttattccaatgctttcaagcggttgtcgatgacttcatcaagattgtctcccatcaacgtcttgtaatcttcatttgacaaatcatcttgcttgatataacgaagagaaccaagatttacctccaccggtaaaacggcttcttgaccataaaccaactcaaaaggagtgactttagtggcaccatgtttagaaatcctatgcgcccacaatgcttcggaaagcatctcatgccacctctttgggtgttcctcaatcttcttcttcactaacttcaacaatgtcttattactcgactcggcttgtccattagcctgagcgtagtaaggagaagaactcaacaatttaataccataagattcggtaaaactcttcacttccttagacatagaagaagcaccttggtccgtagttaatgtttgtggaataccgaatctatggataatatgcttcaaaataaagtcaattacctctgtatgagtcatattcttcaaaggcacgaagcccacttggtgaagtaatccgtagcaactagcagaaacctatgcccctttgatgacgaaggataaatttgaccaatgaaatccaaagcccatcctcggaatgaccatggtttgattatgggattcaacacggcggcgggcgccaattgaacattgccgaaccgttgacaagcctcgcgtcctctataatatttgaagcaattatcaatcatcttcggccaatagaacccagctctcctaagcaaccaattcatcttgtgggccgattgatgagttccacaaattccttcatgtacctctcccatagccactttagattgatcttcatctaagcacttcaacaagacaccatctatatttcggcgatacaaatctccatcaagcaatgtatatttgaatgcttgccgccgaattttgcgatcaaccttcaaatatcgaattttgcgtaggatctttcaaatatcgaatcaaaggaattctccaatattcttctgttccctgggcacaaatgtctgaattcacagttaattcagcctctaaattgattgaaacgtgccccccagcattctgcccagaaccggtcagaccgaccacgcagggccggtcagaccgctctgggtcgccggtcagaccggcagcatgcggccggtcagaccgcccctggttaccggtcagaccggcagtgcaatgccggtcagaccatccctggtctccagttttgccaatttcgcacaaagatttaaaatcaagcaccggctcttctaatatcagaaataatcccttcttcacattatagccagatgcttgttgtgccaagtcatttgctctagaattatcatgcctaacaatatatctaatagaaaaattatcaaaattggcaataatatctaaacatgaattgaggtacctatttagtgatccgtccaagcatttgtagactccggtgacttgttgcaccaccaattccgaatcaccaaaagcttccatgtatttagctccaaccatcacataacttgtaagccaaacaataaagcattgtattcgacttgcttatttgtacaataatactcaaacgaacagatgcttcataacacatgccattaggtgaaaagaaaactacccctatgccttgaccttctttgcaagaagaaccatcaaaataaatcttccaaggataacttcaactaagcaaacctctccctcataagcaatatctgtatgatggtctactataaaaccacatacaatttggcctttcatagatttcaatggttcataagccaaatcatattctatcaaaacatatgcccacttgccaattctcccacttagaattggcctttgcaacatgtgtttaataacatcggcttgacaagtaactatgcatgtactatataacaaataatgcctcaatttggtacaagcatagtataagcatagacaaagtctctctataaaaacatacctcgttttggcatctaaaagacggcggctcaaatatgtaatgatatattccttgccatcttcctcttgtgtcaaaacggcaccaataactttgtcttcggaggcaatatataaccgaaaaggctttccagctttaggcgctcgtacaacgggtggagtagacaaatatctcttcaactcttcaaacgcctcttgttgttttgcccccaagtaacatcggcttcttttttcaagcgaagtataggaacaaaagcatcgattttacccgctaggttagaaataaaccttctcaaataattcactttacctagcaacttttgggcctccttcttgcatgtcggcgctttgaaatcacgaatcttctctatcttcttaggatcaatctcaactcctctctcatacaccatgaatcttaagaacttccccgccgacacaccaaaagcacatttaagtgggttcatcttcaaaccataccggcgcatcctctcaaaagctaacctcaaatcggccatgtgtccttccataccatccgatttgacaacaatatcatcaatatagatctctaggataatacctaataaatcatgaaagattaaattcattgtcctttgatatgttgcaccggcattcttcaacccaaaagtcatgacaacccactcaaataaaccaacaaatcctgggcacctaaaagccatcttgtacatatcctcttccgccataaagatttgattgtagccggcattaccatctagaaagctaatcaccttatgacccgaggcatcattaatcatcatgtcggctataggcataggatactcatctttgggagtagctttatttagatctctaaaatatatgcaaactccaatcttaccactccccttcttctccactaggactctgctagagacccactccacataacgacatggcctaataaaccctgccttcaacaaccgatcaatctcctctttgactcggtcatatagcaaaggattaaaacgacgaggtggttgcttataaggcctaaaacctggtttaattggaagccgatgctcaacgagctcacggctaagacctggcatctcatgatattcccatgcagagcaatcaacatactctttaagtagctcgattatcttaaccttataatcggctcatatttttgtttacaaaagtcagccttggtttggttccatcacctatgtccacttcctccaatggatcggccgatgtaaacccttgtccaagcttctctacttcatcaaaatcttcaatggtttcgccaatatcgttctttgtagaccgatattcttgcaccctcttttgtaaccactctaaattagcctctttactcattatacaaatttatatggcttagccgtgctacactagccggctttacagaaataggtacaaatttgccatcggagatactaataaaatcatagctagaaagttccctccctgataagcattggatattcccatgacgccactcaaaagtagcatcggccattgcaacctcggccgatgtatccgcttgaacaatttcaacatcatcgccgtcccattgaattaaacattgatgcaaggtagaaggcacacaacaattggcatgaatcaaacaacgacccaaaataacattgtagttaccttgcacatcgacgatgaagaaagcggttggtagcgtcttgtttcccacggtgaacttcgccgaaaagataccctttgcctctgttggttcaccattgaagccattgagaatcatgttggtcttcttcaactcatcatcctcacgccccaacttcttgaacaatgaatacggcatcaagttcacggcggcacctctatccactagcatcgtagagaccggcttcccaccaacatggcctttgagatagagaggcttcatgtgacggtttgactcatcgggcttctcaaaaaccgcgtctttaggacctaatgagaattgagcaacctcggcttcatccatagcacaaaactccataggcaacatacataccatgttgatatccatgtcttcttttggagatgattcacctttatcaaccgattgttcctccctctcttatccaacactggctttttccttctctatggattacgccttccataccagtggcggtcgcaactcattgaaccttttatctctttgttcttcagcttttttctctcttatctcttgagcccgaagacgttgcaaccttttcttttgagtagccgtcaaatccttaggcatccacttaggattcggctctgttctaggaggtaaataatgtcccctattaatcttgtttgaagacgatgaagccttcatatcgccctttgcaattcccctgtcaaaccggcgctggagcctgatcagaccggacgtagaccaccggtcagaccggccagacatgccggtcagaccgacacttgacgcacggtcagaccggcccgaggcatcggtcggaccactgtcgggtcggcggtcagactgacctgatgacccggtcagaccggccgcatggctgcggtcagaccggccagaaggcctggtcagaccggccgactgcgaggagttggttttgggttcggattttttgtttgaggatactccaactccatctccagaaggtattggcacatcatgagaccccactttgatggtaattacttctgaagtccttgcctccaccttgacggctttccttccctcttttcattattagcccgattcttaccataaaaccgcctattgtttggtgaagagaaacgctcatgaattggcctcctcggtcctccccatccttggttaaattgcattggaggcatatgattgaaaatttgcggcgttgccccccatggcatgaagtaaggataaggataacccggcgggacattcgataagaaccccatgacatgtcttgtggatgatgatatggaggtgaatgcgaccgtcttggtgaatgaccaaatcgctccctaggaggtgatcttggtcttttccccttgttgtgaaccctctcaccaccttgcttctcatacttctccaaaagcataccaaaagtcactttggtcttcctaggggctttagaagttgaagcgccactcttattctccttccaaacactaacttccggtttctttgtcactatcatcttaggccttggctcgccaatgaccactccttttcctttagtagattctgcttgctccggccgaattaacacctttttatcattgaaattaattgtattcaccgaaaaaggatcatgatcaagcttcatcttggagccatcagtgaacttcaatcgtccttcatctatggccgattgaacctgtcgtcgaaacacattgcaatcattagtagaatgagaatgagaatcatgccatttacaatatgctcggcgtttaaactcttcttgagatggtatgacatggcctttaggtaatctaatttgtttttcttgtaaaagataatcaaaaatcttatcacacttggccacatcaaaactatatttaacctcactttgccgatctttgcgaggagtcggcattaggttggagcaaacaaaaggcttgtttttgttagtccatgaccattcagcaacatatatatcatgatcaccctcctcctcactatcactagcctcagggtaatcaatcacattaacattaggctttttgtcataagatctgacaagttttttattatccttaactcggctttcttgagccagagccctttgcatgagttgactaacatcaagaaattgttggccatctagtctttctctaagaggagcaattaaaccattaaaagcaagatcagccaaatctctattagttatattcaaggtataacatcggtttctaa

SEQ ID NO: 39219 - DNA, 2349 bp, Oryza sativa
cgtagtttctctaaagctagacgaagatgctcctcatgttcttccttcgtcttggagtaaatgagaatgtcatcaataaacaccacgacaaacttatccagatattccataaacaccttgttcatcagattcatgaaaaaggctggggcattagtgagtccaaatgacataacggtacattcgaacaaaccataccgagttgtgaaggcggtctttggtatatcttcctcacggattcgaagttgatgatatccagaacggagatctatcttggagaaaactgtagcacctttcaattgatcaaagaggtcatcaattctgggtagaggatacttattcttgatagtgacctcattcaacgctcgataatccacgcacattctctgagtatgatctttcttctccacaaagatgactggtgctccccatggcgaagtactgggtctaatgtatcctttctgaagcaaatcatccacctgtctcttcacttcagctaactcattagctgccattctgtatggtctcttatggatagggttggttccaggtaccaagtctatccgaaactctatgtctctcttaggtggcagacctggcaaatcctcgggaaacacgtctgggtagtcttgtactatgggaatctcttgtagagcaacttggtttaagttcacaccatgagatttaggagaggacacaaagaaagaaacggtttccccattgctactagttaaagtcaccttacggttgacacaatctataactcctctgtgacgagataaccagtccatccctaagataacatctagatccttggattctagcaagataagtgaggatgggaaaggaacttcttctatttctatagtagcggaaggacaatactgtgtcgaaaatacttgattgcctggggtgttaactagtaaaggtctcccaagactaacaacttccatcccatgattgctcgcaaaacttttagacaaaaaggaatgtgtagcaccggaatcaaaaagcacagttgcgggtatagagttaacaggaaacgtacccaaaaccacatatggtgcattctgagcttctgctgctaccacatgattgacacgtgcctttggtactggaacattggagttgttcggagctggagcgttcttcacgcgccgaggcttaggacacttatcagcataatgtcctggatcaccacaattgaagcacaccactggtttgcttccctgttccttcctgacaggctggttctgagctggagttgctgcaggacgagcaaccacgttgcggttgtcattgccacgattaccagtattgttgttgtagaactggcgttgggggcggataactgatgaagatcctccttgagggtacgatggagcttgaggtccaataacgagacgtggcctctggttactgccctgttgtgccttgaattgggcagccctgcgcttcttctgctccatccggttatacttgtcttcctgacgaatcgccttgtccaccaattgctggaaatcccggaaatccgtagacatcaaggcataagacaactcatcattcagtccctctaaaaacttctcctgacgttcttcatcagtgcgaacatcctctggagcatagcgagctaaacggttgaaatcatggaggtactcagtgaccgaacgagatccctggttgagtgctctaaattctctcttctttagagctacaacacccgctggtatgtgtgtcttcttgaaagcagccgtgaattcctgccacgtaataggctctccttcagccctgccttggcgaaaatgatcccaccattcggcagcaggtccatgcagttgatgcgaagcaaaagaaactttctcctgctcagtacactggatcaaatccaacttcttttccaccgcatgcagccagtctcctgcttctactggattggtggtgcttgaaaaggtagggggtctcacacgtaagaaatctgccagcttgttttggggaggtgggggtggattctggttctgattgtttgcctgctgattctgtgcctgctgcactaacagattgatcagttgtgtttgttgggccagaatctgagctagcgtgggatctcctccattgttagtagctccactaccacttccacttccacttccagtgcgcgtgttcaccatctggcgataagcagagacaacaggaaagaacgacagagagacacccttagaacggagttatttaattaatttaaattctatattgctcttaactgtgtatgattacatttaagttgcactaacactatctcaccaactatcttacactccgacaagcaaaagagctagactcatgctgttacat

SEQ ID NO: 39220 - DNA, 769 bp, Oryza sativa
tcttcaagccgaaagtcatcacaacccactcaacaagccgattgcaccaggacatcggaaggctgtcttatgaatgtcttcttcggtaatgaagatccgattgtaacctgcattgccatccataaaactcaaaatcttgtgtcctgaacggcatcaaccaactgatcggctactggcatcgggtactcatcctttggggtagctttatttaaatcccggaaatcaatgcacaccctaactttgtcgtttttcttgatgactggaactatattagaaatccactcagcatatcgacatggacgaataaacccagcatcatacaagcgtgcaacttcagccttaacagccacaagcatatcggctttacatctccttggtggctgctgatatggcctaaccccgagctttataggtagccgatgttcaacaatcgatcggctgagtcttggcatctcatgatattcccaagcaaagaaatctctgtattctttcaaaagttctattaacttggttctaaatccggaagataaattcttactgataaatgttggccttggtcgatctcctggacctatgtcaatttcctccaaatcatcagccgacataaaaccttgcccttgtttgtcatcgagatcatctactgcatccttggtgtagacatttgaaccctccacgacgcctcaaaataacaatttgggctctgcatcttcaatcggctgtatatcagaatcggacacttttagaaaatctccatcccaaacttatccag

SEQ ID NO: 39221 - DNA, 28482 bp, Oryza sativa
  unsure (1)..(28482): unsure at all n locations
nnnnnnnnnnnnnnnnnnnnnnnnnnnnnnnnnnnnnaaacacttgcattcaatttgtagtttagctcttagctggctacttctatttattctaagaaaaacaactgaattgtacccattttgattaatctgtgaccttttcatgtccttcaaatttcatcatcttctgcatttgttgatctaatacggcccagccacctgttttttttttcattcatagtctgcatgatcatcgcgcttcaccctgagtgggatcgatcctgatctgccaggtaggcctctgttctcgtcgtcatcatggtgctttgcccgtgagcatcgcttgtcgttctttgttgagtcatcgtcaagctgttaacaccaaaatttgatacggttgtttagaggattcagttaaggaaagaagtcaatcaaccgatcaggacttatatcttttcttttatctttaggaaacttgtatcttgtccgattaggactaatatcaacctaagggtataaatatgtacacccgtagactttgtaatctatttccacatatcaatacattactttcggtacattgccaacttttattccggcgagttcttagttttgagcaggtttgcatttgttaagttcgatctcccacgaggaagtaagtttcgtcaacttcccgcgaggaaataatctcctcttcctatactatttaactttggctacaactttctcgtttaagtccaatattttattcaggttgacgcaagcattgtctatctgatatattgattatatctttaactgcattgctatttagagtggtatcggcttagttaggactttctcacttaggtccgatattttgactaagttgatgtttttctaatcgtattgccgttttagatagatcgatgtatcaatcatgtttgtatatatatctattggctaaatatttttttcttgttatcgtcaatcttaaaatatcttagttaggctcgatctgttagattgctactaataagtctatttctactaagccgataggttttcatgcaacgtttcatcggactgttagccgatgagttgtctttattgtgggttagctatcagatataatgattacttagttgatatacactttaatttatttactgttggcggatggcatgaggcccttcgaccaaatctgccgaaacccgtggcaaagactatggagcaagaacggcgcgagacgaggggtcgtgcgagtaccttgtcgagccagaggcgtcccaggcgaagggtgcaaggcgaagagtatctgccgaaggaagacgatttcgccatggcaagttcgcccccgcgagggccgaagaagcctttccggcccatcaagcctaggggctatagggccggcggtcgcccgacggcccatcaggggcccatgaacctccataacattatgtaccccctgtaaatgtccctttcgtaagggtaaccatgtaaattcccctgtataacctaaaccctagtagtaagaacctataatggggctataaatagtcccctagggccatgtaataaggggatcccgaagtaaaaaattctaaaattaatacacttcgtttctttccaaccactgttgagtaaccacgtctttcgacgtatgcggttgtcgtttcgacaacatttacattggatcttcagccaatggatgttttaaccatcctatttacatcacattatattattagttttgaccgattggttcaaattatattatctcatggcatcttctgagttacatcggcttatactcaaacttgtataatcatagttaaatctatatttatcaacttaaatcttatattttttcggtttgatcttatctatcaatattgcttttgacaaagaatgtgtttacactcaaatttggcacctagaggcgaaataggaaaaattgccaagatttgggaatctaccggtttcctccagaagggccgatctaaccgccatgtatggaccactcagactgtggccagagggccggtctgaccagcagagtccaagtcagactccgtttttgtcgggtctcgagattccttgctcagggggctatgttttgggttctttttttgttttctacccctagttagacatggaggagggcctgtagagggcaagaccaacccctatttaatggataaggtcggttcaaacaatgtatcacacaacgatcaatcaatcgaatcgctttttcaatatcgctttctgcttttcacttagctctactttaattcgtccatctttattgatttacgccgtaaatcattcgccttcattgcgagagtgcgaaatcctttgtaggtttgtcccgtaaaccttctgtttgcccacgagacatgtagttattcaccgttttatctaaatcggctccgctatccggtttaatctatcaaaacccaacttgatctagattttgctggtttggggtggttggcgactctacaaatcaccgcaagacgtttaggtgttgcgatcatgcttatctacttgaccaaaaaagttgccaacagaaagcagacgggaagaagaaggacaagcgcgcgagaagatagaagaggcgagccgagaaaacaaggagaatttctttaatttgtacggggaaatctctactattataaaaattgaagatattttcgcggtccgtcatccgtttttgagtcggttataaaaattgaagatgtttctgctgttcgtcattcgtatttgagtcggttttaaatttatgttttggttttaacctatatctctgtctctgctatttaaaaaataaagatgtttttgtcgatatttttatatgtcatctgtgtatgagtcggtttttaagtttacttgctttttttgaaaataaatatccgtatttaagtcggtttttaagatcattcacatgcattttttttatagtaatagtattataagtataaacacagtagttaagacggagccaaacacagcagagccgtcccgatctaatcgaccgagcccaaaactaaccctaaattccccagctccccaccacgccgccgccgccgcctccatgggccgcaaagatacttcctcgtcgtcctccgccgccggcggcaagaaggacaagccgatgtcggtctccgccattctggcctccatggacgcgccggcgtccaaggccaagccatccaaggcggcgtccaagcccaagccctccaaggcgcccgcgtcgtcttacatgggcgacatcgacctgcccccctccgatgaggaggaggacgacgccgacctcgttgccatggccacgaagcccaaggcggcccgcgccaccgtcgacctcaacgccatcgcgccctcgcagaaggacgcgaagaagaaggacaagcgcgaggcgatggcggccgcgcaagccgaggcggccaagcaggaggcgctccgcgacgaccgcgacgcattctctgtcgttattggcgcgcgcgtcgctggatccgccggggcctccgagggtgactccgccgccgccgatgacaacatcaaggatattgtgctcgagaacttctctgtttctgcccgcgggaaggagctactcaagaacgcctcgctccggatctcgcacggccggcgctatggcctcgtcgggcccaacggcatgggcaagtccacccttctgaagctgctgtcatggcggcaggtcccggtgccccggagcattgatgtcctgcttgtggagcaggaaattattggagacaatcgttcagcgctcgaggctgttgttgctgctgatgaagagctcgcagcgcttcgtgccgagcaggcaaagctcgaggcctctaacgatgctgatgacaatgagcggcttgctgaggtttatgagaagctcaacctccgggattctgatgctgcccgggctcgtgcatccaagatccttgctgggctggggtttgatcaggctatgcaggccaggtccactaaatcgttcagtggtggctggaggatgcgcatctcgcttgctcgtgcgctgttcatgcagccaacattgttgctgcttgatgaaccgactaatcatcttgacctccgagctgttctttggttggagcaatacttgtgctcacagtggaagaaaacactgattgttgtgtcccatgatcgcgacttcctgaacacagtttgcaatgagatcattcatttgcatgataagaatctgcatgtttatcgtggaaattttgacgactttgagagtgggtatgaacagaagaggaaggagatgaataggaagtttgaggtgtttgaaaagcagatgaaggcagcaaagaagactgggagcaaggcagcgcaagacaaggtcaaaggtcaggcactatcaaaggctaataaggaggctgccaagagcaaggggaagggaaagaatgtagcaaatgatgacgacgacatgaagccagctgatcttccacagaaatggcttgactacaaggttgagttccacttcccagagccaactttgctcacaccaccgctccttcagctcattgaggtgggcttcagctaccctaataggccagatttcaagctgtctggtgttgatgttggcattgacatgggaacacgtgttgcaattgttggtcccaatggggcaggaaaatctacacttcttaatttacttgctggtgatcttaccccaaccaaaggagaggtaaggaggagtcagaagctgaggattgggcgatactcacagcattttgttgacttactgacaatggaggaaaatgcagttcagtatttgctcaggctccatcctgatcaggagggaatgagcaaagcagaggctgtacgtgcgaagctcggaaaatttggtttaccagggcacaaccatctcactccaatagttaaattatctggtggacagaaggcccgtgttgtgttcacttcaatatcaatgtcacatccccacattctcctgctggatgagccaacaaatcacctagacatgcaaagtatcgatgcattggcagatgcactggatgaattcactggtggtgtggtcttggttagccatgactcgagattgatctctagagtgtgtgacgatgagcagaggagtgagatatgggttgtagaagatggcactgtgaacaaatttgatggaacatttgaggactacaaggatgaacttttggaagaaatcaaaaaggaagttgaagagtaatgtgtttttatagttgcaggatactgcttattctttatagactgggctggtaaacttaatgtactagtacttattttctttggtttgcagagtatttgtatggttgagtccgaaacacctattcgagctgttcttgctttttgcatgatctaagaggttccaggatgagtctgataaatatgttttctatgattttgctgccaattactctgtactaagacttccatgatatacatccataataattcagtatgatttcatgttattggctcatataattaatattatattatgctcagcggtactttatgttggtcagattaatccaaattattatcaaattcttggtcaattagttcaatatatggttgaatgcctatatgcttatggatggaatgctcactgaacaatcatatggaactgcagcactgaattgaaagcacactaaatgtgcgtactgaaaccatggtaattgaaggacaatgttacactgctgattattgaaactctacatcctgcagcttgatcctgaaggactttatctggttattatcaccgtatgccttactgaaaacatgctatatctaactactgaaatgttcagctattgattgtgtcacaagttgtactgctaattaactaagctacatgctatgaatggcgatttaatgccataccgatacggattgctctggatggtttgttacaagacctatgatttctgcttaatggttcaactagaagatctgcacgcctgttggcgtgccacctaatttagcatgtaatatggctcatctgtaatatatatagaaaatttgcctacctctcattttatattatttgtaactctagcaaaatttcacatcaaacaaggagatgtggcaaattacactgatatgcttattaactacattataatcgttttcaaaagcaatattaactttgattgacagttatacatggcatttaaaaggtgaagatagaagaccacgatctaaaaataataatttgaaatgtgagaatgaccagtaatattaaacatgcagagtaatatattattacatgagtaagtttaactctgaaaaaaattctttcaaatggacatgttaatggaatttaattttatgtttgtcttagaattatgagaaaaaccaaagtaagattgtaattaatgatgatcaataatttggcaaatagctagactctattagaaaatttaaagttatgtttcctcaaaattgttgtgatttcattaaccaaaaagtcgtacatatagtatcaatgataaagtgcatatttgaagaaatggttcttagtttatatttgaacaaattctcatccaatctctttcactttatatttgatatttagtttttcccgattattatttattttatataaatacaggatatcaatattttatgttttgaagattttttttacaaaattatttatacttttctctaccttcctttttcctacttttgtttggtcctgtttgtgttattactaattaattagcccgagaaggtaaagtgcaacgtgcaaatgctgtagcaacaacgctagatgaccaggcctagtgcagtcatgcatgactgggctgtacagcccatgacaggcgggatggtaattttgccaatgggttcgggtatccacggatacccgatccaatgggcacgggtgtgggtgtgattttttacctgtgggcacgcctacccgagacccgcagacatcgtgagcaacagccgagtttcattttttatctgtgggtaacccatgcccgacccaattcatatgtattagctaatttcgacttatctcttaattcttatacccctttctcttgattcatttgtgatactaactactaataataagttgtgacgtaattcaaattattgttgatagctgataatttgataaattgttgattttatttctctttgttaaattatatatttttcgagtattattcatgtgagatccattgggtacccgctgggcatacccgtgcccgcatgggtacgggtacagagttttgcctgctaaccctagtgggtagggtttgggcgggcgacgacgggcatggggtcgggcatggttttgctctacccgtgcccaacccgacccgttgccatccattgacagccagtgaatgaaccaatggcttttcttttctttttctttttctttttcacggtccagtgtccggactaatcgagagggctggacgaatgaaacatgccacgtggaccaatgaaacgctagaagaatggctagctttagattaatagaagagatgagacaattgcacaatcgacgctctagctgaatctcacgggacacgtggctggttttcaaaggagcaaaccctaaaatcttagggagccacgtggcccaatcatatgcttgattttttaccttgaattcggtatattagataagatttgattcttttaatgggacatgctgctatgtggtctttcaggcttaaatctgaactactgatgccacttgaactgctgctaatttcctgaggttaatttatcaaggtcacaaactaattctaactaggtcataaactaatgataactattcctgtataaggttcatcctgtagggtcttcattagaatcttacatcatatatactagcttatgttgtcacacatttgcgcgactcttgttacgtgatacgtgagtgtcaatcaatctgttgtttttcttgttgctagtaaaatataatcaatctgttgtttttcttgttgctagtaaaatattgggtcaggatgagtcatagtattatgttggtaaagtagatggcttaatatttattgtaaattttaataggtatgagacatatgtatcaccctttattcttcacttattttctattagtgcgtacccttttgtgactcattgtcatatattttgtaggtttttaaggattagtttaatttctatttttaaatttgtgtgaaaaatcattaagcctatattcaggtgaccatgactcattattggaaggaatatgcatgtctcagtagcaattttttttctcaaatacattaacaacaaattgctagaaacaaaaataatcacatgaacatacattttgaatatgccctgaatagctcaatcttgactaatgaatatttagttaagggaatgagggtgccttttttcttccttcatttctttctttccacttctagtagcttcatctcctgaagtctcttgaatgtgttcttttgccatcatttaatccaatggtctaagattcattcactcttttttgtcttgtagtaagttcaatggctaatatttaccaaataatgtggctcattctcagtccactttggatgtcacttttcactagttaagatataaatagctgtgatgggctatgagataatgagatgtgagacggcgaatggaatatggagggtttgcatagggattggggataagatctgggcccttggattgtgaacctatgattcaagatttggaagattagagatccaatttattgtgaaatttatatcctctatgttcccaaatataagcaaattttaggattcaaattttatacacaaattgtttttataggactatgattccaatacatgaaaataaacattttcaaccaaatattccgtttgtccaaaaaaaaagaagtatgattggatgtgacgtaatctagtcctcgagccccgacatgatggtcagggtgggagacggggattgatagagaaaataacgtggagctgagacgggtggtggaggggggaggtgtgaagttgtttaaataaaaatgaaggggtcgagtgggctgaagttgtttgtagcgcatctgtcatctgtctcgctcacaatacgggatgtgggtgttgggtggtgccgttcgcttgtcaccaaatcatgccatcatgatcagtgagaaggtagctttaaaatagggagtttataggtagttttgtctgaaatgatattatagtgataaacacaccatttgagaataatattttgataaaaacctaatatatcaaaggctaagggtgaatgcgtttggtagaggggagattttaggagggatctcctcttgacctggataatggtgagttggaaaggatttcatcctctaccctatctaaataaatcttagcactatatttttatttaaaaatacatagtctaaactcaatattatttctaccttctaccaaaaatacaagattaagattgaaaaataaattttcgtaacaatcatacgatcaatttcctcataaaaaactcccaatcctcgtctcaatttaccaaacaagcccatgcatcaaagcctccaaggcaggcgccaaccccagcccgggaacatcttctccggttctccctcaccgctcactggctctcgtctctcgccgccgccgccgccgccgccgccgccgtcttgccctcaagcatccgggttcgccgatcgccccacttctcccttcctccctccgccagcgccacctccgcgctactgcctcctccctcctttctcgcgcccgcgcctcctgaaactgggatcccccaatggcaatggattcaagtattcaactctctctctctctctctctctctctctctctctctctctctctctctctccgtgaacattggggccgccatttgccaaagatataagcccgagaggttcagcttctcgtagaagctaaggctgtgatgcgactgggcggatggatgctccggccactgaaccgcggcctcctcctccccaccttgtcatgcccagttgccccacaccgccgtgggttcgcagcctatgcagcagcgctacagtggctggaggacgagctcacctcgctcgcgatcctcccctccgtccccggggtggactccttcgcgtgcgccaggcagttgcagggctgcatcgctcgtggcgacgcccgcggcggccgcgccgtgcacggccatgtagtgcgccgcggaggggtggggcgcctggacctcttctgcgccaacgtcctgctcaatatgtacgggaagctcgggccccttgccagcgcgcgcaggctgttcgaccgaatgcctgagcggaacatggtgtccttcgtcacgctcgtccaggcccacgctcagcgcggtgattttgaggctgccgcggctctgttcaggaggctgcggtgggaggggcacgaggtgaaccagttcgtgctcaccaccatgttgaagctagctattgccatggatgcggcagggcttgccgggggtgtgcactcatgtgcgtggaagctgggccatgatcacaacgcctttgttggttcagggctgattgatgcctactccttatgcagtcttgtcagtgatgcggaacatgtgtttaatgggattgtgcgtaaggatgctgttgtctggactgcgatggtttcttgctattctgaaaatgattgcccagagaatgcctttcgggtcttttccaagatgagggtgtcgggttgtaagcctaacccttttgcactaaccagtgtgctcaaagctgcagtttgcttgccatcagttgtgctaggcaagggcatccatggttgcgccataaaaacccttaatgacacggagcctcatgtcggtggtgctttgcttgatatgtatgccaaatgtggggatattaaggatgcacgtttggcttttgagatgattccctatgatgatgtgatacttctgagttttatgatatcccggtatgcacagagcaatcagaatgaacaagcctttgaactgttcctccgattgatgcgttcttctgtgctgcccaatgaatatagcctttctagtgttctgcaagcatgtactaacatggttcagttggatttcggaaagcaaattcataaccatgctataaaaataggccatgagtctgatctttttgttggaaatgcactaatggatttctatgccaagtgcaacgacatggatagctcacttaagatcttctcatcattgcgagatgccaatgaggtgagctggaacacaattgttgttggcttcagtcagtctggtttgggagaagaagcattgagtgtattctgtgagatgcaagctgctcagatgccttgcactcaagttacatactcgagtgtgctccgggcttgtgcaagcacagcatcaataagacatgctggtcagattcattgttcaattgagaagtccacatttaataatgacaccgtaattggcaattcacttattgatacatatgctaagtgcggatacattagggatgctctcaaggtatttcaacatttaatggaacgcgatataatttcatggaatgcaataatctcaggatatgcgcttcatggacaagcggcagatgctctagaactttttgacaggatgaataaaagcaacgtggaatccaatgatatcacttttgttgctctgctatccgtctgcagtagcacaggattagtaaatcatggattatctctgttcgattctatgaggattgatcatggcatcaaaccaagtatggagcattatacatgcattgttaggcttctaggacgagctggccgtctgaatgatgctctacaattcattggagatattccttcggcaccatctgctatggtttggcgtgcattgcttagctcttgtataatccataagaatgtggctctgggaagattttctgcagaaaaaatacttgagattgaaccacaagatgagacaacctatgtcttactatcaaatatgtatgctgcagctggaagtttggatcaagttgcccttttgaggaaatcaatgaggaatattggtgtaaggaaggtacctggtcttagttgggttgagatcaagggtgaaattcatgccttttcagtgggatcagtggaccatccagatatgcgggtgataaatgcaatgctggaatggctcaatcttaaaactagtagggaaggttatattcctgacattaatgtagtgttgcacgacgtagacaaggaacaaaagactcgaatgctgtgggtgcatagtgagaggctggctttagcatatggccttgtgatgacacctcctgggcatccaataaggatattgaagaatttgcgttcctgtttggattgtcatactgcatttacggtgatatctaaaatagttaaacgagaaatcatcgtgagggatataaatcgcttccatcattttgaggatggaaagtgctcatgcggtgactattggtgatcttctgttgttccttgatgtgttaaaggaatccatacaagttatatgtgatataatgtgtttggcaaatggcaatcttctaggaaaccaagttatcatgcatgctctattgttttgggtaacatggttttgaacttgaactcgtgcaatttcatgctattttcaaggcactggagaagagatatcatatcagactgggctaccattccgaaaaaaaaaacccattcatttttaatgtttagtgttacctaagcacattttcgttattgacttgaatactagtgaatgtcatctcattagcaatagaaaaccttatggctgaactgaattggctgatatttttcgttctctatgatttcatcaagttggtagatagccttttgtttaagtatgttctagtgactgcattggaaaattgacacttgcaccggccttcgtattgatagtaattagcatagttcatgctatgacacaaacattaggccatgcaagtggttttcatgaaagagctttccattttctaacgtttatcttacatagttttgttagaattgtaggggggttttagttataataaaattggcagcgaacctacaattaaagcatcggttgattttcttgagttatagttaaagcagcaaacctataattagttatatactttgagttgtttaaataaatatcgtttgattttcttgtgccattgccttgacatcattgtgccgcattatcagttcagtcacacttcacactgactaggtgatagcgactcttctagcactagctaatggggatattaagtgtaatgcaccctgactctgcttgctgtgggagaccaggagttgttttatttttctgatcttctcaagattgtggcaaagcttgctaaaggagaaggaaaaataatttcttttgcctatcttatatgatataaactgcttgcccttgttaaaataaactctgttctgcaggtgatagttgggcaaggcaaccataagggtaaaatgcagcctttggaagtgaaacgagcttgcctactggcttattcttaggctatataaccttctactacctccttatggaagctgagggattgtttgtgccggatcatcctgtaattgctcatcttgtagagatgaagagtattgtagaaaaggtttgttttcttttctacaacaaccttgtttctttaatttgtatattttctggaaggagttaatgcagtaccaatttcaattaatactatgattttttatcattgagttgattgcaaatatttgaataatatctgatattaaacgtatcattaaacaggccaatatatcttccaagacaacaaggagacattaatgactgttgtacgcctggtagcagtaccatggatgtgctagacaagataatttttttggacaaggacaatttactagtacgggataagataaaaataggatctgttcttctttactttactataaagtacaaacatgataattgaagtattctggtaactcatcatgataatttttattcagcgtgcggaagttgctgaattgacaaagaatgaccattctaataaggcttagaatgaaattgacaaaagaaaggacaaggttgaactgaaacaacacttttgatatattttagcattttgtttcgaaaataatgcagatgcacaaaagctgaacaaatattaaaattctaggatgagcatatcagctcacaaagccttgaaatgttggaagtatgagcaacccttgaagaaaaagggctctataatttcacgcagttgaagcctgagaaggtttcaaacaccaggacaactcctcataggtgagtcattagttgtgccatctctttctcttttaaacgacacatttaatatatttggatggttttagcttttaaatgcctttttgttaataattatgagatacctgcaaatgttggatgattttgatgatgatgttctcagaaatagacaagtaaccaaacctagcaaggtcctggtagcagtggtaaaatccaataaaaataaggtctgtatacatttttttaatttttttccacctttctttaataattttatatttggttggcttctttcttagtttctacaatttcttaaatcttgtgataacatgtaagcttgaaatgatttaaagtgtgccaatctaaccgaagccttctattgagatgatggaaatacagagctacctccaaaactgtagaaacaaaagtacttatgccatgcatttttttagagttactgtagaatattgatgtataggtagtttactgcaatagaggttcaaatatcatacttctatcaagttacccaatttgacaaacatttttttttaaatgtgacagtagattttggtccctggccagtggtctcagatgagaaaactgctatttcatccgtcacaaaatgtaagcattttttaggtgggcacgggtattaaagaagtacttcctccgtttcatattataagactttctagcattaccacattcatatatatgtctagattcattaacatatatatgaatgtgggtaatgctagaaagtcttataatttgaaacggagggagtaggtgagaatgattcgaggaatattgtgattgattgagaagagaaagtagatgaagaaatcaaatgaagaaaaatggttgtgattggttgagagtagggtaggtggaaaaatagctttcattttgggataaggtattgtgctagaaatagctacatttcgggacagaggtaacaaaataaaatctttgacatcagtttgttcagaatgatctgagaagaaaactgcgagaaaacgttgcttgagtttgcaattaatgttgtatttctgaggcagtgagatatctaggtatacattgccaaagtgtagtaggacttcacaaattgacagaagagaactgaaattttgtataagacctggtcataattcgtgtccattcttgtgaatatttgaagatatctcatccttgaggaagcgtaataggaatggactctgctgcatttggtgccttttgtccttgaaaacttggtttagctatgtactagctagatctaataattagctttctcaaatatgcagtaccaaaatatattggatattttcttcttgtattatttcaagtcattcctctaatggttgtctcgctgctatgctgttcttgcagagctgatgtgctaatctgtcatattaactcaataacatctgcgtgtgcataaattgtgttcaatattctttagaacaaaaaaaaatgtagttattcttgcctggttagagatagtctgaaatatgtaattgggttacagttttttaaattgctggtgaagtggtgataccgtgatatttcttcatcagtggtagtgtctggttatcactgccatgctcttgcatacaagataaactcttctttggtgtatgttatttgtggttgtgacagttgcagctgtcagatactcttttctgctctttattatctgtttatgtatctccagttcgggtatagtctttttctttggaataaaaaatgtaggcacccttttctggttagaggtatgtctgaatatattaagtatcttatagctttttggcaaaagttgcagttttgaattttatggtggtgttaagaaaagtatcaggtctttgtgtctgattcacaccaggccactactattctcttgcataggagtacctatttagcacatgcactttggagttctggatgtcaaatgcctacgttaattgtggttacgacttatgacagttgtagacttgcaccagctgcttacctctttcttttttttaacctgctatgttttcaagtttgtccctggtgatgatgagcttccaaagcgagataatattggtgaaagacagtgaaaatacgaactacatgttcttgccagagtagaagctagtacacttgaagaagatgacttgcccaatgaagatgcccatactgaagggaagcttaacattttcaatccaaaacaacaggaacagaaacatttccatactgaagtgaagaagatgacaatgatgatgacattggaccatcagagtacaaggacattaaaaagcatgactgaaaaactcgagcaaagaacagaaatactcaccgtaagttccattgataaaaacttatgaagattgattgtttccgatcaaggttcttttggcaaggggatggacacaaaaggaaatatagactagcaaggtgggacatcatatgtcgtcctaaagaccaaggggggttaggaattcaagatcttgaaattaagaacaaggctctccttagcaagtggttgcataaactactcactacagatggtgtgtggcaacaaatgctaaggaacaaatatttggggtcacagcctttgtctcaagctcagtggaaagcaagagactcacacttttgggctagtctaatgaaggccaagcttaattttcttaggtttggctccttcaacatcaaagatggctctcaagttcggttttgggaagataaatggttggggaatgcctgtttaagggaacaatatccttgtctctataacgttgttaggcataaacatacaactatttcagaaattttccaaaccagtcctctaagcttttcttggcgcagggaccttactggctttaagttagtggcatggaatcaccttctctcacgcatcgctaatattatattatctcacgaccaagatgagtttaaatggaatctaaccactgatggcagattctcggttaaatatctttatcttgcgttggtgcagaccgatgtcccaatataaacaaaagaatctggaaaatcaaagccccctaaagattaagatcttcttatggtacttacgtcgtggagtagtcttaacaaaagataatcttattaaaaggaattagagaggaaacaagtcttgttctttctgccacaaagatgaaactattaatcatttgttctttgattgtcgttttgcctgcacagtttggtctataattcaattttgcttcgaatattagtttacctaatagtacaactcatatgtttgggcattggataagaagacaaccacgcaatttgagatctttggtcttattaggggcaactaccactatttggtctatttggctttgcagaaattatgtggtttttgaaagaaaaaacatatcttctcctttgcaggttatctttttgattacacattggctccgcttatgggctatccttcagaaggtcaatttgcggggtactatcattgcggcttgttaacaattggagctagtggccatggagttttctaccccggtgcatgggtggtgttctagactacggttagagggctcctgaagttctttttgtccctgctatttggatgatgagtttatcttttgtttctttcttgttggctgtgtgcactctttgggtgcagaagccggaggtgctcgcagaataattatatcacttgatagagttttactaagattaataaagcttccattatctaaaaaaaatacttattcgttgactgtattacagaaaccccattactcaaccgctggaggaagaagctgaaggaaattggcaagaggaagatctcataccaggttaatcctccactagtgtacggtacaacctttcacaatttttattttttttatatgtgtggctaattaaatctaaactcctccagatagagaagaaaggttaacctgcacaagaacaaaagcttaagaatccatggaagatagggtaagtaataacataatatatgagacagccgagctatgtgagcaagtcattcagatgcactcgcttgtgtgtatgatcgttcaagctaagcatcaaaccaagcttgtttagcggggaggtaagtgcgtggcgtcaaccgtggggtgaatgtccggcatcaatccaaatgttagccatagtgttaggtttaaaggttgatggatcctgcatgatgaattgattatggtctaacatgatatttctttgatggtacgtagttttcttgttaagaattttttgagagatcgcacacatgatatttggaggttcaacgtcatgcattaaaaaattgtgttatgtgctatggatgcttagttctcactggtggagaaacctcaattgtcccagtttacaaccccctatatcccgggttgcaaaccgggacccccaaattctagactaaagatggtatctttagttccggatcaaatttgatcaagtttatagacaaattagttttattaaatttataattgaatattttttcataatatatttgttttggattgaaaatgttaatatttttttctacaaacttggtagcagtttgactttgaccaaaggcaaaacgacttataatctaaaacggagagagtagtttatatgggtttctcattgttttgataccctaccgatggagtagtgcaagtgtagaaatttatggagttaccgaaatttggtagtggtaaggttgtgatagttgcaggagaaaattaacaaaatcgaaaagatacgtagtagataaactcaaaagataggttcgtattacacccattacacccatcaaaagataggttcttttttttttaaaaaaaaacaccttaactatggaactggacattttaaatctcaaccattcaaaccaaccaaattaccttcctaagaataaagtggcattcataattttggcatccaaatgtattagtttttctacttagatttaactactttttatatcttttctaactaagtgccatataagtacgaaaaatatactcgctctgttccaaaataaaataaatggattcctagaatcccaacaaaactttagtagggaggaaatgaccatgcacctggtggtaggtagcaagggataaagtttttttatttgcagatcgggggtatgtaagaaggtaaaaatcaatttattttgggacaaaatttttaaactttaggaactaatttattttcggcttgtttgataacttgagggaaagagattgggagtttacatgagggaattgatgatgagattaagatgggaatttgatttttaatcccaatattttgtttggtagaggtgatggaaattgatagggagtttagttggagattaggtcattaataaaaacggatggctgagatttgcttagacaaagtaaaggaggaattccctcccaattacctgcccctacccaggtattgaaaatgaggtattgaaaaggagggggttccttcctcaattccccatccccatcccaccaaaattcccatgtctcccaccaaataaaacacttaatagcctcatttttctatattcccaatccctcctaaaaactccctccaaccaaacggaccgtttgggatggagtcgaaaacggtcggaaacgatcggaatcggcagcatcttttcagaaacgatgctcgaccggccggtaattgaccatatttatcatttaaactactcagtattgacattaatacggtgtagaaagaattgtgaaaaaacaacatttaaaaatagccaaaaacggtatggtcagaaacggtacctcttatatggaaacgacgctcagtcgatcgggaatttccatgaccgttttcacccctagatagagtataatatttggatcttaaaaccatgaaaccgctgttaaaattgggttttgttgccatttgtgtgtgtgcgcgctcatactttcggaaaaaattttaaaaaataatttgttggctatattgttggtactatgaaacagaggatcgaaatcaaaggtacttgctatactatcaggttctctcatcaagtatcaattaggtttttttctatattttagtaataaaaagttaataaataacaagaagacctctcttttagaaactcaattatattatgtttcatgatttaataatcaatgatatgatattatttaaaaaaatgtaggctagttttttaaaaaaaacaaaattgtaaagtagtagtaaaatcttgagattggtctatattacacccttaaactactggttttgtttttaacaacgaaactagacattttacacccctcaaccaccaaaatcatccaaaataccctcccaaaagtaattttagttttgatagtgtttcttacaattttactaccgattcaacttttctactatatagccaagcccagccaaaagattattatacacacccatataaaatcatgagtaaattgcatattgggctcagtattattaccaaagttttactttgggcaagggtatagcctgcattttcactttggactagagtttctttcctttggttgcacgttgggccacctttctcgtcggccggccaggcactgcgtgcatcccaccattgctggcagtggcaggctccaagggcagccattattgttgctgctgcaaggtgtgaggatctcctgcacatgtgtaggaagaggagaagctccgggggacagccatcagggtggtgaggcagaggagctcgtgcacagcggctgggatggcagcaccggcgacgctcgagcttgtggtggagcaaacggagtttaactaaccttgagggcgagggacacgattccttttgcatcatccggtcaggtccattggggattggaggggattatcgcaatagatgtagaattaatcctctccaaatccccctcaatccacttgtgggagggggccttagagggaagcaacagcaggttgcattctcatgcatggaggagtaggagcaagggggcggaccgcagctagaatgatatggagatgaggagctcaagcaggaagccatgggaggctcgtgggagttttgagttccttggccatgaagcgcgagctcgagctagcccagtatctcttcttcgtatcaccaggggacacccggcttggcattctaccccttgtgcaatgctgagcagagcagtgatgtgctcaagcatcgtccctcacttcctccccaagcagtcttggatctagaccacgggcgaggagaacggcagggattggcggcggtgtgatgaattggaagcagagaatgcacggctggagagattgagacatggggtggcctaaattgcaacaaaggcgatatttcctagtataaagtgaaaacattggctcttctcttgtccaaagtgaaatcttggtaataataactggcccaagatgcaattcactctaaaatcattgtcataactaatactaggtgacacctcatgctttgctacaaaatgtatggataaatatgttaaatattatacaaatgatttatgttgaaataatatgaaaataatgtgagaaagatgatttgaaatattgtatgttgagttccataatattatattctagatgatgtgttatttttgcatgagatttaagatattctagtagaatagtaatagctagtggatgatgaagtgacatacttgcatgtaataattgctagtgagtaccaactatatatagaaggtatagatttgttgatgaacaattgaatttgcaaatgacttatttaatggaaattggtttgaaaatatttgtcgatattggtgtaagtatgtgtgattaacacaaatcggattgcgatatctataactagaaacaatttgtgtgcagatgattaaggatatttttggtcaattgcggtgatcgggactagcatggataaaatgtcatatgacaagattgaactaaagtcatgagacctcatggtcaatctcggttaacagcgggatgatgactacgctcagagaaaccgaggtttagatcagtcaaggatactaggtgataattttggacataagatgacatgagggtggacacatgcgggggaggagtctgacacagtacgggtcggtctagattttctatctatggctgcctttccggagagagggttttgaatttgggaaattgtaaaaattttggataccaagggattgagttatagtgtaaataggagttttcccttaaaagaagtgtaaataggagcttttgtgatggaattactagttatagatagacgagaggtttaactcaacacatggataagcatctagagttagagagaaaagttagggttaggattaaaaggggggcgattgcatttttgaccttgttttgaattcaaactactaatttgactctacttttttaagtttgctcatttgaccctcttttttgaaaatgaaaatcagatctgaccctcttttgtgaatgcaatgtaacggtgttaacttaggtaaaaaaagacgtttacgcccatgcttatttgaccatattttttctcaaagtttttgtttatttgacccagttttctactcattatatatgatgaatttgaactaggtatgacatatttggcttagttttcatttgtttgacttagatttgaaagcattttaagaaatttgacttagatttgatatatttttgacccatttgaattagtttgatatatttttgatagatttgacttagatttgaaaaaaaaagtgaacatacaaaaaaattgacagcatttatttatacgcatacatccgtcccgattaaatcatttctgtaatatttaacatatatttatccatacatttcgtagcaaagcatgaggtatcacctagcgacaatgattttatacgagtgtctataagcttttggctgggcttggctatagtagaaaagttgaatcggtagcgaaattgtaagaaacactatcaaaactaaaattacttttgggaggtattttggatggttttggtgattgaggggtgtgaaatgtctaatttcgttgttaaaaacaaaaccagtagtttaagggtgtaatatagaccaatctcaagattttactactactttacaattttgtttttttaagaaactagcctacatttttttaaacaatatcatatcatcgattattaaatcatgaaaaacattataattgagtttctaaaagagaggtcttcttgttatttattaaattttattactaaaatatagaaaaaacctaattgatacttgatgagacaacctgatagtatagcaagtacctttgatttcgatcctctgtttcatagtaccaaaaaattattttttaaaaaattttctgaaagtatgaatacacacacacaattggcatcaaaacccaactttaacagtggtttcatggtttttagatccaaatagtatactccatcccaaaataatgtagttcctaaagtttaaaaattttgtcccaaaataaattgatttctatcttattcctatccgctatcctattcctatcttgggccttcttttcatctgcctacgtctcaacactcaggccttcagtttcttttcttcttttttgccccatccctttttaaatgaacaaaaaatttaatgtttatattaaaacataatatagattaataatacgaatctttctaaatatttgtaaatattttgcaaaataaaaacgatttgaaaatgactagcacacgtcgctggttatttaaaaagacaggtgattcctcgcgctttgctgcgggaattactaagcaattctcaatatattttttcgacaatcaagttaggagtaaaaaggaaaaaataatgaaacatcagggcttatcagtacttattaaaaaaacaaatgatactcgtactttaatgtgaaacatattaataagtatacattaaatattataaatttattagaatattatgcaaatgatgtgagggatgattgttggatatgcttgcatgaggttaaatatgtaattattgctagtgggtgatgatgtggcatggttgtatcttgagttttagacttagtgggctataactttatataaagtatagatagggagtatttgttattatttattagttacccatacattagaacattaaatttaaaaggaattgtgcgacaattctaggttatgagtggtaatgctcgtttctagggcaagacaatctcaacgatccacttccgaaagtatgttttgctctccgttgatttttcggattttctgaagatggctctcaaaaattccgaaatcacaaaaattcaaaattcggtactgatgtgttttcagatatgttcaaaatgaaattttgtaatttctgaaattcattttagccctgtttttggagatttatatattttcaaaaatgatttttggaatttttgaaaaatggaatctttggttccaacgggtagatctaaggttgtggttataaatagtttcctccactctcaagttttggctactgctccattgaatatttcatgccattgacttacattgatttgagatccattttgagccttgttttctcactttccctctcctccgcttcaagcttggatttagtgtgtgtgaggagttgtggttttgaatatgtatgagtgcttggtattgacttcgtgaagatttattgagcacttgattcatccccaagagatctttgcatcatcttttactcttagaggttgagaacttcttgacggctaggtgtcattcttaaggcaccgatctaattgtggtttgcctggagaagtttgttaaggtcagacctcacttccgaaaggaaagagataccactagtgaaaggagtgcatttgtacaaacctcaagaggaaagggttagtgaagacccggctctttgaaagctcctcaacggatagtagaatccctgaatgattcaaacttcgggaacacatcatcttgcaagaacctcggtgaaaattccctctcttcctcctctagctttgcttacttgtgccgctactagtctggttgctgttagtgcttgctctccatacttatggcttgctagatcttgtgcatttcgcttgctttgagttttttggaatttcctaaagtcattttcgaaacttctaaaaagttcagcttccacatttaattaaaagatttaagtcacctattaacaccctctaggcctaaatgactcttttaatcgggacaattgcttatttgaccctatttcgaagcctaactagtaatttaaccctacttttttagtttgcttatttgaccctgcttttcaaaaacgaacacaccgtttttccctgtttccacagcactgtgaaggtttcattttaaaataaaagaaatataattacttttcgtaatgaccagaatacccttgaagcaatcctatccattcagattatccctatccattcatctctcatatcacatctttctctcccccggctagtggcgcagtgacgtacgaaggggagtggccgtggcggcggctcgtggagggagggagcggcggtggcggcgggagggatttgcggcactaccagatcgaggccgcccgacgcggaggatgagggccacatccatcccaacctcttgctattctagatgatgtgtcatttctgcatgagatttaagatattctagaatagtaatagctactggatgatgatgtgacatacttgcatgtaataattgctagtgggtaccaactacatagaatgtatagatttgttgatgaacaattgaatttgcaaatgacttatttattggaaattagtttgaaaatatttgtcgatgaggagcatacaaagagctgggtcttcactaaccctttcctcttgtggttgtaccttccactagtggtatctcttccctttcggaagtgagatccaaccttaacaaacttgtctagtgtcacgcccagaaatttagcccaaatttccagactattttttgtattaaatccctgtccaggaatcagccaagatacacaaaacgacaagtaataaacagttccaaacgtaaataaagcgtaaatacttacagaagaggctcttagtcctcacaccaaaaagaaagcagcagcagcggaaaaagacgatcctagcggggcttcagctccactccacaggcaaaactcaactggggtctgagccttggtcttctaacttagtcttcagctcagaagcactacacttctgaaaatggggaataatagcaaggctgagtacaaccaccgtactcagcaagccacaccaacgatgcagacgtgcaaggggattcaagaatggcttgtggctatttgtataaaggtggttgtaaaatattttattgagcaaatcagtaaaactgttgagtacttaaggtaatattaaatctccactacagtgtaccaaggggattcaacgctacaacacgttgaacaggcccaaccatcccacctgaactacagtgcattgggtcgattgattaagtgtgagactaatcacggtgaatctggtcgatcgcccataaccgtgggcacggctattcgaatagttttactctggccagaggtgcacaactatacccacaagacacaatccaccggcatgtcaccgtacccggccggacacgtcaccatgtcgagtgattgtgacaagacccttcatataaccccctctgaccaagcacaccacacctcaggtttcacccccgcccccagcaagcagcgagcagtcccatctcgtgcctaggcgaatcagaaagccgcataggccgtcgcagggcccatccgaactccatcacgctcacccttgtctggatgcgtcagccagagaaaagctatacttcaagtcaggtagttacccattcccgcttgtggcaagcgctgtatgtcttccagtgcatcccgcgaaccggtccttaattgccatgggtgcgaccagcaaaaccatgcacccatagcccatcattcaatcgcattttagttggatagttacaaccaatgaaacatggccggatgtctcgagcatgcagctcgtaatgatactaaaaggtctattactgccattatcccatcaactgagttagtggtaattaagcatggctaacatatagttctagctagatcaacataagtgacacaagctagtcgaattatcacccacggttgacaaaggacaggtatcaagtaaacatggcacaagcgagcagataggttaaccctaatcccatgtaattagcaaaacatgcatatttatttgcaaacagggaaaacatttgtaacgtaggatcaaaatgctcaaggggaatgtgtgacttgccttgcttcttcaaacaatcttccgaactcttttcctcgcgaccgcggacttccgaaacaacagattctacacgctagcatgcaaaatgaggaaaaacactaataaagaccaagcaaatagtacatcataagtaaacagacatgtagagctcaattttagatgaattttgcaagttgaatggcccaatttggagttcatatgaattagatatgaattttagaagttttgagccatttaaatgaatttctagaattaaatacgatttatgacgcaattattaattatttttccaaaggaaaaggggttgctgacgtcatcaagggggaggggcggcgccggcaagtgggccccaccggttagcgacacaagggcgccggtccaccgtggaccaggaccactgaggctgtccaccgccggtccacgggaaccgacgtcccggatcggccaaagccgatcgggcggccaggggcggtgcggctggggcacagcacggcacaaggtcggcccgaccaagcgacggcgcggcagcgcggccactggtggcgatggccggcgacggcgcgggcagcaacggcgcacgcgggcagcggcagcgcacgcgagggaggcgtgacaaaggggaccggtcggcctgggcgagcagggcagcggcaagcctgctggccgagcacacgacgcggcgccgacgtaccgggctcaaggaccaccggcggcgaacggcggcggcgcgagggggcaacgcacgcacggaagcgacggcgcacgatgctaggagggagaggaggaggaaaccggggtgctcaccgagggattcggctggtgcggagggaggcaacgacgggtggcaatggcgagtgaccggccaacgacgacgagcggtggacgggatgcgggaggacctacgaaacacaatg

SEQ ID NO: 39222 - DNA, 1971 bp, Oryza sativa
tggcgccagtggcgacgattggagcagcggtggcaggcggctggagccggcgaacggtgatggaagctcggcctcgcggtgggaaaggtgctgcgggggtggaaggggagaacggagtggatgccggggtgcggcacgacgcggtggagcttttggcggcggcgccagtggtgggagtggcggcggcggcttggcttggtgaggggagagcgggagagggtgcggggagctcgggaaagagggggaaacgagagaggagaacacggggaatattttaaaggcttggggaggtcgggattgtggctgattggggcggcaacggccgacgacgtgggttccggcaacgtgaggagatgggggcacgaaacggcaccaaaaattggggaaaagtgggggaagaggtggaagaagtggtgggaaccgattttactcggtttgggagcaagggcgcgagcgggaaggcgccgaattcgacgggacgtgggcggcaaccgtcggccatggtgagttcggcctgggaggccagaggaaagggatgacaggtggggcccatgggtcccacctgtcgggagagagagggagaggaaaacgggcaagggaggcaaaacaaacttaggggggaggacttgggccgagcccgaaagggaggaagggtaaattttattgctttttttattttaattgattaaaggatctttgtgactttaaaattatttctcgagctccgaaaattcacggaaaatttcagagagttcattaggacacaaagaatattacaaaatattctcggccaatgatttttaagggaaaattttaattctcccattatttcgcttgattaaattgctttaaattttattaaatttctagaaaatgtattatttcatgatttttaatcccgaacgaaaatcggggcgttacatctagcaaaccacaattagatcggtggcttaagaacgacgcctagctgtctagaagtcctcaacctctaagcgtaaaggatgacgcaaagatctcttggggatgaatccaagcttgaagaatggtggagagggaaagtgagaaaacaaggctcaaaatggatatcaaatcaatgtaagtcaatggcacgaaatattcaatggagcagtagccaaaacttgagggtggaggaaactatttataatcacaaccttagatctacccgttggaaccaaagattccctttttcaaaaattccaaaagttattttcaaaaatatataaatctcaaaaaacaaggctaaataaaattttggtaattacgaaaattcattttgaacatatccgaaaaacatcagtaccgaattttcaaattttttgatttcagaatttttgagagccgtcttcggaaaatccaaaaactcaacgaagagcaaagcatactttcggaagtggatcgttgagattgtcttgccctaaaaatgagcattgccactcataacctagaatcgtcgcacaattccttttaaatttaatgttctaatgtatgggtaactaataaataataaaaaatgctcactatctatacttatataaagttatagcccactaagtctaaagctcaacatgcaaccatgccacaggcccccgttgttaattttggtaattaatgacaagtactaattatggactaaccgttgctattgagatatattttaagttaggtccacgttatgtgtgcgcatggatgactatcgatggattaaaattgacggcgcaaggaaagaagacggtaaaactagtgctttaatttagaattgatcgaggtgtagggcgatcaaatttgctaatttatttttagtttcgccgtactatcaagcggggtaatgacctagcaatgagatgattttaattgccacattaggtcattatgcatttagacttgtgctcacatttcatctcacacacacaatctctttatttttcactgggttcggcctgaccagggcgg

SEQ ID NO: 39223 - DNA, 2764 bp, Oryza sativa
atgtcgaacgaggtgaaccatgtagggaaggctcccatgtttaatggcacaaactattccacttggaaaattaaaatgtctactcacctcaaagctatgagcttccatatttggagtattgtggatgtaggctttgctatcaccggcacgcccttgacggagattgatcaccgcaacctccaactcaatgcgcaagccatgaatgctttgttcaactctttgagccaagaggagtttgatagagtgagcaaccttgagagcacatatgagatttggaacaagttggcagagatccatgagggcacaagcgagtacaaggatgccaagcttcatttcctcgagatccaatatgagacattctccatgttgcctcatgagagtgtgaatgacatgtatgggaggctcaatgtcattgtgaatgatctcaaggggcttggggcaaactacaatgttcttgaggttgcccaaaagatgcttagggctctaccggagaagtatgagacccttgtcaccatgctcatcaactccgacatgtcaaggatgacactcgcaagcctcttggggaagatcaacaccaatgacatgtacaagttgaagaagaaggagatggaggaagcctcaccttctaagaagtgcattgttctccaagccgaagttgaagacaagggcaagggcaaggtgaatgaagccaatgaggacttggaggaagagattgtccttcttgctagaaggttcaatgatctcttaggaaggagaaaggagagaagaaggggctccaactccaataggagaagaaatagaagacccaacaagactctctccaacttgaggtgctttgagtgtggtgagaagggacactttgcttccaagtgcccttccaaggatgatgatgctgacaagtcatccaagaagaagagtggaggctacaagctcatgaagaagctcaagaagaaaggcaagaagattgaggccttaatcggggaataggactcaaatgaggagagctccgcctcatccgggtccgaggaagaaggtggtgatgatgcaagctccaaaaagaagaagatggccgttgttgccatcaaggaggctccatcactcttcgctccactttgtctcatggcaaagggctcctctaaggtaacatctcttagtgatagtgagagtgatgatgattgtgatgatgttttctatgatgagcttgtgagtatgtttgaggagctccatgcttatagtgagaaggagattgtcaagttcaaggccctaaagaaggatcatgcttctttggaggtcttgtatgaggagctaaagacctctcatgagagactcaccatttctcatgagaagcttaaggaagctcatgacaacctcctttccactactcaacatggagctctcattgatgttggcatatcttgtgatttgcttgatgatagtgctacttgccatattgctcatgttgcatcatctagcatttctacctcttgtgatgatcttgtggatatgcctagctctagctctagcccttgtgtttctatttgtgatgcctcacttgttgagaacaatgagcttaaggagcaagtggctaagctcaacaagaatttggagaggtgcttcaagggtaagaacactcttgacaagattttgagtgagcaacggtgcatccttaacaaggagggacttggattcattccaaagaagggtaagaaaccttctcaccgtgccagtcgttttgtcaagaacaatggtaagtattgctccaagtgtcgtgaggttgggaatttggtgagtgattgccccggtggtaagccttccaagacttgcatgtttgattctcattatatgcttaggaaggcttatgatggtagcattgttgctagatatgtgggttcgcctatactcggtggtaaaaagaatgccatttaggtgcccaaagctttggtctctaacctccaaggacccaaacaagtttgggtacctaaaagagcttgatcttcttttgtaggtgaactactgcaccggtgggagccattgggtgcttgatagtggatgcactcaacacatgaccggtgatagggctatgttctccacatttgaagtagaagggaatgaacaagagaaagtgacatttggagacaatagcaaaggaaaggtaattgggttaggtaaaattgctatctccaatgatttgtcaattgataatgtctctcttgttaaatacctaaatttcaatttgctttcggttgcttaaatttgtgatcttggcttgtcatgtgctttcttcccgcaagaagttattgtttctagccttcttgacaagtcttgtgtgttcaaaggttttagatatggaaatctttatttgattgatttcaattgtagtgaagcaaatttgaaaacttgtttagttgcaaaaacttcattgagttggctttggcataggaggctagcccatattggcatgaatcaattgagcaaactttcaaaacgtgatctagttgtgggcttgaaagatgtgaagtttgagaaagataagctttgtagtgcttgtcaagccggcaagcaagttgcatgttctcatcctactaagagtatcatgtccacatctagaccattggagctcttgcatatggatttgtttggcccaacaacctataagagcattggtggtaatagtcattgtcttgtgattgttgatgattattctcgctatacttgggtgttctttttgcatgacaagtctattgttgccgagtctattcttttt

SEQ ID NO: 39224 - DNA, 13150 bp, Oryza sativa
accaacgggcatctcgaccttgatgagagaggtaaaccggtagatttaaagctttatcgttctatgattggtagcttgctttaccttaccgcatctaggccggatatcatgtttagtgttagaatgtgtgctcagtttcaagccgctcctaaggagtgtcacttaatggccgtgaaaaggattctaagatatttaaagcattcctcaactactggcttgtggtacccaaaaggtgctaagtttaagctagttggctattccgattcggattatgccggttgcaaagtggatagaaagagcacatccggtagttgccaaatgcttggtagatcccttgtgtcatggtcatccaagaaacaaaactccgtagccctctctaccaccgatgcggaatatgtttcggcgggtagttgttgtgcccaattgctttggatgaaacaaacattgttggactatggcatatccttcaccaaaaccccactcctatgtgacaatgatagtgccataaagatagccaataacccggtccaacattctagaaccaagcatatcgacatacaccatcacttcctaagagaccatgttgccaagtgacatagtcattagccacataagaaccgaggatcaactagccgacatctttaccaagcctcttgatgaaacccgcttttgcaaattgaggaatgagttaaatgtcgtagaattctccaatgtggcttgagatagtgcaccatggttgcttcttttgcatattgtatatttgctctcatttgctcttttgttttggatttgttgccatttggttcttcattgcgaaaatggagcatgtcacattaagggggagttttgcactcttgtatgtgctctacttccctttatatgtgagcaaatcaactagtggtgctagtagtattttcaaaatgcccaagtcaacataagtcaaaacttttgcaaaatcaatgtaatttgaaaactatctcttggaaaatatttcaaaaggtttcctatatgttttccaagcctcacattgcaagaaaaatgatttttgaatgaaaatgccagtttggccctcttttgaagaaactagattcttagttttggccaaaatgagatttatccccaaaatgagattgagaaggaatttgagaaaagtttcaaaacaaagttggtagagaagaagatttgaaatgtttttggtattcaaacctttttcaaaaaccaaatcattcaaaagttatttgaaaaccaatttggcccaaaaacccctatagaccataaaaggtcacctcctagcacttaagtgagttttgttgcaaatcatcgtaatcttcaaatattatgggtgtttagcaatatttaaactcacacatttcaaaaattgctccaaaaatcaattttttattgaattttattgtgtggaggttgccggcttgtgcaagggctgtgcacagccggcatggggcctggtggtctgaccggcgctatatgcacggtctgaccggccaggtgcggcggtctgaccggccacatagagccggtctgaccggccggcaggtgggcctaggatttttgtcctttttcttctctcttcttcccctacccgactccatctcctcccattcagccatcttcttccccaacttgaaaaaactcctcctctctcctctcccaaaccctagccacctccctccatcaaatccattcggtttgaccgcggatttctctccggttacaccgtaagtgattctcctccgcctcctctctctattccatggattagtttgtgtttttgttgagtttttgatctatggcatggaaccttaggtgaagcacgaggtgttcttcgatttgcaccaatagagggtagtttcttggtgtgattcaactcctccaacgggtaaatctctctccctcttgtacattgctctcaaatcggtctatttcaatatctagggtttagggtagtttccccatttattccaatcttgatgaaataggccataccctttgatgttctggttccaatcttgtgcaactttgtcctagcaatttttagaatcatttgtgtggattgtggaaggatttggttgtgctcctgtcaatggcggtctgaccggccccaaagcgtcggtctgaccgacttgaggccggcggtctgaccggctgggagccgtcggtctgaccagccttggccctcggtctgaccgcccttaacaggcagcaaccccctttcctcccacttcactatgtggtttctaaaatcattgcttatatatcctttgctcctatttttcagtgatgcctcccctcactcgtcatggtcatcgtgcgcccactccggatcccgtgagtaagcctgaggaatcaagtggagatgattacgctcaaagtgatgaagaggttgaggcaaatgttgagggggctagtggggaggctagtggagatgatgtcagtggaagtggagaggatgaggatgaaggaagtgatgatatgaacattgatccctccatccaatttgtggtgaacatgaggaatccattgcagtataccatcttgaggcatcatgatcagtttttgaggcctcgggacaccccggatccccgttttcacaccgctttccagaagtctgtgtatgagcaagtttatgcagggaaagcatttgcagagcataagtggatttcttggagagacatcaaagagactccagagtttgaaagcttgcaggatctcttcaagactgttggcattgaccggattgtgaccctcaagcaagactacaatgaagatttgatccggcagttttatgctatagtgtgggtggctggagactatagtgagatgaagtggatgtccgacaccctccagtgttctatctctaggaggcaattacggtggctcctcaatattcgcttggactttggagatggcttgcatgaggagcacactcacaattcgctctccatagactatctctgtcagttttatgaagatggagcgcggtacacacatgggaaggttgacggcttgaggactattcctagtgtggttaacaagattgtgagagctaccatcctccctcgccttggcaacaatgatgacattagaggggtggcttggcacgtcatcgatgcaatcatccagggtcgtcaattcgacattgtgtctctcatgatgcaagagattgccatctctaaggggattttcactcagggaatctactatgccccttacatcatgaggttgattcaagacaagcttggggctgctgggcaaaatttgaagaagcacaagcagtacaagccccgccttcagcttggagctccccgtgcacctaggacggtgccctcttctcatcctggagctagctcaagctcagcacctccttctcctcctgggtatgatccaaatgctttcttccatccatagtatgcttattttggaacgcaacctaatgaatacttcaacccggtacttggggctattaataccctaagtgaaagcattcaacgcttgtctatcgggcatgaagcattgcatgaggatgttcgtggcttgcgcaccaatgttggagacttgaatgcttccgtgggaagattgcatactcgagtgggtacattggattctcgagtccaaatgttggagagctctcaagcttttgtatatcatcgtcgtcgtgatgctcctcatccttcatcttcggctcgtcctccttctcctccgcaagaatgaagacctttttggtacttgatgccaaaagggggagaaaaagtccttaggtgtgctctatgtcttgtgggttgggattagtggtagtgaggttagtcatctcatatctaataggtttaggtgttttgggctatattatgtatgggtatgggctattactatatattgtgtgttctttatcgttttgttgaactctctatgtcatttggacccttcatggtcttgtaatagcctatgttcatttgtgagcccttttaggatgatttgtgacttatgtgagttgaatggttaagtgatgtgaacttgtgtgatgatagatggtgtatgtgatattgatatatatgtgaccatcttatgctcatggatgaatatttcttgaagttcacatttgagatattgctcttgtgtttgtgatatgttgaaatgtgaaattgaaatgtgcattgactccatatttgctagttgtaattgttatgcacatgtttaaggggagcttttgatttcctttgcaatatatgtccatatgttccatgtttgtttatatatatttgtggtgtttgtcatcaattaccaaaaagggggagattgaagcatctaggcccccattgttaattttggtaattaattgcaagcgctaattgtggactaaccgttgctattgagatatattttaagttaggcccacgtcatgtgtgcgcatggatgactatcgatggattaaaatttacggcgcaaagcaaagggaaagaagacggtaaaactagtgctttaatttagaattgatcgaggtgtagggcgatcaaatttgctagtttatttttagttttgtcgtactatcaagggggtaatgacctagcaataagatgattttaattgccacattaggtcattatgcatttagacttgtgctcacatttcatctctcacacacaatctctttatttttcactgggttcggcctgaccagggcggtcagaccggccacacagtggcggtctgaccggcgtgccttcgctggtctgaccggcgtgccctggctggtctgaccggcgccacaacggcggtctgaccggcccataaggccggtgtgccgccggtcagaccggccccctggaggccgggatggtgttgcttggggtggccgatacagagccgacggagccgtgttcggtcagaccgagccgatggcagtctgaccgagctgaggctggtctgaccggccactcaacctcggtctgaccggccaggccgatggggccctctgacagggctacaacggctagttttctagccgttgcagagtagcacggtctgacagaccggtcacatacctctggtcagaccggcagagcacagagttgggggatttcgcccccaacggctagttttggttggtgggagtataaatactccccctttagcagcaaggggactctcttggcacccaattcaattgcatacaccccttgcacctctctcacacccacttgagctttgtgttcatccatctagtgtgttagagggttaattagccaagagtcaagtgcattgcttccatttgtagagctagtgtggcacttgatttatcatctccacgccgggtcattgcttcttactcttggaggttgccgcctcctagacggcttgtggaggagttgcccggtgacctctctgagaagattgtggaggagacccagcgccggtttgtgagtggtttggagttcaccaccttcggagtgaaggaagaactacccaagtgatcaaggcttgggtagtcctctccgtgggccggctcccgccttgcccaccccttgacaaagggggcgtgcggtggcttcgtggttgagcggtggagttggcctcacctcaacggggagtaggaaaccggcgagtttccgaacctcggtgaaaaatctcttgtctccttgtctcatttgattgtcgcatttacatttgtgcaatttatatttctagagacttacttgagatcatatcaccctaggattgctaaacattgacataggagtgtgatttattttcctagagatataattgagccactatcaccctaggtttgcaaaacataacttagttgcttagttagagttgaccctcaccaagcctagcaacataggttagttttaattaggtgtcatttgtttttaaatcgcctattcacccccccctctagtcgacatctcgatcctacaaccagtagcaataattacttatttaacctcatgcaagcatatccaacaatcatccctcacattatttgcataatattttaataaaattataatatttaatgtatacttattaatatgtttcacattaaagtacgggtatcatttatttttttcgtaatactaagtactgataaagcttgatgtttcattattttttcctttttactcctaacttgattgtcggaaaaaatatattgagaattgcttagtaattcttgtagcaaagcgcgaggaatcacctatatttttaaatagccagcgacgtgtgctagtcatttcaaatcgttttttttcaaaatatttacaaatatttagaaggattcatgttattaagctatattatgttttaatataaacattaaatttttacttgactattttagtgtaactagtggttacaaaaattaaaacaataaagtcaaagttaatagtactagttatttgttcatttaaaaagggatgggggtaaaaaagaagagaaactgaaggcctgaggacgtggccagatgaaaagaaggccaaagatagaatgaaaagaaggccaaagataggaatatgatagcggcgaggtcatgtatactcacgagtcacggcctttggaaagcagcaagcaaagcaaagccttgttcctccttggcaccgtccccctctccatgagaatatgcagccgtctcctcgagaaaattgcatatgtaccactcataaaaacttgcttcgctataatgtcactctcaagatgggatttgcccaaacgccactcataacatgtgggcattcgctggtatgccactttcaggctttcttccatttcgaaaatattgttcatcaatttcaatttttctcggactattatgcccctgataaggcgagcgtgagaaggcgagaagagaagcggcagcgacaccggtgccgcccaccaccactgcgccaccgctacctctgctctagccgccgtgccgaggtcctccccagctgtgccgctcctcgcctcctcctggtccacgcagttgtgccgcctcctcggtgacatacaccatgagtccatgacacacaacctcacttcatgagttcatacatataacttgcaagcggtttaattttcatttaatttcgcatcaagcagagctaccgacttgtttaattttgtatgagcaagttcgttcgctttggttaacccaaacgaactttaaaaagaagttgcaaaatgtttttcgaagatacaagaagatactactagaatagaagtcgctttgtgcttgaaaattatacatagttgttgatttcagaatgtaaaatcggcacatcactaacacaaaaagtgaacaaaaatatctaccgggcaccagaggaaattacacaggaggcaaaaaaaaccactatgaattcagagaagagaagaaaaaaacgaaagctaagctcaggggtcctcggtgatgcacgagaggtgcggctgcaacggcgaggcatggctcctggtgctcatgcaccgacggtattggtggtggtgatgcttctgcgccctcatcatccttgtcttctccggcgacgcgctgcccgggctgcccaaccaatcggcgacggcggtgctgccctccgacttgctgcggacgtggtgcccgcgtcggcggcgccgccggtgctcgtcctcctcttggcgtcggggacggaggcggccgggatgaggaagtagatctcgccgcgctccagcttcgactccggcgacacgatgtgtatccggcctaccgcctcctgctgcgacaagcactgccggctcagcacgtggttggggtgcgccgccagcacctcgccggcggacacggcatggctgtacgcatcgatgcggccggctcggtgcctagggtttggctgaggataggcggcacgactggggaggagactcgccggggagaggcggcggcgcagctgttagggggcaggaccgatgaggcgcgccgcggcggctggaatagagaggcagtggcggcgatgcagtggtgtggtgggcggcgccggtgtcgctgcctcttctgttctcgacttcttgcgctcgctcgctagattgaaacgaagagaagaaagagtccgactgaatcagttgactcaggggcataatagtccaagaaaaattgaaattgatgaaaagtattttcaaaatggaaaaaaagactaaaagtggcattccagcgaatacccacgtgttaagagtggcatctggacgaatcctatctcgagagtggcgttacagcgaagccagtttttattagtggtacatattcaattttctccctctcctccctttatttttgctggagccgacaagggcagaggcgaggcaaggcaaggcaaggagggagagaggcggcctccggccatggatcccctcataaagctccttgacgacgacgtggtgcgcgaccccaaccccaacccctccctcctcattctcgaattcgtttgttttttggggggaaaggaaggaaggattcaaatggtggctctctcttgttgtggggttgcgcaggacgagaccatgcactcgggcgccgacgtcgaggccttcacggcggcgctcaaccgcgaggtggagggcagcggcggcgcgagcaccagcgccgcggcctcctcctcccagccgctggatcacggcgccggtgagtttccctgtccccaattaaccctaggaaactgtttcccttcctcggatcgaattcgtgtgatcctgtggagaaccgggggttgtaggaatcaacaaactgtactgcgagggggttggacaatgcgctacttggaatggggtaataatgaaatcaagaaacttttatgtacgtggcacctaggtttagtgttcgaattaacgttccgcaattttagatttagtgttggaagggattctgacaaatgagccttctatgattttttttttggtactgcaatgggttgggctttttctcattattctcatcatggagggccttcccctaatatccctaatattaaaatagagataaatattcttcatattgagacccaaatggaaaaaaaaaacaattcatcaagggaagaaaaattataggaaataagtgtccaagtactgaagggtgtgaacataacagcttgttaggaaaacaaaacttttctactggtttatctttgagtcccctaatactgactgcatgaaaataacaacagacgtttataagggtttgtcttaaagaatgtggttattgatttcgaaaaatcatgtagattcttgaattttaccctgcatataggggaatggagcagtaggccatgaattcatgacaatctggagtagaccacaacacttttttcttgcagaaatgattctcttagtgcttgatgacaaccaaacattgtgtaactcaaatagctgctgtgccattgaatccacttttcctttgccaggtctgtaaagtatgcctggatagaaagaactttatccagcgagcattattataccaatattctatgttgctttagtcaacaataattaagaggcatagataaatatgtttcttgaaattgagcaacttccaacttattctgtaaatatatggtacccactttgacaagagctggtgaaatttacactagtgttctacaagaaacgaagttcctaaacaatatttcttgagcttgaatataagttctgattgacttctgtaatcattatacagtgttctgtcttgaagtatcaacattacactttgctgtggaagtctctagtgttatggaagtaatgaaatttgcaagcaaagaaccaaagtaggaacatttacagtaaacatgaagcttgcatacccatcattctatgttttcttctgcccttattatcactgctcttgttctattttacactccactgaaaatagaatttcaaggaaaagcacaactaccttttgaggatagcacttatacctggtttgaaacttggccacttgcagcttacaaacttagaaacctttctttcatggttgtggactagcctctgtgcagccagccatgcccattcacgctagctgagacaagggttggcgggtttagttcaatgtgtatctatatttagatagcgttgaatattaatcctatctatagtttattggttcattagatttccttcttcagtgactggctacataagcacatgattgccatccctttggattaagcaataaaattgcattgtaagcactttcacccaaccaatgcgagtacttaaaagggttagttgtatgtgagttttagaaaaccccaggttctgtgcttcgcctcacttagcttggagaaaacattgtggcaataaataagtaaatcctatgttttgtcactccctgtgctgttaactcattgacatactgctaaagttactgaaagaggagaaagagagcacatatttcattgacttgtcgcacttaaaacagtctaaatgaattgcatgtaggttccattggtttctttctgttttgggacataacaagacagactttcaccactatattttcttaaaccttgggttaagttaaaatattttcacaacttctgtatgcgtgttttaaacgcaggtaaaaataccaatcggaaagataaatgactctattagtctctgacactgacagagatactgtagttcaagggtacaaaattttcatcccgcacatgcttctcacagtggcaaggcttttggaatgaagggtagcatgattagtctctcctgatgtccaactatttatgaactaaatatcatattgcttggagttagttctccatgttgctttcagattattatttttattattgaaatttgcagattgttttgtttgttgaatcaagcctgtttaaacatgcaataacttcagatctgcattcatcccttttgacaaatacaatagagagatacatttgtggaagctaaagctagaaaacttgccacataagtagcttgtttgcttatcagctgagtggcaaatagtttgtacaagctttagatgtttgcaatgtgtttttctttaatattgtgaactgggtagtggggtagagtatcattagaagagtgttctaagccttgtaaaacttactttctagatgtgcaatcaagtaaattatcagtgaaaattgcaaaatattttgcttcatcctgtctcaaagtacaatgcaaatatcacgaaaacttccaataacatttggtcatatgaatatgagggtaagacgcacatgatacactctatgttaaaatgctaaactgggggaaatgtgaccaaagtcctgtggtgcataatgaactgttactggaagcccacaattttgccatatcaaatacctcagcatattgtctttaaaaaacatctaagcaattcagtatatttctcttgaagtaaaagaattttagcatattcttggtaacctagttatgctatttctgtaaaaaaaaacctagttatgctacgattgtatttatcaagtattcactttatagtaatttatctcaaatgtaggtcttgtgcctcaggagagcaattcaatgttcacccacaatcatgaacagtggcagggttcagtaaagaatgaaattggaaaccaggagaaccaacaacaggaacagaaacatttgcatcattcaaatgagcagccatctaggcctgaactggtatctgggggtgctgataataaacaagaccagccaaaggttaagcaagagccaggaaacagttctcaacaaagtattctggtcagaagcagcctttgcaacagatgaggagtcaacaaacaccaagcacaaatcaaactaatagtgctcctacggtggggaaacctcctgttgttacatttcatatgttaataccaattttgagacggcaccttgacaaagacaaggatatgcaagttcagtccatttttacaaagttgcgggttggttcctgaactatgctgaattaaaaaaaaaacaaatagaatattattgcataactgattactcaactatacttatcgcataaagatatcctttattttcgatagaaaaatgaagttagcaaggaacactttctcaaagttgtaaggactattgttggcgataagttgctcaaacaagctgctgcacaatatcaagctcaggtaactaaagtttcaatttattagggttcatttgagacctctcccccattgcaggtaactgactgccactttacattgtgcagttagtgcgtaagttaggtcaatctatctattctttaagttaggtcaatctatctatcaccactttctgtactgctattgttgttcttaccatcacaatctgtttttcttgggagttattctggtcttgttagctgcaagctgctcatgggcaacggaatccacagacaaatccaagcaactattctttgttaagtcaagtttccaatcagcagaatgttcccagtggttctacgtcaggagttgagcacaaatcatatccgtcagctcattccattcctgcaaaccaagctagtgacagcccaagaccaccttttttccgaccttctttgtcaggccaaatgcaaagtaacatgggctatccatcttcagaaagcaatttgcaaaaggttaatgaatctagtaacatgtcagatgtgaaaggggggcatatgctcagccatccacacaatatacaatcagccccagggcaagcaacacagcatccacaaacatctttacctgtgcttgggtcaaataatattcatgctcgtccattgccacgaccagttggaggtccaattgtaccacttagaccacaaatggcagattccagtcaaagaggacaattagtccagggagctgttacctcagtgactgggagcatggcagcacgaccaacgttgcaaactaatatatctccatggcaacaagtaaacaaagagcagaaaactaaatctttccctccaacagaacacacaaataaggtaactgaaatctaatgctctgaatctacgtaagtgtttttttttttttgcgcctccatgcatgtaaatcaagttaacacagcctttggatgtaagggtgttggtgttcctgaaaaccaaccatcaacatcaggtacttctaaatctttcaacacaacaaactcaagtcagcctcatcgatctcatggcactcaagcagaaccaaacatgcaggta

SEQ ID NO: 39225 - DNA, 21427 bp, Oryza sativa
ttcctaatctaacgtaagttttattcagtgtgttgaagagcggttacgaggattcataagcaatacaataagactttcaaaacaggtgtgatggcttaatttcatggatcttttccaaataaagaattctacttaagatactaattcattttgttctttcttttgtgtagagggttgatcttgaaaaatcaagacatcgaatttatcctttgtcttcagatgttcgtagtcacattttgagggtgaacagagaagctagagaacagtgggacaaaaagctggccgaagatgctgaaagaatcaggaaacagagtgatgttagttctgcatgctgtttcagctggaatttcagtatatcttttcacacgtagtataatacatagagactggctggcaggtggatcaaagatgtcaaaagttgtagcatgtaagggggttgacttaaatgtagatgtagcaatggcttgctattgtgcagcaaggtgctccagttcatttaatctccatcgtccatttgtgttctctctccttgtacaggttgctagagtgtatttgatttgatgtgataattagtcatccttcctttgcgtagtatgttgattggcataaattgggcctgagtttcacaatttagtactatgatttgtgcggtttgaatgaagatcatgtttttaaatgcagggagatgacaatgctgtggttgattcagagaaggacaagaatgagagtcgtagcacatcaaagcatgctaaggttagtgtctttcactactcaggcgatacttgcacagttgtataaacatagtatgctatagatattgatgattttcatgccttgcagacctataaggcggaagatgataaaacgagaacaacagctgcaaatgctgctgcacgagttgcagcaggcggagatgacatgctttcaaggtggcagttcatggctgaaaaaaagaagagcaaatgtgatggtgatggttcttctggttccatgccaggcaacatgttgcctcgtacgtcttcaccgaaacctggaaaaggttcaagagaacaacaggaaattgaaaagacaggttaattttcaatgcttggaccccgataaactgttgtatttttaccgttgtttattatatttgtagtaaccaatgtgcataagcgagtcagtcaattgaacaaaaccacttgatggttgagtgggatagttaatattttggttataagcatttagtaatgcatccatgcaaaaggttggtagatatctgtagttgtagaccctgagatttgtgtttggtgagttcttaagaggacaagatcaccttgtatccagttagtgtgaatgtttaatatgcgagtcattttctagtagaccaaagcctcatagagtagattacacaccacatgcattgtgacatgccttgtatttagacgtttgtccctaaagttttgtgcctctttcattaggtggtgttagaagatcatcacacgtaaaagtgacccggagcattacggtgaaggatgtgatcgcagcacttgagagggaacctcagatgttgaaatcctctttgctgttccagctatatgggagatcaccagcagaatcatctgcgaaatagttgcagtataaccattgcatttcgagttgcagtgttcaattttggttgtgctcttgggggcattgtattgagtagaatggttgatagaagatgagtctaataccaagcgatgggtttgattggttgataaatcatttttgcaggatttaacaatcactagtgaaccgacatcatcagccattttttttaacgagaatagtgtgcatatgtgttctttatctcatgaataatattgtaatcgcttcctatgtcaggcatgatataataaacagcatcaagctcattatgtagagctgatacctgattgtgtagttagctctttttttccactaagataattgaattactctcatgtattctgattcttttaacatgcaatgctggtatttcaaccgttggtgggactgggagaatgtacaatatgtacgttaattcgtgtcgctaggatttgcatcacctaaaaacacgactgcagtaaagcagcttgaaatttacatacatagtacctgtatcatgaatataagtaaaacttctctgaatacattctttgttcatgctgcctgggtacattaaccttccctctttagctctgcagctctgctgcatatgtgaactcacaacatacatgctagctttcctatttgtactactatattcttttccatttatcaacggacgacatgcattgctgtgctacttcaccaacatggagctcttaacatccaaagtcataaggaaccaaaccttgcagctctgggccgttgagcctgttgttgttctcaaagctgcagaataagatgagttagctgtcagtttatgtgaaaggtccagtggtaatgagggatacaaagggtgtgtttagttcaagccaaaattggaagtttggttgaaattggaacgatgtgatggaaaagttgaaagtttgtgtgtgtgggaaagttttgatgtgatggaaaaattggaagtttgaagaataagtttagaactaaactccgcgaaactagtagcaaaatagtgaccaaacttatttgactcaaaccattccaacaaacttaaccaatacaaatcacaaatgtcatgtcaatgggcaatgtaagaattaactgacatttgttttagtcaagcatcaaattcaacctaatgcatttcaatagtaaattaacttttaaggtataccttcgaagagggaaggttgagaagggaccgtcaacaggaatagttccacagaggtcattgttagacaagtcactacatttcacaagaacttagagcaatcagtattcagtaaccatagagagtcaaggaaataactaatttaaaataaatagttttatactcacatgactttcaggttggatagtttggccagctcccttggaattgatccagcaagcttgttattgttcaaccgcctgatatcacaaaccaaaagctttcagtggtagcatatgaaacactgtacaaatatgaataatgagttgaagcctacttccttagttcctgtttcttttgataaaagttactcctacttaaatgtgcattggtaacattatctaacaaaaaatgtgcattggtataagaaaaaactacttaaccatgcataaaaccaaatgaacagagatttgtggatttcatatcagttgaagaaattgtgatcacaagcgtcaggatatttggattcaccgatcatttatttgcactagacatgacatgacttcgtattaagcaagagctgtaatataatcaggtggtgatggtacatacatgaatctcagcgagccgagcttggaaagcgacttggggattgttccagtgagcttgttggcatacaaatccaagctgatcaaattcttgagattgcccaattcttttgggatctcaccgttaagattgttcctgtagagctccctgcaaatcaaaatttgatttttactgattaaatcatggtcatatatccctttctcgccatttgaacagaaaaaaacttgcacgtaatatgcccatacaggtattggaggttcacaagacggcctagctcagggccaatcgagccggagatgttggagtttcctaaatccctgaaacattaaccacaaataaaatagtcagaccattaaggatttagtgtgcgatccttctgaacacgcggattgctaccttctgaacacgatttttgctaccggagcagcaaaccaagaaattcgtgaacaagaagcaactcaattgaaagactaaattaaaggtcatttcttttgccagtccgcaaattataagttgacctgctattgcagaagagttggtgcgtcgagatcttgaaccaagtgttgatttttgacgagttcatcgaacaaatcaaaccagtaataactatacgtagctagcagcagatgatcacctaattgacttaatttagaatagacggaaactaagccccgaccattaatcacagcagcacgcacagttgacagattccaaattcgataagcaagagaagtggagaaccatcagcaatctttcgcacggtcggggaccaaacaatttgggcatcggagttggaaaatcttgaagaggcggcgggggggttcgggagggagaggaactcacaggcggacgacgcggctggcgtggtcgcaggtgacatggaaccaggtgcaggggttgacgagggtcgggtcccagctctgcagcacgccgttgggatccgacagcctcgtccgcagcgcgtacagcgcgtccccctcgtcgttggacgcccgcgccggcgcggcgagaagcaggaccacggccacggccacggcgccggcggcgagcagggacacgcggggcgccatccggccgcggatagtcgtaggtagaggctctggcagtcgggctggcctctcccgccggctatggctccggtgtgaaagggcgagaggaggaagaagactagtagaagagggtgaaggcccgctggtggtggtggtggtggtggctggtgggcggtggaaattttggaaaagtaggggattgcggtcaacacttcaactgcaaggtccacggtcaaacttggaccaggaacaaagaggatgcattttgcaaggctcacccagaggaggatttgtcgcccttggggaactgcgttcgaacgttacagatagtatgatccaatccactctgaatccgtctgatatggtatggacttttaaaaatccggttgatatggatgtggatgtagatagtatgatgcggatacggtatctataaaatccgaataggccgttttccagataattcgtaattatcaacacatgtaaccactctatctattgcatgtaacataagttggtccatccaatggcctaattcatcaattaacctagattttcttagtctaagtctttcaccgtgtcatgtcacacactcacacttgcgcagttgtatttttaaattatggacaacatgaaatgtattcatgttgtttaatgttgtttagcacttaagtatgtactccctccgtcccataatatagcaacctagaactggatgggacatttcatagtacaacgaatatggaaactttccgaaccgattctgcacaatttccggcatccgaaataatccgctccacatccgcatctggacactatctgcacccgctccgaatccacttgaaaatatggtttaggatatggtatgaccactatccgtctgaatccggtccgttttcacccctagtcacttagtttttcagcataaaaaatgagatagatcattattgtataattaattaagtattagttattgtacatttaaatttatttgatttattttaagaagcttctataatagttttgcaaaaaaaaatgtttagcaatttataaagcgtgttactgagaaacaagaaaattgtaattttgagttgaagattagaatggaacctaaatccttatacttaggaaatctattttatgctactgagtttattctggttcaacaatttaccattaacattgttttttttataatacaccgacaactttattaattattcttcaatacgtcattcaacttatctttttagaaaatacccaaaatacacttatggacataaaaggttaagattgatttatcttattagaagttttaaaaaatatgaaattttttaggtgacatccttatacattatggaagtttgtatataagtttcaagttttttcatttgtactttttttaaatatgtatatatataacctatatgttatatgctatgtaaaatacatttttgtgttatagtttttaatgtaaatcatctttcatatgctatataagatatttttgtgctactatcttttgtgtaagcaatttctctcttatataccccaaaaaatatttttttcaaaaaataaaaataccaaaaagaacttaaaacttatacacaaacttccatgttgtataagaaggccacataaatattttcatattattttagaatttctaatgagataaattatttgttaacattgtatgtctataagggttaagggtatttttgggtgtttcttttaaaaaaaaggtcagcccactggtatattgcaaaacaatcgacagtgtcaatggcaaatcgttgaactggaacaaacttagtacgaaccaagatgtcgagtgatgggttgggaaagatatattttcaggttataagcttggcttctgccgatagtgtacacaatcaataagtcgtaaggctcaagaactctctgaaatataacctttgccaactgggtattgggtaacatgagctggatattgtaattttctttttacacctatgatatgttgggttgatttatcttcataaccctacacatgactcaaggccaagggcaaagctagccgataatatcagcggggttagtttcattatatgccatagtaaaccttaatactagaaggtttttgtcggctaacctcaatgaaaagggctaactctaccatgacacaaatgaataatttctcaattatagtctattggaacatgtatgatcggatcaactcccctccctagcaagatgcctccagaagtggctctctctgccacaattctttccatgtatagcttagtactctctctcataaaaaaaccaacttctgtagaagttgatttttcatggagggtgtacataatttgagtggatgaatttatttttgaaaaacttttggattgatgaatttagatgtagagaaagggaaatgtgcagtcgatccgtggacagaacaatttgcggccagtgggtcccatagggccggcaagtgggtcccatggggcactcagtcgatttgccgtggtattggcgttctttgtccgggtgcatggtatggaccattacgtgggacccacacagaaaaattcaaagtcatcagctcgttttacatattccactccagataaaaacaaaatccttttagattctaacttttttcttccaacttctaattttttcgtcacatcaaatatttagacacatatatagagcatcaaatgtggataaaaaaaaactaattcacggtccgactgtaaatcacgagatgaatcttttgaacctaattacgtcatgattagccataagtgctacagtaacccacatgtgctaatgacggattaattaaactcaaaagattcgtctcgcagtttacagtcggaatctgtaatttgttttattattagtctatatttaatacttcaaatgtctgtctgtatacgtcaaaaaaaaatttaccaaatctttacagcatttaaacacggccttagtcccaaaatctcttgctcagtcgattttggttgtatgggacacatctaatactatgaatttggattcaactaaaatctcttaggagtatatttttggggtggagggagtattaggccattcatagtgcggtgaggtggcgttcgacctcagcttaccggcgcaggagattccgagccatgttagcgtggagcagtctccgccaaaaatgtggagctttatttgtccacccgaacctcgtcagaacttgtcatcagtaggaagccccatgacgcgcgaggagaggggcaaaaccgcgttggagaggctatgtcccaaaacgcgaagcaacggtcccctcatcatcattgtcatcgaggttgccctgccatcgcgtcaccattgaggctgtccctgccatggaggggttgcgggatgaccgtcgtcgtgccgctgctgtcgtcgagccgctcccgccacttcccaaggtcagatccggtgactttcaggctggatccggcgaaaccagctcggtcaagctatggagatagggagggagagaggtgccgccggtgggggagggagaggcgccggaggagggggaggcgcggcggctgaaaatggaggaaggaaagcgtgtggccagcggaggagttgcggtgatttgttgagctgagggagagatcccagagaaaaggaggaggtttaaatattttttttctagattttagggtgtttattgtaaattttggaccttcacataaattgaaaaaaaagactatgagaactgataaaaagtgtagtggctgaaatataaagtgaacaagattttagactcgtacgtctaggttaggtgacagctgaggctccacaaatacgtgggatacactcactgcgaatgcccttactgtgtgatgtacgtctccccgacacgcagaacgtgctgcgaagaaagagagcacgaaacgaaatatcagggcacctgccaaactaaagtacacacaacatgacttgacttgtgaaaggacataaaaaattttgcctttttatttatttatttatttatttatttatttgcaaaggagaacctattggttttgaatatgaatgaatttgctagttatgctttgtattattttccctcatgaccaaagtcaaccttttttacactaaatttcacgcatccctgagtatcgtgatctaagttgcacaaatcatatagattttgacccatgatatataatcctatgtattgtgaccataaaatttacaaaacaaaactattgattattttaactttattctactattcttttgagttctttccacaatgacatcctaaatttatgagttttttttatccatcatataaatgttacgtggaatctatgtgagtaaagatttttaaagttttgatataagagtatgtcaaattagttaatagagtggttttgagaaactttatgacaaattgacaataaaactagtgttatgtgtcacgtaccatttctacaactttatgacaataaaactattgttatgtgtcacaataggtgtgttttatgaaatgtagtctttttaaaaaaatatagattccaaacattcagtaactggtttccacctaataaaaatgtcttctttcttcaaaatatgctatgtttcttttctataatgcaggaatttcttttccacctaataactggtttctttacccctggctacctccgtaatgcaggaatttcttttcatccttaccttacctgaattaaagtaattgttttcttaaaataatcccgcaatggaattaatttcagcctttcaaagaagtccttcgttgtggttaaatattaaggttatatcaagtgggggacataaaaaagatttttcatggcactttcctttaactttttcaggcagactaaaaataatgccgctagtgaaagtcacgtttatttttactagcggataacataagcattcactagtgaaaatcacattatctttactggcaaacgacgacataagcatccgcaagtgaaaattgattttcactagcgggcgcttaagacgtttgttagtgaaaatcaattttacaaaaatatgtattcgtatctaacttttccataaaaagttggatgaaaataaaacttataccaaacttgtactatatctcaatgagatctacaacattttagtgaaaacttttccatttaagattatttagggttcaaaatattcattacaggattcaagatctgttttacaaaatttcagatatatgattcaaataacctccaatggacaaatgacatgtgtcaaactcttagagctctatgagatctataactttctatcatgactttttttatttggaagtcatttagagaggcaaataagtattttaattttgaacaatggaaatcaaaacaataacattctgaatatatagacatagacaacaagtgcttcattgtgagatgataatgtaacacatgtgtgtctgtgtggagagaatcttgtattcgaatccttcaaaaaaatcgcatacttgtgaatttaatccgaaagagtgtaaaaattgtcaattaggatttatagttgtgttatagatgcacggtaaaaatcaaaatatttttttatttttactttcccacctaaaaatcaaaatgaaattatggaaatcgattttcactaatggtcggatgccgctaacgaatatcattgattttcactgaacctttaattgcttgcggaatgtttggccgccaggaaaaatatggtttagtctccagaaaaaatgtgttttgtagtagtgggaaggcttatttccattatcgaaagaaatcaagtgtggttcaaaatttttgtacggagtaccccgacaggcacacaattgaacacgaacttacggttacttggttgttgtagtaacaatcctgttgtttgtcatgaccatcctacacgcatgcttatgagatgttgatgatcggcttaattgggaagatcatcaaacaatatttattaagagtgtgtgtgtgtgtgagtagggaaaataggagattatgaagatacgtaagataaagtaaatagtgtataatcaattaatataatttttgaagcactttttttataatttttttagaacaacatattatttagcagtttgagaaacgtgtagtccagaaaaaatcataattgtttgtttttttagaactataatttttttttgcttaatttgtctttctttggaatcccagctagctgaactgagtagtgaacagtcagttctctgaaggcatgcatatgttagagcatgagcaatgggtagcccctgggcataccctcactcacggccgtctggctccattgctttttaggccgcgttgtccccctacgagtaaacgcgaccctcggttgaaagacgcgtccctcggccacttttggctgagccacttcgccgggatccacgttgggcgcgtggtggctaggggtgtggcttgtggacacccctctcacctctagatttcccctttccacctctcggccaataagaagtagccgccgccgccaccgccgcccgagtaccgacgcctcctccgccggtgccgcgcccgtcactgccaccatctcctcgatgtggagcggccgacgccgctccatcatgatctgcccgcacagggctagatccacccacgacaacaccggatctaccgcctttggctagcgatggcgagaggcgaaggagccgccgctgccctggcctcgccggacattgtgctcgccgccgagggtgcggaagagagtggcgaagagagagagagagagaggagagagaggcgaccggcggcgatgacggatccgcgacggcaatgaacaaatccgcgcgccactctcgccgttgactgctcgccgatgaacatatctgtgacagccctcctcatcgccttcgcagctactagcgatgggagagagagggggagagagtgaggcgaccaatggcggcgcgtgaggagagagggagtcaggcggcgacgatgcgtgagcatggaggacgaggggcggcgaagaaaaagaggccggcgcaaagaaaaagagaagagagagggagaagagaggggtagcataggaaaatagccactatcggctttttgggttgggacatctattgtgggtttgagtaccttcacccaattgcttcaaattttgaaaagcccacctaggtgtagcctccaataggagatgagtactcctaagagtaccctcgattattgagggcactctatgtgtggctttgattgtagatgtccttagggcatgtacaatgtaagccactcctagagtgtcttcactaactgaagccgctctatgggacacccgtctcgtctcctaatgaaggacacaactaggtgggctctttaaaatatgaagcaactaggtagagagatactcagcccacaacgggtgtcctagcccacaaagccccatgcatatatttttactatcctacccctaatctctctctctctctcccccccacacctaatctctctttttttcgtcaccgcccctccttttctctttttcttcgcctctctcttcctcttgccgccgctaccgccgctcgcttctctctcccgtcatcggcggccgcgaggacgacggggagggccgctgttaacagtgaaaattgccagtgtgtgtttttcgcgtcaacagccgcctccctccctctctctcgtccccgctcccacccaccgccgtccgtctccgcactgacgacactctctccctttctcccgtcgccgcccgtcgcatcatgtcgtcgccgtcctccccagcctcctccacctcgcggtcgccggtcggaggtggcagaaccgatgctatcgtgggcagatctgcccccctcccccgcagccggatcgggatggagcggcgatgaccgcgctgcatcgaggagacaggggggcactcgcctttgacagtgatggcgccattgccttcttctctccctctcgccgccgtcgttcgcctctccctctccctctctctctctctccctctccctttccctctctctcccatcgctaatggtgattaggatttgcgccggtagtggcggcgcggcggatgaggacgaggagccgacgtctgctggctgtcggggtttcgaagcactagggcgagggtacaaggggaaattccggggtagctttgggcgccttggccacgagctccccacgcgctcaacacggcgcttagcttcaactccccacgaaaaagtaggctaggcgtggagagagccgcgtccacctgcgatgtgccgcgctcccctgctgggcgacgatgccgggtcaaaaagcaacggagctgaacggcgtgaatcggaggaacgacccagggacaccgattgtacatgctcttagaaccgcataatatttctggtagatcttttcatccttgggcgggccttggccattttgtattctcattcgtcacacgatgaacggctttatgcttaatttcctcatagacgtaagattattctattctaccgcaactgagttgcaagtcattcatatcatcatatgtatccatatcgcaagcaaattcaatgaactgggacaacgagaaaaaaaaagttaagtatgcgaatattacagctgctagctaaatgaacatacgatatggataaaaaatactctctccgtttcacaatataagtcattctagcatttcccatattcatattgatattaatgaatctagacatatatatctatctagattcattaatatcaatataaacgtagaaaatgctagaatgacttaaattgtgaaacgaaggaaatatattataatataacatagataaaatattgttattaaaaaatattaatatttgactatttcctaatactaaaaatatattgggctaatttatatagattttctagtgtcttacatagattttcctagtgtcttacatagattttcctctcggacgaagaacagtgtcacgtatgtctctatatataagccccatttgattcaaagaaaattcatataaattttagagaatttaattcctataggaactctttctacgtagtcctttggatcaaaggaatgaatcttacgaaatcccatgaaatccctatgaaatgcctcgttctatgtaagtttcgaaagaaatttaatataagatagaacctcatgggaaaaaaaatccttgaagtcttcatctcttctgcggcccaatcaaacggtcattcctgtaattttttctgtgttttacaattctctattttatacttgcatttctgtcaaaatcatatgttttttccattcctctattttttttctttaatttcccgtgattcaaatgggcctaagattacacctatccaaagttggtacaatagttcacacttgccactggatattgccctttggctaataatgcatgcacgatctgccagtgtagcaatatgtgtaattctagttttgtgaaagttacagcgactatagaaaggatacatcctcttttgtacaatttggaaaaggttggaattctgaacgcaccagtatctaactccccctggtgctctctgacgcagagatgctgtatactctctctgtcccaaaataataaatgtagttttagcactgttcatgttcaatatttgaccgttcgtcttaattgaaaattttttatgattactacttttattgttattagatgataaaacatgaatagtactttatgtgtgactaattttttaatattttttataaattttttaaataagacggatggtcaaaacaatgaacacagatatctatggctgcatttattttggaacaatgaacacggatatctatggctgtatttattttgggacggaggtagtatcaatcaagcatatttggttaacctaacccaacttttttatagctgacgatttgacccagcaatgtcgtttcacaactgcaaaaagatcatacatgcaaagaaattagcacttcttttgcctaatgcaaatagctaaatatatcttcatttcaagctgtacactcgtaggtctttttttatttgaaacacatatatattaaaagcaagaacataggttaggggataaatcccattacattgccagaagataaattaaagcaaagagccacccttttgaaaagggaggttaactctggactaaagaagtagacttcctaatgggactgagcagcagaaaaggagcaaatcgatagggagttggggcaataccgcgacgactgcttccttcctagagcctcataagacgtgcacaccgcttgacaaaccggtaatcctcatcggctgcctccacagaaacggcacaggacagaggtgtgatgctgagccgtagatattggtgtgagcttcaccggactcagcaaaggatctccacggagctcgtcattgaatctgaggaactctaacaataaccctgtcgactgaaatcgcgcaggtggtccgagctcaacccgaatgacaaactcagcatgttttctactaatcaggcaaaaaagagaagccagaaccaaagaccaatcaaccttcatcatgcaagagttgtagtggctgcaaagatcctcttgtcttgctgagacgacgaagttggctggggaagatgaaattgcatcaagagtctacaagagtccggcaagagcataaacccatccactgccgtctccagaactccaaacatgtcctcctccacaagggcacctagcaccagggccatcatcgacgaggtcaacaacagcaacagccagcgcaggtgagactgatgaaggggaactagaggaagaagtcaaggaggaggggccagcgaaggacacgagaagccaccgcagtcgactcaagggacagagcagcgacctcccggccaaagacagcgacgctgctgtcgacgccgccaccaggagccagctccaaccgacaatttgcccctagatctttggatctcgcacctccaccgccaccaatcatcatatcaccgcctccgaccactccgacacccatggagctcgccggcaaaagcacaaactagagacaaaccctaacaacaggaagaacctgacgacctaataacagacctaaccacacaatactagtagggggaggtggacggacctctcctccaaccctcgccggcggcaagccgccggaatcgaggaggaagaggggccggagagctggaggaagggggcggctactgtagaaagaggaaggggaaagaagactcgagaggacgcaccagcttaccccactcgtaggtcaacaaggcattcttcgtcagttaacatctgagtaatcatgtacaattgaatcatcagacaccacattcaccagctgcatgctagctactcatttactcattcgccatacccaaacaaagagcatagctctgatccagcattatttatcttgaggtacctataccaccgatctaaatccggccgttcatctatcgggggtaggatagggaacgaagcaacgcttggcatgctaagctcgcccacgatgctcctgtctatcgaattcatccccttctacggcagtggttgaagttgaatagtgtcgttatcatcccctcaaatggtgtcaggtgcaagggaaacggaggtgttgaatgctagggatggcggtaaagttgggtgcttgacgaggtggatgtggtggctccggatgagcgtggagatggaggtggcggcgccggcgccggtgcacggcaaggtgaacgcggtggcgcagaaggcatagcgggttgtgtcgtatttgggggatttggagttgatggcgaaccaaacaagagaacatggaaagccgttgccaccgcctattgtgaccacatccccctgccctttatttctgatggatcaacgacgggggcaaatgggcaatactgaattggccaagggaggcgggatgtagatcatggtgccggcatggaagaagacgctgctagccatgaaaatcgttgacaatcgtacgagagccaaccatgaaatcaaccgctcaaatcttcaccagcgtcgtgatgcatggatggaaggagcagcacactgggaaggaatccaatttactcttcggtttccggcccctcccaccgctccagcatcctactccactggcgaggctgccggcaagggcactgccatccgatggaggaaaaagaaaagaaagtgagaggagaaagagagataggtggtgtttcaaactcatgaaaatgaagattaagtgagcgaacgtaaaacaagaaagctattagcatataattaattaaatattaattattataatatgaaagttttcgtatgaaacacgttatttagtaaagcgtgcttactaccatgtaccaatttctcctaaccgttggatggaatggatcggattgcctagattgcaggtaccgagaaacctgaaggaccgtgaaaaaatctccctaactaaataagcataaggaataagcatgtatttccaagagacagcttgcagtttctcaaaaaaaaaaaaggcggcttgcagaaaaaaaatgtacaaattaattacaacaggtcgcaaattggtgtatgagcaaaacgcgtcattaagcagtgaatgttaaatgagaatatgcgtgaaatgagagcaagaaactaagttcaaagttactgaaaaaacctgctccctaaggtcaaaaggaaatattgctgtgaatgaacccctcgttctaccaaggagacagaaactaaacggctgaacaggaataactgaagggttcatcaagccatttctcgccttaacccctaaagaaacaatatgcccttctcaagtaaagggagaacaccatgggagtaaaaatacataaaatgcaaaatgaattcactcaagtcaggcacatgctcatgcaaattggcacagaattctcatgatcaggtagacaatcaatctggtttaacagcagacaatatcttagttggaaaccacatcactttcttatgtagagtaacataggacaggacgcatgatcagacggtagcaaacaacatgtaaggagctccatcagaagagagaaacctcaggactaatggcaactgacccaaacattaactttcaaatttttctggattccatgaccatgatacagcttgctggtacaatctttcatttcttgagatgggggaagcactggtacacatctgtctttggatgcttagcttctgcatgctcccggcatttcacttcagatgtggtgcacatgaatgtttgcatacacaccttgcactgcaatcatgaccatcaaaacaatcagtaaactagaaccagcttgcaacaacatgcaaatcattcatctgcacatagctattatgtttcgaaagctcaactatgaattcacaaattccaacaagcagtaatcaacaaggtaattgactagggccataagcaactacacttcagaaggaaaaccaatacacattcaagctcatagtactaacacacagaaggcatgatgcatcaaaatgagttactgaaggcctaaataactgtaaaccactggagccacacaggcgacccatttcatcgagtcacattcaatgccaagtgtgcatgatctgcatagcccaaggcaaattccacagatcaagaattatgaacagtgttatttgtcaaaatactttacagtttgttgtcgaaacgacaaccgcatacgtcgaaagacgtcgttactcaacagtggttggaaaagaaacgaagtgtattaaattttgaatttttcttgggatccccccattacatggccctaggggactatttatagccccattataggttcttactactagggtttaggttatacgggggaatttacatggttgcccttatgaaagggacgttcacagggttacataatgtcaagaggacttatgggcccttgatgggccgtcaggcgaccgccggccctatagcccctaagtttgatgggccgaaaaggcttcttcggcccttgcgggggcgaactggacatggcgaagccgtccttcttcgagctggatgccagggcgaactggacatggcgaagccgtccttcttcgctggatgccagggcgaactggctatggcgaagtcgtccttcttcggcaggtactcacgcgacccttcgcctcgcatcatccttggtttatagccttcgccacgggtttcggcaaatttggtcaaagggcctcatgccatccgagcccctcacaggcaagggtgagagtggagcttcggccgagaccgtgcaaaccatgtggtatgtatgtggcgccccctttcgaccgatgcttctgccgaaacctacactgttcctgcaaataaaatattcttatttgtaccgggccggaagggaacagtattgggccttttactgtgctgtttggatgatgagattttacctttacgcctacccttgcgctacgtggcgccttatgattggcgggtaggcgaaacgtcggcccggtgggctatatattcccacccctttctttttcaccgccgcactcgccatttttactgcatgcgctctcctctcccgttacttcctttcgctgtgtctcttgaactcgtaggtgctttgcctaccctcttgttccgccaccgcccacacacctttcgccatggcccctcgcaaaccaaaccctgttcaggcggttggaccggaccctggccgggtcgacgacaacacctcctttttgggggtctctcttatggacgacgaggagctggcgaagctggtcagctctggggcgttggttgaggggcaggctttcgccccagggaaagccgtggtgccgaaacctgcagagaatcggacggtggtttttgctgtctttttcgaggctgggctacggtttccatgcaacatgctgttgccggagatccttcgcctcttctaggtggaactcccacagttgagcccgtcggcgctggttctgatctcggtcttcgactgggcatgccggacttccgggttcgaacccagcgctaccctcttcggcgccatattctttgccgccgtgaactcgaagacgctggttactccggctggaacgaagaagacggtgttcgggagcgtgaactttaacgtttgcccctaggaagcgtagggctcctgcttcgtcggactctgatgctgatgacgaggaggatgccgaagaacatgacggcgaagaggaggaggggaagaagaggaggtggagatcgtggtcgagaaggccacgggcgaggcagtcgggggccgcgctgagactcccggctatacccccactccgagtcctggccataacgagaccggggtggagtcgaatagctccccccttcgccagaaagacttagagggggcgaaggccctggttgcattctcttcgggcacagcggcgaagggaggtcctgtaaaaaaggtggctaagaagaaaggactcatcgatgtcgctcgcgtttttagcgacgatgagtcctctgacgggactccgacttcgcccgctggccgcatcttggatctttcggccgcccctgttcctccactcggcgccgctagagcgggcggtagtaccgccgctgaggcttcggcctctgcagaaagaatcgtgacggccgcggcgaaagtattcggcagtcctccgcgtcagccggttgcatcgccgctgattgatgcgaagggaaagagagccgtcgttgagacgtccgcttcgaaatattcgctctcgttaccccgcttcgcccctggcgatttcgagacgcgggcggacccccttccttttgtggagggggtaagcaatcttgtactgcccgccagtgccccgagcttgttcaccgaactgaatgagttcgatgaggggtgctctgctataaaaagcctggctgttcgggtatgtttttcccccttttttttatttttactctccctctctttttttttacaactgacacttgttctcttcgccgctcctattttgcacccagatcctcgcggctcactgttcgatggagcgaaccgtgcgagcccgccttgacgggttcaaaagccgtcttcgggtcaaggatgatgaattaggccgcaaaaatttggagatggaggcccttgccaacacccttaaggaggtgaaggtcgaaaacaagcggctccaatcggaactggagaaagggaaggaagctagggccgaagtcgatcgcttaaaggccgatctggagaaagagaaggcccactccgccatgctcatagattattacaacctcaccgagccaaagatggaggctcttcggcaggaggttcacaaggccgaagcaagcgctgcggaggagtcacggcggttttcgcgggagatggtgaaaaccaccgagtccgggcggacagcgtgccaaacgcttcgcctcacccttactaatatgggcgcgaaagtgcggggtgtcccctctgaaggtgcctcagccttcgacttctccgaatggacccgacaggctggtggttcgatttcggactgcgccaccgcatacggcgactgctgtgcgcgcgtgtcagcggcctttaccatgggcctcctgcagcagttcggctacgagcacatcgccgagttccccaagtacgcgaaggaggattgggaaatcagcgcgcaagacatttcgcccgcacttcgtgcgtggcgaaaacaattctggcagaaggacggccgctccaccgctaaggcgcgccttttggagcagctggcgaaagcagaggcggcggacctttgtgaagaggaaggcgcggcggccggagggggtggaggcgatgcccaggaccacccagaggtgtgaggccctccgcccttctcttagattttcatagttttcttttggtgttcgctagatgtggcgaaccgttgtatattcggcaatctgccgctaacccttttgttgtaaccgaaacaggtggccgttgggcgttttttaaaatatgtataacagacctacttttcgccacttactgtcggtccaagtctttgacat

SEQ ID NO: 39226 - DNA, 4958 bp, Oryza sativa
  unsure (1)..(4958): unsure at all n locations
cgaaatggagataaacggtcgcagctataaggttttcaaggttgccgattggctgcgggtgcaccccgggcgaaccttagaagattacgatcttattcattcaagacatttggaggatatggctcgcttttggcgaaaccatcagaagactaaacgtcaggaaacgatctttcagcgtcgttatagtttagtctgtgtttcgccccctactcctcttaaggttgtgtacgatattagtagtgatgacgaacctagttcgcctgacccttccttagggagggatagtgattatgggggcgaagatgtaatttacttgtaaggtgaattgtatcgtgtgaaccttctattctttcgaagttaataaaaatgtgttttatttccttttcgctatttttcgcatcgtcacattttgtgcttttgttaggtcggaacatgccggcccctttgcgtatattagcgaaataggtgtactgacttttcagcttttcgtcgttcgttttcgatctgtagcgttctgtgttgaaagaaacgcttttgcttttatgttgatcgagcgtaacgtcgttcggctagttattttccgagacaagctgttgcggtttcaacgttcagcgagcgatgcttcggccgattcgtttcgcccccctggcctttttcgctgatcaggcgtttgccttggggtttttccacaaattatcaatcacacaaaaaataaaaagaaggcggaggacacagagattttatactggttcgggcctccatggtggataatagccctacatccagttctttctcttttttctctctatcttttttttcttgccgaaaggcttacatagtgccgaagggcttacataacggtatgtacatttttacaagttggcgatttgggtgccacccattctagacatagaagcgcttgagagaggcggcgttccaggaatggtcgaactcctcgccttcgagtgtcgctaggcaaaaggatcccgtcctggacttgtgtttgatgaggtactgtccttcccactttgattcaagcttgccaaccgctactaggttcgccttcttccttaggatgagatgaccaggcatcagctccgtcggtcgaacttttttgttgtaagttgccgaagtgcttgtggcgtacttgtgcatgtgctcgagcgcttcgactcttaccccttccaagagttcaagcgatacttcgtggccctcttcgcccccagagaacatcacccttggtgagttagcccctagctctgctggggtcattgcctcatcgccataaagaagcataaacgggctaaacttggttggtcttgtgggggtcgtccgaagggcccagagaaccgatagcaattcctctggccatttgcctttcgctgccccctcgagtcttttctttagtgcttctagaatcttgccatttgtacgttcggccgccccatttgactgcgggtgcgcgaccgacgcgaacctgatttccaggttaagcccttcgcacatttctctgaacttatcagagtcaaactgcttgccgttgtcagtaatgaactctttcggcactccaaaccggcaaataatgtttttccaaacaaacttctgtactgctgccgaagtgattgccccaaggggttcggcttcgatccaccgagagaaatactctatggccacaattacgaacttgtacccgtttcgcgctaccgagaacgggccaatgatgtccagcccccacctggcgaagggccaaattggcgcaatgggttgcaagttataatggggcgcagattggcttcggccatgacgttggcagctttcgcactttttaatttgctcagcacaaacttttaacacagttggccagtaaaccccttctctaaataccttggaggccaccgttcttgcagcttggtgcgcgccacatagcccctggtgtatttccctcgccatttcctcaccttcggcgaaagagatgcaacggagtagaggttgaagcgtcccggagcgataaagttggcctgagaccaacttatactttgtggctctgatttgcaagcgctttgcttctgcttcgtcgtccggaagccaaccagcttcaagatatttaacaaacggggttcgccagtcatttgggtcttcgcccagtttcacttggtcgattgccaagactgtcaaactgtccacaggcaaacttggtgtgtgcagtacttcaaaaaatatgccaggcaaatgcggtccgccacaagcagcagattttgccaaggcgtctgcttcctcgttctggcccctaggcaagtgttcaactgttatgccgatgaagtacttttccatggttctgacagcctccaaatattttttcattccttcttcttttgcctcaaaggttttgtcaacttggcctgccaccaacttagaatcggttcagattagcaagcgccgaactcccagtgctttcgccttccttaggcccagaagaatggcttcgtactctgctgcgttgttggttgtattaaattgcagtcttgcagcgtaccggactggtacgccattcggcgaagtgagtattgccgcaatgcctgccccgttgtgcgaccacgaaccgtcagagcacatcacctagggttgttcgacgggctcgggttcggaagcgaacacaggtgtccattcggctacaaaatgcaagtcgaacggggatagctctgccgcccatttgctaagcctacctgagatttccttgcctcggaggatttcgcccaaggggtacagcgaaggcactattaccttgtgggcctggaagtagtgcttgagcttgcgtgaagccatcactagggcgtaagcgagcttttccatttcgatgtatcttgtcttcgccccttgcagtgcttcggagacaaaataaaccggtttctggccagactctgtttcttggacgagggcagcactgaccgccaccggtgaagctgctaagtatagcagcagttcacttcctggtgttgggcttacgagggctggtgggctctgcaagtattgctttaactcggcgaatgctacttggcattctggtgtccaactgaactttcctgcgccccggagggtcttgaagaatggcagacctctttcggccgcttttgagaggaaacggctaagtgccgcaattcggcctacaagcttttgtacttcatgtacacttgacgggggcttcatttgctgaatggcatcgattgtctcggggttcgtatctatgcctctttcggaaactaggaaacccagcaatttgcccgcgcgaacgccgaagacacttctcaggattcagttttatgcccgctgcgcgcaagttgtcgaaggcctcctgcaggtcggacacatgatcaaaagccctacggcttttcacgacaatatcgtcgacataagcttctacatttcgccccagctggttgcaaaggaccttgtataccagtctggcgaaggttgctccggcattccttaggccgaaaggcatcctgaggtgacagaaagtgccgaacggggtgatgaaggctgtcttcgggatgtcaggcggattcatatggatctggtgatagccggaatatgcgtccaggaaactcatgagttcgcacatcccttccttccttcgcatccggtctcgatctggaagagttttgctcttcgtattaaccttagtcattactattaatcagtttgtttggggaaaaaatatttggggggagggggtggttcaaactgccccacgttaggtctgccctttttgtgctttgtatgtatgtatctcaatggcattgtgttggcagttttgctatctgttagatgactgagaactgtataaagaaaagatttagtcgagtttgcgcaccgtcgaatccatgtgggggatgtgtgagatttgtgctctagttgtcctctttagcggcatcctgcggtagggggatggcggcggcggcggcaccagattagggnttcatggtggggggattgggggagggggtctttgggcttatagcgatgactggagcggtggtggccgtggtggggtgttgaggcgacacctcggccttggaagaggatgagggcgagttccggtgatggcactgaggaaagattctcatataggctaagaggggtgggtgggtggttccggaggttcaagctggaggagacaggcgaataaatgggatgagggaggctctcaatggagttgaggagagggcaatgagatagtggtgatcgagggtggcctggtagggagggagtggtggcacggaggggctgaagattgggaggatgaggtggcaaaagaatgagagaaagagtaagggctaagtttgtgaaggctgcacgtctttgaacaatcgtggccatcaaaaagtgagttcagttgaccaatgaatagacaacccctaggttgattcaattgcatttggtaatttttgcgctctaatttgaatgtgaaaaattagtaccatggtgcaaaaaaagagaggaaaatatggttggaacattaaacttgattctcgtagcactggtgaagtggtaaggcaagtgcaggataagttcctcttgcattgcctctgctttgcatatataagtaccagaggtgagggggatgggacgggagtaagttcacccccgagtcaccagccaagtacacccacccaaaatatgtgaaatggtgagagtattgtttacatctgacccacccaaaaatccttgttctatccccctccccccctcgcttcttcactttctttctctttatcctccgtcttcgccctactttgtactatcccacacaggcccctcttgcgctaatttaaccattttgcttatcaaaaccagattagagtctattccaggaaaataatctgaaacgttgggcctccgtgtatacctgagtgtgcataccccactcattatactaaggctgtcccactagccagcag

SEQ ID NO: 39227 - DNA, 2981 bp, Oryza sativa
ctcatagttgaagagaagggcaacataaatcgtagataggtggatgtcatacaagaaaaacttgtttgcacccatggatcaagggtataagagttgctggttctacctgaaaaaagaaggggatatgccaaacttcagaatttcaacataacagaaagtcagaaactcataaaataccattatctaaatctgagagtggctaaatgctccatcgtgtaacaatctgtataagcaaacactcacagcttgtgcagcttcatcaattataacaacatcaaaagcacgagccatcctgctgaaaatggatgatccactaaaacttagcgtagaaaacacctacaaattttgcttgacagtcagaatcaaatattaaatgattcctggaatactgaaataagcaaaagaatgtgaaataagaaaatgaatgtacgatggctgcttcatcaagaatggaagatctaattcgatcatattcaccagcccctcgtctcccaccatctgatgagcgatccacaccagaaagtttttgttgtatctgcaaagatatcaacttatcaactcactgtaattgagttggacagaaaatacttagcaactaaaatcacgtacaaggtaatccatggaaactgctttaacagagtgatgcgccttcagtccaattcgcacaatcttaggattataggtgttgttattttcatcgcgtattcctgaaaggaagaagaataataatttagatgattgattttccgatcaataaattagtgaccagatgagcctaagaaatgttgtttagtttgtagcacatggatgcaattgaaagagtatttttattgtcagaacatttttctgaattggatcagtcagcacagaaacccctttacctgtttgcagaactcgcagcacaatctcatcaagtgctgagttggatggagcacagaccaagacatgggcccgatacttgcgattggaacttacgacctcaggtttctatcaagacaggtgtttaccatgtaacaaaaatacaaaattcatacaggcatcatggcaaatatagcaaagtacagagcacagaagcttactagctcattcccagtaggataaaaaccatcatcgccgtcaacaggcataattaaatctcgaggatttacaccaatcagccacggggaggccttcatccagtgtgcatgcctatcacatgagctctgcagtaagatagtgcaacagatatttgcagcagtattatgtagcaaataaaggaactgcataattccacagagtaagaaaagaaaaaaatacactgaaaagaatttctttatcagttcccatactacatataaaatccacatgctgagtgatcactaaatatgatagtacaaatgtaaaaatagctacaatcttctccctctaacaaacactaagagaagtaccataaagtaaggtgaatttgttatttccaaacaccatagagaacttgtttaaaggaggaaaaaagcaagcagaagaaatggacaaaacaagaaaattagctgaggatgaagcaattgaaaagagtccaattcattaacatacttgccctcaatatcaagctctggaccgtgttttttaacatcaaaaccacctctgcatgacaagaacgtaaatcatgtcagatacatgtagcttttggaaactgtattgaacacttatatttatgttttagcttctaatatctctttttttatatatcaaggtttctcctctccataacagaaagatactagtctacatttcactcagtaataaatatacacaggtgaagatattacttggtttgcattcttgcaggagcagaatggagaacagcactgaggagtccaaggatagtttgtgtttttcctgttcctgggggcccctacaaatatacattggagttctatatgaatggcatgtgacaacaagtagagcacatgtagctgcatatactctagttctcaaggcactagcatttctctaaaataggttaatgataaataatactgaaaaataaacaaatataactggaaataagcaaacaaacctggataagaacaaaggatctgcgagaaagacctgcctgcaagagataatgcattgatcaatcagacatctgatttttcttagaactaaattgagcaacaaaaaaggatattaagaataatgctcacgttgactgcatctagttgtgaatcattaaggtttgttttaagataatccataagtggctcagggacattccaagcacggttttgatcattcccaccactgttcttctcactagctgaaagaatcagatccttaaaaggaagtgatgctacagagtgcatgcccgagaattctcgcattatggtagacaagctgcaaatctgacaattttaaccataaaagaaaatagcatattcatatgtgttgtcaatgaattatgcaagcatgaaaactcaggcattctttattagcagttgaaactcacctttaaaatccagaggaagctctctgtagttgaaaaaatggaagcaatacgctgcagcctagaacagctcacaggctttgctacattaagattttttatttcacctgccacaaatgtccttagagaaatcgtttctctgccaccccgctgttccactaaggcaaaggcatatgcactgggggtcactccctcttcaaactacaaaagtgcagatatatatcaatgtgatgaattttcaatcataacttctttcttgaagagatatcgcatagaatcgatggagcattttgctagcctggcatattatctaaaaccatggaaagcactttttctggtgaaattatgtctcaagttccccatagcccttccaaatgtaggagcgcagataagtaactaacattgtcttgagttcttgacacgctatatgttccactaaattctgtagccatctataccttttgaaacatttcctatcacaccactaaggtgctaaagc

SEQ ID NO: 39228 - DNA, 2238 bp, Oryza sativa
gccatatagaaaaaaaattcaaaggtggtgccggtgattgcaaagcgagcgctcggggcggggcggggaggggcgtaccttggagtccgcgacgaggcggacgtagtcccacctgaggacgatcttgtggaagcggtccatggtgcaggcggcgacgcccgacgaggaggagcaggcgccgcctccgcctccgccgccgccggatttgtccaccgccattggggcggcggcgcggcggcgcggcggcgagagaagggggttctggggtttagtgagccgccggcgctgcagcggcaaacagcctcgctctggaaagaaggaaaaggaacgagatgagagcaaacagagagaaagtgcgatgctaatggttatggccatgtaatgggcctgagcccatttctgaagtacccccaacgaacatggggcaactccgatgcaaatccacaaacgaaagtttgatgaaatggggcttcaattacttgtgctgtggttagcgcattaatcattgtatacaaaatacaaaaattcgctgctggacaccgtatctattaaaatatttatttctaatttaatagaagagagaaatcataaaaaatttattgctggacaccacacttattagaatatttatttacaattgaatagaagagataaatcacgtataagtctccatctcctctctctctttctctcagctttctctctcgttctcggtaggataaattagcctaaagtatataagtcacatttaaggtttctttaataataaaatatgtcacagtaaaataaatgatatcctatatacctatacaaatcatcctcactgttagaattctctgcttcctggtgcttccatgtcaccctttttgtcctcaccgttggatccgcatcggccgttcctcccgcatcgctcctctcctctcatctcccgcatcttgctacggcgccagccccacgcgcatcgctccccacctctcctctctcgcatctcgctgcttcgctggccccacgcgcatcgactcccctctcccgcatcgctctcctcctcgatcgtggcgggcagccaggaagcgcgaccaccgcgcaaacgtcgtgcctcttccattcaccgcgccgcttgctttgctgattttatggcgactctcctcctcccagcgctgttgtgcgtagtagttgagggatcacgacatcctgtcgttccctccccattcacccagatcccttcgtttacacttcgatctccttcctctcacatctgtatatcattggcaataagcataaaagccatcgaatccgtttcctccgactatcaaatcgtcgcccatcttctcaaacttcccctccactttcatctccctcacatgtatgtatgtcggggcaccaggttgagtccagctgcacatcgcctactcctcttcgggctaaagaacgcacttttttttatcaagggtggcccttgctgtgcccagcgccatggaggtaagcaccaccaccgcctttctaatccatgaaggtaagcaccatcatcgtcaattttgcagcccaaatacagaacagaaggaggtcgctggcactgggcaaaattgctcaacttgccgattattcagagccgattattcagagctgaaggagcacgccaatagcaggatgatgccttctgattcatcactatatctatgtgaccaggtctgaccgtctgaggcattgtccaactttcatatgtaatttttgcatactacaaatggattcagaattgaagacactattcctaacacaaaggtaaccatatcttccagcgtttaaacacttatttacatggatgcttctgttaagaaaaaaataccataggtacaaattcaattgctggttgattccaaaaatatatcatggaaaaaacattctcttccataaaattttcaggctgcaaaactgcaatgctaatcttctctttgtaactcatgacacatgaacaacctaccaacaacggttcttctcctcctagattgtaacccatgtgtttatcctccagatgtgttccctttcatattattgaccctttatatgaccatcatgttatcccttctcctaacacaaaagttgcactaccgcatctggaggatcctaacataaaacatcatgacactaacaaccaaatttagtatcctcatactattaattgccaattttgtttgatttacgaaaaaaaatcctcatagacatagcactcttgaaacaaca

SEQ ID NO: 39229 - DNA, 1545 bp, Oryza sativa
tattcattaaatggacttcactgagtcatttcttgtgaagggatttcactatgttattttgatcataaatctagagttaccacttttactccccataatttgattagactttcaaggaaatattgtacgtcaaaatttgatatctcaaaatcaaaccgataaataaacatggtttgcttaaaatataacaccacatttttcacgtaatttcaatcatttttttcctatgttattgcgctctctcccctatatatataagtatgcttctatctctcctgtttgcggccgtcgaacttgcaaatggctcagtggtgccctgcaatttggtcgagttacaaatctccatttggagctacaagtatactactactcagtatctttgtttttaagttatcgtacaaattcagaagcaacaccaaactgaaatcacaggaagattcttatacctaactacagattcgaaagtgaagtcggcaaaaggagaatcagccataagaaatcttgaaactgtgcacgctttaaagacacaatacttcatccacaacacacgacttgcagggaaaaaaaaaatgtcgacctgagccctggccaactcgatgagcagaaaatgtgtctagtgcggtgtctgctaaatgataaattgtggccaatctctagtgatcgtagaagacaagatcaagtattccatacctgataaattgtggccaatctctagtgatcgtagaagacaagatcaagtattccatacctgatacagggacaaagacgctgattattcttctcttcagcatccggcctggagcacacaagttgattttctgttctgtggtccttggccagcagcgctccaatcgctactgccaaacgggaaccaccggtccatctcaccaacaaaaagaaacacgaagcaaacgcataagcatgcttacaatcttattcttggaccacagctgcgttcacttgttaaacatttattagtcgaacaagaggaaatatgcataccctgatacccatgagaagccagaccagtgttgacttcctctgcaattaaatagatttctgagcatggaaaatcttgattactaacaccgactgtatatctgaagagtcaccgtttgtgtgtcataagaacagtacgtttttctgtcataagaacagtacatataacatgagaacttcacatgtaactgtattagtttcatttatctgcacagtagatggcatcagctttagaaccacagacgcaagtatcttcagaagccttccatattaaactgatgcaagatgttaatgtcatgctaaatattgcactggagaatcaaaacaacagaaacagacaacagttagatctttaaaaaagacgatggagggaagggtggccctgatggtaacgcagactgaaaacagtcaagtggtcagctgcaaccccaggttatggattaggctggaatcttgctcgtatccccttccaccactcattccaagccaccactcgttcatctcagcccgagctgggccaccacagaaagcaagccctttcctcca

SEQ ID NO: 39230 - DNA, 12243 bp, Oryza sativa
cctgcagcccactgacatgtgggccatgaaaaaataggacccacatgtcagtgactcaactgcatgtgcagttaagtcagaggatctgcttccatcgccgccgcctagcgaaagagatggggaaagagacatatggagatgtgaggaataagatgagattaatatgacatgcgggctctacatgctaactcagctagtcagccacgattaacctaccatgttagcaaaaacttttttaagatgaaaaagatgttataccagttttacggttggagacaatttaatcaggaaccaaagatgaaggagtccaaataaaactattccgagagaaattgctccagtctccatgtccatgggccggcccatcctagcagcgcatgaattgttgcctcgcatcgcattcgatcgagaaagaatttttcagagccgcaagagagggggagacgaaggttggagctccccgtgcttgtcgcttcacgttgttttcgcctgttcaagagagtgttttttttttcactgcatccttatccataaacgtcttatccagaaagatagaaacccgtggttaatctcaagttttgtttctacaaacaaatcttaagttttacgatgatctatattatatcacttcatactgtgatgatggtgtagtttttctaactccactttaggctggcagagtaaattgatttaggcattttagttcacctatattagtgctgcatgcgtactgctggactactggagtgcaaaattgccataaattttgccaagtatgcctgatgtttgtcataactcataaatacacctccaacttttattagtaaaaacataatatattgcccggccgtctcttataaaccaatgcatagaaaaaaatcaaatgttatgtgaaaaaaactactactccctttaatcattaatatatactgttgatactgtatgtcgtttgtcaaattgaaactaatgttaagaacgtcatacattaattatcgaagatagtattgcacacatacaggatgtatatcaaaatttaataataagtgggctacgagtaacagcccgtacgcgcacgtgtggtgtgtgtgcatgtgcgtataaggcatgcttaatttatgtacaaacctatttttatacctcgaggaaaaatgggaaaaaaaacacctgtcggccggaagataaaaattccacctataaacccccctcggccgttcccacctctccccttctttttcgccacccgatccggcaacaacaacgtacgtaacctcctctctctctctctctctctctccccttccagccgcgcgcgcgcacgcacgccgccgtcgtgacgtcgccgtcgcggtcgccgccatggatccgacgccgcagtcgcacccgatcctggcgtacgtgctgtcgcggctcccgtcgctgctgccggtgtcgccgtcgctgtccaccccgcgcgcgcgggacatcgagcagccgtccccgcgggcgccgtcgggcgccgcggagttcgacctcgtcagccgcatgccggggctccgccacccgtccgtcctctccgccatgacgcgcgccgtcgccgacgtctcctcggcgcgcgacgcgctccgcctcctcggcccccgccccgaccacgagctcgtcgactccgcccgcgccttcctccgctcccacgccgccgaagaggccgaagaggaggaggaggacgagaaggtggcgaagagccgggaggtggtgcggctggacgaggcgcacgagtcgtacggtggcttgctgcgggaggcggaggagaggctggatcgcgtgtaccggacggcgatgagagggagggacatgcaggtggtggccgcggcgcacggcggtggcggggaggaggaggccggggtggtggacgacgaggtggtgcgggtgctccgggacgcggaggaagggaaggcggtggagcgcctcctcctcgccgaccggcagctccgccacctgcccgagcagctcggccggatccgcggcctcctcgtcctcgacgtctcgcgaaatcagctcaaggtattattaattgctgatttgtttctgtcattttctgtggttatcgatcgccaacctgcaaaacctgcattgcgttgcgcggttgcgttcgcggatcacgagttcacgtcgtttcagatttagaaattagaagaactgttcgtccgatccggggaattcgggtgatagggagatttgttatgttttgcatttctcgggtagtttttcagtccagaaatgcagatcgtataagacattgcagatgtgcatgccccaaaaataatggatgacgggtagaacgcaatgctggttaattaaaattgtcactgaaagcaatccacttatgagttaggtttatgagaattgtttttgcattttttttttaagatcacgcatgtttatttttgatatcatgattattgaacacgaatgaattatgagcatagaggagtcaaatatggtataaaaaagaaatcattttcttccaactacgaaattgcgcaatatgctagtaaaactgaatgtggtgatgtggtccattcaagaatttctggtttacaggctacagtcccacaaagctagaaaacactgtaaagttcagttttattttctttccatctgttagtactagctattttcattgaatttgcagaatgtcccagatgccataggcgggctcgaacacctggaagagcttcgcctcgcttccaacgcgttggtctccctcccggactccataggcctcctcaccagcctcaagatcctcgacgtctcgggcaacaagctgaggtctctccccgacagcatctcaaaatgcaggtagaatcaaccagccaaggccaaagcacgcatcatcatcatcttcttcttctccccaatggcatccagatccagttaaagaaacttcaattctcgctaatggtgatcatcacaaaatgatccaaacgtacaggtcgctggtggagctggacgtgagctacaacgtgctgtcgtacctcccgacggggatcgggcaggagatggcgaggctggagaagctgtgggtgcacctgaacagctgcggtcgctgccgtcgtcggtgtgcgagatgcggtcgctgcgcctcctggacgcgcacttcaaccagctccgggggctccccgcggggatcgggaggctggcggcgctggagtcgctcaacctcagcagcaacttcagcgacatgcgcgacctcccggcgtcgttcggggacctgctcggcctgcgcgagctcgacctcagcaacaaccagatacacgcgctcccggactgcttcggccgcctccagcgcctcgagcggctccgcctcgaccagaacccgctcgccgtgccccccaaggaggtggtggccggcggcgtcggcgccgtcaaggagtacatggccaggcggtggcgcgacgcccgcgccgaggaggagcgccggggcagcgccgtcgccgagagccccagggtgtcgacgcccaaggagtggctggtgcgcagcgtctcgtcgctgggcagctgggtgtccgacgtcacgaggtacggcgccggccaggacaaggcagcggcggaggaggaggaggacgcctacctccagcagaatctgtgatcggagattacagcatttgcttgctccggtgctttcatccgtatgtacagaagaactactgcagaccgtcgccgcgtcgttcgtttcgcatcagccgtgtgtttgtgtgtgtttaccttcgctgattccttaccatttaccatttttgttgttgttgttttaaccgttttgctgtttaaaacttttaaacccaggttactggaccacagtgcctgtgtgtttgttatatttaccttgctgattcctaacatttttttggaggttttcgtttaaccattttgtgactttgtttgatgaagtgcagtcaatcgagaggccatgaattccgatacggtcaagctcaccatttttgttgttgtttaaccattttcttaagacaccaacgctgctttagttaaataaaagggctctggtattccccaaaaaaaaagaaagggctctcccaaaacgcaaagagagcatagatattcatcacgacagtcaacagcaccagcaaagcaacaaattcttactagtagattggagcaaagccggacaatctcaggtcattcattccaacagcaccaacagggcaaccaatagaacatcgggagaaaaaaagaatgaacgagatcatacaaacatcgattaacatacgcaacatagatcttattaatccatcaagttccagtcacagcagtagataagaggcatagagcagctaagcccatagtaattacacgcagtttacctggcaaggtaaccgctttttaagaggcgcgcacgcgcacttaacacatatctccgcgacaaatataccagtcgcacaacaccacacacagttcataagcaagcaggccctgagactgtagcagcagccccggcggccggcgctagccttacacctcgtcacattatttacgcatatacacacatagttaggttatagatagggatggctcaagagcacacgatcttcactggtctttcttctccctagcgatgaggtccatcacagcccgcttgatgcttcctccgttcttctcgagcatctccttgtttatctcagtgtcctcaaagccctgaaaaggtgaaacaacagctaacttcagaaccttgccaatacattcgtgcctgtgaggctgtgagcactgtccagaatagggcacatgtgatcttaccatttcctgcaactcctccaggagagggtcccattcgctgacgccacagagatcatcgacagactgctccaggttgtacttgttctgcctgagtatctccttgttcagatcgacctgcctaaaacccatttcctcaagttccttcagcagtttctcttctgtgagattgtcaatgccatgatgatcagatgatgatgcaccaacagacgcaggtgcattaccagcaggcacattaacagttggaggcacaggagtcacagcaggttcaggcgcaggctcatcaaagacaggcacaaaagcagcagcagttgaactggagggaacatcaacatcaatgatggggtgaagagatgttgtggaagaaacaatgggcacaggtaatggagcaggctcaggattcttgggctcgtcaatctggtggtgtatcaaatgttcaagtaactccttgtttgtgctattgacatgttggttgaagacttgatccacaggctcaatattgacatcaatcaaattacttgtgtttgtgatattgctttctgggggcaaattcaagtttatagcggcagtcctgttgttactgacaaaagaaggatcctccacctgcagatgcaatcagaatttagatgttaagaaagataggtatgagtgtcaagattctagacctatatggacaaaaggaatggtagagttgacaacctggatgtgaacccaaacacgctgaccaaatttctggccagaaggtgatgctaacctccagtaagatatatacctcccaggccttgcaggtgccacaaaatcaacagcaacatcaatctcctgatcaacaggaaacccgtccactggaatctgcacagaacacaaactcaggtttaatgattttacatattttaaatagcatgcagtctaaactacagtcaaaacagtaaactgaacaggggtcacagtatgcataactacaattagaacagtaaactgaaaagaggtcacagtatgcatagtacctacctctaatggaacataggtctgcagtgcaaactggtcgccaccaacccatataagctgtgtgcccaagggccacatgatagacccattgttatgcatacgccaaatcttagtaaacggagttgaaggtgccatcaatgttccatccaggacagttacatccaaaatgaagcgactttcaagtttctcccgctttgacttcatcgcagcccgtgaatggatcttgcgacactgaaaccaagaaattataggacaaactaattgttaatatattattttgtgtccttaaacctatttatacaaaccagagtacaggatggatgagtttgctaaataatgcatcgacaaacatacacgtgcaagcgtatgcctgtgcactcatgcctacaaattgggtactcaccaatgtagggtctctcagtaatctctggggtaagagtggcttgtcaatcctggtgtactcgacctcattgcccatgcgatgaaagcaggcatcacacaaatcataatcttcttttctgttggcaaagaggcgaagaggagggatgtcaaatactgagataggaaaaagaaactagatagagcaatagctcaattaaaatcttacgttttagacttgtatcgaggcccaacaattggttgcactccacaaccatcacactgaatccatctatggaatgtgcgtgctggtgagttctcaatgttattaccaaggtctccatgcagatggccagaggacaagaggcggccagggtaaggaaaatgtggagaaggtccatagctcattggtgcaggcattggtgggggtggacggctcaggggagcatggggttggaatggatggccagctctgcacaatggaacacgccatctggaatcactattggcttttggatcagcttcagactgccaaatagatgggtaaaatgtcgatccacgtgctggtggctgagaccaatcattcagagatggaattggaggagctggacggaaagcaggagcagcaggaggggtaggtggtgtagcagaggtcataacagattttcccttgctttgagcatcactaattcccttgctggcagatttgtcatcacctgagttcggtaaaaagggggagaacagcaactcctcaatggaagggtataatgatgcctgttgaccttgagaagatttaacacccgatgtagcaggagcctcaactgacagagtcttaagacctctagcaccagatgatttggagttctgcgtgtccaagggttgcgaccccaaacttgtgtctattttgggctcgtcattagttttgggatcaacctgtgtttggggcaaaccagttgaggagctgcaggaaccatcagcatgcccattagatgggttgttgttgcttggtgtaaccagtttaacaaaaggttttattagctcagctaattgtggtgatgcggcttcaagtacttcatgggacagcttcgcaagtgtctcaggaactggctcctggatggacttcatagatatcggcttcaaaacctcatcgataactgatttaatatgagctagtgggtcttcagtggtggtggacctgagaggtatattatctgaatcctgctgtttggcctgaggtgctgcagtgtggctgttgtttaactgaacattaatcctgagggggttcagtttctgatgaatagcagcatcatgcagatcatcatcatcatccagcatgacaatatccccatcctcatcagtgtaagtcagaatgaagtcgacatccgaaccaaacttaaaagcagatgcaatcttggaccggagagcggataagttcaggctgaattgtggtccttgcacatacccaccgaacctcttaagagtttcaccatacttcacctgaaatatgtgaaaagggataatttgagaactgctaacaacaaaatttgaatcaaacaacacaaaacacacgaacaatgaaagacaatgtatgattcttaccatcaagaaattaaattggactagataacacatatccaaactgcattacatatttataggaagtcagttgaaagaatagttgaagatccatagggtccattcagatggtagaggatttagtttaatcacttattttttgtgatgtctactattctaatttgagcctaggatagtaagattgaattattttcatcagttgccatatttccttgatgcaaaaatatatctgttgcaacttgattaagaaagaggaagctagatgaacattaaaatatgaaaataaaaaggagcagtgaaaacaaacccatgctaaggctcaatgactttctgcacttggtctatacaataattcattgtgggggtagttaatttctcagacagactcctatggtattactgggctcctaattgaatagatgggtttagcccttcctttgggcaatgtttctccaggcatcaccggattcaggaaaaaggttctatatgaagtgtacaataacgagggcatcacttgtttcatatatatcattagatagaatgtagataaactgtataaggtaatagtatattaaaaggcaaaatatcctagagaagttttggttattttaccaacagtggaactcaaaatatactcgtgtgtttataaagcaagcatgaactctgaaagcatagacaaactgaagatgttaaatctcggtatctcagctaggacaaaatattggcccgatttcatttcaaataacagtaatatcataatcatcgtacctatcaattagaaaaaggcataacaacagtaaaacctacagagtaaaaacatttccacagttgaacaaagtgcaagtacattctagattatcattgtacatgtgaaagttacacggatttgaagctgaagacaatagtttgcctacaaatggtaagatgtattattacctctcccccatgagctggaggttttagaatttagattagccatatacctcactacctcccctggcccagggaatatttaatcccaagatcatgatcccactagacaaataaattcctatcaccaatcaaacagggaacttcacactagcagataatcgaatgttcaagaagttttgaggtttggaaacattcagaaagtttgcatgtggtcgagtacagtcaagaagtaagcacatgagcatatacaagtgaggccataaaggaaacaaatcacaataaacatactaagcacggttgtacgtgaataattgcatcaaaacaacaagaaatatactcagctcaaacatacgcctaagaaatggtaccagaccactaataattgttaggagtacttattaaggacggctgaattatttttttctgaccaatacccaacacccatcagaatggtaaaagaatagaatacatcttagaaactgaactcatgtaggagtatgatttttgttttgtgcaaaaagatgaaggctcttcttttttttttctttttttgattagtttaacaccaggcaggcgcgcgtcatcaacagtcggaggaatcgacattcatcaaaacgagctgacgattcttaaaaaaagaaaaaaaaatcagaccagggcagacctctaagctaacaaagagtaatcaaactcccctaatttctcacaggccaaaaaaaaactaactagcgtacacaaatcccgcaacaccacacatttcgtcaatcaaaccctacgaaaacgataagtacgcaagccccccacgcttcccccaaacccccaccaggagcgattcccctttccccttccccttccccctccgccatcccctccccctaatcacaaaacaaaaccacagctcaatcctgaaaaatagacgatcatctcaccttgaggacgacgtcccactcgtcgggacgcgacgcgagcccgtcgtacatcggcgagctccggccggacatcgcgggggtgcgggcgtgcggcgggagggcggaaacccctcaaaccctcaggacgcggcgtcgatcgatcgcgcggaagagcaacaacaatcccccaacagaagaccaaaccctagatcgatcgaagagagcggagccgaggaggaggggaagagagctgcgtagccgtgagccgcagcggcggaagagagcggtggtgcgagagagagagagagaggaggagaggagagagtggcggtggcgatgcggccgagtccctcctcgatgcccccccttttatcgcgcaaaaccgtttccttcgatgcgaagcctgggcgacaaccagagaagacggttgggccattaagtcggctgggggcccacgtgtcagcggcgcgggccacgctcgcgggggagccgtagagggggctgcgtgtaaaaacccccacaggggtatatgtgaaatttattacgtgtaatgttacgggtgagagtgtaaaaactcgtgcggtcccccatccttttcctcccgtggggcccacggtggggcccacgtgccagtgacgagaactggataagggggctctggaatatcctagagtattttaatcctgccatcttcttttcgcgcaaggccggggagagcacaccgccggagggcggcggcctccgctcctcgcctttggggtcgcacgagggtcgctgacatgtgggcccggtgggatctagtataatcctcgcatcggtatttcgtaggagtattggattgtcggtgaggtgtgccgttttgtttaatgatctgctgctagctcttcttggcgtgtaagttttggccttggcgtttgacgactaggcgaaggaactttggcgtcgccgtcgtcgaagtcgtcgaggatgacgacgaattcgggtgtgttcgccacagcggagcgatatattagcacatgattaattaagtatttactattttttaaaaaaatagatcaatatgattttttaagtaactttcgtatataaatatttttttaaaaaaatactgtttagcagtttgaaaagcatgcgcgaaaaataatgagtgaggggttggtgccgaacacatccgcaccgggtccaggactacgggagtggggactagtctcatagagggacgattggcagacgtacggttgtgttcgggagtgagggttgggtactagaatgcaaaacgaagcagcgtttagcacatgattaattaagtattagctaaaataaatttaaaaaatagattaatatgatttttcaaagtatacgggatcgactaaatgagtacggcaaacgctaacaggtgaagtcgcagatgacaacacgagttcatttaggttgaagttgggggctactgtcatgattatggataaggcatacctcctatcttaggacttatggaatatatgaatacggtataccttcacgtatacgggttgtttccgtatgctctaagaaaattcatcagatattaaggaaaatatccttacgagtcgagagactgacaaagtcctactcggtagggatagggtccttaccatattgtacggggtctgatgtcgatctgatgtttctgagttctacttggagatcaagatgacctacggtacaaaaggcaccccctgggaggggttcaaggcatcgaatctcaccgccaacacacccatcatagtctacgaagccatgtatgagattcgaaggcatcgaatctcatagcacgtgaagccaagtcaccatgaggtctcgtcgaatccatcgactactatcccatcggtatcgccaaattcatttgttcccattgtactttgtggttttttcatatcaatcctatataaactggactagggtatgttcatttcttctataagtagaggataaaattttagatattcgtggcacgcttttcaaactgctaaacggtatgtttcgtgcaaaaactttctatatgaaagttactctaaaatatcatattagttcattttgcatgtttttagtaattaaaactcaattaatcgcacgttattactatctcattttgtgtgaagcatttaatctttatcttcaggagattcaaacaccacctaagactattacttgattaggggcctgaaccggtataattcttgtctttgtgtttgcttgatatcatatcacgtagatactcgtaccaacgaaccctaataccccaatcatccagtctacgggtatcgacaaacatttttatctctgtaataactcattcgtttgctgcctcgattgttatcagaaaatcagatattcttccatcaattcagacttatcaaaccgggccttagttcagcacactcaaacctcacgctctcttgggcctcttacatatagccagaccgaaaaagtacaccgaaggtccctcaacttgttatcgagttacaaaatcgtcccccaaccgtaaaaccagatatccggcgtcccttaactaatcaaaaccggtcataataagcctttcggtggttttgacccgattttatcctacgtggcggctgagtcagcgtgtaacccatgtggggcc

SEQ ID NO: 39231 - DNA, 8348 bp, Oryza sativa
gtagatggagtcgtagttgtggaggaagtcaagtgtgcagtcctttccaaccgcccgcgcgcgtgccgccccttcctgcagccgcgcgcacaccgctcctccccctgcccgcccgcgcactgctcctcccctcgtcgcccgcgcgctgctcctcgccgccgacgccctcgtcctccagccggctgagtcagagtagggagagagagatgaggaagggagagaagaggggaaaagagacatagagcgaggaggctgacgtggcagccccgacatgtgggtcccacgctgactcaaccaccacataggataaaaccgggtcaaaaaaaacatcaaagaacctattatgaccggttttgatttacgggacgccggatatctggttttgtagttggaggacgattttgtaactcgatgacaagttgatggacgttcggtgtactttttcctagccagacccaagaaagctattgggccgaaatatatacatattcaccctggcccgcttccgtccaccactctctctcgctgcactgtagtcgccgcaacccagaacagcggcacgaaaccccgaactccctcccccctcgcgccgcctccctccccgatggagcctctgcaggaggcggcggcggcggcagccggcggccgcaagcggcgccgccgaggaggcggccggaaccgccgaaagcaccaggcttcgtcctcttcgggggcggcggcgtcggcgtccccgccctcccctcctgcgaagcggcagcgcggggacgacgccgcgcccaagggacggggcagcaagccgaagcccgcgagcctcctcgacaaggtaatcggctctccggagcagaggtttgcgaggcctaggcgtgtattggtaggtaggagcaggagtatatgccgtgccagtagcaggagtcggtggaagtacaaaatgttcggggtggtatcgggaataaattttgactagggttgatgggttatttagtgaatctggatgatctctcagtgtgggtgaagtcaaagcatagggtgcctcctctgttattctttagtagcgacagtagaagtgccaaacctcagtaattcagtagtgcttcgtatgctcttatgcatggttgaatgtgatacattgctctgaatttgcacagtattcacattttctttaggcaacacagtattcacgttaggcttttatttgctgctccttaataatttaataacttttgcttaaaaaacaaaattaatgaactagcctgcagtttggagataactcatgacttattatatgaatgttttacttattttaccttctgtttattctttgaattttttttctctgagctaattagttgatatgttttttttatgatgtgcactctagatgcgtgcaaggttactggtggtcatttcagaatgttaaatgagaaactatacacttgcaggttcgaattcttctccagataacactacttttatgctaatgatgtgctgctattattgaatgctttacattatcaatactgtattgaacagtcttcaaccaataatgaagtgtaagaacatgacgatactccaaatttcgtatgttgaaatatccacacagtttgtagcttacattttgtacaaaatactgctatctttaatcatgctaagagatagtgacatgcatcaatcttaaccttcatgctttgtctgacccggtactgttaattattggtcatatcaaccggtatgcctgaaaaacatggattgccctctcacgtatgactcagaatattctaaattggagttcctaatgtggcttcgactttacccttggaaactggaaatgtagaaatcactaatcagagcttcatttttgcaatattcacacttttactcaaacattgtttttttttcttttcagtggacaagatgcatttgactacttcacaaatgagcctgatctttttgatgtggtatgctatgcacttttcatccattttggtaatcttattgtttgctagatgaattttatctttgaagagtatgggcaacaaattttgaactctgggtggtgactttttcatatcttacctcatcaactcttcagtcagtgccttattgtttgtacctctacagttctatctacacaaacctcatgctgttagttgtttctttcttatttgaataattatttttgtgtattttgtgggaggaaaatgtattgcagcgatcgatatgcagggactttttgcattgcagcaataattgcccctatggttcataccacctgatatatggctgagatttcactttgttttcttttagtatcatgcaggatatcgagagcaaatgtcgcattggccagagcaaccagtaaatgttataatcaattggttgaagagtcatagtgcatcttggacagttgcagattttggctgtggtaagaatgctaaacatttactctcaatatgccgacaccttttcacaatgttttcctttttatttccctggcataatcatggtaatacaattgacatcttgtctaggcaatgcagcagtttctaaaaatgtgaagaacaaggttttctccatcgatcttgtttcagaggacccttcagtcattgcctgtgatatggctcatgtaagcatttaaccatatcttgtatggttgtacctctttggtgctttaacgtgttggcatgttgtttatgtgtgttagcataaatgaacaaagtgtttcttggttcatttccagtttagcttcaggggaaattctggcaattccttgtcagccatgtatgctctttttccatgattcttactaagcttcacaactacactatgtgtcattacaaaatgacccaactttaatcctccaaatattggttatattcttgtgcaccttgatttcttagtgtgggttccacaatttatctttcatgattccaagtcattacatggtcaatactcttttagcattgaatttttctgatgttaacatgttgttcctgtgttaaaaatagaagccattatggtcgatactcaaatactcagtacactcatgcatgaattacaagtaatgtaagtatgtgtatgagggccaaaggtaaaagcagctggccagttgctattcttacaatggaggtgcattatcaaccaaaaacaatttctgataattctttaatatgtcacaagaaggaaataaatcactagctttgggccattttaaacatagctcttgggacattctaaacatttttcatgatttccattatgtgcaacatatgtaaaacaactatacgaaataaacactaaaatatctgttttttttaattgagttgttacttaaactaaaggctttgttatttctgtagactccattggagtcatcctctgtagatgtggcaattttttgtctgtctttaatgggaacaaactatccgagttatatagaggaagcaaaccgagttctcaaaccaaggtttgcccctaatgattagctgctacacttctatgacaaagtatgtgcttccttttttactattgatacatttgtttatgcagtggttggcttcttattgctgaagtgaggagtaggctagacccaaacactgcaggtgctgatcctgataaattttgtgaggccatcagcaagcttgggttttcccttgtttcgaaggtatacttacggtttcttctacctttttctcaagtggactttggggctgtttggtttgttgccgtttgtaaccataccagctttagcggtgccaaaatcagttaagatagaggtatatatggtgtgtttggtttgatgccttgcctaaacttttgacatgatgttgagttaggaagtttctagaattaccaaattttggtatggaggatatatgaggtaatatttggtttcccaaagccaaaatttattatggccgaaaatggtaacaaaccaaacaacctcttagttacaatgagttaattttatatagtgaagtcctagaaggaatgaaggattataacataatatggcgatgtttactgatgtccaaaccaaaggctaaactcctgaagcgcatatgtgaaaaaggacatatcatctattagcgaactgatggaataacgacttgtatatctcaagaaaaaaaatctctgacttcttggatgttgggctgaaaattagcttgataggattgggtgattattatatttatcccatttcataattgaccatttaatatggtcagaaactgaggccattctggtccactggtttgtgctgatatatttgttactatttaatctatactatcgctcgatgatatatttattactatttaatttattactatctctgggcatcactaaatgttcaaagccatgatgatgttgcttttagtgcagtagttaccgaacaataggtcatattttcaaacatcgcatccttaccatgtacttcagaaactaatatgttctttgtgcccattctctctttgtggtgatggtatctgaaatgtttcctttgatgtacccacatgacggattcccattttgtgtatccttttcatgtgtggtacttattttgtgatatgaaaattgttctgtattgacacaagactgttctgtgcgaaaagagaacagtgtcatcatgtttcctaaattggcaattggttcctttctgtaggatgcgaaaaacaaaatgttcattctgttccatttccggaaaaaggtcagttatgccactgccgtaccttaattgcacttgaaaattactctatactttgatcattgagagattattgttcagctatagtctggcattgaatgctgtggtttcacgtctttgcaggaaaagagtaaggtggtcaaaaacatcgattggcctcagttgaaaccttgcttgtacaaacggcgatgatctcatccattgataactgtaattgtactagacctcttccaaggttctcttaaattaagttgttgatgtactctatgttcccttatctcaggcttatctgtttccgttactttctctttttgttgtcgcgtgattttctttatgcaattatgcgttggacctcaccagacaaaggcctagtcatctagtggcctgtcgaatgaggtatgctcacagggcagagtataattctgaatctgatgcatatcctgcgtgagccttgtactcaaactaaactagcaagtaagattagcaacttacgaatgcaccaatgtgccattttgttgctagtaactgtaacctgtaaatctcctagcttaacaacgtggttgtctacattgcttctggacatttttcttcctgcctttttgacttgtagaacgcaggcttggatcggtattaacgagtgaccatcgctaccgccatggattacgaccgcgaccgatttgcctgactgcctgccactttctggtagaaattttgttccttttcctgggtgggtcaaagtcgtctttacgtctccgactctccgtgcgtgtggttgcgttgcgcatgttgttttcagttgcagacttccagtagcatctccgtgagtgtgggggcgaaatttgattcgattagactttggcgtgccatgcttaaatcgtaagcaaaaggtatcattttgacaattatttggagagatttggtcatatcctctccctagattgaaaattgaggatttatactcctatagcgctgacacgtgagatcatctaagattacaggcatgtgggacaagaggataaatccttaaaatttagggtttgaacgaatgaattaactagttataagtagttaaaaaattgctttagaaaactatttttaaaaaatcatatagaaatatttttgtactacctttgttctaaaaataagtttatttttcacacatcccacacatactaattaaaaaaaagagagactacaatgcttttattttattaaatcataatgcaactatttctcactttatcatcttccaatacaattattccatactttcacaatttctgatgtaatgattactttaaaaaatgaacgtatttttgggataaaaggaaggagctagagatgaacttaatatgggatggagaaagtatgaaatacactatttgaaagctttaaaaacatacaaacgaaaatccaaaatcagagtcaatagggccggagggcacatgatcagatttcatagctcttgccactgtacttgcattccttttccgaaaagaacaaaaaaaaaaacaccattggggcacacgtggcacgcgttagagcatcgaggcccacagccccacactagagaagctgccccttctccaacccgcagcgaccagagagacagctagatcgatgttgcaaattttgcaatcgaaacgatgccctggtttttgacataagtttattttaagtgcaggcttcttctccagcccagaactggcattacaaaattcggagcagataaaatacacatatgaaccccacgggtgacaccctaatccccaagatccgattgtttaataaccaaactaatcatgctgcacagtgattagtccctcctaatggagcatcagagcttagttcgatctgacaagtgccccctgtcgacagaggcgagaaagcatcatcatcatcatcatcattatcatcacaatcatcataccaagtgtacttacactagtactggtgtaccactagcatatactactaataatttaagttctttttaaccaggtgattagccaagataaaccgtgtactaataatgcaataatttacaggacacggagctctcggcctcaggctgcttcgtgccaccttctggcttcatgtgccagtctatctgcatctccatccatgtctatcgctggtgcagagagaaggtcacaactcacacgcgcaacgcctgcctacgccctcattggccggacgcctgggctccagacatggacaaatttggttagcctgtggggtccctgtgaccctaataaacatcggaccaagcatcattagatcagttttaggcccctttgaatcgcaaaattgagaaaacgtacgaataagaaaaacgtaggattttgatagaattgtaagtgtaaaacagaggattgcaaaacgcaggaaaaacacaggaatgaccgtttgattgaaccgcaggaaaaacgcagaaattagatgagagagagactcaaaggaaagtaactaagaggttgaagctcttgctaaatttcctccaaaatctctataggattatctatttcataggaatttcaaaggatttgataggattcaatcctttgtttcaaagagcttcataggaaattttcctataggattgaaatcctccaaaattcttatgtttttcctccaattcaaaggggcccttagttggatttttgtttctctttgttggtacattggtcttctttcagatgcaggggtttgcagtgtggttttgcatgaattggtttactttctgtgaaattctcggaaaatttctccgttcagaaggagaaatgtttcgtctacataccgcaatagtagatattaaaggacactagacatcctgtatgtgcgcacacacaaatgacacattctctcttggtttggtttagggcttgtttagttggcaaaattttttggcacggacatatatttaaagtattaaacatagtctaataacaaaaataaattacagattccgccgggaagctgcaagacgaatttattaagcctaattaatctgtcattagtaaatgtttattgtagcaccacattgtcaaatcatgacgcaattaggcttaaaagattcgtctcgcaatttcctggtgaactgtgtaattggtttttttttctacatttaatactcaatgcacgtgtccaaatatataatatgacagcgtgggaaattttgtttgtgggaactaaacaggcccttatatactgccgattactcactgcaaagaatcactactaggagtaccaaattagccaaccttactttaccagcagcactagtagtactgctacattaagaaccatccctaagaaagaatcattttttttagacaaggatgtggtataaaaccattttcatctaggtgatgtaatgtaagatgccaagataaataatttattcgcatgcatcatggccccaatgattatcattttagcgaaaccaatctgacccattccatgccgtgtttgggcggttttacagacttatctttccgtcctttgaatatgtgcagatcttagggcactaaagtaatcattttccacctattgtttctctccacttttaatactcatggagttatatttgttccagcatttctgttttaccccatatctgttaataagaattattctcctt

SEQ ID NO: 39232 - DNA, 2739 bp, Oryza sativa
acttgtgtttatgatatacttttctatcgacttgcaaaaacttctaaaagttgagtttcttaataaccttaatgtcttttgatgcgctgtacgcgtgccatatgctatgcttttacaccaacttccaagttttccctaaaagctgttcttctatttaagcgattagtggggtcgtgtgaccccacgggacccaaagtggatccatttcgacggggatggaatctgggagtgagttctatgcgggcgaaggtctccagatcgaccccaagtggctcatcgacccaaagcttctctttgttgggccacggattggcgaaggtgcacatgcaaaggtctacgaggggaagtaagtctcatatttttgcactgtcatctataatttgatgatctgtgtgaaagttttgcttctaaattaatttttgattgatgctgggattggcaggtacaagaaccaaaatgttgccatcaagattgtgcacaagggggacacccctgaggagatggtcaagagggaggggaggttcttgagagaggtgactatgctgtcaagggtgcagcacaagaaccttgtcaaggtcttgatctttttgttgactcttatcatttcttttcttggagtggcagttgtggatgcttttgaatgttgaaaatgtactcgcttgttgttcagtttatcggggcttgccttgagcctgtcatggtggtggtaactgagctactagtggggggctctttgcgcaagtacttggttggccttcggcctaggagcctggagcctcgtgtagctgttggatttgcgttggatattgctcgagccatggaatgtttgcatgcgcacgcgatcattcatcgtgatcttaaacctggtaagattgctatttggaaacctggttgcttcatgggcatttacatggtggatttctgcaatccggaataataactattcattagttcatatacaccatgaggtcagacagttgcaggacttctttttgtgtgtgtgtccttgggtgttgggggcatggtccattcctgtgcataatcaatttcttcagtgggtactcatatgtcatcttgtatcaacttctaataataatttgaatttcacacagctgtttgccaaaaaactaatgttttttttattttaatattacattaaacattctttgtggatttaccccaccagccaaagtcacttgaagattcaagacaaataaaatgttctcattagtaacataggatgagaattgagaatataatctactctggctgtctgacctattatgtaaagttaagcttcatattgcacaagcaatgtgcatttttcaagggcaggaatgagctcttctttttacattcaatcttattaagttatggtgaattggtgatgtttggaagttaagtcaaaaggtagcagtgtcaatggcttgttcctcttttcctgtgtcctgttgtgtctgcatgtgatgctattatgggctagtctatttatgggaactaagcctaaataccacaaatagcactaattgtgggtgtaatggaagacgagtgcaggggagcaggcaatctatattgtttgtgtatgtttgtccaatgaggtaataacctcaatcagcaaatatagtgggggaaggaactgattcaatctgtcataccatttttctcttcattctttattattgcatggactggtctgcaatgatggagatctgtctagatattcatggcgttgattgggaaatttactaattatagaaaaatgtttcaagataataatgattatacagctttctgaggatttcttggttgaccttcgatggaagaaaccaaatttaagtccatcttgtactatgttttcaatgaataataatgtggatgaattagtaatgtggaagattccaagtacgaccggcatatgatccattagaggggcccttggggggcgggcatcttaaaaaggtagcttcagttctgaccttctgatagccaccttccaagggcggttccttttggaaagaggtggttctcccaaatggtttattattgtttttcggtttaagatataatagaatctctaagcatgctaagtttatactgtatagtgtatcaagtagcaaaacattcaggacgggtgtacctagtgcaaaagtgaaccagcaactagaaaaggactgctattatttcctctttcgataaaatgccaggaaatattaatgagctgaacatcggatgccagtggagtactactgattctagttcacgaatcaatgcatagctctgttattcaaaaaacagtactatatttctctactgtaaatttacctaatactatttggtgttttttttcagtattttcttttcagagctatttttttgaaaaaaaatcaagccagaaatatttgtacaaataaggtttatcatgagccattgttttgtccttctgtacgtacagagaacttgctgttgaccgcagaccagagaacagtcaagcttgttgaccttggtttagcaagagaagagacattaacagagatgatgactgcagagacaggaacataccgttggatggctccagaggtttctgttactgcagttcatatttgtcaatataattcttttttgtcaatatttgctaatcctgaaatatatccacagttgtacagcacagtgacattgaggcatggagaaaagaagcattacaatcataaagtagacgtttatagctttgcaattgtgtta

SEQ ID NO: 39233 - DNA, 2090 bp, Oryza sativa
  unsure (1)..(2090): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggttttagcaaggagaaaagagagtgagtctgcaaaaactatcattattggagactgatgtaagaaaaaccggtgaatgcctgctctttgctccggtgctcccgtcatttcgatctgcttttacaacgtctctgtaatcagcaaatcacaaattaactaaccaagaaatcagtttccaactaaacagtagcgtatgtgttgtctacctcattatctaaaagatatatttctattgtctactttctttctgttcttttgttgctgttgttgagataatgatatattgcttgcttccattgcatcacgccggcatctgctactcttgctgccatatcggtctcagcatcactgtttcgcaactggcacgaaatgatacatataatgcagcgttatcacacgacacgtaatctccagttctacatcatccaatcagatcagatagataatcatcgcaaaaggcatgtagcccagtggttacagtgacatgagtagcgctccaagattttaagtttaaatctttataggaacgaatttcatatcaagttgtttgtgtaaaatcaaagtgtttatgattcttattctgtgatgaacaattggcatctgtaattattggttttgatatttggagattattggcgaagtggttttggagatgattggatttgcaggtgttaaataggtgctgctagagatttgggtccggtcagaccggacatgggttgttggtcagaccgatgtgtatcgagcggttagaccggccgactctgtgtcggtttcggtttcgggttttttgtttggatatccgtggatgtttcatgtttatggcttctagatggatactatacgtatgtaatactattgtttgctgacaatgagctaagttggagatagcttggtctcggaatatggtttctttgtttgattcatgtgtaggtgacttgatgcctcgggagagtagtgccggtaatggatcgggagtcgacttggagataaggcaatgtccggacggacagatatcatgcgggatacttaggctagagttcaatgcacgtggttggtgaagattccatgccatatgatggagatattgtgtgcgtacgagatgcggagtcgaatttggaaggagtccaaatttggtatgtttggagtttgtaaaatttgtttcttgtacgggaagatttcctaggtagattaggacttcctgtatgagtttggttcatggctttagactatctacctcatgtataaatagagagggagcgtgaggcatccccatatcgcttttgagagcattgagttgatagttgagttagggtttcgagtttagtcgagattttcgtgaggagtgctgttgttgcactttgtaaacacagagagaagtaataaagttgtcatctacatcaagagttcttcgatttgtgtttgctcgggttcggcagtctaaccggcgagacaccagcggtcagaccggtggatcacgggtggtcagaccggcggcggtttcaggcgacggcagttgatctcggcagtttgaccggaggatcaagcccggtcagaccgacggcttccaggcggtcagaccagcgcgtctacttcggtcggactgtgtttcgtcgaaatttagggtaacttttaattccgctaaaagttttggtttttgggtataccaaccattcacctccctctggttggcttagctatttctattcgatcatacagtttgatggcatatatcctgttagatgtaaagtccgagtaaaaatacccttcaccaaaaaaaataagaaaaaagataatcatcgccactaccaccaaaacaaacaatgagtgtctccacaaataatcatcgctactgtcaccaaaacaaactatgagtggctccacaaaattat

SEQ ID NO: 39234 - DNA, 3213 bp, Oryza sativa
caacgagccaaagtggcatgtgttctaccataagtgcaggagatagctttggatccatgtactctctacaatatctcgtggagctagggagcccaaacagggacagggcaaccagcttggatggaggatggtggagctaagcgtacgtgcgtgcagacgtatatatcatgacccagatggctccacctcaccagcgtctaccgatcggacccaaggtccaattttggtttttccttttccttttccttttcctttgcgattttgcgcaggaaatgagactctgtgtaataatgttagtgggggcattttaactgtacaggtaatagagtcttttagtaagaaagcccatgtttacagtgacgaagttttatagtgtttgagggtacacatgaacccccaaattcctaatttctcacttaaaaagactaaaatatacagtgttgcactgaaaatttctagattctcaatggtagcgcaccctcttattttgatgctagcttcgcccctgtatgtttggtaccctaaaaaaccaagggaagagccaagaaattctcgtgtgtagggatgagctaataaatagaagagtgaatatttttaaaattaaatagtatttttattttaattaatgccttagctgttttatgcatgtcttcacccctaactatgccttgacttgcctaagtggtggtgggtgtagtgtgccaccaagcgaagagccggcttggagaaaaataaaggttttcttctcctagcgtctgtgttgttcgctgctggggggagtttggaactaaactctccgcacgaaaaacagagtaattcattagtacgtgattaattaagtattagttattttttttaaaaaaatggatcaatatgatttttgtaagcaactttcacatagaaactttttgtaaaaaacacaccgtttagtagtttgaaaagagtgcgcgtggaaaaagagaggtgtgagttgggaaaggggattctcaacacacccttagtagcagattgaatacgtccttacacatctcaaagagactcatctaaaccaggtcgaatgatacaagccagacttgacttgaccctttgtaggaaaccaaacgcatcttactgtgaggggggtggctaagactttttttttttttgtgtgcatgaacttgttaaagacacgcatgctggcaccctttgtcgttccacatcagatgagtacttggtttaagtatcattgtataaaaccatgtaaagcacatatagataattatagatatattcttaaaagtgacataaatgttggtgtggtcatgcctagtctcgcacgtacaccagatatgtatgtgcacatgcacactcttgtcctttgtgcttttcacagataacagctatggtccaggaaaacaacctgtcaaggtttaattttgccaggcatcttccttgcaaccccacaatagttaacctcaggggaattaagttagggtgatacaaaatgcaattatgccacctaattatgtttcgtcccttcttaaaagcttggattaaacttaagctccgacaattttttggcattttttttgacttgccatgctggaagcttgggatatctagctagcttagcccttgaatttgtactagcgcaatgcaggttggcctcacttcaatgcttgtgaccaccgttttatatctattgccgatttatttctctttgttttttttaattttgcaaaattaatttatctggtcgtatctagttgcacgtacgtacactagtacacaatttttctttcttgtgcacatgcactaggactgtacttttgcgctttcacggataattaaactataactaactgaagaagcaaacagatacaagtacaaacgagcctggaaaacaacctgtgacgagggctttgtgttgggttattgcctaggatcttgctaacatctccagaataattaaccacaaaaaagatccataaacaaatcgccagaggccctcaatgatgccgcttaatcatgcatgtgtggtcctgaacccaattctggagatttatgcctttgcagctatgctgtctctgcatcatgtagtacatggagagagagagagagtgtgtgtgagagagattgattgattaattacctactcagcaagtttaatagtatagccaactactaactccaaatcatctataactatactaatgtaatagccaattcatataatagttgtttactatactgtgtaatacctagtcccatctatcatacacacattacatgttggagtccatgctgcagctagctacagatttatagcgtgctactcttctctcttttcttttatctctttaaaatatatttatagcgctattgtacctagtctaagcatgtagtagtagcattgatgcttctagtcgatgcgatgatgacttttttttggttggttgcaaatgtgccatgttgcctgtgcacacttgtgcatcagggttaatcaggttgtcgatctgcgtctccctttgccttgtgtgagattgtggcgttgctcgcagcgtgtcccctgtgcagcaaggcaagacaaattatgaggtcatttgattaacttcccagttgatgtggcgatgatgtggagtgattaatttgtacatcgacatccacgttatttgtcggcctggccgctgattaatgccatcatcagcacgtcaccaggtcggggtaaagcgagaaatctcagcagccacatggatataatataagtacgcccatatatatgtcactgttacgtgtgtaccatgtgaatttatgagtaccatctgttgaacataaaacagatgaaacgcaatgctattttcaattgtgcgattgatttaatatggaggtcgatataatctatggtcaattaatttatctagttaacgagaagagtcccgctcttttttttacctcatgaacgtagaaagacattattgtcaaagaaatttctagagaaagaataaaaaaatatttcgccaatcacaatatctgacggcctaaagttttcggaatagaaatggacagtccatgtttagtagatgacgtgccttattattttatttaaggaaaattagttttttcactactttagatatggcagctcccctccatttgtgtatagataaataagctcaggtgaaaaaaattcctattcaaattaagatattattattgtagacggtgggatatgta

SEQ ID NO: 39235 - DNA, 1835 bp, Oryza sativa
aaaggccggccaaatgtgtaaacagtatctatattcccttcgaaaattttacatacggatttaagcgtattgattagttaagtattaacttaaaaaaactttaaaaagataatacaattttataaattaaacaacttgattataaaaacaattttttttaaaaaaaattactcattgtttagtaatttagaaacatacacgtacgtaagagacgtgaaagtagaagttgaaaaagtgcaacgctgaacatcacccccacggctagggcagggccaggggccagagagccaggcagccagccaccacgttacgtacggctcgtctgcatttccgcaaaacgccgacgatgtgtcgatcgatcgctgcattgccggtggtcctaaaaatcccaaccctgctgccctgcatcccatgccatatgccaacccgcacgcacaatgattccgatcgatccatccatccacagcgcgcgacgcgtacgtacttctcctgatctgcacgatcgatcgagctgatgagcaacagccagcccagccgcgtactgcaacaactactatactatccctctcgatcgcacgtttcaccgggagctggaaggtgagtgcgatcgagcgtcgcaacaagggaaacggccgaatcgatcgatcgatcgattggttgattattagcgtgtggtgatggcgcatgcatgtcagcatgtgtgtggctggctgtggttggctggctttctcagctcgtcgtaaccggagggataggttgcagctgctagttgctgcctgtcctccctgtcgactgtcgatcgatctgggcgtcctatagcggacggagcgtgcgtgcgcatttgttggccgcatgccctgtccgccggctgtcgatagatcatccaaatgatcctagtaagttaacaccggtggtgttcttttctcttttaacatgaagattaagttttttataaaaaacgagatgttattaacgtatgattgattgagttttaattagagtaaattgcatcggcaatacaataacttgtcaggtgggtgcaatatagtgtatgaacttgtaaaatgctcgttttggtacatgaatttatcttgtgcgtgcgaaataaggtcaaaaggacattacatgactaattttgttgatttatgtgctgattaggatgctacgtaaacacacacacacacacatatatatatagtgattgcagagaaagatattaaaaaccgaacaatgatacaagggttagaaacatacgaaattcaaaataaagtagagaacaaatttataaatatagcatgttttatgcatactcactatacgtatgcacgccatatcctaattaacatcacctaggtggaattaaccttggcaagccatgttgaacctagttcacacggattagataagtttgtgtaccaaaacgagcattttacaagttcatatactaaattgcacccacttaataagtttgtgtaccaccaatacaatttactcttttaattattacaaacttaaaaaatagattaatatgatattttagagcaactttcatatagaaagtttcgcacgaaatgcaagagtatcagaatcacattataagtgattctgatactcttgcatttctattattaatgttttacaattaaatctcctccttaatacgaaacggtaaaaaattcatacagttcgaacaactactacaagaagaagggtggagagcagattcaaacaagagagaagctgctaatacatatatatatatatatatatatatatatatatatatatatatatatatatatatatatatatatatatatatatatatatatata

SEQ ID NO: 39236 - DNA, 23711 bp, Oryza sativa
tgccataatataattagatagtgtattcgaagtgcaatgttataaatattgtaacattttgacgacacttttcacttatgcaatatatgtatatttgttaatatcaaatgttttttagttactaatattttttatgcatcaattaattaattatttggaaaattatttatcacaaattattattgtagcatttttttaaaaaaattttgtacctattttcgcaggcagatcaatcacattttttctggcgcactgaatctattttcctaggcggcacctctagctccagttcgcctacgataatggtcttactaggcggaccgccggcctgcctgcgaagattgtgaggtataggcggagccagcgtccgcctgggaagacccatttcccccgcctgggaaaaatactttttctagtagtgcatagagagagtcatccaccattcaaggggcaaaagataaaccatactagcatgatagcaatataggatctcacaagattgttttgctgaggtgtatatatattctggtgaaaaattttcctctaggacatgacacatcctttgaagcaacattgggggccaggggtggatgagcctgcccccatgcatgctagtgatgagcaacaacaagttaaaggatcatagggtggctagaaaaggctgcccatgctgacctgttcttgtttatagtggttgctgacccaacaacatttcgagctcgaggtctcatcaccaaatcatcatgccgcggccggggcatatatacccctcctacacacacgcgaagacctaacaaaggggatctttcaggtaaaaagaagatgaaataataatatccgcggtgcatttgattccctcctggattttccatgcttctttgttcctctctctctctttctctctccctcttgggtctcttcaggatgcaatttttctcaagccaagtggataacaatcataggcctgcttctcgatcgcgcattaaagaaagggagatatatatagtgcatggtgatggcctcttttgctatttgtaccatgaaaactatgatgtgcactattgtcataagagatgctgatttcagtgaacacaaatatatacattttcaaccaatgagatgcttggaaagaaaaatattgtcaactcaaagtttaaaatttaaccactaaagtgactacaagataatcttttgtctataccttaatttttgctaaacacttggaaattcctatattttagaatggagcgagtatacttgcaaaatcattttgtcaagtggttttacggtccttaagaacacaccataaggtacaattatttttagtattatttttttaccttattaacactacaaaatatggtgcctttgaatcacaaaagtcttgtttgttaatatataatttttcatgaacaatttgttcgcacaaataatatactctataaaagaggaaattggggtggccaatagttctaactaggggtgaaaacgactcatatatgaatgaacagtagttctacggtctaccacatttgttttcatatataccggaatcataaacaaatacagaaacctagactataataatggaaacgaaacgaatatcattgaatatagatacgaagcgaatacaatgtcgattatcgttgatatatgagttccctgcatcagcatgttcagcaaaattattgaggaaatgtgcatgaagtaaattgcactccatccattcaccttactccttacataagtatataaactgtgcagttcctatttatttttaataattaagcttacaactacatgcctcacccaaaaaaaaaacggagagagagaaaagattacaactacatggaagcctggaaggtacacttggccttgacactgtaattgaaaaggagaaacaagaagaagagacaagcaaagaaacctgcattctcaggccttgggcaagcaatgcaagcaagacacccaagaagaagaagtacaaaaaacctagtagtaatggctactggttgcgacgctaatgccgctcggtggtgacgcctctggccagcggccacagcttgctgagcatccgcttcggcctcgccgccgggatggcgcagaacgccctgaaccgcagcgatgcgctgcgcgccagcccggcctgctgcctgcgcgcgaactcctcgtcgtcgccgccgccgccgtcgtggtcgtcgtcctcctccagcttcatccgcagcgtggcgatcttggacgccgcgcgccgcaggccctccacgctccagtcgtccccgggggacgcgcctgcggcgagcgcgcgcagccgctgctcgtccacgcggtccgccgcgtcgtcctcctgatccgacccggacgacttggactgcagcagcgccctgatgctgcccggcagctcggccgcggcgtgcgcgccgcccgccatcgccgccgcccgcgcgtgctcgaagaagagcacctgcaccaccacccgcagcgggaggagctcgttctgcgccgcgtgcgcgcacgccttgtccgacagcttcctgcagttgatcaccctgcacagccgcttcctcgcgctcttgctcatctccgagtgcacctgtcacccaaaaacaaaaacaaaaacaaaagttaaccacaaattcaaatccaaaaccagaacaagattgatatcaagttaaatattagtagaattttgtaatgtttgtggtattcaaatatattctcaccttgaggtaagtgtcgacgactttgtagaggccgtcgtgctcggggcgggcggtgtccgggacggcctcggccatggcgagcaacttgtcgagcggcatgttggggtccctggcaacctcgatcaagaagccgtcgaccagcctgcccaccctgacgagcgcgtcgggcgacacgggcgcggccgacgacgaccgccgcgcggcgccgtcgaacccgacgctctcggccgaccgcgagcgccggtgcccgccggaacgcgccgggctgtcgtcgtcgtcgtcggggctcactgccagcgccaccggcggcggcggcgcggcggcgtggcgcagggcgaactcgtcgaggatggccgccacggcgtccacgtcgtacagcgtctcggacacgcacgacagcgacgggatcaggagatcgccgacggtggcctcctcgagctgccacgccaccctccgcaccagctccgccctggacgtggcggacgcgctgaggatgttcgccgccttgaggagcttgaggaggaagctgcaggagacggcgtccctctccgccgggatcaggctcacgatcttctcgaggaggaggcggtgcctcgtggcgatctgcttgacgctggcattgccgccgtcgccgccattgccgaccccgtcgaacggctggtcggcgccgacgacgatcccgtccttggcgacgttgggcagccaccggcgcgcgtacgccttgagcgcgtcgccgacggtcttctcgtggacggcgccggtggccttgacggccaccatgatgcgccagaacaggtcaaccccgagctcggcgacgtcgtgcgcccaccacggcgacgccgacgaggagtgcgccgggagggcggcggggctcgcgatgagcgccgcgacggcgtccacgcaccgggaggtgaggccgatgtcctcgcagagcggcgcgcagtggcgcgtcgagttgagcacggcgagcgcgtccttccatcgccggaggaggcaggaggcgaggaacgcgtcgagcttggcggcgaggttgccgcggtcggcggcctccgacatgccgaggtgcgccgcggcgcagcggagcgggacgaggttccgcgcgctcaccgtgacggtgatgccgtagcagaacttggcgcacgcgtcgaacgcctcgacgccgcccgggaaccccgggagctcgatcacgtcgccgccattgccgccgcatccggactcggcgcacagcgcttgcagaagcaggcatttcgacagcagaggaaactgtcaaaaacaaattccaaacaaacatcatcaacaaatccttcgatatcaaaacaatccaaacatgcaaccaaatccaaaattcccctaaaattcacgatctaattatcacaaaagttgcagaaaagatccgttctagaaccacagcgaaacaaaaaacaacaacaatctttcatgtcccattaccttgtgaagctgatacaagcagtcacccaccaagatttgcaggtcagtggcgacctctgtgcagacagacctgtgaacatcacaacaaacacccacaaaaatcaggcaaccacgattcaatcacctcagacgacaggcaagaatcccaggaactgaaagtctgaaaccatgccaagattgattgattgattgattccacaaatcaggatttctcaagaaaaaaacacctcacggattcgttggagaagaaggtgtcaggccgggtgccaagtttcataaacttcatcttgggcgagcgagcgagcgagagtcgcagggcttctctcacttgctaaaacgggagggtctgaaagtttcactgggaggttggttataaccactggcttggctggctggctaggcccctgactttctgtgagcccttggaaatggtttcttggtggctctacttatatcatgatgcccaagtggttggggaggagagagagagagagagaagcaagggccaaacaaggaagatgcaaaaaagaaaaaaaatctttttttttggataatggaagtattcaaaatgttttttccgattacgtgtacgacatgcaacaccacactcacatccgtgaaaagcgtccactaacacatgctcggagagatagagatcagcggcaactccctagccttgctaacaatgttttttttttttgaaaggccaagaatttcactaatttagtacactaacatgaggtgtttttttttctgggattcaagggcgagggagtgggaatttgcaattcaaactattcatataccagactgtcattgatgaactctgatgagtgctagcaagggtattgattaggatttgggacttgaattggaaggggacatgtgaaacagggaccagagtggcatgcaaaagtcaggatggaggggctcagaaatgagtaggatcttgcaggtttttgctggggatcagatgagcatgatgggctcctagatacaggactcggttggatcactagttaaatgttctcttctaatgcaggccaaagttactttcacatcgatcagtttaattctattctgaatcgagaaaaaaacatcttgcattctaagaaggccctgataattttcttttggaaatatcattgtcatacagtggtcaataactgaatttaccattttttttaataatggattttcattaatctggcctctatatccacgaaggatatacacagccaaaaggatacaatagtacttagactcacgtctcaacaaggaaaagaacacaaccaaaatagaaaagaaaaccaaacgacttcagcacatcctgcttttctgcttccatattctcctaaaacagctagatttgacgagtgaaagtctactagtcgctgtcgcccctagtgcaccgttgatgaaaacctccatttgtgtcatcttcatcagtttcaggtgagctgacgtcacacgccgcttataagcccactctcaaccaccatcattcgtcgtatagtcggaactagccaactagacacgaaccgacgggatcggcttccactttaccggattcctaaggatctactatccaaagtgctcagaccgccaccgtcttgagccaccgcaacccctagagccgccgccgtcctgggccaccgtagcccctagggttgccggcgccgacgagagccaccaccgcccctagggccaccaacgccaacggaagctgccgccgtcctccgccgcagcctctagggccaccggcaccgacgggagccaccgccgtcctgggctgccgcaacccctagtgccgccggcgccgacggaaaccgccatcgtcttccgtcgcagtccctagggctgccggtgccgatgagagccaccgcagcccctagggccaccaacgccaacgggagacgccgtcgtcctccgacgggaaactgaatttaccattataatcttaattaagtcatcaagtgtatgcaaaaagtggggttagcagtttgttcacaaggaatttatgtccaacattaaattgattgattgattgtgttaattactcagataacctatagctagattaattagctacgtttgcgtttggtcgtgttttcattagcagctacggttaggcgcgacataggtaggttagctacttagcgtttgttaaatcaaatggagtggatgtggagcacctctggataaatttttctatccaattcttgtcaccacttaattaaagacgcagcaattagtaaattaaatggtgggtctgaactccagtcgaaaggaaaaaggtcgcactgtctgcgaccataaaagttctactttaattaagagaaatgtatatttttcccttttttttcccatatggaagtttaaatgaaaataacatgtgaacatctgcacttgatatcaggtttatttcattatctaagaaaatattgtgtttatactaagatagatcgccttttcataggagtgaaattgtatggttttgttgtttggttggttagacgagtccaaagtactagtaatttctataccgcccttggaaatgactagtactaccaaatatgaagatttggaatgcaggttgtttcgaaaaaagaattaaaatgcaggttagaagtttggttatattgtatatacaattagtcatggctcaagctaattattgaggctgcccgtttatttccataaccattgtatcggatcaagcgcctgcccgccacttgtgatttttcctctttctgaatttctgacatagaggcagcaagattcttccgtttcaggaaaattcagagctcgcactcccataactaacgaaatgtccatgttaaaaactgctccatggcttgagctctactactagtccgagggtttgacctagctgttcaaaggttcagaaacgcatggttaatttcctatagccattaactggacaaactcatcggttaatgagctgaaacacattagttttatcagagcttgccacgccctgtctgcaaatctggcgagcaaacacgaagattatgggtggataattaagaaaggaaaacttgagtgatacgattgaatggaacacctgaaggtcgtcaattctgtccctcatgttaatctagtattaatcttccatgatagtgtggctgcagaccatcattggttataatactgattccctacgctgagctcaacatctctcaagccggtttagtttatgcgaatggcacctgaaatcttgctttggagttcaagggttcatcattgcaatctacttctctacaaaggcagggcaaccatttccttttctttttgtttgaggctttcttttccctatcttttgtgcaactaaacatttgcatttcatttcttttcatggcattataaattcaaaatctccatctaattgcgtagggcgccacataatcaagaggaaagcaatagtgaagctggccatgtctgacgactgacgttatataaatgccctggttacatagtctgatccaagtcctgtgcgacgttgcagagccatagtacacaacaataataagtctattgtattaaaaggagaaaaaggtcacttgtgtaaaataaataaataatccggtgattaataaaacaacacaaagccaacctagttgtactctgcctgttcagtttttattgccatccattcaggagcaatgatagtagaagcactactctatcatgaaaccaaaataatactagcagctctctgaagatatgcttcatatattcatatctgccaaatagcatgtcttgctcacttgaatggtgaacatgcccttgcagtacgtaaagagctgggccagtctgctgcctccttaatttcatccttaatttcttcagtgtattctcctaaaccatggctaactgcagcttttttttaacgaaggctaaactgaacaaataagtaatactagtattaaagtataggtggtttatctaaagaatctttgactcggaattctttttgcaccgttgcagacgtttaggtgattctctccattccaaaatataatcgcttctggctatttattatgaagaaatatctaggtatatagcaaaacgatgcttatattctagaatgaatataatagtaaattattagcctctgtgatcttatcaaagcaatcacctcttttctgcagcaaattcactatagataatccaaatgcatcgggactattcaaaggcacgagagataaggaaaaccaaaaaccttctgtgagtagggctttgctatggttgaaatggtccaggatgactggatgaggcccagctcaagacatggtctccattggacatttggtccattacagcctttaattagctgcgggtgtattgtggtagcccacggaaggggactgagtgctatgttttcagcccaatctggtacaactcaaagcccatctattaatgctcaaagggcccaacaatctagtagatggcccacatggaccggatcctgggccgttagttctacgaggccatgtgctctctctataacggaataagttcactttgtgaccctcaatattgatcgaaatctaatctatgaccctaaaccataaaaccggatatctcgaccccctaactcttaaaaccggtgcaatttgactccctcggcggttttggagagcggtttcgctgccgtggcgcctacgtggcagtattgactcggtctcctttccacgtgacgttgacgtagcgcttaggtggcattaaaaataaaaaatatgtgtgggacccaattgtcattcaccaaaagtatgggtgggacccactgatatgtggggcccacataacatcattctctcctcatcctcccctctatttctcttccgttcgctggcaggtgggccccgctcgccaggagctttttccacctgtgcccgtcgtctgttcatctgtcccgtaaaactcaagcactgccgcctccattgatctccctgccctatcgtttctcctctaaattaattagaaaaatcggttccttgtgtagtgggcatcaatttccccaacaaatcccgcttaatcccgcactaaatcgccctcaatcgatttcttaaaccggtgtcttcaatagggagctccaccgtcgccggcgccgttttccgtccgtgcggtcgaccttctcccctccggcctatataaagagaatccccaagacctgctctttcccatccccgtgccgctcgagcgccacgctcgctccatcgccgtcacgcactccagccaccgttaggcgctgccctagacgtcgccgagtctcagtgaggccactgccggcttcgtcgtctcctcctcttcctcggccacgccagccgtagccaagacgatgaactcgagagttggccggcggtggcgacacaaatcggtgcgtgaggaagaccggaggagccagtggaggaagagattggggcggcggataccgaatttgatggaccacccatggctcgaccccgcccttcctcctcctccccgtctccttgctttatgtgggccccataaagatgaagagaggatgatttccacgcactcgcgctcataggggaggacggtggagtgggaggcatcgcaggtcgaccagacgagctcgccggagaggtcgagggcgagggggtggccatccttgacggcgatggtgtagagcttggtggcgccgtccttggtgatggcagtgacgaggggcttgccgctgccgcttgctagcgtgtgccatggcaacacggagaggaaggagatgaccaccaagagaagcagtttgcctttgggatttggcctgcggcgacatggtgtatagtgtatgtacgtgagtattgttacactaatcgtgattagtgtggtaatctgatgtgatttgatgaatgcatgatttgctctttatattgatcgagctagctagtgggccctacatgtcagtgtgcccatccatacttttgataaatgacaaatgggtttcacacatattttttatttctaatgccacctaaacgccacgtcaacaccacgtgaaaaaggagaccgagtcaatactgccacgtaggcgccacgtcagcgaaaccgccttccaaaaccgtcgagggagtcaaattgcaccggttttgagagtttgggggtcgaaatatctggttttgtggtttagggttacggattagatttcgatcacttttaagggtcacaaagtgaacttattcctttaattagctgcgggtgcattgtggtagcccacggaaggggactgagtgccatgttttggaaaaagtccactttgacacccttaaatgtataccgaatctaattcgtacctctcaaccagaaaaccggttaggatgactcccccaattactaaaaccggtacaaatagactccctcggcggtttcaagggcggttttgctgacgtggcgttgttgacttggtcttcgtcccacatggcgttgacgtggcactgatgtaagattagatttaaaaatatatatgtgggaccaatttgtcactcacacacaaaaattataataggatccactgacttgtggggtccacatgtcattctctttccaacctttctgcctccctccctctcccttatttctctctttctcttcccgtcggcgagtagcgcggagagcttgccgagggcacggatggcggagcagagggcggcgagggagcggagtggaaggcgccaagggagtgcacgaagccgtgaagccgtgggcggcggtgggtggagaaggccggcgcgaaggccgggcgaagcggcggcatcgagagctgccagtcgccgcggtcgctcctgtcgcgtatcctacagtgaggtgacggcggcggcagcggtgggaagatcgggtgccgggtgcggctgccgtggcggtacagctccacctccgtgttgatgcgatgttgttaacactccgccgccgccggtagtggcggcggcggcagcggtgggaagttcgggtgctggatgcggctaccggcgccggccaaggtcaaggtcatcgggagggcgccggagttgtccctcgacacgccgaggagttcttgtacactcgacgaggggagaaatggtataattcttgccgtgcgcggcgccagttcagtgccagagacgagagcgacgacacggaggaggtgactgacacgtcggcgtccttcgccgccaaggagggcgtcgtcgccgccaagacggacgacgtggcggcaagaaggccaaggacggtggcggcggcggcgcggtgctggtgacggtggacggcgacgtggagctggagatggagacgctactgaaggcgtcggcgtacatcctaggcgcggcgggcagcagcatcatgtacatggcggtattggacgacggcgccgtgctggcggtgcgcaggatcggcagcgacgacgcatcgcccgcggcatggcgagagggctggccttcctccacgacaagaagttcgtgcggcaacgtccggccgagcaatatcctgctcgacgccgacatggagccgctattggcggacctcggaatccaccggctcatccgcggcgggggcacgctcaagccggcagcagcggcagcgccggggcggttcgggagcaagcggtcggcgaagtgcttgccggacctatcgccgccaggcgcgaggccgctagcggggccgtccgggtccggcgacgcggcggcacagtaccaagagaggagcgagccagagctgatgctgagcagcaacaaccacaccctcgtctacacctacgacaacgtgtagtgcagtgcccgcacaacaactacgcactcggcttcctcgaccgcttgctctactgtttctttttgggggatttgggggaaaaaatagagagggagaagatggctgacaagtaggccctacgctttttatattttctcctatcacttacatgtgggcctcatgtgtattttggtgactgggctgacacgtcagcacaacagaccaagtcagcatgccacgtcagcaaaaccaccctctaaaaccacttagggagtcaatttgtaccggttttagtaattgggggagtcgtcctaaccggttttctggttgatgggtacgaattagattcggtgtatatttaagggagtcaaagtggactttttccccatgtttttagcccaatctggtacaactcaaagcccatctattaatgctcaaaaggcccaacaatctgtaaatggcccacatggaccggatcctgggccgttagttctacgaggccatgtgctctctctataacattcggcttcaactgtgccgttttcacaagagttgcgttaggctcttcctttaccatccgattacacatgtaacggcccaaattaagttctcccaaatactgttcccctcacacggtatgattttactgttcatagagttagtttactgctggcctcatagttatagactttcagtagtcgttgtccgtccacaatacaatactactactgttttccatttcctatcttaggtgatcagcagttggatcccccagcaatttctgtcagtttttcatttcctgtaacctctctcctagaattttttttatacgatctaatttcggtcaaataatgggcctgtccggctgccctggctgcggctgcggcgcagtcggcatgaacagtgtcgcactcactgtgcgcagccgcagcagttggcctaccgaacaggcccaatgttttctgaaattccttttttgtttaatcacattacgcaacgttgggttttttttttttggcggatcgttttttttcgttcgtaccactcgatcgttagcagctacaactcgttggagacttggagttatgattctctagctatgaagatcgcaggagacgacaagggccgcatcatgtaacacgcattttcgtccccatcatcttcaattcatccgatgcatggcaatatggcatgatgcactacgacccccctatttttccacaaaaagaaaagctgcaccatgcaatacaccgcgcctgtggctgtgtctggctagctacgaccctccttaatttgtctctgagagacatgtcaactggcatacgacaaatgtgctggagaacagtactgccatacgtaccccccaaatacgtgcagctacttgtaccgcatgtgatatacgtaaatatacaatgggcgcgtcggagttgtttctcgttgtccctttacttacgctagcaaaacagtaccgccgccgggctctagagttaccgcgcttaccgcgactccgcgagtgtactgtaaaagaaaaactacgataacctctttaaattcaaataaatttaaaatatacttcgaaattttgataaattttatacggtttcatacggtttgccacggttaccacacgataaccgtgcttaccgctagagcgcggtaacctgaccccggtggtttgggaaaccctgccgggctctcaaacactacgtggttagggatacaagtggacgagcaaactgtttttttccatttatgctaattttaattatataataggatagagctatatatactattattactataacatgcgtgcacacaaatctaaaatactggttgcagggtgcaaactctaccaaatcattgggccacgtggccaaaccaaaaaccaagttcacatatcatcaaaatgtgccacgtgtccagaagagcacgttcattttgaacgtgtgtgaagagtctagataaaacaaaggaaaaaatccagagcattctaaactcggttgaaaaaaatcacacgataacacgaaaagaactggtgaaaaagattgcatgctgaggaaacaatggataagaaaaaaatagtatccaaaaaactgccacaagttttttaaaggaacaacttttaaatctaactataatataattccactataactataccgtaacaatattgtaacttgtatataagtattaaaatactatatgcaactttatatcacttatatagagattactacagtacagttacactattatgtacaatgtaactatagtgtagttacattgtgttatactacaactatactacagtaacatttaaaagtttttttttgccaaaaaaacttgtgacaactttttagcaattcccaaaaaaatataaacagcgagccgatgttagctgtcgtaaatcggcaacgaggaagacatttaccgcaatattttccggatccacggaagctgttgccaacgagcaagatccactcactcaatggagcaagtggagggcgtcgagccataccagctgtgatagtccgcgagtgtggatgcgccaaccagccaacgagcatcgaggtcgagcacgtcctcaccatccacggtagcaataaccacgaccccaagctcgaccaaatccaggaggaagaagagagagggatgaagaagggctcaatgaggatacccagctttggacaatcaagggacgagggcgatgttgccttcgctaccatcatcttcctccttttctccttgttctcgcaagcgttgtcttcctcaacggctgatgcctttctcccagcaccaacgcgacaatccttgttctcgcaagcgccattttccccaacggttgtcgcctttctcccagcattgacacggcaatccttgttctcgcaagtgtcgtcttccccaatggccatcgcctttctcccagcaccgacgcgacaatccttgttctcgcaagtgtcgtcttccctaatggccatcgcctttctcccagcaccaacgcagcaaataaagttccaatgccaggatccaacgacccggggccgcgatggcgatgagcggtgaaggggacgaatcatcgaagattcaaggcccttccactttctattgctaggtgattctccatgctttgctacgggatcactaaacaatttttaatatattttgttcaacaagtaaactaagagtaaaaagaatagaaaataatgaaacgtgaagttttatcggtacttatcataaaataaacaaatgatacccgtttttaatgtggagcatattgataagtatatgttaaatattataaaaatgatatgtatatttgttaaaatattgtagaaataatgtgatgatatgtatatttgttaaaatattgtagaaataatgtgaggggtgaaacactttgttttttttaaaaaataccaacaccaattttataattagttaataacttaattataattttagaaaaacaaaggaagaaacaatagcatgggtggaaaaaaagagaaaatttgatgattttctcaacaatatgatctgttatgttaaactggaactcagaaaattccattcaactatgatttttgcatgagtttcaaagaaattaaattgatttctatattttttatgaacaatgtgctaattaataacacaaaaataatatatacgggctataaatcatgcgcgccaactggcgcgctgattttctagttataactgatgtactactactggtggtattgtacgcacacacacatacggctactgtaactactgtatgtaggagtatgtttgtcctgacggatcgagtacacgtctgcaagcagtatggcaatggtggtacaaccagcagggtcaggagtgagacccgtaggcagaggagtggtatagggacagtataggagggacaggaccatgtgacaagggtccttggtttccaaaccctagaacactgctgcagctgcaggcaattgaatgtcttgtgtttgctcgtaaactccaacccagtcacacccatgccattgccatgcccacaacacacacgcacggcacacacactctgtgtatgtgtgtgtgcgctgggagctaggggtgggcattcggtcagactgaaaaattcggtctcggtcttcggttatttgggtaattccgtctttggaaagtccggaccgaatttcataaaaaaaacttatgaccggcaaattcggtctcggtcttttcgatctcggtcagaccgaaatttgaggggaatgaaaaattttgacaacattttccctctttttagactttttttcacagacatatatatcacaaaaataccaaaaaataggcaacatcaagcaccaaattatcacaggataggtctcaagtctgaacctcacaagttacgagtcacgactgccacagtacaagttataggttgataacattacatcacagatcaagcagtagcaacagccaactagtaaataagttttaggcttgacatgtacccatcttagtcttcttcctccacttttcagcaacctgaaacacattttaaaacaagcaaccaaaacaaaacttgattacaattcagaaatattgacagagaagatgggaaatagttaaaagtgttcaacttggtgaagatcatgtaggtttaggtttagaagccgacgacttggtggatttgcttgccggcgggatggaggtgccaaggtggaggtgggctgactggagagtggatgcggaggcggcgccgaggcggaggtggcgccggcgctggaggcggacggcggaggtggcgcgatgcaggtgaaggcagaggcgtgggggggctgggggcggcgcgatggatacgaggcacggaggcagtgagcagctctagtctcggctgctccaccctgagtccctctagggtttgttctatttagtgggcttattgggcctactacacctgttgggccaaatttcgattttctcgggtaattcggttaactgaagcatatgaccgaattaaccgaaaaaaatcggtctttagatggctggcaccgaatcactaaccgaatttctcggtctcggtcttttcggtctcgatctcggtctttttggttcagttttttggttcggtcttattctgcccacccctactgagagcagctatagcgaagaaatcttggccaatgaagtgcactggagccataagcatggacattgatgaaggcacacacaagaaaggagcctttttgagagcagagggggacatcttctggatactccagctgcaatcattctgctgcatcctgccctgcccaacgagctattctgaccagcttctattccatggcctggccgggcctgattagtttatttgtcctactctgttctcttccctgttcggacaccaccctgcacaaaattgctagagcaacccaagcatgagctacacggtcaaaatgcgaaaaggaaaaaaactacacggtccatgcatgcatatcttgggaatttatggactctgactttggcacagcgcatttgttttctttgcactgccagcgccaaacaaactctgccatgatttgagatatcaaattcttgctgctatggtgcagtgagatcctgtgagcccggcagcgtctgtgttccttggcacgtatgattttcagaacacaatgcatgcatatattcagccacggctgggttacacgggacagagacaaagaacttcaaattcagtagtaccatctctgtcccaaaatataacagcttttaaccttcaagatttattaaaaaatataacaacttttttaccaacattctcttcataatcaatcacaaccctacacaattcattttttctacctaccttcatttctcatctaattataatcttctctcatataattctatcaactttcttaacaactaaaaaaaattatattctgtacgtatataatattatttatttgtgtatgtgtgtgtgaagaactggaccatcagcaacccagctgacatgatcacaacagagatcaccccccgacctccgttgtggccggattcacaggttttcctatcgagcaatcgcggggggcggcacgacgaccggaagcgcagctagcggaatgcgcacgtacggtacacgaacgtcgggatgcgcgcggcgggcagggccgggtgccgggtggtactagtagccagcgcctgctgccgcgccaccgcctggattcgctgtgcagcctgccgtgccgtcgtcggccgcgggggcagaggaggacgtgcgtgcgtgcgtgcgcgcgcccgcggagcccggcccgcgacaaggagccctttttcgcgtcacgacggcatgcatgcagcagctgggaaccaaccagtacggctgcacgcatgctcttcccgcggacagtacagtggcgcgcacagtgtggccagccggcgggccggggatgacaagatgggtgaggacctgtgtgtgtgtgtgtgtgtgtgggcgcagtcatgcgtgcatgcgcgtggcacgggggagagaggagccgctgctgtaccgtagtactcctactgtactgtaggtctgtagctggaggaggctgtaggctgtagcagcgatggccgatgggaacttttttctgttactacaccgtaccactggagtagtagtagtactagaagatcttcacgaatcgggatatgacttttgcaatgcaagtcctgtaggatagcgcgtggtgcaacaaaagtggcggtcaacccgttagagcaggtagccaactataaatatattttgagaatataaaagataaaagagaagagcagcgggctacagatttatagccagctacagcacggactctaagatacatgtgtgtatgacatgtgggaccagatacgaattgtgtagtatatgtatatagataactattgtatgaggtccccatcggttgacaatgacttattataagcgattataaaatgatatgccagtaaaacttttgtatatatgttcgtagtgattgaaaagccaaagctaagaaaatatgtgctgaaaaagcatcaaaatcaaattaaaaatcaagttttaaaattcaaattttggctttggcttataagccatacggcaaacaatgaggccctgaattggctataaaatagactatagttcatttggagccagtagtcagctatactattaaacttgctcttagctgggtattagtactcgggagacgctgcgcgtacaataatacgtactaatacgtgtactggaatctacaataatacgtactatacgtatctggagtggaatagtagtacaaacaagtgtacaacaagcttacaaggggggtttgaacttgtttatgtacgtgccattcttcggtgagctcgtcgatcatacacctctccggcgccggtgcgcacagcttgctataaggccaagcaaggttttttcacttgaacccacagcaacccatcatacccatcatacccgcacaatacgccatcgaagatcgtcgatggaaagcgccacacatgcagtgttccaggcgcccctgcacagcgttatgaactctcgcgcgaatccagacgtgctatactatccctctctctctctctctctctcccctctcccagcaacagaaccgttcggtcttaattaccctcacatcctgcgttgccgccggctcaccgccgcgacaacaacgacatccgagataggagtactccgctgcacgtctgcacctatcgtttggcgccggctttgcactgttaaccaccggtgctcacgtcttcctggcgacggattggtcgacagggcaattgacaattgaaccgcttgatttgggccaggggtgacgggagatttggctagctagcgaagcaccaactccggaatccgcgcccgcagcatgcaagatgcagcacgcatgcaccaagggaacaagaaatttatcaccggccgcatgcagactgcgacgactctgctcagctcgatcacacatatcgcctctctatccttgcgcgcacgcgcagagaatgaaccagacgccgggccggggccccgcggccgtactgcgagaatcgcgtgcgtgcgtgttcttcgattccattccatcgagctcaattgctcaacgaagtttagttcacgctgaagtttgaaaatttggttgaaattggaacgatgtgactgaaaaatcatatgtgtatgaaagatttgatgtgatggaaaattaaaaattttaaaaaaaaactttagacctaaacatggccgaactactagtctagcccaactgggccagctcaagccgattttggctacaactattagcaggccgatcatcgaacttaagcatagaaattattcatattgttggtttgtccatgttgaaccacagcatcaacatattttagtcgcttgatcaatgtgtccctcaaacatcaactgttagattattaggtctacaggaacaactagtgaggcctaaactagaagataggcccaaatagactcccacctcattttcttttcaacccaccttttaatctctaaaatttctaccacatttagtttgccatatgtttagcaaccattcttaactagatatcccgctgcaaagtatgggattgcatccaattctatagtgagccaccacataggcagaaacgatggcgggttcacctctcaggtggatcaggcaactgctcgagctccatctctagctttgtatccactattgctctgttgattgttgtcgacgtatgaaaaaatagtcagtaactaacaaacgctattagtcaccgcctcaccggccttgacggcggcactggctttgcaacttgatgaaaatgtggaaaaaggcaacataacatggtcacttgctagagtcaaagccatgtaaggagcggactgaaagagcgagtatggtttgtcccgttagtttcttctgtaataggtggatgaaaatttagatactcgtgacacacttttcaaactgctaagcggtgtgtttcgtgtgaaaactttttatataaaagttgttctaaaatatcagattaatatattttttaagtttgtaataattaaaacccaaatagttacacattattatcacatcattttatgtgaaacacttaaatctttatcctcattttcatctccaggagatttaaacaccaccatactaggcttgcacgataagatgaaagaagacatggcataagaaacacaatgactacgcacgtttgcgtagagagtcaagaaatgccatgggattactatgtcatgtttttaagaaaaaaaaatttaggaactaaataaggccttagtttcatactcgaataatagatggttttacaaaattctctttttattcgttatgtcactatttacctttgaatcggtttttgtgttcaggccaagtttagttcctaagttttttttttaaactttcaacttttccatcacatctaaacttttctacacatataaactttcagcttttccgtttgacgtgaactaaacacaccctcagtttagctggtactccaaccgagatataactcgtccaaccaagggagtacaacttacatttaactcgtgcatataaagttacaactgattgaaatgtcactattagtggctagtacttgcaattgcaaccttgtcgcgtcacgaagataatctaaagcattaagttgtgactgaaatattaggccccatttagttcacgaaaagaaatttttgttgtcacatcggacgtttgaccggatatcggaaggggttttcggacacgaatgaaaaaaactaattacataacttgtctgaaaaccgcgagataaatttattaagcctaattaatccatcattagcacatgtgggttactgtagcacttataactatcatggactaattaagctcaaacgattcgtctcactttttaatgcaaaatgtacaattaattttttttctttttatctatatttaatgccccatacatgtattcaaagattctatgtcatgtttttaagaaaaaaaattagtaactaaacaaggccttagttccatactggaataatagatggttttacaaaaatctctttttattcgttatgtcactatttacctttgaatcgttttttgtgttcaggccaagtttagttcccaccaaacttttctacacacaaaaactttcaacttttccgtttggcgtgaactaaacacaccctcagagaacccacaatggtaaagtaaggtgctatctataaaacatgtacatctcagcaatagactagattaatagtaaaccacctcaatagtagtatatctacatgggtatctatagctctctaatacattgcctcgtttttctctatagactatctccaggttagtagatagctttgctctctctctctcttcatttaatctcttccaagtaagaaaatatgcgggcatggatctcttatagagagcctataaataaccattgtgggtgtcctcagtttagttggtactccaaccgagatataactcgtccaaccaagggagtacaacttacatttaactcgtgcatataaagttacaactgctgcttgtcgtttggtaagaagccgagctcactgatggatggatgtggcatagtaggactgtataatgcgcttcaaagtaaaagtgctgatatagatttgactataacaatgccccatgtttcacaacatttttatgattgctagtcaatctatacgacggtttttcaaagaattgatctacgatggcatttgctcgttgctattaattgaaaacggcaatataataatttcgtagtactagtaatttgttgaaacgtggttgaaaacccacactgatgaaataaccatgagattgtgcatgtaataagggccatcaattagtataacccatccctgcttttacgtgcagggcattaaagagctttcgatcatatcagagctgaattttttttagcaaaaaagagctgaaagttgaaaaggttttaatcgaactatggcactatgcaaacaacaaactggttgtgaaaaatctccctgtgcatgagcaaactagctgttgatgcatgcatgctaatgagcgagattttttttcattaagattgaattaattgttcaataagatcaagattcattttttcaacaagatcaagtttcaagaaggccatgcatggaattagtactagccaagatatcaatcatcccaagttaaactagtacacagaacaccaccgtaatctcagcaagattagagaagatgcagatagtaacaaaggatagcgaagcaaaatgcgcccgcattgacgcatgcatgcacgcgcgccatgagcggctgcgcgcggcggagatctcgacgtcgccggttcggctcagcccctgcggctgacgcggccgacggcggccgacggcgccgccaagacctccatgtagggcgggcactggatcacgtcctcgaggagcccctgcggcatcatcgggaacccgcggtagtcgtcgtcgccgtcgccgtcgccgtcgtcgcagtcctcgacggcgccccagggggaggacacgcggtacgacgacgtcgcctcgtacggccgctccagcttcggcgccggccccgcgtcgtcgtgcggccgcctggtcgggtagaacccgtgcaggacgtcttgcaggagccccgcctccggcggctcacgtcgcaggaggaagccccacgcgtcgtcgtccgctcccggcgcggacgtcgctgcggcgcctgtcgtggtggccggcgcggtcgtggcggatga

SEQ ID NO: 39237 - DNA, 4381 bp, Oryza sativa
gtcccgctgagagagccgccgccaccgccaccgtccgcgcccagagtcgccgcgcagccgccccgccaccgggcgacgggcgctgctccggtggtggtgcgagtgcgcgtgagcgtggccgtacagctgcgcgttggcgggctcgtccatggcctgctgcgcctgcatgcgtgccggatggatgggtcgatatgtgcgacgcgagtgcaaggctgcgcgggcggagagtttagcgggggatatgacatggcgcagcttgctggcttatatatagaggggaatgagggatatggcttcgtgaagaaggctgtgtgcctgtgtgcgactgtgcatcacggtgcaccagtgtctgtgcactgtggacaaggacaacatcatcctcatgccttggcatgggtgtgggtagagaggccagccattcgtctgatcgtctctgcctctgctagtattttcttctcttggcactctgccgtcactgaaaaacctaacctaaaataaaatatgacataatttagtataataaatctgctccagtttagattcgttatactccctccgtcccaaaataaatgcagttttacactatttatgtctaacgtttgaccgttcgtcttatttaaaaaaaatttatgattaatatttttgttgttattagatgataaaacatgaatagtactttatgtgcgactaactttttttaaatttttcaaataagacaggcggttaaacattggacatagattcccacgactgcacttattttaggacggatgtagtactagttatgtcttattttattctaaattatgttttttttggacaagggagcagttatttccccatttttctttgtgacaggtaaggtgtccgtgtcaatggcgatggttcatgctcctagaaaggagccactgtgcaaatcttaaataatcctaaattatcactgcaaaaaaaactgttattttcccgaacaaattgcagatgatagcactgatattcatcatcaaaatgtaagttcaattaaagggaatgccacgttcgattactcgtcattcaattcgttgttataaaatataaacacagtggatttttttcatgaagaggttaaccttaacaaacgagggcttaattcgatcgtttgtttgaggttcccagcttcacatccctcgtgttcaacatgggcgatttcaaaacagctaaacggaatgtaactttaaaaacaaatctccatagaaaaaaatgattttaaaagaatcatattaatatttttttaaaaaatatatttaatacttaattaatcatgtactaatgcgtgcttcgtttcgcgtgtcgaaaagaaagggtcctaacccctcctcctaaaggacctgaacacaccctaaggagagagctaaaataaaattagtggtggttgtgagtcaatccagatccgatgtatttgctattatgactagggatgacaattgtgtccgtttgcccgtttacccgtgggtaaaaaccctattagagttgggtttgttctccattttatacccatgggtttcttattggatcaaaagatatacccgatgggtaaatgggcatgggtatgggtaatcactgcccatgcccgctttgcccatttacccgcgaaatctaacttacatgtagaagccacgttctttgttttctacggtttcccttttatttcccttattatttctctcccccttcctctatcgctgccagaggagagacaccacaccgaggcggagaatatttgatgttttaagttcgattttgacggagcgtggggctcctcaccgggagaccgcgcgggcccccctttgccggttcggccgggggcgctaagtgaggttctaagcccttgatctgtggaatggttcgcgagagagcaaatgcgcaagacacgagcgatgtagacatgttcgggccgctgagaagcgtaataccctactcctgtgttctggtggatctgtgtatgaaggagttacaaagagctggagagcaagagagttcaaactctagagcccctctccctcctcttttctccgtctaccagctccggtcctctctcctctttttctccctcctctctcttggtaggcatggtcctccttttatatctcaaggggataccacatacaccatttctacctacccttcttttgggtggggacccatcctactttgaccaaaacttggcttgtaccatcgtctgacaccgggataaccctgtccttcctcattaatgggcggagatttgcaatggctgctgtccgaatgaccctccgatgggatgggtcataccaacctccactccgccggaagcaggtgcaacgtggaagcacggttgtttgctgatgacgcgaccggcgtcagaccagtcacagaccggtcattcttgtccaccacgtgtcagtttagcatgctacacgtctgcccttcttcatacaatgacttccttgcaatggttgcgatgaagcctggaatgtatctggccggggctgacgtgccaactccaggagttcccacgccggctccggctagggacgagtgcctggaggctctcatcattccgacgggacggggcgaggcgtgtgtcaggccgcctgttgccccctaacccgcgatctgaccggtctgtgaccggtcacacactgcgaccgatcacggaccggataagcatgcgctatgctgcattaaatgcggcatgaggcgctcgtccaacccgcaataaacgcggttaggtgagcgccgctgtgctcacctaacccacacacgtggcgccaaaccctcagggggtcggggcgccccagccctcggggggtcgaaacgggagcggcccgacccctcggggagatagagggaggggcggcctcatcaccatcgggcccgacccccccctgagggggtcaggccacgtgggtgaccgcagctgccccaaacctctagtcaagatatccccggtcccatgtcaccgacaaatttgaacttagaagcttgtagactttttttccactgctttttttgtggcgggtaaacgggcacgcccgcaggcacaaggcgcacgcgggcgatgggcatgggcaacaatcattgcccgtaaacgggcacgcccgcgggcacaaggcgcacgcggacgataggcatgggcaacaatcattgcccgtcatgtagtaacgggcatacccacgggtacaaataatatcacgggcacggccgcacgggtataggtaggcactacccgtgcccgtcgcgcccgtttgccatccctattatgactgcagtcatagtagcaacacatatggtcaatagtagcaaagagtgccattgtgaatatcctgttgtagcaattgtttgcgtctgtgttaggtcttgaatggttgtaattgcatgcagttgcttttgtgcaaccgcgctgaatctcaatttgagatgaagttgagaaattaaatgaaagttggttgtgattgattgagataggagtaatggtgaaataaattagatattttagaataaaatttaaatgttagacactaggccggatccagtcatctgtgacggactctaaccctcacctttgacggatttggttctggtcagagacaagtggtcactgatgactacacctcacctttgacgggtgaaagcccgtcactggtaattaaaacctttgacgggctaaaaaatatagccgtcacaggtgactcacacctgtgacgggtgactctttgcaacccgtcaaaggtgacaaaacagctgtgactggttttagttctcacccgtcacagacgtcaaaaatcacccagaaaaaaaagaaatgcctcagcccaaatgtacgaaatgaagaaaaatcaaatacatctcaagatgcacatgatacaacaactttgtattttaaatcaaatacatctcaacaaacaactacacatgaagcaatctgacaatatacatcacacaagtatccatgtccattttaacaaactacacatccacacaagcaacaaacatgagcaaatcaagcacaaacaacatcaagcacaaacaaatccggcggccggcggtcggtggcggaggggaaaggccgcggacgctggatccgcgtcccccgacctcgtggaggccggatatggcggtcatcggtcggcggcggaggaggcggcgtccggcagtcggggaagaggttgtggaggtggcgaaggtgtcggtggctggatccgctgtggcgtcggcggccgggaggcgagggaaggctccggcggcagaatccggcttcccggaggccaaacttggcggcatcggcggccgggaggcgaggaaaggcgccggtggccatatccggcttcccggtggccagatctggcgaccggcggtcaggagg

SEQ ID NO: 39238 - DNA, 11328 bp, Oryza sativa
tatagaatactcaagcttagctgtttatacataatatagacgggtaatagtaagacgaaaataaacaaagtacaaaggcatggaacaatatcgtactagaagcagccagtgcaggtggacaagtaagtcggcaatattttgaagtcaaaattacagtaaaatagaagcccacacaacatggttgataagcagcctacctgattgtaggcctcatttggtttgcagtcaaccgccatgtccatacgggcaacaaaaaaatgttggtgaactggtgcatacaaactaggggcaatagtagtaccatatttcctttgctccccgggcatgagagctcctaggctaagaattccagtaagctttacttctgcttctatcttgccatcctgcaaccaacaaaaaaacatatcaggaactagagttcctttcgaaagtataattgtgtctgtagacattccactgaaaaggtgaactactcacctgataaaaatgccaatagaacccgtattcataattagcaatagtgcatacaaatgacacagtaagcctccttgaccgtctaacttcagctaatcctgttctccaatcttgatgtttccagaggatcccatggtcttcttcatggaagcaaacaacattctcaatggtctccacaccaccagtaaaatttgtaaaatgtgcatcaaaatattttataagacccaagcagtcacatccctacagtataacaaacaaaattaagttttttcaaaaacaaacaaaattaagtcaaatcagcatttaggtgcaaccatacgaaaaattctgggcatcagcttttaggtgcaacatgaagcattactaagcctaaagaacacaatttcaattacttttaaagaatatgaaatgagaaattcttggaagacaataaagaaaaataataagcaaatggaagaagttcaagtaaattactcttctgtattaattcaaacaaatcaggttgatttgaaattttatcgtaaggctgcgtttgttctagcatttggattgggattttcagcggcacgagaagcaagacaagccgcaaatgatcaaccgaatattaattattacaaacttaaaaattggatttatttattttttaaaagatacttttttatatacctttttttgaaaaaaagaatatcattaagcagttcgggaaatgtgctcacgtagaacaagaaagttgccggtccaatgcaccttagactcagcctagtatattaactgaggtactacttgacagattaattcttgtttttactatatgcttttaacatctatttttggaataacagttggctgccttaggatataagccactagtagttttccttaggatgtatgccactcctagtttttcttagaatgtaagccactcctagtttcttaggatgtaagccactagcctataccttatggtgtaagccactagcctatatatatgtatccaaccagccatagttgattgagtggagaatagaaattaaactagtcccaaaacctgtattccttttgctaacaattggtatcagagcaaggtttatctgagttccatcgattccccatccaaaatgtctctccactccattcgttccccctctctctcgtcccatgcctcaagcacttccagtggacgaggcagcaggcggtcggcggctgacgctgagggcgacggcgatgcgactgctgctgcgcgggtcgcgcaggaggcgcaagcggctgcgcgggaagcacgcgcggcgtgtgaggaagcggaggcgcggctgcaggcagccacaagggcggcgcgtctcgcggcggcagaagctgaagcagcgcgcaccgcggaggcagccaggcaggctgcagctgctgctgctgttttgcgagctgaggaggaggaggagtggcgtgacctggagcgggcagacgcggcccgcgtgcgacgcgacgcggaccgggatcgacacgcaggtcgacgcgaccgcgacttcagcccccatcgcggaggagcagatctccaccgcggtgaggaggagcggcgcgatccatggcgcgatcctcggatagaccgcgccctggaggcccagcgactccgggagcaggcagcggcgattgaggcacaactggacttcgaccgggagcagggtggacgggacgttggcgcacggagccctcgcaggcagcgcgcctccccttccccggacaggcgccgtggtcgccgtggaccctccggctctcctcccgttgtgcagaccgtcgtcaaggatgttggcggcgcatggcccatgctcaccaagactaactacgtcgagtgggcgatggtgatgaaggtgaaattgcaggcgcgccacatgtgggacgcggtctggtacggcgacgtcgactacggggaagattggcgggcgctggaggcgctccttgcggctgttccgacggagatgcagtcctccattgtgaacaagcggatcgccaaggacgcctgggatgccatcgcttcggcacgcatcggcagcgaccgcgcccgcaggtccacgcttcagaagctgcgtcaggattgggagaacctggccttcaagccgggtgaggacatcgacgacttcgttctccgcttcaactccttgcagcagcggttggcgcagctcgtcgacaccaccatcgacaaggagagagccgtggagaagctccttcgcgtcgtccccgagaagtacacgcagctggctctgtcgatcgagacgctgctggacttcaccgagctcacgatcgaagaggtgacgggtcgcctcaaggccgtcgacaaccgcaagcagctacctccctcagagccgatcaccattggtggcaagcttttcttcaccaaggagcagtggctcgcccgccagcaggagcagaagaagggggaggccacaggctcttcggcttcaggatcgtcgagtagccgcaagcgtcgaccacgcaagtgggagaaggcgcgtagtggcactcttggcggcgccgatggcgagcgcaagggcagccgcgacaacacctgccacaactgcgggaagaccggccactgggccaaggactgccggcaggcgacgcacggcggtcaagcacacgtcgctcaagcgctggagggtgacgaggtggctctgtttttcgtacacagaagcatcgagccgcacttcactcccgcacaggacgctaccacgcccctccaactcgacgagccgcgggcccacgtcttcctcagcaacggatcctgcggcgacaagatcgacggatggtgcctcgacaccggtgccactcaccacatgaccgggcggcgggaattcttctccgagcttgactccagcgttcaaggctccgtcaagtttagggacgcctccgccgtggagatcaagggcgtcggctccatcctcttcaccgccaagaccggcgagcaccggctgctcaccggtgtctactacatccccgcgctgaggaactccaccatcagtttgggacaactggatgagaacggctcgcgcgtggagatagaggacggggtcttgcgggtttgggatcgccatcgtcgccttcttgtcaaggtgaacaggggcgccaactgcctctatgttctccatgtacaggtggcgtagcccgtctgccttgcagacggccgcgacgatgatgcatggcggtggcacgagcgctttgggcacctcaacttcgaggccctgaagcagctcggcaacaaggagatggtgcagggcatgccgcgagtcgagcacgtggagcagttttgcaacacctgcatcctcaccaagcagcggcgactcccctttccccgccaagcaagtttccgcgccaaggagaagctggagctcgtgcacggcgacctctgcggccccgtgactccggccacacctggaggccggcgcttctttctgctgctcgttgacgacgtgtcctgctacatgtgggtggtcctgctcgactccaaggcagcggctgcagacaccatcaagcgccatcaagttgctgcggagaaggaatgcggccgcaagcttcgggtgctacgcaccgacaacggtggcgagttcacggcggctgagttcgcggcgtactgcgctgacgagggatccaacgccacttctccgtgccatacaccccgcagcagaacagcgttgtggagcgccgcaaccagacagtggtggccactgcccgcgccctcctcaagcaaagagggatgccagcaatctactggggggaggcggtgatgactgccgtccatctcctcaaccgctcgcccaccaaggcccttgacggcaagacgccgtacgaggcctggcatgggcgcaagccggtggtgagccacctccgcatctttggctgtctcgccttcgccaaggagctcaaccacatcgggaagctcgacgaccggagctcgccgggagtcttcatcggctatgcggagggcgtcaaggcctaccgcatcctcgaccctgcgacgcagcgcgtccgcatttctcgggacgtcgtgttcgacgaagggcgaggttgggcttgggacaaggcggtggacgacggctcgacttcgacgctcagagacttcgtcgtcgactacgtccactttgggggagccagaggagctagcagctcatcttcaccgagctcatccacctcggcacccggctcgccatcagctccggcgagtcctccaccacctacaccaccagcgactcctccatcaccggctacgccccgctctcctacaccggcgcccacaccaccggtggagttcgccactccgttgtccaacgacgaggatcgtgttgatgcgtaccacgacgacgagcctctgcgctaccgcaccgtggacagcatcttcagtgatcagcctgtccttggactggtgacgcgcgacttcgaggccgagctgcacctagcgcatgaggacggcgagccctgctccttcgcagaggcgaatggagatgtggcatggcgcactgcaatgcagcacgagatgaacgcggtcgagcggaaccggacgtgggtgctgcagatcttcctgccggccaccgcgccatcacccttaagtgggtctacaagctcaagaaggatgaggccggggcagtgatcaagcgcaaggcgcgtctggtggcgcgcggcttcgttcagcaggagggagtcgactttgacgacgccttcgcgcccgttgcgcgaatggagtctgttcgtctcctcctcgcgctggcggcccaggaaggatggcgtgtgcaccacatggatgtcaagaccgccttcctcaacggagacctgaaggaggaggtctacgtccactagccgccgggattcgtcatccccggcaaggagaacaaggttctccgcctgcgcaaggccctctacggcttgcggcaggcgccccgagcttggaacgccaagctggactccactctcaagcaactggggttccagcagagctctcacgaagctattgtctaccggcggggcaaggacaacaatgccctgttggtaggcgtctacgtcaacgacttggtgatcaccggcaccaaggaggctgaggtggaggcgttcaaggaggagatgaaggcgacttttcagatgagcgatttgggccttctctctttctacctggggatcgaggttcaccaggacagctctgacatctcccttcgccagactgcctacgccaagcgcatcgtcgagttgggcgggctcaccggctgcaacccagcctacactcccatggaggaaaggttgaagctgagccgcgacaacacggctgaggaggtcgatgccacgcagtaccggcgtattgtgggcagccttcgctacctcgtccacacgcggccagacttggcatttgctgttggctatgtcagccggttcatgcagcgaccgacgacagagcaccagcaggctgtcaagaggatcctccgttacgtcgagggcaccaccgactacggcttgcactacccgaggtgtcccggtgcgcagcacttcatcgggtacagcgacagcgacctcgccggtgacagcgacacgagcaagagcaccagtggcacgctgttcttcctcggcaagtgcctgatcagctagcagtcggtcaagcaacaagtggtggcagtcagtcaagcaacaagtggtggccctgtccagttgcgaggcggagtacatcactaccacaaccgcctcaactcaagctctctggttggctcggctgctgggtgatctcttgggcagagacgctgaagcagtggagctcagggtggatagcaagtccgctttggccatggcaaagaatcccgtcttccatgagcgcagcaagcacatccgcatcaagtatcatttcattcggagctgcttggaggaggggagcatcaaggccagctacattaacacccaggatcagctcgccgatcttctcaccaagtccctcgggcgggtcaagttccaggagtttcgcgccaggattggaatggttcaaattccccaaaaggcgccacacaagacttagggggagaatgacagattaagtcttgtttttactatatgcttttaacatctatttttggaataatagttggctgccttaggatataagccactagtagttttccttaggatgtaagccactcctagttttccttaggatgtaagccactcctaatttcttaggatgtaagccactagcctataccttatggtgtaagccactagcctatatatatgtatccaaccagccatagttgattgagtggagaatagaaattaaattagccccaaaacctgtgttccttttgctaacactactaacagggaacaacaaaaataacctttttaagagagtgtgcgttctttccaagcccatcttctccagcatcaaatgcattcttccgataatgtggttcatttggatctccataaggaacaaccatctcaacgaaactcagcctgtgagcgataggtcgacgcccacggtttccatcaacatatgcaacagaatgaataactaaaccttctttgggagtaaagccaatacggaagttccactgttcaatagaaataacaggtgagattttttgagtcagttttatctaatagtagctcaagtgctcaacaattgaaacaagaaacagaagataaccagttaaccttctgccattccacaaagtaaccgttaacacgaaaactggggccatcaggttgattgatgataagagtcttcaaatcacttctatcaacaccacctcgtgtttcccctggagtatagtttctcaaatgatctggtggaggaagagggacaaacttcctatcttcaaactctatcacggtattattctgcacatcaatgacgatatggatcccttccacaggtcgcgcataaccattctccatagggctatcactttcagttctacagaagatcagaggtttggcaattcttcgattgggagcatcagcatcactgtaatatcctgcacacctatattcaactagaacaggtcatgtttcaaggttctattgtttcgcaacaagaatcggaggaggacgagaagaaggatgtagggaaatccttttgtttagtcagcatgctagatcaattagtgagtgactggatcgatacaactaaaaaaactgtttacaagtttctttacaaatcaaagacatggagaaagacggtagaagtgcagttggctaaaggaagaattatttggtgagtgaatctttcttttcaatgagggaaggattctacgtcagtaagacaatgacagcaaaccccgaatgttttataaagcgtttattaactacagaaattaaccagaccaagcttaccatggatctaccatgacaagatccatgtcatcaactcctctttttttcattgcttcaatgaaaggggggtgacttttcacagtagcttcacattcagcatattccatggcatcctgtaatacacacaagcactacaagataaatctagtaattgacctaatataagtattcactaagtgcttaactatcaaagtaagcatcaaactaagtttctgtgattccgctgattgttttaggccctgtttctttcagcttgggattattataatctagattattgagttagattactataagctagattgttataatctgtagtagaataagcggttagttgtttctttcatagattattagagcctagattattgggtttgcaagtctaaagagggagtggggtggcatggtgggtaatttttcacccaataatctggaaaagctcacctaaatgagtttatcagattataataagctgggctccagattataataagctacttcaataagttgtctgtttctttcagcttactcccaataatctggattataataatcctaagctgaaagaaacagggccttagtggcaaataccacagcacaccagcaataatttagaaccacatgctcattagaaaataaatttggctacatataatctcattaagtgttaaatagtttgaataaaatggtcaaaatcaagaaaattgtgcccaataaatctatagaaagtggaaatatatcattgcaggctgaacatttggaacaacctctgatgatatgagcttgcctctctaatgtccacccctagtagcagcatgcacttcggagagctctacaatccaaatactagtctcatttgtcattttgttgtagacaacaagcctggccctcctagctggcagcctggttggaatgataggagtatttttggttctgggaagcagtgaaggttggaatggtgggaaaaagtatgcatcagctaatgccacgacagttttttctggttccagaagcacaacttcgacaaaacgcatgctgtctcgaacctataatttcgggagtgacttaattatatatttggaacatgagtacataattttgtatgaaaggtagtagatggacagagacctcaggagttcttccagaagctctgacagttgctacagccacagaaatttcagcagcagatagtgggtctaaggggtggcttttctgtgtcctcgtcatgatccggattcctgaaatgtttctcccgcataacgtcaagtcattgtgatatagcatagctatgtactgatgcttaaattgaacagaaaatattaaactatccaaataccaaattgtggcaggcaaagggaatatcatagaaaacatttgactctttttttttcttttgcaatttaattacagagtaagggacacaaagtttgtatctgtaaaagatagctacacacttacgcagatatttctcaattatgcatgtgcccaccagataaattgcatatggaaccattaaaaggcccttttgattatattgatcaagcatttccattctaaatggcagaatggcatcgttctgttagctaacacaagataatatttcagaccttttatttggtgggggagcatcgattcactcgttcgacaaacacaacgctaagatcaaacacaaaattcctaacacaatgacactctggctcgtagaaactttccaaaaaaaaaaagcacacaaccaaaacaccttaggcaaacattttccctacgctccaatctgatctctcatcgtggtcactcacacctgaagcagttcataaacggaacgccaccgaccaggcgctaacattttccgcagacaagcccaatccagcaaaggggggcacccgaagagagagggagttcaaggagagtgagtacctttagacgaggcgatggcggtggcgggcggcggcaccacagtttcggcctcctcgatcacgccggcggcggcggcgatcgcggcgccgccgcagcacccctccgcggcgcccatcggagagggtccgaaccgcgcgcgcgcgaggcgaggcgagaggcgagcggagaggaggaggggtttggggggtttttgttttgtttggttggtatttcgctcagtctcttattttattactccttccgttttaaaatataattatttttagttttcgatatggttttcgaaatattaatttgatctataatatctataaaagtaaaatattttaaataaaaatagttatagttcgtttaatgataaagatagtaatatcaaatttacatgattaattttttttaagtttttgttgctaatagttaaatttaaaaagtttgacttggcgctatactaaaaatgcttatattttggaacggatggagtattagacaatggtggctgactgagtgttaaattaacgaaaaaaattggttgactggactattcgtcatgtaattaacatgatcacttcatgtgtggctactgttcactcctccggtacgatatccgcgtcatataggccgagtttagtttcaaactttttcttcaaactttcaattttttcatcacatcaaaactttcctacacacacaaactttcaacttttccatcacatcgtttcaatttcaatcaaacttttaattttgacgtgaactaaacacacccggggttaacatgtgaattgaattagggtctcatgttttctagaagaatgttctacaccttctattcatgtatgattgacctatttgagtctaacgcagtgaccaagaaaaacgcaactcaatacacgggacattggtgcataggggaatccacaagtagttgcatttgtacgggagacgtggctgcatatgattggaatgggtgaacattcgattcacaagacctactgcgtgcatgcatgactaaaacaaagcaacgacagcatccaaacccaagaatgtgtggcaaaagaaaaagatgatgatcaaaatagaaaactttttcagagctaatatgtctattaaacacaaatgaagagaatattagatagcaaaactttatcaaatagttactagattattaaacttttccattcctattaaagtctattcaaaatgaataaaaattctgctcataagcttttctacatgaataaaaaatatatttacaaactttctacaggagaaaaatctttatacacaaactttctacaatagttaaagatagtttacctagcaaatctattttataattaaaggaatagaaaaaggaaataactgaaattcggaattaaaaataaggaatattagaagaggagtatagagtccatatagaaatacaattaggaaataactgaaattcggaattaaaaataaggaatattagaagtagagtatagagtctatatagaaacacaattaagaaaaaaatataaattcagaactaaaaaataaggaatattagaagtagagtatagagtccatataggaatttaaaacttactaaaa

SEQ ID NO: 39239 - DNA, 2291 bp, Oryza sativa
agagtccatataggaatatacataatttacaaataactaaaatttgatattaaaaataattaataactaacacgtatataaaatataatttgaaaattcagaaataaaaataaataatattggaagaagagtataaagtctatatagaaatacaatttacagaaaaatcggaagtaaaaaaaaagaaatattaaaagacgagtctagagtccatataggaatatatataatttataaataactaaaatttgatattaaaaagtaattaataactaacacgtatataaagtataatatgaatattacacattagtagttttttaaagttattgcaaaatttaaaattatgttgtcattttaatatatttgaacaatataatgagaaaacatatatgctattatatgagagaaaatataatgatgctagccgcgcaatctgcgcgggccaccatactagtttctatgaaagtaaacgacttttcaccatataaaatctaaattgtataactttatgttaataaactttcatcacgaataaaaactttatattcaaaaactttgtacaagaataaaatgatacttgaattttcaaaaatatcttaaaactaattcttgaattaaataataaaaaagtatatgtattcttgtcttaaggtgatccaaactagtaattgagccaactcagccaaacaagctacgacacataaacgtgtaggctctcaactcctgacaagatatgttgcacgtaaaatgttaggatagtcggaaaagcaaatacggttgtaacgaaaagagaaaggatgtcatatacgcgcggtaagcttgtgtgcgtttgttcgcataacaatcttctcagtcttagctagctagtttgaggtaaaattgacggtttccatgtaaatctacggtacaatgttgccctgcttttgtcatcatggttgctgtaacacgtaatgagtcacagaatttctaacctaatactcccttcgttccaaaatataagaacctagagtagtcttcattctgagtttcattctgagttgtattcattcgaagtagtcttctaccctactgtaaaagcataccccctcgcatagaccgcgacacagttgccaatccacatgtttaattactataattactaatataaaacctaaatgaaatgtataatacatatttgagtaaatttcataaaacctcacatattatggttcaagctacacaaaccacatggattttgatatgtgacatataaccccagatattatgatcctaaagttttacaaaaccatactattgatcattgatcattttgattttgatctactatacttttgagttctacaatcacatctcaaatttataaatattttatccatcatataaatattactttttttgaaattttcaaataggaatatatcaaaatagttaacgatgtagttttgtgaagctttagtacaaaatacctgggtttatatgccacatgtcaaaatccctgtgattttgtgtaacttggaccataataataggtggaatttatgaaatttactctacatattttgaactattttaagacaactctaaccatatcactttcaaatattcagttgaaatattcaaagagaacttaagtgtcaaagtttaataacgttaattacacacatttcgaaacaccactttctgaccagaggaaatagttatttagagaaggctttgttactttctaaggcaaattacatgacgtctagttaagtatacatgatgtacaaagattacacatacaacggccgtttaaacattggtgaaatcgcttgattggatgagccacacaaacaattcacaatgtccgggtactttgcttttccaaatcagccggccataggaaggatcaatgtctgcaaaggaaaggacaattgagtgatttgagtccgagtgtaggacttggaatggtcggctacacaaggcccaggtgatagagttgcgagcacaggctgatcccaagggcctcaggcccatgaaatgaccaccacagtccacatacagcgaatactgatctgttttcaaaacgctttcattggctatttgcgttaccttccaaaacaaggagtacctatgcatctttcgaaagatttctatgatcatatcatataaatttttaatctttggattaaaatccaatagacatagtaaaaggcaaaaagcaactaagaaacaccatatagatactaaattaccatatctttaagaaaaagaccaaatccaatataaatttcaaaacttacatgcga

SEQ ID NO: 39240 - DNA, 1390 bp, Oryza sativa
tcatggcctgaggtactacccttcagccattgtgtcacctgccaagacactgaactcacacctgagctttccccatgccacaatatcctcctttgccaatgctgataatggctccagcgggcaagcagatgccacagagtctgaggaggagcagaacggggaatctgaactgtcggagatggccaaggcattccatatatcgccccggatggcaatgtcaatctcagtggtgattgcatttgcagcgctcactgtgccactggcgatgcagtcagtggtcttccatgggacgaacaaaatgaaggcactggcatatctgacactgctttcagggttctacatggcatggaacattggggcaaatgatgtggccaatgccatggggacgtcagtagggtctggtgctttgacactccggcaagcagtgcttactgcggcggtgctagagttctctggtgcattccttatgggcacccatgtcaccagcaccatgcagaagggcatcctagtcgcatctgtcttccaaggaaaggactctctgctcttcgctggattgttgtcatccctcgctgctgctggaacatggttgcaggtaatattccaattagatcaccttatcagttaccgcccttttgagctttgctggaatggtgacgatcagaggatgcaatcatgtagtgccattagcagtacataattactgagacttctgcaagtttcagtatatgaaacaaaatatttaagacattccatcagcgacacattcatgatgcaagaatagcatgatctacctagcaaggcaaaatcaatagacctttgcacttgaagatgctaggttaagccccagaaataaatgatagcagtaagttgtagcagctttattatattcagtgaaacctactgcatgagaaccttctatgagttgattgtactatattacacaatttcctttgaggtataaactccacaatacggtaaacaacttccatggtaggaagtgaaaactgaaaagggaaaggaacttaacagcatagctttaaacttgttgaagtcttttaacgtaaggattttaatccaattatatgcagtttcaggatgttgtgtaacatccatccgtgaatgttgtgcagctcacttgcaattaccagagtttgatgtctatcttatcaacaatcccaactagcagaagtacagaagcaacaaaatgagacaattaaagacaatgctcactagaaatatagcaacttttacaagggatagactaatggaatcttgaatcattagacaactaggcatgcacaattttgatgaagacatttttggtgggactctaattgcgggagaatgtttcatctgcttaatcattggaattaagatattttcatgattg

SEQ ID NO: 39241 - DNA, 1401 bp, Oryza sativa
cctgcagcccattgccgatatctgctacacatacacttgttggtgcagtgatgggagtgggatttgcaagagggctcaatagggtcagagcagagacagtgcgtgaaattgtggcctcctggttagtcacaattccagttggtgctgtgttatctatcttctacacattgctcttcacaaagattctggcatactttatgtgagtgattgtgaaatgtaattagtgttttgagaggtgtacagcccattgcacttcataaaaatttccgcaatggcaaagagataggctgactccaaaaagtttcgaccataaaatttttcaggattggccagagtaaataatcatttctttggcaacaaaacacatgattaggtaaaaagcttttacagccagttacaatgttacatactccagcttgttcgtccgtttatctctaatgtactgccttgtatcttttgttttatatcacaaggtggaccataataatttcttgtagagatacaattatacataatagacaacaatggttcttctatccttgcagttatgttacatcaaggacatggttctttaatagccactgaaaattaataatgtttttgtggtatggtgcaagataatagcaagttcactgctagcaagaattcagaaaaatccttttgcattaagaaattaaactaacaaataaataaagcataatttctgaggtgattagtgccaaaaacactcgcacattgcgcaacttgtactaagattcagcaagaaacaaggaactttgtgctttgttgtttaagtagacatatttatcaccgtaaatagaggcatggatcttcagggaaaaaatacagagaaaaggtaatcaacactaaaagtaacaggtttatccatttatgcatgagcaggacagacctatgatcataataatttttccttttaacaggactctaatgtagtgtacagtaccttttttacaaatcatccatgaattcaagcattgattaaagcatcattatgcaacttctatagatacttgatcagctcggtcctcaggttttggatgatccgtaacacaaaaccaccggtttggggggtttgcgttccggatgccccaaaatacaaggttttgtgaaatttactctttgggaaaaaaagagtataaaaaggagagcacttacacaaggctacgggcacttgcacacagttaggaaactaatactagattcttaaattgagacacgcaaatgcaccaacaagctattccgatacatgttattcaagcaataagggaagcattaagatttttccaagaaaaaaactactaggtaaactgaacacatagagatagatcagattggggatagcaagctgtagcacgcacgcaataaatatgggagcagaga

SEQ ID NO: 39242 - DNA, 994 bp, Oryza sativa
ctggacagccgccgcgcctccccacccgcccctgccggatctggcggccgcgccgccgccgccgccctcgccggctcagcgccgccacgcttcccctcccgccctgccggatctggcggctgggccgccgccgccgcccccgctggctcggcgccgctgcgcctcccctcccgcccttgccggatttggcggccgggccgtcgccgccgccccagccggcccggggccgccgcgcctcccctcgccacggcacaaagaaagaggggagagatagagaagaagtggaagagatagaggagaagtggagaagagggagccggccgaccttatctcctcatgtgggccccgctgggagaggagacatatatatatacagtggcagaagtcatctcaaacgggctgggacttaaagccgtttgaggtgagtaaacctcacctctgacgggctgtccggctgcgacccgtcacaggtaactagtcacatatgacaggatctgacgtagtgacatatggttatatgtagacgtgccggagacagtgagtgagtattatttctcctaagtcttgatctatcggttgagatatgagtatcactctacaaaattatcacgattcaatctgatggtgtatccgatcccaatgcccgaaaactacgcctacatggttccttttcagaacgagtagcagaagaaacttgcgatagatcgatcgggatggccgatgcaaacggcaaggcgctagctgctcgctatactccgtgctccataaatcaagagctagctagctagctactcatacctgcaggggggtggtggttagtgggagtacagggaataggctctcctactgatactgtaattattcggagaaaggcgccatgaatcaatccatccatcgatggagctagctagtgcaggtagccgtccacgccaccggtgcgtggccaatgcatggactcgccccgcccgcgcgaagtcaatggctgccgttttgt

SEQ ID NO: 39243 - DNA, 1763 bp, Oryza sativa
aaacgaaacggagggagtattaattttgttgttctatcccaacgagctaggcgccggcccggtcatcgatctgccacgaaccaacgcgtacggtaacgttttggcacgggttcgctaaaaaatatcgttactgactaccattagcacaagaccagcaattacgtttataatatgttcggattgagtaaaatgaatatactctcgtaaataacgtgaggttatatccaaacgccaataattttaaaacgggaggaagtatgtaaatggagtacgtttctatctcttcttttaagtacgtaataaattacttctaatcataattctcctatacattgtgcactagaaaaattatattgtagatattggaacttaggccccgttcgaatccaagccaaggggtggataaacttttggatttctgtggtacgctttttaaactgttaaacggtgtttttcgtgcgaaatatataaaagttgttttaaaatatcggattaatcaatttttcaactttttaataatttaaaattaattaatcacatattattaccacctcattttgtgtgaaatacttaattttcatcttcatgagattcaaacaccaccttacattgaaattacaatataaacttagaatttatagcgtaattacaatataatataagtgtagggaatatacagtgttaaaataatttgattattttttggaactagtaatatgagatgttgtaagagatcatgcccatatatatagttagagatgggctagtagtgtgattgaagataaaacattgtacccaatgataatttttcgtgtatgaatgtgatacacacagtagaagggaaggtggacgacttcgttttaagatagtataaaaatagcgtgataatgtagctactcccctttgacaatgcttgtatatggtggctataggggtatacacaattcattgaaaccaaactaagcgagatcgaaaactcagtcgtcaattgtaatgaaccaaaattaatatggtcgttttgccttgtcacctctatcattcccctgtcgtccacctctgcttccaacctccccatcaccatcgcccactgctatttcggtcatgactgaagaccaaccagaactgaccgaaacaaaatagttcggtcttaactatcatgtgatgcattttagtatttggtttgaaatgacctctttgtagtggatcgtcgacgaaattaatttctacacggatggttacgtccacaaatcgctgttttcactaacgcctgcgtccacgcggggcggccggccgcctatatagggtctgttcgggggagtttctagctgctgcagcttctcacagaatcagaaactcttctaaacaatccagcttttgatctagattctgaaaagctgtagttgtagaattcaggaaataaactagaagtcagaagctgagaaattcagcttttccagattctgagaagctgctaccatccagttgcttatcagacttttaagttctcccaaacaagcctatagtaggtgtagggcaggcattgaccgatccgttgtcgctctaaaagaaaaggaaaaggttgactgtgcagaaatggaaaggcctcaggcgaggtacgacgtgctccggccctacctagggagcatgtcttctgcacacaagcaggaacagaagaaagggcagggcgacgcagaagccatcatggcgcctttcatcaggcagccttccttccggttccggatcgtgcccgatctccttgtcca

SEQ ID NO: 39244 - DNA, 3433 bp, Oryza sativa
gcacgaccaggcatacatcccctcattttttcgcttatatttataattatcaatcaaattttaattttttaattttttatttgaagctgattttaagatttttcatcgaaatttatttttatatatgtatatatatatatataagttttattcacaagttactttttatttgtaaatacgacggttcggctccgtgtcggaatactacaactatagaagcctctcttcatctctctctgtctgaatacagatcagagccgtcagagcatgcgtccagtactctcctctccggccatgcatgccgtgacaacaagaaggctccaaaacacagccttccctcctagtatagctcctactagctccatttaatatcggaccggtggacagtagcttactgctcgatcagaggcatgcacagtgtgtgagtgagatgaggtgcatggccgtgccatatcctatagtaggactaccttccaaaataagtgcagccatagatattagtatttagcgctttgaccatccgtcttatttaaaaaatttatagaaaatatttaaaaaattagtcacacataaaatactatttatgttttatcatctaataacaataaaaatattaatcgtaattttttttaaataagacgaatggtcaaacgttgaatataaataatactaaaactatacttattttgagaaggagagagcagtacgagtaatacgcatgctgtcatgcaatgcatgcatgcgaatatatgcaacgcaaccgctctcgcccgctgatccgctacccgctgcatgctacatgcggctgggctggcgtggtggccggccagcgtactgtgtactgtaccatgatttcgacgtacgtccgtggcgccgtgtttgcatccgtggatgcttgcatggcctgccgcgcgtgcagccatgcaagcgaagcgagagcaaaagaaagaaagcgcatgcatgcgtgtatccgtgcatgcgtctgatggtcgctggccggagttgggcatgcacgcgcctagcttaagcttagctgacggatacagggctatgaccatgcagatcgatgcaggcggcacgtctcgatccggcgcgacacgatctgatccttccccggccgcttgggagtacgtaaacgtacgtacggttcgtgccgatcgacggggtgtgtgggcgtgggtgcatgtttggaggcatcctcttgtcctacctacttaccccgaccgagtacaaattaatgtatacatgcatgtgaggtgttcttgaggctttcttaaaattttattgaaatttcataaaactatacatactttgcacaatttatcaaactacagatttaaaaacttattttataaaactacagatttaatatcttcatttatcataaaaccacaggtttaatgtcttcattaccacaaaactacaggtttagcattgttaaatctgtagttttatgataatggagacactaaatttgtagttttgtgataaatgaagacactaaaatctgtagttctgtgataaacgaatacactaaatctgtagttttgtgaaacaagtttttaaatctgtagttttgtgataaattgtataaaatatctgtagttttgtgataaatggacatactaaatatgtagttttgtgaaacaagatcttaaatctatagttttgtgataaattatgcaaaatgcctatagttttgtgaattttacacaattttatttgatcgatctgcaccgttggatgcgaatcagatgcctcgtatttagcttctctgaatgaactgcgcggcacatttctctctaagctcagtcattaagggcaccagtcgtccattatctagctaggatagttttaacactcgcgcgccaatggacggctggatcttgatcaacagctaaaacatgggactaatgttatatgataaattgataattcaggttattgttaaatagctaacggtgtgctcaacttatatgcgatatgcacatgtaatacacttttggtacaacaatttcgtttgcaacttgcaactctaacaaatatgctgactaaccgccactgccttttcaccccatccggacatgcatgatgacgcccacttttatactgtctgtatatatagtaccagtcacacccatgtcattgcgacggtacattaggtggtgtatggatccataagtcctggggacttatttcagtcctagaactaatcactttagtccatggctgttttgttatagagactaaaagggactaaagttcattaaatacgctgcacaatgaccatgttacccctaaaatcatacaaagagaaatgcaccatacccatgcatgagggcagcaggtggaaaagagctactttagtcccaataagctactcccttagggacttatactaaagcactttagtccctcctgtttgggactctacagatttaaagggacttaaagtggagggacttcttttttagacctaaaaaaacagggccttagtaaactgtgcgggggatccgcgcactaaccgtgcgtggctacttttattcaccgtgtggaggagataagcaataacgagtttctatagcctaaggtatacgtatagaacacaccacgagcacacaactagtaacaaccctttgaaaggattaccatagaaattctgaatgatttaatttcctaaggaaattttcctatgaaatactttgattcataggaaagtataaggttcttatcggttgctcatatttcctactaattaagtcaaaatgacttattagaaaataaaaaaacatctttttgtaaaaaatttttatgcatgttcttagcgacttaaaaactaatgctaaaagaaactatattgaaaatatcttaaaattgcctttcaaattaagtttgaaaattcaagagattttctccagtccaataaaatgtacctcgaggtatcggtatcttatggtaccaaatcgtttccgatcgttatatctaacaatgcccatcctgcccagctagatccaacgattagaaatgatttggtaccgtgaggtactggtattgttggaccagagcaaatctcaaaattttaattttaactttggctttggcttattagggcaaccaatgggactcttaagaatttttctatagaattatatttctatggctcaatttcataggaaaataagtaagggggtgtctagagccaggggtgtaaagttttgacgtgtcacatcgggtattatatagggtgtcgcatggggtgtttgggtactaatagaaaaactaattacagaatccgtcggtaaaccgcgagacgaatttattaagcttaattaatccgtcattagcaaatatttaatgtagcaccacattgtcaaatcatggagcaattaggcttaaaagattcgtctcgcaaattagtcgcaatctgtaaaat

SEQ ID NO: 39245 - DNA, 8536 bp, Oryza sativa
ttctggttagtgtaatccgatacaggacattgagggagcctaccgggagatcggtgaagtacgagaaatcataacggaacgtgcgtgcgtgcccgcctatccccgccgaccctgcatatctccgcgcgcgcatgcaccgggtccggcgcgaggcacggtctggtccgcccactccgggtccgggatcggagacggacggacgggagagagagacgcccacgcggccgtgtaccgtactgcgtgggcgcggttctccgcgcgcgaatgctacgtgcgctggattcgatttgacgcgcggcgatggatggtggtgggggagaggggatcggatctctgctagctccgcggggcacccagggggggaaggcaatttaacgggagccggctttttgtctcctggatcgttcgaccgcgccggggcgcggggcggcgctgcgctgcgctgcttgcgtcgtctcgttcgtacaagtacgggacgacgtcctatcgatcgctttggtcagatcgttccggtatggcccgtagattgggcaagtcgaacagtgctccctaacatactgtatatagggctgtgtttagatccaaacttctaacttttttcatcatattaacatgtcatacatatacaattttttagtcacatcgtattaattttaacctaaacttccaactttggaaggaactaaacacagcctagtccgggtttagtttcccctattcccaacttttcatcacatcatatcacatcaaaaactttccatcacacataaatttctaactttttttcaaactttcaactttcttcaaacttccaacttttttcagaaactaaacacacccatagttatgctcattgtggctccaatgcttagggtgtgttcggatgccccttttcccaacccctctccctcgttttccgtgcgcacgtttctaaaactgctaaatggtgtgtttttataaatgtttctatacgaaagttgcttaaaaaaatcaaattaatccatttttgaaaaaaaatagctaatacttaattaatcacgcgctaatggatcattccattttctgtgtggaggtttctggttgggaaccaggtacaacgaacacacccttatccctattgattcaaagaaaattcatcagaattttagagtctttcattactatagtaatttttttaaatatctcccttcgaatcaaagaaatgaatcttatggaatggctaatgccatgcaaattttggaggaaactaacatgagattctacctcacggaaactttcctttgaatctttatctctcctctaatttctgtgtttttttgcggtccaatcaaacagttattcatgtgtttttcctatgttttacaaccctctgttttatacttacattcatgtaacatactaaatttttcagggtaaaatttttgcgaaaatatctaaagtcgatgttcttcgttctttcgaattggagcctcccaatccttatattccttttgtttcctctaagtttccaccttccgcttaactttatttagtttccctctccaaaccaaatccgagatatcccaaagaaaattcccaaaatcatcagaagagctcgtgtttattttaagttaaaccggagtaatcatgcaaatattctaaaacccccaatctcatcgattcctattcaaaaatatcctaccaaaattctattaaaaatctctccaaaaattcaaatagatcactgtgtttcttctcgggccgagttcctagcaatccagcccatattctggatttcctttgcccatttccctctgtttgggccgtgctggcccacgactgctgttggcccagccgaggcagccgccgcacgcgccgtcctgcgccctgctcgtgttcgcacgcgctagtcgcgtgcggcctcgctcctgcctgcgctgctcatgtgccgccccgagctcggcacacgcccgctcgagccgcctccaaaacagccacgcagttgctcgttgccatccctcccttgtttcccctcctcctccagaccttctctccttcaaagtgaacgagccgaagtccgctattcctctgtagacatcaagtgctaatctcgttttcatccccaaatttcttctgccagagccaaggccggctgtgcagccgtttcgccgtcgtcgacctttttccgccgcaccatagcaccagcaggaccacctctcactggtgagaattttccccaaccttctttccttgcttctatcgggttcctatcgtgctcctgtccgccaccatggctaccaccgtgctcagtttttccggcgcttcatctctatcaactaaccacaaaaatggaaccttctcatccgggaacgcgttttgacgcgctcaccaggccacgttcgccaccggagctcgccacccaatcttctctctcctctagcggctggaatcctatagttcgcgttccggccagcatgaacatcctctcagagaaccagcaacagcttcgagttcgtagcacctggggacgaaattacctcaagacgttcttactgttccgccacaataaccgtcatccaacttttctctttttatctctctctctctctgtgttcgtggttcacagaggaagaagaacagtactagattcaatactgttccaccatggtccagcctgaccacaccacctgagccaacctaggtagttgtcaaccaaaagaaaaccgattcatatcaattcttccatcagttcacccccagattcaaaccaaatcaattctagtatctgtaacaacaataatcccaaagtgcaaccactactacacatgccatgaatcataaccctaggataaatctttttttcatccaactcaaattaactctcgatttaacattttcttttgttcgggctctgattcacaatatttattttatcgtttatttgtagtatttttgttataggcttatttggtcgtttcttcgtgtgcatacgctagatcgcgttgaagatcccaccggactcgcaggaactgaagtggacctagaaggctacgttgaagctcccgaaggccacatttcacgaggcaagccatagttccaatctttgatcatattgaaaccttgtagagaaccacttagttattttctgcattgagtatttataaaattattttgcatatgaattatttttgaataaacttgttagtttagttattacccattattacattgttattattggccaaatccatgaattgctatatcacgtcctttgataacctaggtgtagatttatatacttcacaataatattctagtggataagactaccaaatatctatactcatatacatggtttacccgtcgtcacgtggtggcgtgtcgggtgatataaaatgtgttatttgatatgagtcactcgcctggagtgatatggaagattaattccgggtgaagatggatgttgtggtgtgtgaggccgtgcatattgttataattattttgtggaaagtgtatatttacacttgaagtatgcacgggcctgtgctagttttggtggctttcccggatataaggactacccccttatgccatggaaaatgatgtaatttgcgcctatccataggactgagtaatcagacttagcctagtacattgtcccactatatgaaagactgtagggtggctctatgagcaggtttggggtggacatgtggaaggggctttggccaggttgacatgatccacaacggtggaacccgtgaaagcagcgaccgtctagccttgcttaggcctagcaagtgcccgactgctaggacggatcaatatcccactgggcagtaactagtagtaagtgggattctcaaacggctatgttgtcctcagcctagctagctgttgacatcaggtgggtaaagctgggcagtctctacagagatgagtcttaaatcattcgaatgtgccgtgcttccggttaagaagctatgtcattgggtgattcctatttatcatggtatgagtagattttaaattaaaatatggaatatgacgaagatgaggatgaatggtgattaatattgctaccattttaaaatgatgatttataattgtttgcgaataaaatgtttgataaagtagggaaaaactatttataataggcttgttatggaacctccttgatgaactatattctttgtacgccttgcatatattctatttgtattattatggatgtggcttgttgggtacctcgttactcacctcttgcataaaatgtggttcagacgatcagttcttccctgaggaggcgcaggaaggggaagaattctatggtgctgtcgagtttttgttctaggttgatctgctctcaggcgttgcctgtggtgtttttatcctattttgtgtttgagtcttttgtttgtagggagtgtgtttggcctgtcggcccctaaaacctgtcttagttatcttttatgtaataatttctgtaaaaacttgggtatatgtatcgaaagctgttctgtatatcaatctgtgtgcgatcgaaatcctggacggtcgcgggtggtttcgggataccatactcaaaccgggtatccccacaattcatatcaaaatcatatgtttttcctattcctacgttttctcaatcctgcgattcaaatgagcccttagggcccctttgaatcacaggaatgaaaaaacggaggaataggaaaaacatatgattttgacaggaatgtaagtgtaaaacagatgattgcaaaatacagaaaaacgtatgaatgactgtttgattggatcacaggaaaaacacaggaatttgaggagagataaagactcaaaggattttttctatgaggttctacctcttattaaaattcctccaaaacttatataggaagaggcatttcataggaatttcataggattccatagggttcattcctttgattcaaagggctttgtaggaaaaattcctataggaataaaatcctctaaaatttctataaatttcctttgaatcaagtaagtctaaaatatagaattgcaaaacacgtaaatatctacggagtatttgattagaccgtatgaattcgatgaaaaagatagacttcaataatttttttaagaagttgaagctcttactaagtttcatctaaaatctatattaagtgagccatttcacaagaattttataggatttgaaaatatccaatcttttttattaaatgattaaataggagttttctatagaatttaaattatataaaattcctatatatattttttatccaaggactcttatagtgcacactgcttggcatgattggctaggcctggcagcgagccgctcttaaatctctattatggcagccaaaaacagttaaatttgctcttaagcatcgagtgacaaattttacaatagttgaataaatccgaaacctccattttttttcctcaatcgatgtaccatatctaattatatgttaccattgtaactactggaagtattatgtaggagtatactgaatacaattgtttctactggcaatagaattctaatggctccggttgtttttactaccagtaataccgataaaattgttctcgatgactctgctagctgtacatgcagtggagaattcgccgctcccaaagaccccaatagtagcagtggacgatttgccagtactccacagtacatgtcctactatagcaatggggccaagacatcagacacagttctattcccctgcctgctttcctgtaaaaaaacattagtatgacatgacgggctatagcagcaacgacagcaacactcgttgtgacaaaaggatgaacggcaatgcccaagtgagaaacatgagaggcaatcccatccaataatcaatcagtccgatggagcaaccagcggcaggccagcagcgaggctagcagcagcaccaacgcgcacgagcgagcatgaattttgttttgttggtgaccaaagggaggcacctaccaacaaggcaacaactcaacgtttcaacagaggctcaacattccaacaactcaacatttcaacaagggagcccgagaatcttgacgagttagcgtaatactcccttcgtctaaaaaagaaccaattcttatgaatatggacaagcatatgtttcatagctagaaattaatttttttagtacggagtgagtactacagtgcaggctgcagctcgctgctgtgcggagttgacggctccacgtccatcctgtccccgctttcattcgttcgccggctcgccgctgccggttcttcacgcacgtcaactgctgcacgtcaactccatgaacatatgaagttcatttctgtaagtaaatatcataaaaccataattactttaattaaattatcactaaactatagatagaaactatatatttaacatcatatatatcgtaaaactacaaatttaaaagatattgtatcacaaaactacagattaagcgatgaaattataaaaaaactacatattttaaagtttatatctatagcactattgagattatgaaagttgtagttttatgaaatctgtagtattttataccataccttgaatatgtagtttcataaaaaaatgatattaaatatgttttatgatacatatatttaagtatatactagttttgtaatactctctcattccaaaagtctaagtactatttcattctttgatttttttcaaaagtctaagtcctatttgtagtcattatgtgctatattaaatttttgatcgaaacccaataagtcattttagtagttattggttgcatgtttattagttttgtcacatgatgaacgagttaactacatcttgatcttggtgaaaaagaaataggacttagacttttgaaaggagggagtagcttgatcaaatgaaatttactttcctttctctaaagagattaagttaaataagggatggtataattgattaaggtaagaaagtagatgaaaacacgcttatcctatatatctataaagtttatttcaataagtataataatgttatttctcttttctctaattaagccacattatcttaactatttctaactattggacggttgatctacgtccaaattatatcactcttttttcttctcttataaagttatatcaccttagttttgtttttaaatgattgatttatactattatgttatttcttttccttctctcattgactcacatcatcttagtttttcttttatacgatcaattcatatgtatttaaattgttataaaccacatcaaatggtttatatatagcatatagcctttttctcaatagttgatcagagataaaaattatacaaagtgtgtcaattttacgtgttatttttactaataacatataaaacccccgcgggagtggggtttcatctggtattcttaaacattcaattcgttatttaccgctcttgttataagcgtgaattgttttgaacttctcgattgtttcctaataaatacaaatcgttgtacaacttccggacatattctttttcatctttcttttacccctcccgtaaataaataaatgactacttttgaatgcagtaaaaatgaagggtatcaaaagttagtcttgaactgttctatgcatgtggagtaagtctaaaacttacttgtgcagttatattagaggggattatggttctgatgaccatggactgttattcctgccgagcatcctcggcctgaactttgcccccgatacagactcagcaccaaactatcaacattgcaagcaagagaacaagggaaagatacagagaaggaacagagcctatagaagtatagcacccccttgatttccagcacaggagaaaactgatgaatgcggattattactatacgatgagcgggcgcagtttagacattgaataacttgtccaccgaaaatatacgacagaactattttcatcactgatagcaggagtcaaaagcttactcgatttatcctgccggtatgttaaacatgtcagaagaagagaggggtggactgactagcagaaacaacagttctacaagaacttctgccattctttgggtatgggctatgggcaccgggactcgccgccgggccgtgatccgagccgctgtgcatcaggaggtaatgttctcttcatatttgcatcctccagggagtttcctttgttctgtgctaatagcactggctgaagcagaaaaagaacccccttggcttgtcttccatcttgcccttcggtgtgtcgccgaggtcgcctcgagaagccattagggagcttgtcccaggagattcaggaggcaagattgcattctctgaactgaacgtccgaggcggagccagaggttctggtggcgaaagggtggaaaggtaatgcagaagcatttgtacgatctgcgtgaagttcggtctctcattgggttcttccttccagcaggttgttaggatttctgatagctcctcaggcaaattatctgcactaggtttaatgttttgcagaaaatgaggcttgcatcatgtcaaata

SEQ ID NO: 39246 - DNA, 31634 bp, Oryza sativa
agtgtcagctgctatgtggcatactaggctcatggaccactactttgtgatcagtcgttgtccttcacatgaccaactgaagatgatagaattcgaaggaaacgtctagcgctgagtggataatcctgagaattttcttacttgttccactgattgagaaatttcgttttgttcttcgtgagtcaatttcaccaagtgcattcatatctgttccccttattgggaaatttctttcgttctttgtgtgtcagtttcactgagttaagttctgaagattattttagccgggttggccgaagaagaggccaaccaattgtattaagttttgggacaaaaagaaacaggaactgtacatgttggcaactgtacatcgacaggatgctgtcgaaaacggaagaagcacaggaaaccccacaattacaagctactcatcctgaaaaggaaacaggcctgcttccttccagatcatgagctcctccttgacccctccaaagagctgtgtcgacaagcatgattactgatcgaacactcttcaattctcacatagataagccaacatactatgaaacaaagcgagtcaaatgcttcccgcctatcaacaccgttctttaagttctgaagatcattttcatttctgtctgaaagaacatatattaatttctgtgagatttttgcatatagggataaagtcttaatcattgtaaagtaatctgattctcacatagataatcttatttaagagggtaataagttttatggtgcaaaccctcttctattatgatggaaatttagattcttaaggcatgcatcctggatagccatcctttttttttttgaaggtgatagccatcctttttgtggatatgctggatatcattcttattatctgaaagaacatttatcttattaggtgttgttaaatcagaaaatattttactaagacattgttaatatgcttttgtggttttgtactttcactgatgcagagtatgttttatagcacctaatttattattactattattgtaatactggagaatgacatgtaatccttggggatatttcgatgatgaagatttacttgcactccatggggatcggtacgctaccaaaactttattttccaatttttcagaataagctgttcaactgatttaactcttatgatccaacaggtgccaactctgttgaactcaaaattatttgtccctagagcccaagaacactatgttgctcactaaaacatcgttgcataacttagaattaacattactcggccttattcattaccaccgctggcagtcaagtccagtccaggtacataactggttacattcctagtgaagattatatacatggaagcaggcacagcttggtctgctgcacttagctaagccagtgcactagtgttgtagacaagaatagcgccgccaactagaattccagcaagagtgattgcccagagaagtaaacctgcctttcctgggaaaatcaagaaattttgtaagtacaaaatttgtgagaacaataaacatctcatgagaaatttaaataagcagtgcgcagtgttaaaattcttgtttctcgagtccttttttttgcttacctccaacatagacatcaccagttgaagaccattcttctggggtatatattgggctgtaacacggtagaagcaacaaaatgtcatggataagctatggatttcactgtttttacagataataaataggtgtttctcttttcatctccctcatctagatctgtaaatttctccttttattcattcacatgctttatcccatttttactttgaaactaatatttttatgagttactatatattattatttgtgcatggatctcaaatatattgttcttcattggatcggtaacatttacctgtacccatcaacatttgctccatacttgttggaaaactggtaaagaccctttccctgattaaatttgaaaaatttaatggtgaaaaataaccattttgtctgatatatatgcttgtctgagcttatagccttatactgaccttggctacccttccagatgcatcaacaccttccttgaacaccactcctccagcaggccctagatggtggcataccataactttgtgagaaggtaaactaatttagagaaaaatgaatggtaacaatcacagttctattcactaccatttatcacctttgcatgtaaaaaataagataaccaggagacactcattggtacccatgaaactgagaaacccattttccatttcatgtttaagccagttgctaatatattaactctgaattttacagcatgtactgaccatagggctgggatgtctgaatcttctttgctttcttggccactatgatcaaagatggccttgccattgtccctttccctcgaagcttcgaacgttctagtaatggagatgcagatggtttcagagccagagaagccatgacagaggcagccatgtttatgcaacaacactcaactgatcactcactctatctctgaaattaatgcaaatgatctcttatgcagttcatcatcagatatccatggctttaaatacaggaaggctttcagtagcagacagtgagtgactatgatttgttagtcaattgtcagttggatagtagctatgataatactgtgtcatggggccatgatcacgtgacaagatcttgtcttttacctggatgattagagatgatgtactgatgaaaatctgaagcaagcacctagttggttggttgatggataatcctggggtttcctgccctgcttaactattttcctggtcgagaaatttcaggtgtcaattctgatcatagcgagttgtctggggatcttatctctaacagagccagcgagttgtctgtaaacagtatattgatatatgcagttaatgttacatattttcgtggtaaaggatgaatggtgcttttttttttttgatatagttcaatttatatgaactgactattgtgtagtaggtatgaaaatatcagtttacctaacaagttgttatgtttttactcccaataatattataccacaaataaacgtacctaacctgatcattttacctacattatttgattctctccctgtagcctgatcgatctagcactccttgcaccaagctcccttttattaaaaaaagagtaactactgagttttgtttttgtctaacattgccgggacagtaattaaacaataaagtaaattttgtgcagattttagtattttacattcctgatcgagcctattcgtgtactaagtattcgtgtgcaatgcatgcataagcgtaactcaactttgtatcgaagagaaagaaacacgtagtacgttaatatgaaattaaacgtaggtcggtgcattactagtggcactgtgggtagcttatcttttactcctaaccactgtccttattaatccctgcgttatggaaaataaatcttaacgagtggagtactccctctgttctcatttactccgatccaataaaaaaaatatctcgaggtatcggtacctcacggtaccaaattatttctgatcattaaatctagttagacataatgtgtattgttagatctaacaattggaaatgatttggtaccgtgaggtaccagtaactcgagatacttttcgttggaccggagcaaatctcatccattcctaacaccttgagcagcaaagttgaagtagcgttagatccagacatgacgccgtgattgttatatgatgttatctgatccagttgtagctgcggatgccgggagaaggaagcagaactagcacgaccaaccgccaccaagtgttagcatctcatgctgccatgagcatccatgtacatggaggtaggggcgaagttagtgcgaaatggagagatgtatcacatgcttgctttactctactttggaccaaatttaagctgatgcgggtgtctaagttgatcttaaggggtggtggaaatagaaaataaacgaactatagctaaaaattttcaaaaccggattcctgggcactgtgtggaggggaaagggcggatatactcaggtacgggttcaaaattctagtttgtatgaaattttcaattttttttatgaatttgataatattttattcaaatttaatcaaattttattctaaatttcagtatatcggcaccctccgatacaaatcccaaaaatgaaagattgaaccctgaccctcgtgtggtttgagccagtactaatgacaaagtttgagcagagaagaatgcttacaattggaattattaggttacatttctgttgacatttttggagattccaaagatgattgaattttgacaagttcgaattgatactttcttccttttctttgaagaagaaaaaaaaataaaactttgattgatccgtacaaatgggccttcgtgggccgtgcgcgcgcgactgggcgagatcaagcccaagttcaaggccttagggaggtcgatcagagttttcttctccgacccttcccctctggcatggacgcatggtgatacgcgcacgacgacagccgccgggttcgcggccatgatctctgtctggctcgcgcccgcccggcgcacgcatccgctgatctcgccgccgcaggtgaacaacgcagccgtgccggcgagcacgccgacgcgcgcgtcatggacacggccaagtccctgaacaagaacagttcgaggtcgacatcgtcggcctcactgccttcccgtggtcgcctcgccggcgccggcgccggccgatgacgactgaggactgaatccccggtggaggccgtagactgtggcgtccgcgagtccgtttcggtgtttcaaactccgaaccccattgacagtgccggttacctcgccatggcctcccttagcttgctcacctcaccggtcaccgcacgcaccgacttccgaccaagttccgggcgccatcatccaatgcatgtgtgcagtgtcagtgtgctggtgaagtggtccgtatactccgatcccaaggggtcggagtcttcttctccgaacccccttgccacgtcaacgtaactccggttcattgttcgtcgactcgccggagcgccgccgcccaatcctggcggtccgctgctttggccgctctccggcggtcgcacgcgcaggaacacccacaggcatgcatgcatggtgatctgatctgatcccgtccgcgagctacgacgagaacgttctcgccacgccgcacgacagccggttcacggccatgctcagtctcgccgcttttgccagccgcagcgcgcggggcaaacggacgccatctcggacgctacgcacgccgcgtgcagagcgtcggcgtggcgaccgcgcgcatggccaggcagagggtgtgcagattaacctgatcgatccccattggaaattctgaatggcatgcagattctgcagttcttgtgggaaaaaaaaaaggagctcttcttcgaaaggcgttgttgttgtattattgggaatgtgctctcagagacaggcatgaactgaattactgaaaccatacaaggttgaagtaaaaaatgccgtactgttcttcaattgcgtaaatgatcatgttagagtagatttttttctctttttttttgaacaatgatgttagagaagaatatcatggtgcattaattgtttgtttgatgcagcacaaaaaggttccagagcaattacagtcgtcaataatccagatatggccactatctgtggattccattatttcatcaagtcttggttagattaactatgattcagattttttgttttttggtacctgaagtaatcatatcaaccgagaactactcctacatccctcgtgaaacgcacatctgttacagtgatgtactagtatatgatatatccaacgcgatattaaaaggagctggttgcaacttgcaaacaaaaatgtgcagtattttattcattagttgaccttattaaagtttaatttactttttttttctataacttgttaagatcgaatttaacactgcatatttaaagatgatatatcgtgcattaatatatcttgttaactttcgttataaaaaaataacgactatttctgtgacataaagaaacgtgatctgtacaaataacactgatcgatctgtacaaaatgcatgcgcccaacttcaaggccttggggaggtcggagttttcttctccgaaaccccctcccgatccaccacctcacgtacacgcacaacgcggccacacctcctctctggcgtacgggaagaagcaccttggcatggtggtcccgtcggccatcctaaccatcagcaagctacgacgtacggacgtgttcccgccacgccgtacgccgcgcacgacagccggtcactaccagcagattcacgaccaaccctgtaggagcgaaaccatcagaaaaattggttttaccgttagaaaatgtattcctgtaggtgaaccgtcagaaatcgccgatagaaaaaaggaccacgagaaattcaattttcctatcaggtagaaaattgcaactggcgtcaagaaatgttaattgtgacgtggacccgtcaggaaaaaccgtcgatcaggctcacggccatgatcgatcaggctcgccgcgcgcttttgcccggccggcgcaacgtacgcagccacagcggcatgcatggtctcccgcggtgtaagtcggcggccggccctagctagcgcccatgcatgcaaaccagacggagtagcaaacgcaggatcgttggcggcgaggcagaacggcgactgcatgcacacaacatcatcggcgaggttgccggccggagctcgcgacgcccctacgggatcgatgtcgctgccgaagcccaagtggtccttcatggctaccctgatggaccatggtcatccaatgcatgtgtactgtgctcatgtgacaaggaaggggtaattaacatagctcatctgatttttaaatacgcgaattggcttagtgctacacgcattctatacacggttggccgcctagcgctatgtgattcttttttataaagtcgcagttagctttgagctacgcgcattatatttttaagacgtggttgccctaaagctcgcgttatattcttaagccacgatttgcccagagctacgtgcatcatattttatgagtcggtatattactcagagattaacaccgcatatgctataaactaatattgagtcacttggttggttaaaattatggttcttactatgtgcttagttgtttcccaactaagcacatagtttgctacagttatcaggtacacctattcgatgtacctgtttatctatcaattcgatgcacctatttttttaatttatttgacgagccctccacagtctctttgcaagatatcaagataaggacttaataagtaaacactcgggaggccttcgcaaagaagattgaagcactcagtatcggtcatgaaccatagagaagactgtaactcgacttcgaaggtttcggaggctaatgtggataatatggataccggataaccacgtgacctccatattcgactagaaatataggaggtgagccgaaaccatgtattatgtaatagagtaaggttcggttgtcatgttgtcctgtatttaaagacctctataccacgacgaggccgacggtggcttcgactgtgttcttccccccattttcccaacccacatctcttgttttccgcgcacacttttcaaactactaaacgatgtgatttataaaaaaaaattctatatgaaagtttttttaaaaaaacatattaatccattttttttaaaaaatagttaatacttaattaatcatgcaataatacgagctttgttttgcatgtcagggagaacccctcctccccaacacagcctagggtgcttcgacgtggtaggtgtgcagtgatggagctctacgatcgaggttggtggcagctcaaggatgttggtcgggagctcaacaaggtcaaggtgcaatgtgctagctggatgaggccactagcggctcaggagctcgacaaagggtgtgtttagttcacatcaaaattgaaagtttgattgaaattggaacgatgtgatggaaaagttgaaaatttatgtgcgtagaaaaatttcgatgtgatagaaaagttaaaagtttgaagaaaaagttgggaactaaaccggcggcttgggagctcgacaaggctgatcataaagtcgtaacagttggatctgggccaccatcgtcaaccttctcgagtacccgtaggccgtagtatgatgaccatcttcgtcatccatcggtccgggcacccgtcgttaatttgctcccaacgcgagatgaaacatcctttcccgaccaaagccaacaatggagtgaagagctcaaccgcaatctcagtcagatctgacgctacctggtgagaagtctctcgagagcttgtgagagaacaggcttctacagtaaaatccccctccccgaccccttttccccccgattccggtggttcgtcgccggcgagggccggaggaggggtcaggccaccttcccgtactagtatagagtaggttaggtcggagttcttccgtagtcaggtcttcctgtagctcgggtttgtcccttttggagtttcgccggtgttgcttcatggcgatcggagaagacgatggtggcggtggtgtttgtggccgtggctgtcccagtgtcgcttttaatctggaccgcagctggcttgctctccacatcaagggtctgcgcggtgtccgacgcaatcccggctgcgtcgctgaagatggacggatctggggcgtttggcgtcctttccatggcgacaagggcttgcggtggtggatctggtgcagctggcctcggttcattgcttggccagagcgatggaggtggatgtggtgtttctgggccggccgtctcaggctctctgacaaggacggatggtgttggctgcaagagctgctgctgctgctcctgctcgttggtgggctgaatgagctgctccagcttgttagttggttgaatctccacatgcttctgctgaagctcttggtggcaagcttgttggttgcttattgaagctctctacggcaacattatcccttcaatctccggtgttgcgtacctccgccaaatcgttacaagacaggggttcagtcgccgttatcctaattcttgcatgttcaaggcaagttggagtatggagactttcttcaaatctccttgcagtagtattcaggttgaggactccattcgggttgagtataaaccgtctagtcggctcttgtcgataggattgtagtctatgctcctcagattcgatggagaactcctagacaatattttgttgagtccggtgaagcttaagaaaaattcatgactcaacaacaaacctcgaatagcgccgtttccgtggaggcagccgaaggggtcaccggtctatcaagcggtgtgcgcgtcttcagtagaggctcgtggacgtggtcgtcgcggcattgccgcagtcccctgtcgatcgcgttctttactgctgtttggattatcttggaggatgtttttcttagttcagctagctttaccttctgaatggatggtgttgttctttgtcttatcttttatggcgatgttttggggatatcatttcctttaagctctgtctgtaatcctcactatttaaataaatttatgagttttaaaaaaaacagtcagatctgacgcctgctccctcccggcccaacaccgtggtaagtacgtgatggggccaccggatacaacggctacagtagtgcttaatttcatcgctagccacaccaaccaagctgttttttcactggtggccatgtttccaagtgttagaagaagataacgactacggaagaaaaatggctaggtgcattatattttgatccctgtgaaaaattacagaattccttccaatcggtcgaccagctcgggggcagcaggatcgtgcgctctcccctaacgcgcacgtgtctcctcctggccccaccacgtatcttcaccatatactccattgcaacaaatcacccacatattttggaaaccctttattaagggaatttgttttattttttttccaccaagaatgtttcacttaatgtacacacattgtttcactatgtatagatctaatattgcagtgaacagaaacattcttttgcaacaaatcacccatttggaaaccctctattaagagaattcgttttattttttgttccataaaaaatgtttcacctagtgtactcataatgtttcactatgtatacatctaatgttgcagtgaactgaaacattcttttgtaacaaatcacccacatattttggaaaccctctattaagggaactcgtttcattttttttcaccaaaaatattttacctagtgtacttacagtgaactgaaacattcattcgctatttgctgaaacattgttttcatacaagatgaaacaacacccaatttaaatgattgaaatattttctatctactcagtgaaacaattccgatatacttggtggaacattgtgcaacatttaaaaataattcaataataagctaaaaaaatttcgtcggaatatatccatgtgtggtcttgttttaaagatttaattgcaatgaatttaatggtgtaatcgaatcatgatttggataaataatttaagagaaaaaatagtttcaagtggttttgcatgtatacgtggcgcgcccgattccccccccccctccatcgggtgcccgacgcgtaggagtccccgaaaaaatatggtataaacaaactcctttaggacgcctcataggcttaggccacataatggcacgtttcgaattttatggtataccaatggcactgagtcgatttaacaaacagtaacgtcatttctccaagacgacgaatttgtaatggcccatatattgcaacaggtccacatatgtaattagagatgagtagcacaacccatatcaatagggatagatcattagtatggattgagcataagtatggattgagcataaaagaatatatccaaccatttttttatgacccgagttcatgagagatagaatcgatagcggcagtataatttaaccaacatgaaatcgtgtactcattttctccatgaaaaatataagggtaaggcaatgcttatggttattatgacaataaggatggaacccgttacagctcggagcaatatttatgataatatctacaatggttaagtttttggaagaacataagatgggtcccgttgagttccaccaaaggaaaaaaagatcacttcctaaccaccccatgcaaggcagcaagctagagaaatagtccgtggacaatgaaaaaaataattttatatttctttcggatgaaccttgggcctaaggttctttttggttgtatgaagcttaaggtgtgcttccacaatggctaaagttacaacacttaatgcttaagactaactttttggtagattgtggttgccctaagtatttagactaaaattttatagtattcctagactgattcatatgatatcatcactttaatgatttcaaagctaatcagatgtttcgaaataaaatgtaaacgatccaaaatttaaaaattgacaactgaagtgactaaaaataaatattttgatatagaaatcctagtatttgctactactacatagaaatccttattttcgagtaattagtaggcgtaggcggcaaaatcttgagctagtaccagattgatccattgtgggtagtaattaaggccttgtttagttccaaaaaattttacccaaaaacatcacatcgactctttgaacacatgtatggagtattaaatatagataaaaaaactaattgtacagtttgcatagaaatcaagagacaaatcttttgaacctaattagtccatgattagccataagtgctacagtaatccacatgtgctaatgacagattaattatacttaataaattcgtctcgcggtttccatgtgagttataaaattagttttttcatttgtgtccgaaaacccctttcgacatccggtcatacgtctgatatgatccaaaaattttcttttcgcgaactaaatacaccctaaagatatgcaaatgatcgtgattgaagtggcatatcagaaaaaaaaacatggataatggagtagaccagcaggtgaggtatttatggccacaccacacggtcacactcacaggtcacatacactagagtgacctattttcggaaacggaatctgtcagtcggaattttttggaaacggaaacggatttggaaatattttctcggaaacggaatcggaaatgataagggcagtttccgtcggaactcggaacccgtcggaaactttccagaaattttctcggaatttccagaattctttctaggaatttccagaaatcacaaaataacctgaattctttttttagcactgaatagttaataccatggtgtttggctattatttttttaaaatatttgttatacaaatctaaaattacataagaatattgggatttatcaacagcattactaatttgttttatagattgtgttttgtgatgtactgttgatacctaacaattggacttatatgattgtgttttatgatgaattgttgaccgttaagacttgagaattgggtttatcagttagaggggtttttttattcaaatttccgttaccgtattcacgccggttcgttttcgctccgttttcggtttcgataatattcgattccgttttcgtatccggggttttcgattccgatttcgattccgaaaaaaatatgaaacgaaaacgataaagatgatttccgtccgttttcgtaccgttttcacccctacactagaggtactagtgtagagtaggcacgcagaagtttcaactttgcagacgagcagtgaattgtgcatcgatctctgtggtattactttgtacgagtagtatcgatcttctgtcgtactgtacgattgtatcgtagtaactcgtaagtatggatcgacttttgatctatagtagtacctacggtgtggcctggcttctttgcgtttccgtctggagtctagcttgccgacccgtgatcaattagcacttcacttttgtcaaagtatttccgaatgtttagttttgggctgggtttagttccaaattttttcttcaacctttcaactttttagaacatcaaaattttcctacacataaaaacttctaacttttccatcacatcgttccaattttaatcaaacttctaattttgacgtgaactaagcacaaccttggtagtactagttagtgtctcagatttatagtgctagtaagtgttccatccattcaaaatcttttatataatgggatggagaaagtatgccgcttgtcacaacccaatgcaggtgttctccatgcagcgttacaagaagctttatgatcgccatcatcgactcatccaccaaatgcctagatataatttaggaggcagcaaacaggcagtacaactccgttccaggatcggctccaccaaatgcttagggagaaactcaattggtttagggttaagtcagtttgaagttgttagggtttgagtatattgtgctagctctagccgtatataaagctgatgagacagacaaggttagattgatttttttgttagccaacttagggataaaaggtgaatgatcgggcttctggctcggccatgagacgcgacttgtgtctcgcggttgattcatgacgaatgtataatttcctattctgattaatgaattctcttccccccaaaaaaagattgattttcttttcctcagccatgtctcgcccggacacataccgtcatagcccatgacaatgaaaggaaacagaggtgcaggaagcggtgtcgtcaccgatcttggtgcgcccgcgtatatttacatggttgccaatagccggcaacatggctttacaggatcataacgaccttggctaatcagtatctctaactaatcctgattacaatcattatctatcagctaagataagatcgatacggccaggttgttatgcttacacatgattatatctaatactccccctcaatcacaacctacctagatcgagattgtacttaaaattttcaagttgtcttaccgataacgcctttgtaaatccatcagccacttgatcacctgtaggagcaaactccacttcaagtaattttcgttgcactctttcacgtacaaaatgatagtcaacctcaatgtgcttagttctagcatggaagacagggttagatgataaatatttagcaccaagattatcataccacagtcgagccattggaggacttggcacactgagttcctctaacagagtttgtatccatatgatttctgctgtagcattagccaaggccttgtattctgatttagtactagaccttgacatagtagcttgtttctttgcattccaggaaaccaaattatcccctagaaatactgcaaaacctcctgtagatcttctatcatctatatttcctacctagtctgcatctgaatatccactaacaagcatagactttgacttactaatctttaaaccaagtttagtacactgttttaaataccttaatattctcttcacagcagcccaatgaactgtagtaggagcatatagaaactgacataccttatttactggaaaggaaatgtctggtctagtcagacttaagtactggagtgctcctactacacttatgtaattagatgcatcattgggacctaataaatctccttcatgcaaagtgagtttctcactagttgacaaaggtgtactaacaggtttacaatcagtcataccaactcgtcttagtagatcagtaacatatttttcctgggttagaacaatgccactagatgccttgttcatctctatgccaagaaagtagtgtaagtcacctagatccttcaaggctaaatccttttataggtccttcagcagagctggaaccgcatcttgtctcgagctagcaacaattatgtcatcaacataaacaagcacaaaaattatcagaccccctttattataaaagaatagagaagtatctgccttggatccttggaatccaaggtgttgaagcttctgacttaacttagcataccatgctctaggtgtctgttttaaaccatagagagctttatcaaacttacacacatagtcaaggatggaccttatcttcatacctaagtggttgttttatgtatacctcttcttcaagaataccatgaaggaatacctagttacgtctacaaagtatctagttactagttgagctgtactgctactagcaaaattataaaaattagacaaaaacaaatacaaaattaaatactcttcacttaaaattgtaattgctgacaaaaattacaaaaccaaaaatttagcaagacttttgatatgtagcaaaatctaatctaccatcagcttgattaatatatagcaaattaaaaattgacaaaaaaaaagaagacaaaactacacaaactcctgatccccactttaattggaattggaaataattagtgaactgttataacaaaacttataacaaatagcccacattcacagtgctcacaaaaatgacaaaaaatgacaaaactaggaagtgaactgttataacaaaacttataacaaatagcccacattcacagtgctcacaaaaatgacaaaactaggaataagtatggctagtagatgacagaacaacctactgctagaagtcaggaaatctcctttagagattatgagctgcttatagaaaattaaacaaaccaaaatacctgctagctgaaaattaaactaaagaaactaagtactcatcattgagaacaaaacttacaaatatatttctaacaaaactaagtacctactcttcacttcaaattctaatgtgatgcatgctaatttctaacattcctaacaaaactatgttatctttattgctaaccagtttactgtttagtagcttatatggtgccctgacaaggtaaattaaccaaaattctactgcagataaattagacaaactacatacagagtgcaaaatttatcccttaagttcacaaacattaatttgtttgcttcaaaaaggaatatttctctgagaaaacacaaaactgtttctaacaattctatgtcttcgcacaatttataacaaaaaaaaaacgttgctcatttccatcctacatcaatgaactaaaattcagtgaaaatagaacataatcttaactttagatggccagatccgttggcggggaggacggggacagtggggagggacaggaagagaaagggagagggcggggtggcgagacaaagagggggaggggaagaggacgcacagcggccacttgcatcctcacctctgcgcatcttcctcccctccggccgaccggatccgccggcggggagccgatgacagagctgggaggaagagggaaaggggagggaggaggagagggagagggcgaggtggtgagacagaaagggggagacgaagaggatgtacggcggcgactcgcatgctcaccctggcgcatcttcctccctccagccaggaggatccgccggcggggagagcgacggcgatggcggcgactcacgtgaggaggcgaagagactggcgaggggaacgcgttgggttcccattcggatccggaataaaacaggtgcacacccaaaactagctgtttgcccggtaacgtttgcacaaatcttggaacaatctgatggccaggaattcagctgataaaacaaaatttttcagcagggtgttgtatagcaaatccccatataagccaacatttgtagacaagcccatactgctgggctccgtgcagacgtgagccggcacaattgtccgcttctccgtgtgcttccatggtactccctccgttcatcttataaaatgttttgactttggtcaaaatcttttgactttggttaaagtcaaacttaattatctaagtttgactaattttttttaagagaaaagtagtaatattcttaacccaagataaatatattatgaaaatttattcaattataaatttaatgaaactatgttgatgttgtaaatattactatttttttctacagagttagtcaaacttataatagtttgactttgacttgaaacggagggagtcactactacaaaaatggtattttcaggcagccaaaaactatttttcccggcgggagagtagtccgtctagaagcaatcgcatgcgaaaatcatcgattttcgcaagcggcccagtcacccgccagtgaaaatcatctctataaaaaaaaaaatcgcggccacccccacccgcgcccctacccacctccggccgatctagggttagggttggggggcgctgccgccgccaggaggtgaggggaagtggggatctgcaggggcgctgccgccaccaccgccctgccccggcatccctccgggcggatctggagggaggggaaccgctgccgccaccaccgccctcccccggcctcccttcggccggatccggagggaggggaaccgccgccgccgccaccttgcctccccccttcggccagatttgggagggaggggaggggagccgtgccgaccgcgtgcctcgcctcatcgtcgacggttccccccgccgccggtcgctgagggagttgagggagagagagttgaggaagaggagaggtgagggagagccggagaggaggagagaactgagaacttagaaaaaaaaatcccctcatgtgtcgagtctatttatattccacactaattttcgcaggcagacaaccagtttcaacccggtttacatttttttaggcggctatttcgctccgatgatcatacccgcctgcaaaaaaaaaatactcaacgttggcaaaaatgttttttctagtagagagtagattctagattgggtatccacatcaagaacataattcagaaaacataatacacaattgtactccaatttaattttactgtgttatgtttcttcttctttcaatcagcttctgaccagcgaagtccttttgtactggaaattgtcaggtaatctctactgcgtgtgttccctaatcgaaggatgtagcagtgcatgtgtattcagttgtagtctcaaacaaaaatatcgagcatttgatgtagatcagaattgtactaatatgaacaaaatttgtgtcccataataaatcaaagaatttaaatttgatttatttggaactattttacttacaaaatctacttataaaaactaattgtactacacaacaataatgtactatatatgcaaactacataaaattcaattttcaaaattattctgtagctttaggtaatccctttactaccatcattaaggctgtgttcggctcctgggttgagaactaatactccgcgcatgtaaaacggatcaactcattggcacataattaattagatattagttatttgtatataaaaaacagattaatataattttttaaaagcaagtttcttatagaaaagttttgcaaacaacgtaccgtaccgtttaatagtttgaaaagcgcgctcgtgaaaaaaaggatgtgagtttgagaaagtgaacaaaacaactcagcctaatggttcttaaaataataaaaatattttccctcgctgtttgtcaagtttaatttatattagagccacaagcaacttgtctggtttaatttatattgattttttaagtgcgttgcatatgcacgattaattactagttctcttaaacttccattccttctctcaatttccaaccaatcaaacaaacctaaatgtaaacgaaccaaaccgtatggcacgtacggcacgggcttgcaaaacaacatgagggagaacgacatcggtgctgccgcctatcgacctcgtgctcaaggcatcgtgcaagcgttgtggctcatcgtcatgagggtgctgcttccgccagccacaccacgatcgatgatcgatgttttgctgttctctttgcacgcgcgtgcataggagtatacaacaccgtcttggtggataccaccgcagagaaggaactctcgatcgatcagcatattcaccgtcgatcggtttggcataacacaatgataaggaagtggatttttatcccctacccttgtatttcatgtcgtccaaaaaattaaaaaaaaattgatatcatagatcaatgtgaaatatgtcattccatagacatacaaaatacaaattcaacctaaataaatagaaacaaaaacaacaaattttattgtgaatagtacacagtcaaatctatcatttttttttacttgtctatgttgaatttgatttttctgtgaaactgacatatttcgtattgatcaattataccttttttttaaaaaaaacagctatttaaattacatgtaaaaatgagaagattcccggaaaataaggctgctccaagcaacaatgaaccggagttttttttatgcccttaatgacactaaaagtttaaaatcttcatctgacggaaaaggtacatgcatgttagagattaactatatatttgcaataaattaattccaatgatagcatgcaactcaagaacttaacccttgcttttgcttttgatcctcctatcgtgtggcacacgtacttatttgacaaaagaaagcaaaaaaagagaggataattacagcaacacaaaaccaaataccccatccgtttctaaatatttgacgccattgacttttgaaaatatgttcaaccgttcgtcttattaaaaaaaattgaagtaattattattttcctatcatttatttattgttaaatatacttatatgtatacatatagttttacatatttcgcaaaagtttttgaaaaagataaacgatcaaacatgtgctaaaaagtcaatggtgttaaatatttagaaatggaggaagtaatttttaaaaagagacaggtaaattaccattatgcgagacggggagccggacgttcatgaggaacggcatctacataggtagccgacatcgggccgagctacccggcgcacgcgtacaggtacaggcttcggagcacggcgttctacctgctgggcaacaacgtacttcgacgtcgatcgacaagctcatctccgccgccgccgacgaccagcgccacccgcctcttgaacagcttcgagcgccgcccacaccaagatcatcctccaggaggtcatggcaaagagagaatggcctagttttagtggtggtgtacactagtatttgtctcgctttacttgtcatcacattcacatatactccctccgtttctaaatatttgacaccgttgactttttagcacatgtttgacggatcgtcttattcaaaaactcttgtgaaatgtgtaaaactatatgtatacatttaagtatatttaacaatgaatcaaatgataggaaaagaattaataattacttcaattttttgttgaataagatgaacagtcaaatatatttaaaaaagtcaacggcgtcaaatatttagaaacggagggagtatatatatatatatcctcctcatcacacatacatattcacatccacgctacgcaatataacttcatatactgagtactaaaaaggcaacagagcagtcactcatttgaattccagttactagtctgtctttatcatccaaacaaagctagcccaacacagcacagggcacttctccaataaaatacaaccaaacctcacatcttgttactaccactgcacattgatgcagccacaaattagatactactactactatcagtaatgcaatgagatgctcgtacaatcaacaaagccacatgacaaatcagaatatcatacacaccctctaagcaaatgctcaagccccatcacacggaggggatgcaaatgaaatgatccattgcatccctcaaataattcttaaaatgagacaggtgaatatcaacaccataccaacgtcaaattcatagcttaactcaacatacggtttgtgacgttgcatggcaacgatttacatacagttcattctagtgatctagtcccagtctccgtgcttcattgacaaaaaaaaaaaaacacgctactactactactgaagccacgatttgagattattgaatactaaaaagcatagcaagtcctgtagaacaacacaaacatgcagtagaataataactcttgtgaatcagctcaacgtcaactaagctaagcaaaaggatcatctagtaagaagaagcaatataggaatgggttttctcgcatctgatccactgtggcttccccagtgccactactagaaaattcattttcgatgtcataggggatcgattttcacaggcggacaagtaattcggagccaaaaccccgccggcaaaaaaagtacccggggtggagggggcggtccgcctgcgaagatttatctttgcaggcgccgcttatatggccggcttaaaaagatgcctctatatagtcttcttcctccccgagccctgttcattctccccgaagtttctctctcctaaagtgacttaaatatatgggggatgttttgaacttcaaatcttcgggggatttttctacggtacttagatctactcatttccacactaggtatgcaattttttaagcttttagaccttaatttgtgatggatttatgcatgcaaaattgtgaaggaagagctccatgttttttaattttatttcttttgatatgttgatgttagatgtatgtgtaatacttgatgcctcttgttgtagtggtttaatgtggtaacataaattctcaattttttttatttttgctatcacatccacctcttagttctagatctagatctagatcttgtcatatatagggagagaataaaatttttaatgtctatttattcggtgcaatcaaaaaatagttatagtattttgtaatatgccgatgatatgattttgttagattttcctaatgtactaatttggcatgtctgtgtaaaaaaaattgaaataaactttgatttttttattactttacacttaacctttagttaattagttttgaatagcgataagttttttcaataaaccctacaaatttggtattaattgtgcaaatattttacgtgtatttttttagagatatggaaagtcgggaatggatgtatcattggccaaggtttttgtctccatatagaaacaaagtgtctaaatttattggtattgccaagacacacgctgagaagaacaatatgaggaagataatttgtccatgcgctgacagtaagaatgaaatagcctggaactttgacaatgcttttaacgtgaaggagtacttagtaactcgtggatttatggacaagtacgaaatatggacatgtcatggcgaagaacaagtggacgggcctgaaaatgtagttccgacacaagttgaagacatggtgcatgacgatggttctattgtggacaaaatcgacctagaggaaatgttacgtcatgcagaacccgaggtgctgatggggtcggctagagggttaaataactttgaagctttacagaaggcagcaaaggaagttttgtatgatgagtcgaagggctgtgacagtgagttcacaacactccggtcagttcttgaacttatgaggttaaaggcgagacatggatggtctgataccaatttcgacagtttgttagaacttctgcagaaaatgctcctgaggcctaactcactaccatccagcacatatcaagcaaagaaactcatatgccccctttcacttggtgtggaaaagattcatgcgtgcgtaaatcactgcatactatacaagaaagaatacgcttctttagatgaatgtccaataagcggtgctagccggtacaaattgaatagcaatactggcctagaaccgtctgacacaactgagggacgacagagaaaaatcccgcagcttgtgatgtggtaccttcttgtcaaagaccgcattaaacggatatactcaaatctgcgagatgcggaactaatacgctggcatgaagaagggcgcaaaaaggatgggatgattcaacacccgacagatgctcgtcagtggataaactttgatgctcagtacagagagtttgctaaagacccacggaacattagatttgccctgagtactgatggagttaatccttttggagacatgagcagctcatatagtacttggccagtgcttctcaccatgtataatcttcctacctggctctgtcaaaagcgaaaatacgtactactctgtatcctcatacagggaccccgtcagcctgtttttcttttatgttagaggtttgaaactatggccgatagtactaaagggactgaagagaaaggtttagtggagcaagagcagtcccttactattgtggttgctccggaaccaacggtcccaccagaagatagttccggcagcgacgtagctcacgaagacgatgagtactcatcaccaagcgatccttgtccaagcccaagcccgaagagaaggaaaaagggcgacggtgaagaaggcgacaaagactacattccccctaaagaaggggtaagtaaacataatatgtaaactgttcaccgtgataactattagcccgagctaatttgaaactgtcatgtataccttctcgtaggaaacggcgccacggcgatcaaaacggcagttccgtcgcaaattgacgaggtaccagctaacacaaccggctcaaagaaaagcgaacggtcagctaaggcgaagaaaaggaagggcgagagaagcgtgaatagaaaggatgaagggttccatgttgttacccatgtttcgccaaaaggagagccgctcgcctctaagacggcacgtgcgaaattcagttcacagtgtggcataatagtaagggaaaagatccccatcacggtgaaggactgggatcatgtatcgaatggggataaggaagtcctatggaaagagttgaagaaaatcttccagttcccggatggatcagaggcagcagtgaggaattgtgcactgcaaacaatggccaagtcttggcgtggttggaaaaccaccttgaacacaaaatttgtcaagacgggacgcacaccattttcgacgtatgacaacataaccccgaatcagtgggatgactttctgatgttgaagaactccccgaaagaaattcaaaggagccaaagtatgcagagttggccaagaagaacaaatttcctcatcgcttaggctccgcgggatacgcaccaaaggtggagcaatggacaaaagaggaggagaaaatgaggaagaaggggcaaccggtaccaatggaggaatggacacagagatcaaggaactgggtaagagctagaactcctaagatcacgaatgaaggaaaagtattgtttgaagatccggagctgtagagcgttgctgataaaatagagaatttatctagttcacagaagaaaggatttttcaagcctaagagggagaaagatgtgctaagtacggcgctgggtactcctgagcatgggggaagggttcgaggtgtgtcgagaaaaatgagttggaaggaagggttcaaacatgacccccacaagaagcgtgaagcgtacaatgataaacttagagacgaaggggctgcggagtttgaaaggcaaatgatggatttctgcgtcaagcacatgattttgcctcgcctcgaaaccaaagaacctgaaccagattaccccttcgatgacctcaaggagaatacgccctgcagattgcacgttcccattggacgctccgggaaaactcttgaggccgctacaaccattgctatccctgggagaacatacaacgaagagttcatacccaatgcgtatgccaaggtgcagccgcaagtggtccacgaagggtttgagtcctacgacattgacttcctgactgcagatggtgtatccgtacttggggatgcggtcgatcttgtaattctctggcacaataatgacatatcctttggattgggcaccgatgccacggaaaaacctttggtgccaaaaccggggttgggaaaacctctgagacctcctaagaggaaggtgactgataaggcggaggaacccgagatgcaaaaggataatctagtgccggaagtgccaccggagattgtagtgccagaggcagccatggagattccagtgccggaaatgcccatggagattacagtggcagaaccagaggtgcaatttgtggcatcagtcgggtcagaaatagaagaagtaccaggattggaatgggacggtacagagccagaaatatttgaagacccttctcctgcgaaagaccccgaggtgcaagagaccactgtccctaagaaggccactaccagttctgaggtgcctagagtgcttaggagccacgactccaagtccaaagatgagaacaaggagaagttcatggtaaccgtcttcagagggggtaaggaacgtgccaagctcagagatgatgacccctagaagaccgctgaactagccgggccaacatacttcacaaccgatgattgcccggaaaagtaccaacatgggaaagcactcttgcctgaatgggcactgaatgaaggaccatgagagatgaaaaggttacataccttctacatggaggccagcaagaaaggcttgggcaatataacagctcgattaccggcagattgtttcggcgaagaaggttatgtatggctagatttctcagatctccacgccatatgtcgtcgggataagatggacgtcaactatgtcggtgtttggtgcatgtgagtatgagttttaattaattatatgaaaaatatgtacaatacaaatccatgtgattgttactaacaaacttcttctgtaggatgcaatacatggatgctaagaagaaaaaagaacctatcggcttcttggatccaactcggatctgccaaacacaacataccgtgaggctagcaccagagtctgaccagctgaagggcatgaatccaaaagagatagctgaatacaagaaaggcttgcacaaggagaaattgattactgtcgcacagtacattggacaagccttcttgcactttcaaaataagagagtcgtcatggccgcttataattttaagtaagtccggtacatttatcttctacacatatgtcttattttagctggtactaactaactatgctgttgttaatatgtagcgatcattatatctgtttactcatccaccctaaagacggaaccgtggtagtcttggaccctctcgattacagacaccagtcatacaaagaatttctagcaatcttacagtagtaagtgattatgactcttgcatttttatatgaatgtattataaataaatatcctccttaatgtgaaacggtacgacatccatacagtgcgtaccagtattacaagttcaaggatggagaacagacccgaactagggagaagctgctagtacgtacctattggccggtaatactccactcacttaatgtataccaattatttcactaattgcaaattttaactatttttttatgatatgtcctgaagtgtcacaagcaaccgtgaggaacggtcctttgcgggtattacgcttgcgaattccttagagttaacgggaggtacaagactaatgcggaggatgtaagtctctatactatatgctagacagcttcacatatttatgatactaatatattgtttatcttcaatgcatgcagttgccaagattagaacgtcgaacaagctttgacgatacaggcatcaaaaatgtccagcgtgatctgtggcacttcatccaccatgagtgctgccatgtgaaaggagatttcttcgacccagagggtgccctagccacaagtgacgaattcaaggatcttcgggagtggaacagtgctatgccataatgtattaactggatggcgtatttgaagtgacaatgtaaaaaaatattgtaatatatatattttggcaacacttttaagtaatgtaatatatgtacatttatcagtgccaaatgcttgataatcttccaatatatgtacataataatctacctgcaagaatttctattaaataatttaaaagtaatttacgggcaaattattattaaatttcaatattttctacctatcttcgcatgctgaagttttttttttttgcaagcggccgattcctattttcgcaggcggatcagactagccaacgtccgcctgcgaaaattatcttcgcaggcggatggccgccccgcctgcgaagatcggcgatcttcacagtcgttggcttacaggtggacggccgccccacctgcgaagacccttttcggccgcttgcgataatgcttttactagtagtgtgcgatcctttacccaatggagcttctgctgaacctggatggacaaactctcccatgtcttgtgccctgtaacgtcttcaagcaactctgataagctggagtaagtcatcaacaggatctgtgctacgaagaaaagtgtatggagcaccatgtccttggcgcctgctctctggtggtacttcatcatataagcactgtaagcacaattcagaaaacgtgttataactttgtctcagtgttagtaggcaagcagctaaagcaaatgatttgcatcagtaatagaatcacctgtgttgttccaaggcctccacaatcttacccactgctgctcccagagcttcaccttgattgactttgccattgacatccatcactcccgcggcgcgcagctcctcggcaaatcggttggtggcggaggacgggaggggacgctgaggaggcatcagccgcacagaaccatcgccaaacaagagcttgtgcacccttttcagggcagcaacgacagccatcctctccggggatgtcgtcggccccagcagcagccgcacaagccgctcgccggcaagcgcggcgccggcgcgatccagaaatcgagtcttggccgcgtccttcacgccggcgaccgccgacgtggacttggctctgtacacgacgaaggtcgccgcctggagcagaccgccgggcacctccgaagcggtccacctgctcctgccgccgaggctgccaggcatggcccggaaggggacgacccagaccgcagccgctcccctgctgccgccggcggagagagcggacggcagggtccagcggtcggcgacgaggccgccggcgccggggtggtcggtggtggcggtgaaaagagagctctttatcttgacttggacgggaatcggctcgccgaggacgccgaccttgccgcggaacggcacgccgttcaccgccgtcgcctggaacagcgcgccgccgccagctgcctccgaagcggtcctcctgccgccgtggtgctcgacgacgacgacatccttccccttgccaggcatggcccagaacaggacgaccccgaccgcagccgctccactgctgccgccggcggagggagcggtcggcagggtccagcggtcggcgacgaggccgccggcgccggggtggtcggcggcggcggaacgggcggacgctgccccggccgttgcgatggtgcgcgcaaacgacggcactgccgccgtgttgctggccttggccaacacgcggatcattcttcgtcgtcgtcgtcggcggcggcggcggcggcggcggaggattgggaaaaccctaagtagatagtttggcgtgtagcgtagcctgccggcgtgggagaggagggaagtgttttggcgtgggaggtgggagacagtgggatggacaggtgggagacagtggatggactgatgggtgtttggatgggatgtactctctccgttctaaaatataagtatttttaaactctaacacggtttttgagatattatttttgaccaaaaatatctacaataataaaatgttttaaataaaaagatatgtatattatgatagtttgtttaatgataaatctaataacatcaattttacatgattaatcttttttatttttttgtcattaatgattaaagttaaaaatatttgacttgtcactatgctaaaactgcttatattttggaacggaggagggagtaattaattaagtaaatcaacatctatattactatttttctatataaaagttaaaatacatcatttgaacgtaccagcaacaaccaaacaaccacgaaacattaatattttagtgtcatcttaaatcattctacgcaatacagattcatctaacgttctattaagtcaccatgtgtcacattttaaaactagaaaaaattcttagaaattcgagcatcattagtttctacttaaatcgatagcctattattttcaagcactataaacatatcatgtcttgaaaaatagggggaaaatgagaaatctgagaaaaaggacacctgattattggatttcacttaaatcattcacgaaaatagaaatagaaagtcaccttcacctccctcgctcatatgcccacaacactacccacccctctctcttttggcccgaactctacgctcttcattaatcataagctatcaaagtgaaatagtcaatagttataagatacatgtgcgatgtctgatctaacttttattgtattataatgaaaaaaaaatgcaagcatatgcctatattttgttatataagaaatatgaaatttgggaacaatgacccgtgcactatcaataattatcaacacaaattacgtctttatacatcaaagtataaaacagtattttttttttgacggacaacatccctgccctttttacatgtcatccaaagataaaataactatgaaataattcagcaacataggatgcaccatcatatattattctgtaaacataaaaactaaattaaatatacaatgcctaagaaaaatatatcaaataaaaaaatcggtgggacatataccattggccttttacatgtcatccgaattgccataaaagaattataaaataattcaataatacaagttgagccaccatacgttgttttgcaaacatgaattaaattaagaaatgaaactttaactcaaatataaatagtccaaatcacttcataaaaaatccagtggctttagttatagaaaacaaatcgaattactttatgttttttaaaattaatgtggtcaaataattcgagtagcctaagcgctctaaatcatctaatagattttttaaggtaccatctaattgattttagatggtgtttaatgcactttggtatatccgtagatattcaagcatgtattcataataaatcacattaaaaaaatgtgtgcacaattatatttagccctccgattgtattcacgctaggctatagagagcctcgcacactctacataaaacgtccacatataggttatttcccacactatgcaatcactcaacaaactcatgcattcagataggttacattcaattaatagtgagaacctatatcggtcttacatgcttatacaaaaggtagcccatttatttttcaaaaaaatgacataaaatgtgtaacgcaccgtcactatttaacatatcacaaagtttaaacttaaaataagaattgtataaaacaaaacagaaaatagaaaaaaaagggccaatatgaactgcattaattgaactaattggagaaaatcttattatttcttttgattcatacttgcacttaaattgaaacaaccattgccataaccattgcatcattttttttaattaagtgcttagatattaatattttttctctatcctacaccatggtattatgattttctccacatattattgcaagtataagcaaaaatattaaggttacagtatatagttgatttagaagttatattcataactattaaatttaatttttaagggtcaagctgattagatttttctttttaaaagtacaatggatcacacatatcatagggaatcgagacctaggatgtatgtatatatcctctgtcttattcatatataagtagtaattaaagtgcatcaatataaaccaaataaaaggagggctagctaaatggtataaataaaacacatttgttagcaataatagtcttttaagatttgatagagaaaacatagctcctaaacattcattttttttaaaaaaaaacacctactttttaatttacatttaatttgttagatatgttttctgaacaaactaagtctgttatattttaagtgatgaagaagattacatataattgcttaaagaatgattaaatattataccgaaaaagctaacaaacagattaaaattttatctaagcaacacattctacaatacatgcccgcgcaaatgcgtgggctacattcctagtttattaaaactgggatacattacctatacgtataaatgtatccctcatctatttataaacttgtcgatcttcttggctgagcacatattttgaacatcctttttttttctcccagtggagctcgcgtccaaggatttctgtacacatccacatgataccgggcatcacatattcacatcgatgtggagattgctgctccccccccccctcctccgtcaaacagaatcctgtcactat

SEQ ID NO: 39247 - DNA, 3225 bp, Oryza sativa
ttttcttttttcattgtttctttgctacttgctagggttaatcaaaccccaaatccccaaatcaatgtaacatcccaaatcattcacatcataaatcctaagttacttatacacacaaatcaaatacatcacaaatcttaaaaaatttacacacaaatcaaatacatcacagatcaattatacatctataaatcacaaattatcaaaaaaaagaaagaaaaaaaacgacagaggagaactagcgcgctgtcgcccgccatggatgctgctcgccacggccagcgcctgccacctgcggccccgccggcgccgccacgcgctgccccgccagtcgccgccgggcgcggccccgccagctgccgctgcgcgctaccccgcaggccgcttgcccgccgccgccggccgccggatgggaggaaaggggaggagaggaggaagggaggaggagaagggaggggaggggaggagaaaggggaggagatccgaggggtaggaggtgaggggatgatttgatcttatctaaatatctcggtgaggagtaaagtctcgtctgggacttaaccgatcagagatgggagagaaatatttactccctccaaccgggactaaagatagatttttaatcccggttggtattatcaaccgggattaaagatctaaccaaccgggactaaagtggtgatctttactccactaaagatcctcgacctcctgacaagcctctgataggggatgaatcgagactaaaaataatatttagttaatgtggaaaacaaccaacctagcaaagatcactcttcccagtagtgtgtgcttgctttccctctcctcgatcccggtcacctgggcatgcatcgcgactgatggagtgcatcgccagaagctagctagcccacgcgctggctgcttcttcctgggttaagccacaacttgcaaaccatggctcacggttatggcgctcgtggagacgtggttgctcatggccgcagttgggggcaacagcggcgaggctcgtgcacggccatggaagcacatggggataatatgacggtggtgcactgcatggaacggagtttactggtagtgactgacttgtatggttcttggcgtgcgtggagtgagcatatctagtgctatatatacaccgtacgtacatttccgagcacatacggtctgcatgcgatggacggaccgggtacgtactactgttacactccaccatttctgattctgagcaaaactcctgctctgtgcggtatacagcataggattaattagaacattgagaggataggtgaactattagcgtataattaatagagtatcaattatttcaaattcaaaatatattagtttgaaattttaaaataactttcctacagaaaatattggtaaaacacaaaacgtttagtttttttctcgatcagttgttgccgaacgcagccggattatctgatttttttttcagcttgtagctatttgaaggtactactatgaacatgccctcatattcgagaggaatgaggagtactatgagatatttcaaaacatggccaatatgtaatggatatatacaatggcgaatctaagatgaaaatagagatggtgctaatgcatagagctaaaaatataactcagtactagaaatcatatttcctgaaaaatatgaacttaaaaatatccatgtttcattttggaaaaacatgtatgctcagttgaattaaaccctccaattaatgtgccctaatcagatacaaaccaagagctccttgtagatggtaatatctgtgttgtcttgtcctcgccagtttggtaattgaattggtaattgtcctcaccggtttggtaattgaattgggcttggtatagcatttagcaattaataaacactggataacagattgagcactaatcaaaccgcagagctataggcaagttttcttcctctctagtcgctgcaggccccaacatgtatactctaactgtcccagtgtcttctactagctttgaacttattgggagaacacttggggctagaagctggagctagggcttgcgctccaacaagcccaacagtgaatccgcccctggatatatacatagcaaaaagaaacttttggaaaaagacaaaaaaacaactctcttgatagtatgttgtgatgcacatttgatcaatgtatgcttttaacttgttatttttagggtattttaaaaatatatatacaagttagataacctatataaaaattctagatatgttagtgaataaagttcatttgtatttctagtacaccgtattaatagagagcaactagtgtggatcaagtacaaagctaaaaatacaagattacaaccctggagggtcgtaaccaggaaaaaagaaaaaatataccaccacccacacaccgacaacgccaacacataacccgggagaagactagcaccggaccggccgccgctaagcgtgaccgaccgccgctagaccaacaaaggtacacagacgagatcgccccctaggggatgctaaaacgacgtcttcaaaaagagaagcgacggaaaaaccaccgccgccgtccgtcggggctcaaagaagccaaagactaggctttcgcccggcaaccacccttagggggtgagacagcacgacaacgccctcaggattttcacccgccgctcaccacctgcgaatccacggctgacgcaccgatgctccatcaccactcaagctctactgacatgtgggacccctacaccgatgtcttccgctggtcagccttcgagcgccgaagaccacgcacacccactggcaactcctcctcacaccgaggtcacctcctccaccaccggccgcgcctctcgcgctaagccggcctccttcaccggacgcgcctcttgcgccgatctagcctccctccatcagccgcgcctctcacgccaagccggcctccatctccgccgcccgcgcctctcgcgccgagccggcctccgctaccatcggctgcgccactctgcgccaagccggtctccgacccctcctccaaacgataccgcactgaccagatgcaaccgtctgccacaccctcagctagccgtccgaggccgccatgcctccggtgaccgcagtcaccggcaccgcagccgctgctgccgaacacaccaccgtgcctcctcccaccgggccacagcagtcaccggtcagccgctgacaccaccgctgcgccgagc

SEQ ID NO: 39248 - DNA, 23213 bp, Oryza sativa
gggtggtccactagatagtgctacagtacatgtccatgtcccatgtcactactcttttcgaaaattatggaatttattacttttaattttcttaaaaaaaaggaagaggggagaccaagtaggaggggagggaggaggcacgtacccacgtacacaatataaaactacaattaggtatttgggtaaagaggatagagaggtgaggtatatggggcctttattttaaaaaaaataaataggttcatcaatttattagagtgccacgtaataatttagtagtatgtgggagggtgacacagtcgttttatccaatcaaaacatcacacactatcacatcagctgtaaacacagtactcctcccttaagcacttccttcgttttcaaaataaacaaacttaatgggacacattctgtaacgaatctaaatatattatcttaataactaatttgttgtactaagatgtatcatatatatcgtatcaaattgtttattttagcttagaatgaatggagtaactaatgcgtttattacagatggctctcacacaacgccgattcgaccgttcgactcaatattccttacgggcttgtcccagaggataaaccagtgcattctccataaaagtggccagctagctctagccaaaaagcattacgaactatgttgatttttcatgctacgaaaaatgatagtcatgtcatctgtagtagacagtgtagctagtatctacaatagaagtactgttacacaaaaattcaatacgttttattcagcgagacagaatgaatactacgcaactaggctctccttatctacttgtaattaagctcatgagccacatgtaaattttgaaacttaaattttagagtgatttttttgtcgaagtatattttttagatttaaaatagaaaggttgttttgtttatttctctaaggtttatatattacgcatttccaccaaatcagagcagacaaatatttagactcgatctaagggttcttaattaaaaactattgattattcaggaccgttagatattagtctatactagtaacggttaatgggctcttcccattcgagcggtacgtagatttgctcgcatgcaaagattgatctacccatacgattatgctagccgcatgcagaaaaatgtatttcatagatattttttttgcatgcgggatgccaaccgcataagaaaactggttttgtccgtctacagaaatagtttatgtacgtagttgtgctagttcttaaatgagtttttttttagcactgagagattaaataatcctaaacgattctattaaaaaccatagaggttagaggttaggcctcaggggttacctggctattagcggtttttttttacagtagcagtgaaggtgctagagaaaatagagaaacgtcttaccaatttcgcaaaacaatatatatactatatatatatatatatatatatatatatatatatatatatatatatatatatgttcttttctagaaaaggagtttaaatatttgaggtttagctagaggcccacgaccaaccgtaatttggacaaccggcgtcaatcacaggatctcatattttcgctcatggttatacttatcagctaaaatttgatttttcaacattaaatttgatgctgattttggagttttttttattcaagtttatttttcagtctttgcttttagatcgctaagaacacatatataaaagtttagccataaatttacttttcatttgtaaatatgttgtttagtttatttcatgaataaacgaaacaatgggacctcatagtgcctcgctcagcacccaagacagccatagtattccgtattttggattgacaattacagttacagcaaagcatgataatatgatactccctccctccctccgtattttaatgtacgacgccattaactttttaataaacgtttgacctttcgtcttataaaaaaatttatgtaatcatcatttattttattgtgacttgatttatcatcaaatattctttatgcatgacataaatatttttatatttatacaaaagttttaaataaaacgaatggtcaaacgttggttaaaaatttaacggcgtcatacattaaaatacggatgaagtatatcaacatcaagtattagattggttctgtatgtaacggagaaagtactgtactatagtggtagtagataaacttgtcaacacttgatgcaaggatacagtataagcgattggactcgagagggtgcagaaaaacaacgcagacacaacacttgttaaccagaccagctacagactgatagaccgactggctacggatatttgtcctaggattaatccgatacatgccaatataccattgcataatcgttatattataaaaatactattactatccgtaatatttgctactcctacatgttactgaattttttgtaaaattaagaccgagtttagttccaaactttttcttcaaacttctaacttttccatcacatcaaaactctcctacacacaaacttccaacttttcagtcacatcgttccaatttcaaccaaacttttaattttagcgtgaactaaacacaccctaaaaacaataccatcacaatcatattttctatcatcaccgttagattcacatcctctcctctctctgcgcccgagccttatcaacatctatggctttttcgactttcacgtcatcgttgaccaccaagaagcaccggtatgctctacgagctgctccactccaactcgtgcccgccacggtagccgtgccgcatccgccttcattagacttctacttcaaataaaattataatatttaaaagtagcatgcgagtcaatatgacatgattaattgaatttaactttgtaaacttaaaaatagatttattacttgatttttttctaaaataaacttttctatacttttttaatattcaccatttagcggtccggagaacacattcactagcaaagtggttaagctgaataccagaacacaatagaattaacccagccttgaaagaaattaaaggatgtacttatatattcagctaatatagacaataatatacattgatattattgattctaaagaaaatatggccagataaatacagactactcctgcagctgattaaattgtagtaaattttaaaatttgccgtggtctatatatataattagttcatgttatctccaaacaaacgatcgtcttttaaatttaaaatgtacagcagttactagaagtttcacaagctagcatgttccatgtcagtgtgtgaataaaaaaaacgaaactttagctggtaaaacaacatggttgtgtttagttccacatcaaaattagaaatttgactgaaattggaagtttgaagaaaaaagttaaaagttggtgtgagtagtaaaattttgatgtgatgaaaaagttagaagtttgaaaaaaagttagaagctaaacaacttcgaaaaaggtttattggtaaacatttttatataggagtatgtatctcactgcaccattgcttcgtcgggggtgtcgcacggtgcgagactgcgagctagaacagtctcctgtcaattttgtaggtctcctgtcaattttgtagagtactgtacacctagtacatcacatgtcactcactagcaagacgtgcgatataggagtaggagtactaatttttcaacaatagtatcatgatcacgtagagtagtatggtactcccatcgtcaaataatataataagggattttaagtttttgcttacactgtttgaccactcgtcttattcaaaaaaatttaaaattattatttattttttttgacttactttattatccaaagtattttaagcacaacttttcgttttttatatttgtacaaattttttaaataagacgagtggtcaaataatacaaacaaaaactcaaaatcccttatattatgggacggagggagtatttaagagagattaagataaatatcaactcagcgcgtatacatgattaattaagttttaattattataaatttaaaaacagatgtatttaatattttaagacaacttctatacataaattattttttaaaatagtttgtaaaacgtgctgatggaaattgaataagataatcatcttaatcaggaaacgtgttaacagaactccagtagtatataataatgtactgtaactgtttgagagaagtttataatttgggctctgtttagatttaaactttgaactaaaaacgtcacatcgaacttttctacacacacaaacttccaatttttcagtcacatcgttctaatttcaattaaacttctaattttaacgtgaaactaaacacacccttgatagtattttaattcatcaacatgagcctggccccctagcttgtccatccgtccataaagtgcaaccatagaatagcctattttcatttttatccgcgtagtactagcatgtggaattgctacgcttcattcagaagaacccctgatgaactactactcctataccataccaaccatgcatgggacagacaatttaagctacagtattacatggatactaatttattggtttaaaatcttattactctacgaccataaatattcagctaatatagacaataatatacattgatattagtgattttaaagcaaatatggccagataaatacagactactcctacagctgattaaattgtagtaaattttaaaattggccgtggccggtctatggtcctgttcggctgcccaggctaccgcactcactgtgcgtagctgccgtcgcagccgcagccatcgcagtcggcctgccaaacagaccctatttctaagttcatgttagctccaaacaaacgatagtcttttaaatttttaacgtacagtagttactcgaaatttcacaagctagcatgttctatgatagtgtatgctaacaggaaaaaaacgaaactttagctgataaagcaatggcttaacaacttagaaaaaggtttattggtaaaaaaattatataggagtatgtatcttagcaatttaataaccaatattataaaaagaagctttaattgaaaaaaatcaaaaaatacattttaaaattagtaagcggctcaaaagaaactactcctatagtggggattgtaggatcgaacagtaagaactaagccaaccagagggggggtgaatggttggaacacccaaaaacctaaacttttagcggaaataaaagttaccctcaaattcgactagatcggtctaaccgaagatgatccaccggtctgaccgccctgatgtcgtcggtctgaccggtgtagatcgatcggtccgaccgcctgaagatgcctgtcgcgcctggagtcgctgccggtctgaccgcccttaagccaccggtctgaccgccgcttgtcgccggtctgactgccggtgagatgccggttagaccacagaaacccggtgaaacacaaatcgaagaactcttaaagtggatgacgactttattgattatctctgtgtttacaaagtacatcaacaacactctttacaaaaatctcgagaaaactcgaaaccctaactaaactatcaactcaattgctctcaaaagcgataccgggaagcctcacgctccctctctatttatacataaggtaggcagcctaaagccacgaaccaaactcatactagaagtccaaatccccataggaaaccttctcatgcaagaaacaaactttacataaccactcataccaaatttggactccttccaaattcgactccgcatcctatacgcacacaacacctccatcgtatgccatatggaatcttcaccaaccacgtgcatcaactctagcctaagtatcccgcatgatatctgaccaccacggacgtcgtcttatccccaagccgactcccggtccatcaccgcaaatactctctcgagacatcgagttacctacacatggaacaaacaaagaaaccatattccgagaccaagctatctccaacttgactcaatattagcaaacaacagtattacatacgcatagtatccatctagaagacataatcatgaaataatcacggatatccaaacaaacaatccgaaaccgaaaccgacatagtgtcgtccggtcagaccgcgcaatacacgccggtctgaccggcaaccactgcccggtctgaccggtccacataaaataacaacacctgcaattcatctgtaaatccaatcatctccaaaaccacttcataaataaattccaaataataaaaccgataatcttcaatgccaattgttcatcacagaaaaataatcaaaaacatctttgattttacagggataagagcatccgagcatggagattcttactctccctatccatataggggattatttctaatttagcactcattaaggaagagaaaaaagtgcatctatagacatctggaagtacacattggcacattcaatgaactaattaatgtacttatttggagaatatactgttgcttttggtaggttgggaatgaacttaaaacatctgaccaagttaacattaatgagtttacaaaagcatatattctaccgtatccgcattattgacgccacttacaaacatgacagtttgaaactcaaattttaaatatgccaccaaaactaaacaacagtactataaataggcctggtttagatcctaatttttttttaccaaaaacgtcacatcaaatgtttggacacatgcatggggcattaaatgtgggaaaaaaaacaatcgcacagtttgcatgtaaattgcgagacgaatgttttgagcctaattacgccatgatttgacattgcgaagctacagtaaatatttgataatgacggattaattaagcttaataaattcgtctcgcagtttacaggcagaatatgtaatttgttttgttattagtctatatttaatactttaaatgtgcgtccgtatacttcaaaaactttacacccaaagaactaaacacacccataatcatgagcttatttgccctaacctttctcctccttgctccctagttctagcactcctattcaaattatacaattagcagcaatcctatttctaagttctgtagcataataacgacccatctattttcgagacagaagttccaggtagtccccgttcctcgattcggaaggaaattcccggaaccaggaacacacccatgtggcataggggtgcagtgcaaacagtacaaacacgcctatagctagctctagctgtggctctgggcgtggccaggctgcagcctgcagctgcttcagcttcagaaatacagtatgtctctcacacctgcacaccctgcacgtattgttgtttttcggcctgcagctttccgctctttcctctttcggtaatttgttctccctcatcctcctcatcggccactacgtcgggatatatatgatgggcccgacctggcatgttttcttcatcgaatttgaatgttttttcagattaaggctgagtttagttacagattttttcttcaaacttttaattttttcatcacattaaaactttcctacacacacataaattttcaatttttcaattacatcgtttcaattttaaccaaacttttaattttgacgtaaactaaacacaccctaaagcaaccgatttttttttcataaatcctggtactgccattatgtaattagataggcaacttattaggatattttttacaatagaaatggtacgatgttttagtatctcatcaggaactctagaactattctcaaaatgtatgagttatcccctaaattcttaaacccgacattctaccaacagaactcttcatactagacgaattacctaacattcaaagtagtattggtcctagctgccacctgcacgatgacaatttggtcacatggcaatctagtcaacaaactaaaaaaatatattttttaaaaaaatttatggctggcccactccctaagaaacatatactctctccgtcctactcactaagacgtgatcaaacataactaagtctttaaaactaatatttaacttcagatttcttatatactacaatatttatagcaacaaaatcataatcatataaaagtaaatttaaataataatccaatgatattgttttcattaaataaaatctaatttataataaaatatttactaaccaaatattttaaaagttgaattttaaaatatgtatacggagtgggaacggagcaatattatatacttcctctgtcccataatataagggattttaagtttttacatgcaacgtttgaccactcgtcttatttaaaaaattttgagattattatttattttatttgtaacttactttattatccacagtactttaaacacaactttttgttttttatatttgtaaaaaaaaattaaataagacgagtgatcaaacgatacgagcgaaaacttaaaatcgctgagacagagggagtaagtcatagctgaattgtattcgtggacattccatccagctactccgatgcgagtatttacagtagcaaacattaattgcgctgcttgccgatgggattgatcaaattaaatgcacctggtatatgcagggagcgattgcgagtcaaaattatattttgattgaaaatgaaacgatatgatggaaaagttgaaagtttatatgtgttgaaaagttttgatgtgataaaaatgttaaaagtttgaagtaaatttttggaactaaacacggtgtacattgaacggagtatggttcttggcgtgcgtgaagtgagcatatctactgctatagataaaccgtacatatccgagtacatacagtctgcatgcaatggacggaccgggtacgtactactgttacactccaccatttctgtgcagaaccaatggaggaagtcgccctcctgctcctgctctgtgtgtactgtacgtgtgggtgtggccaccaacaactcaccctggcctcgccggtctggaggcagtcgagactctggagtgtggactgtctcgctatgcatgcggctgttcagacaaaagttctggtgtcacatcaaatatacgacacactattattaaacatagtttaataataaaaataaattagagataaatttattaagcctaattgatttttattagcaaatatttactgtagcaccatattatcaaatcataatgtaattaggctaaactattataatcctcccgaacacatgcccacttagtaaaagctgtaaaaaaaaaagacattcaaggaagctcaattttcacacctttacactgcaaaatttgtaaaaatatcactaatttgtgaaaacataaaatttgccatttttagtacagtgacagaagtgctatggcacaccttaaacatagaaaatttccattttctatgattaataaacacagcaaaaataatacacaatgcatgacaaccaattcaacaactgcgcacattaacaatcaatatttttctctataattaaaatgaacagaaaaggcagaataccagattccacataaaggtccatttcttgaacttctaaagaatgaattaaatgctatagaaatgtaacaattctattatatcagtattgtgataacgttttctgctattttcagaaaaaacaaacaggtaaattgattttggtttttatctgatctttctctaataggaaacttgaagatggtgacattgtaaatgtcgacgtaactgtatattacaaaggagttcatggtaagttctctgcagcctggtattgtatttcgctgctgaaagttgttggtttttttgacacagtatataactaaactgcaggtgatttgaacgagacatattttgttggaaatgttgatgaagcttccaagcagcttgtccgttgtacctatgagtgcttggataaagctattgcaataggtgattccttcagtttcagtctagtgttagtagcaatctaccttgctttatgccttggttatgtttctcttcagttattatttctaaactccaaacatatgattgctcatttatctgaagtttttgttacatttattggaacatcaaggcaagtatctgcacaggaccacaggtatacataccaaatatcaaatatgagtattcgtcataaaatagaagaattaaggcctaactggatcctggcgtcctgcaatgacagcacacatgggaaaatttatcaaacctaggaaccacatgtcagtgagcaaaaagttaatatgcttttcagagtgctagcagaaggtaaacaccaacattttttttggcaatatgctaaatattctgattcggaataacctaataaataccatgaagaaaaacattagtgctcattccactacaagtcatcgtccaaacctgtacatggtccagggcggcatcatgcccagtaggttgcctcttctttcaaatatgaaaaaaaaaagcctttcagcagctcgttacaatgaatgcagcaatcccagatcaaataattctgattagccataacaataaatgaatgtcagttaattcctctaatgacacaaagatcagataaggtgctcataagactccttcctagctacctttccatgaatttgggctaaaaacatactgtaaatccagtatcagtttcatgattacattgtaaaatcaaacgcaagatgatctggtgcagcagagggaggagatactcaggcgcatcacaacggtgaggaagctgttggcgacttggcggtgataacggctgcggtgaaaccatattgattagttagtcttaataaatttgtctcgcggtttagaggcggattctgtaatttgtttattattagactacatttaatacttcaaatatgtgtccgtatatctgatgtggcacgccaaaactttacacccctggatctaaacacagcctaagatctcgtagatagcaaagcaaatactctctccctatctctgtttcaggttagatgtcttgactttggtcactttaagtttgaccaagtttatagaaaaatagtaataataaatttattataaaaatatatttaattattaatttaataaaactaatttggatcagagcatgttgcgatgcaggcggcctagctagcttgtatgacgattgcgtgggtctgaaactagtactacttcggctagcacagctcgatcgtcgggtcttgtcagagcgcgcgcgcccggctcatacttatccatggataacaacccgcttttctaaaaaaactagccgagaagttttaaggtgcgtacaacttggaacctgaaaaatgaaaatagaagttttaattagaattgggttgctataatatagaagcaaataagtattcatcttgtagtgctcttcctcaaatcactgtcaagatcaccattttcttattcactactctctccgtttcaggatatatataagacattttaattttggtcaaagtcaaaccactttaaatttgactaattttgtagaaaaaaatagtaatatttacaacacaaatatagcttcactaaatctataattaaataaatgttcataatatttttgttttgggttaaaaatattactccctccatccacaaaagttacacatatttcacatttgagcttttccaaataagttgttcatatttgtagtatttatgcattcaagagttaaatgaagagataaattaaatgtttgattagaatctaaggagtaatctaaatactcattgattgcatgcttacattcactccttgattttgtaacatccaagataatttaatttttccttgatcttgatgacaaagtaataggtgcaacttttgtggatagagggagtactttttttttataaaattagtcaaacttagattagtttgactttgaccaaagttaaaatgtcttgtaacaacggagagagtatcattcattttaagatgtaaacattatcccttgatgatttaatccaaatgaacctgctgctactccccacatagagtttcactcattcattcaagccttccaataaacaagtggcatgaacatggatttcaataattttctctcaagatatgtatgaatggaaagcataaatcaatagtaattaagaatggcatgacgacattagcaatataagctaaattaaactattatatcagtcgataacctcaaccgcaagatccagtatgatccggtacaatattgcaaacaaaagccaatagatgtttactgaccattcagctaggtggtgactagtgactagtgagagggacaagtcatgttggctctgcaaccaaattgtgcttgttctccatggccctgcagaccaaaaacatacttacagcttattaacggacatgcacctagaagccaatcaggatgaatatactcaagcataatgtgctaccaagaacatgctcatttgaatttcaaagattaaatttccaatcatgaaacaaattaattaacatggtataaatcacaaatgattgatacatccaggactcattaatacctgattggaaaactgaactattatgacattgtgaactgaactgaaaagctacaaatatacttactgtaactattccatggaaaagagcacatctcatataaaaatttggtaaattgcactaagaaaaatcagtactgaattgcatgaatattgatagggaatcaaaaggtggaaaattctagaaacatgccgttcttaaaaataacacttaggtgcacacaactgctaccattgaaatctcacagattgatgcagaaaaatttagctcgaacacacttgatgtcttgatgcagcacgattggaagagtttgggcccaaatttgatttacgtaatgatccattggagaaaacactgacaaacagccccccccccccccccccggccgcctactaaatccttaactcctcctcgcctttctctaatgtgcagactctttctctgtattactaatctgaactattatgttttgattgtgatgagatttggcctataggttgcgagcagaggggaagcagggaacacagaactacacaagttcctatctatccccatgaggtgcagttgtttaagaattgaatgtttgcagagcttgagcaatcgttttcacgcttcaaagatttatctttaactgttctggataatttatttccttagagcaatcagagcacatattgttcattcaacccaaaatttacgctgtaacactacaaactggcacataggcatattaaaattcatttctgaatttggccactatgctttgttaatgtttagggctaaatttgaatatgctcaaatgtataatattttttatgtgagggagtgaagcaatttttacaagcttatagtgattaataggctgatagcgctagaattggcaatgctgaacagtttacgattagttttccaattgtcctggtgttaagtgcttatgcacataaggttcaataatactgtgataacatgaaactggaagtctaacaaacgtggcattgagtatatggataggatcatattgtatctggtttgttatggtaggataggattagtttccatatctatctttttgagtttagttaaaatccaatccatgtaacctatatgcatcggccctctgaggctcaatacagcgtggcctaatattcgcagtattcctctctccctatactatactattcattggcgtcatcttcctcaatgactgtcgcgattgcatcactgtcatcgtctttagcatgtcctcgtgcacctcactctacggtgtcccatgcgcaccttgcagctgggctacctcgacatcatcggctccctgacttcggctacatcgatgacagctactctacgcacggcttcatcgaccacgggtctctcacacccttcgtttcggctacatcgactatggcacaaagggctatcatccgtattgagcattcttgctggtttcttcttcagtccaagtgcccgcgctgctcactcttggactgcggggggatgttagagtatatggataggattgtatcgtatccggtttgttatggttggataggattagtttccatatctatctctttcagtatacttaagatccaatccatgtaacctatatatacctgttaacagtgaaatttggtaagcccctaagagaattatcacatcgccaatagtccgattcctgctatattcggttaaggaaattaatctattaaagaaagcttatccagaagtgaccgagttcaagaaggatgcggcatggcagtttatctattaattaggagtagtttgttagtttccttttatctttaggaaattgtgtttagtgtcctataaagactttatgttttcctttttatctttaggaaagtttctttcttgtcctacaaggactagtatctccccatgggtataaatatgtacaccctgggtcattgtaaaatatctctcgatcaatactactctcagcgccgttggtgttgttcaaggatgcatcgcttcgatctcttggattgctctggtttggtcgatatatttgcctacatgatatcttagtcctatctctaattgcattgtgtttagagacgtatcagtttagttggaactgtctcggttaggtctgatcttctgtcttaaccgaaatatctctacaatcacaatgctgttctagatagatttgttatatccatcacattagacagatctatcggctcatcgagtattagattatcatatgcattctcgtgctctatcggttaggttcgacctactagattgttgttgataatataaatcttgttaagccgataggttcatgctaatgttttatcggggtgttagccgataagttatctggacgttgcatcggcttacaaggattgcatacatattggatttagccgatcgcaacaaagattttactgtttatctaatcgtgtggattttgtgacatcggacctccagccgatgtatgctttaaccttcggatcagtgcttactcgagcatgtcattgttagccgattggtttctattggattatcttgttgctttcttgcattatcaccaggcgattgtcttcatattgttatttacatcaagcgtcagaatctacatcagaattatagccgatagctcaaaaccctatcgctatcggctggtatcggcatcggctgtaattaatctatcggcttgtcagccgatcggctcattgatctgctatttgtatatcttatcagttgcagggtcaaactgactagcacgcccgcatctcatcaacctttggacctgcacttgatctaagcagatctcccgggccagtgtgtatttttcgcgtcaacaataccggcccctgaggctcaatataacgtggtctaatattcgctgtatttctctctccctacactgttcaacatgaatgttctatgtttctgatttaaaaatgctttcttcagaactctttcaggggttcaggtaaaagaataattaatgcaaatgcagatctgatctatgtataggaaatatatgttaaagctgaagtgtttcatccaacattaatcatgaaaatattttattcaacagttcatctagcatccgactagcttagtagcttgtcatggctaaaatatattatgtttcaaaacaacaccttttatattatttctcaactgtgtgaagtcattgttgctttttattcctagaaaaaagcttgccttatttctcgaatagttagtttttcttctttttccccctttgtttacccatgctgtttttcttctagaccatatactatttgtcctggctagggaaaagaaacaaaagaatgaagaccatactatttatatcttagatacttttattttggatttaactaaatctacagtgaactcctttatttgatgtcctgtatatatgtacttttttttgtcaatttctatggtctaatatcttcatcttggtgaggtgcaggtaccattacacattcatcaaggttttgtaagaagtaaccaggccaaatgtacatgcaagtatatgattagtttaacttgggaaaaatattgttcagtgttcatctcatgaatggatcaagtgacaaatattgatcgtcccagagtcatatagacattgtatttcttatagaatcttgctatagatttcttgttatagattgatgtaaaaatattatttactggtttcctatgtaatacaacttgtcatgttgattctatgttattttgggggaaaggtacgaatccctgaactatcacggtcgaccgaatttcccccctgaacctaaaaaccagacatcacttaccccgaacttaataccggacgaattacccccctcgacccaattcagagcggttttgtcctatgtggcgtacacgtggcaacccaatcagcattttccctttttttaaaacatggtgggtcccacctttcatactctatcatgtcatccttttcctcttcccctcttcccctctctctctctctggcgtcgacactccttaggcgcggccgcgcggacggtcggcgcgcgagggctggcgacgggcggtgtcgagttggcggccgcacggtctcagctcgaacggcgcaggggtcggcgcgcgtggacgcagatcgagcggcgcgcgagggccggcgatgggcggcgtcgaggtggcggccgcacgggcacaggtcgagctgcacgggcggtcggcgcgcgagggccggtgacgtgcggcatcgaggcgctgcgcgacgacctcgtccgcctcttcccccgccgcgctggtgcgtgccacgctcgccaccacacgtcgcttccgcgcctcctcggcttcctcttcgtcgtcccgggccgcaagccgccgcctccacatctgcctccggcctcgttcctccccggcggcggctgggcctccacctagtgggagctcctcctgccgcgacggggttctcctcctcctgctccgcaaccacgaagccacgaagaagcttgccgtcgccgaccccgcacaccgcccgcccccgcgccgtcgccatcctcctttccccgcaccacagtccaccacgagctccggctgcctcctccgcgggcggccaaaggggagaagagggcggcagcggctggatttgggggaaccggctcttctccgcctccacctccgcccccagctgcgcgagcgagctccgccgctggtcgtccgagtacgcgcacgagagagacagcaagggggctgggagaggttgggttaaagagagggatgacaggtgggccagggattttttttttgctgactagtcagccacgttggcgccacgtgtgctagctcaagtcaaaaccgctcagaacagtgttcaggggggggagtcgttagtccggtatatatagtttagggtgtaaaatgtctgatacttgagtttagggggataattcggtcgaccgcgatagttgggggggattcgtactttttccttattgtggacatgtgatgcttatcaaagactataaaagtatgtttgtacatttctgaaaattataaacgtgttactgctggaggtagattcgttgattttgtgttactcgtgtctatatttgtatgtgttaccgatgaaagggcatgtagcctagtggttatagtgacctgagtagtaccccaaggtcctgagttccttatttcaatggccgtatatatccggttggatgtagaggccgggtaaaaaaatacccttctctaaaaaaaaaaaatatttgtatgtgttaccggctctaagcgattgtgtgttactgctgcctatatatgtgttgctgcctctaagataggtcttacaggactcatgggaagctgcacgagctatgctcaaaaaggtgttactagtgtatctggtaacactaggtatgtgacatgattgtaacacatatttcttgtatgtcggaacactagttttgtgctactgtagtgtacataagtaacatgggctataagatcacttaaaatttgtgttaccgagaaccacaacaggtttttgaggttgtagtagcacatagctgtgttactaaagccttgatctgacgtagtgaaagtataccaccatattttcatccaaacggaacagtagaccacaatatttccatttcatcctcaacaacacatcaaaccaatcgagcaaaacaggaattcatgcatctttatccaaagcaaacatcaatttggatggaggcgatcactgatatcattttgttaatttgtgatagcaccaagaccagaaactttaatatatgtgatttgtgaacgaagataagtgccaaaagaagagatcacctttcccctggacagcaaaatatattacatccaaaataaagtcaccagaataatggtgtggatgtagtagtgaatacacattcatatgctttcttagatatagcatgaaaagaaaaggacaaatggtttgaaaatctaaattttgcactggaaaatataagtgaatttgacaattggcagaacagtgaagcactttattcaatcatccagatccatttcacccccaatccaatcattttgcttttctatcaacctaccaaacggtcacagtgcaaggcttcataatggcacatcgtcatatcgaccacattttttaaatttcatagtggtaccctgttcaacgatgctatgtcctggctcctgattctgaacatttatctaaaccctcttacattgactgctgccatttcaacaatgccatgtcctgactactgatctgaaaatttgtctaaactatcttacattgactgatgggatcttacatgaaaaaagatctgcaaatgaaagctctttaaaggaaataggaagtgaaacaactctagccaaaggtgacccaacaaatctacgttccaaaattgtgtacattctatcaaatactacctgattacagtctgcgagagatctgatatcgagtcaaacagtacaaaagtaacaaaatctgcgagaaatctgatatggagtctaacaatgcaaaagaaatgaaatcctgtagaagaacatgactcccatacatatcaaaatttgaaatgagctagtagtataacgctggtggtggacaatcaaaaagtttattgctcataaagtgttcaccatctgtacgtaaatagatccagaaagcacatggtttccaattcctttagcatgagcaaattaatttcagcaaacaatctatatgtaccactctttaagatcttcagaagattcaagggaattaaatcgctcaccactgtctcgctgcttgaatctgatccagtcaatcttaataaaaacataaagtacctaggtggccatggctgggggttaacggcgagtcaaagacgtaggtcagctctcgagggcgatctagaccttctcggcactatcagcagtttcggtgacggagaccagcactccagcagcgcatacggtctcgccatggatgaaaaggatgcaagcaagccatacagcaggttcatcatggccaaaaaggacagtatgttcatggccaaacaattcaacatgttgatcagaatatcgtatgatttaaacaggttcatcgtaatcttcaggacctttaggccatacataacaagtgcatcatcaagccattcattacaacaaaggccactagttcgaaaccatcgtctagtaatttgttaccttctcaattcaaagttcctcgccccaagtgccttgctaaagctcaaatttgccacaataaggtgctattacaaggcatatatatcgcatagatgctagaaagttcttattccacaagagctgccacaatataatcagagtgctgtcacgctatcacataacataaaaggagccagatacgtagatgctacatcgatagttgttagctcccctgacttcgtccagcttggaggcgagaccaaatgccactcttaatatatttcttacagatttgccattggagagaatttctgttaacaatttgccaatttcactactgtggtgagacatatcagcttgccatcatggtgggatgtggaatgacaagcgtgccctggcccagataggcaatgctatttgcagcttcatacttgattaaaaaaacacaagcaagccatagcaggttcatcatggccaaaaagtacacaaacaagccacaacaggttcatcgtggccaaagtaaagacaaattcaacatgttgatcagaacatagtaagatttgaacaggttcatcatccatacaaaataattagacatgttcatcagcacatactaggccatacataacaggttcatcttcaggacctttagaagatacataacaggtgcttcatcaagccatacataacaggttcattgttgaacccgatcaatttgccaagttcttggaaacatcgttgacaagataccaaaagatgccatacccaactaaattaccaattgcttgagaaatcatcatgttccgcgcaaacctgtcttgatgtgcacgaatccgttccaagagtagccttgaaaagagaaaaaaaataaaggaaaagacatgagtcaacaaacaaaggaaaaacaaaggaaattaactaagcataagcatctgcatcgtacatttcctgaaaatcgagagaacttttttcaacaggttttggaggtggcagagagcttacgctgcagttgcatatatgaggaaatagaagaatagttagtaaaacgttgcaaggattgtagatgtcaaacagctcgatattaggggaaagagttgaattggaccttaggagcggtggagacggggcgagacggcggaggagtccagcggggagcggccgccgggatcctcagcttggaggcgagagcacgaagcgccatgccgattgccgatctggaggaggaggagaaggaggaggaggcggcggcggctagggtttgatcgcttgatcggtcctcacaaactgggagagacgcctccccttcctttttattttaggcgcacgcgaagcggaaccgctgctctctgggcttggcccatgcatggcctcgatgcagcgtcaacccaaggaaaaagtccactttgaatcccttattgatgtagaaatcgatggtttatacatacgaattccacaaccaaccataaaaatttgtttttccagattttgagttttttttttgaaaaaatcattagttttgacttagacaccaagaacttttgttagaataggtgtcgaatatactaattctattaggagttaacttgaagttggaatatgtgtaggatagagttagagtttcactctgtcataggctctctcttaaatatttttttagataatggaaatttataaaacccggcttctacaccaatggaggctctctcttaaacatagaaaaggataccacaaatataaccatggcgattacaatgtagcagtgataattaaggccatgtactcgtagagacttggtgctatattggttggggaggagcacccattatcacaaccctggagatgtaggcttcggttgaatttcgttaacaaatatcgtgtgttcatgtgtcatcatatgcgcttgtttttggtgatcaataaccagagccagccccgaggggcccccattcctagggggcccatctatttgcgcaaagaatagtaggtttagcgatcttccgccgagcgatgcgaggagaaaacacttctaattgagcacaggggtaagcggtgatggcaggatggagtactctctatgtccaattgagctttattttcacaataaatttatcttgggttaaaaatgttattatttttctctacaaacttggttaaagttaaagcagtttgactttaaccaaactcaaaatgtcttataacataaaacggagggagtatatggaaagcaaaataaaaaaattcatattatttgataaaattaattaaaaaccatcaacaattatatataagcagaatagtagtaagagttgggaacaattgttttaagaaaatggccattataaactaaagagatgatgattcactgctgaagctaattgaccaagatgaaacatgcaaaatcagacgtaattttgctgttctttgtaaggaataatttcgctttcatcagtccaccgcatcaacactaatattattgcagaaatgcacctcatttagtgaatcagaggtctcataaacaacataggagtgtgtactaattaagtttcaacagaaaatgccaaaatgtgaagttatacatgcatgcaacaatgaacaatgtatcttcactgagaacaattcttgaaccagcagtttcttgaaacgtcaattcagaattttctcaatcttctcaacatgtacaaaacaaggccaagatggctaacaaatacaaagtcagtaaacttgcacgagagaggttccctttgtctatcccagcctacaacaatatacaagcttgaatttgtagtacttacacataacaaatgacaaccttattgcgtagtatatgtacaaggtggcctgaaccaatatttcgggtcaaactttgatggggtgtttccacctctctattctctgaacctaaaactaaactaatctatctagtagtatacccgtgctaatgctacggtggcatttggtaatacaaatgttgtacatccacgtcattgaaaaaatgcttttcattgttcgcctaatacaaaatgttgtacataaaaaactcggagtccatttacaaataaaatgaatcgctgaaaacaggagtacttataccaaactttagctaagcatcacaatataaaaaccaaggtaatgctgattttcatcgaactttattctttttgttgaatatacaactcaataaataggtcagcctctttctactatgaggtggtttggtcctccatgcaccaagaaataagtatatatggttcaaaaattaaagagtaaattttataaaactacagatactttacatgatctatcacaaaactacagattttagaactagtttcacaaaactacagatttaatgtcttcatttatcacaaaactacaggtattttgaacactatattacaaaactacaaatttaataacttgtttcacagaactacaggtttaatatcttcatttttcacaaaactacatgtttaatatcttcatttatcacaaaactacagatttagt

SEQ ID NO: 39249 - DNA, 35322 bp, Oryza sativa
  unsure (1)..(35322): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacaaatttgactaagtttatagataatagttagcaatatctactatgcaaaattagcttcattgaaatacccccacatggttatcggctccgcggacctctagcaatattgtcattgaaaataaaaaagatcgagaaaataagaagaaaagtgaataatgaaatagtaatatatgttaattttttagttttacatcgtattacagtgaagaacaaaattaataataatagtatattatcaaaacataccatggatgtaagcaacttcccctccccccatgtgttttggctagtgacattatcccctcttcctatcttctctcaaagtcccccaatcatgtttaggtaaaaaaaagttctattatgactaaaataaaaaaaacgattcgactatattatttttcaaagagaattcattgtgtcactgattttgactcgttatataatatgatatcgtattttgcttaacttctattccatccgtctcaaattataaggcatgtatttttcttacatggtctttactgacatactctaaccattaatttactctatattttgttgccaacgaatataaaattagcatcacatgaaactactttaaaatataaatctagtgatatacttcatccgttttacaatgtaagtcattctagcatttcccacattcatattgatgttaatgaatctagacatatatatgtgcctagattcattaatatctatatgaatgtgggcaatgatagaatgacttacattgtgaaacggaggaagtaacatgtataatacttagcgtatatatatttagtatgattgttagttaaaagttactgagcttgatttttcttaaaaggaggacgcctataatttaggacggagggagtataatataccatcgccctctagttagactccattatcactgtataatttttttaattaactcacgcaattatccatggaacaaaaagtgttcaaaattgaacaaaaatttcgaaatatcatattatgaagtagcacaagattatccatctcaaactttaagtgcagttttaaagtaaaaaaactgagatagagtggagcagctcgagtatctccgtatctcccccttcccttcgcgtaaaagaaaatcccccgtctcgtctcctccgctccttgcgccatctcgcggctgaacaggggaggggcgccgatctccgtctggcgcgcagagcagggggaggggatcctggtgagcatccacatcctctttctggttcatctctctcccaccgggagtacttttgtctggaatttgcttgcgttaaccctagtttctcttctagatctggaagaagcttcttctattgatttcagagccttaaccttaatacaagaaacagtttgtttgttcccccatgtcccaagttggatccgcccctgtctgccagttcagtagtttttggtgggattttgaggatctcactatggtgtgtgatcgcttttgtcattcccaccacacatggatttgctcattttgtaataggggaaaaagagtggtgcctaaagatagcgtggatcatatcgcaatagtctgtccaacaattacctgaatccttttgtttagtcataaatccttgcaaatgttctttatatttgttctctctactctccaggattgctgaattacttaattgacttaatcttaatcctaaacttattagctgactgtagaatttcaccttggtagacttcgattagtaagggtattggatgaagcttgtactgatctatggaggtgggtggtccacaagatgctctggacaacagaagtgatgataatgactttgataagaatgacaattctgatcctgttgtttaccagttagttcgggtaagttctcatcatagggtctattggctatacactaatatacataattggttccaattgtttagtcagttctttgagaaacacattttctttaaaataaaatgttcaggttgaaggtgatggaacacttattcctgctacggaggatgaggtcttacagtttgaaactttccttcatgatgagaaggttgatgatgatctgccttctattgacgatgtaacacatgtggaggaatattttactaatgattgcatagtgaagaagcctgagtttgaaggtgccctcagaaatattattctatctcaatttctactttattgtcatttctgtttgggtgatcatacttccttagatcgataactgaatatcatgccatgtgaggataaattgtagtttgcaagctagcatgattaatgaattgattcgattggtttgattacttgagatgttgacttattactatattttcacagaggggccttccaaattagacactgcagatgtacagacacaaaagttagatgctggcttagaggtatattgcttatccattgtgcatcatgaacatgattcactaaacctatgaggtatattgcttatccattgtgcatcatgaacatgattcactaaacctattttctgtttcattcaataccctcactaatcgaagtgaagtatcttcgattgagtataagcattttatgaccagatagtatgttaattctattagataataggtttagtttgttcttaggtacctctgtggtcatttttttcaagctaattctggcatggtaaaaatatggattagttcttttttgtctaattagcagttcaaagttcaattgtatgcggtctcaacaaattccacttttgtatgtaacaactttgtttagtactagttaggaacatatttttatcgtcatcaagaactgacatagagatggatggatggatcaaaactatgggatgagcttcaatgtaatgagaagatgctgagttctttaagtgaacacaggatatgcggtgagacatatctgactgactgtagatcattgaaagatgtggtaataagagattgatctgtgtgaaatacaatcccagggcaatctatttttatttgagcacttcccttaaaaccatccactaaacatgcacctgtatacatcttctttcaatctacatattcaagttgatgtaacactaaatagatgcatatcatttcacaggaagacaggttatgtacattgaatgattcgatagttcttccttcaaattgttcagctgttcatgaccagcagctggataaactaaatacagaacaaggggcaaatatcattgcccaacaggacaatgcttcgactgagactacaaaatcaacagtattaaatgacctttcttctgataaagaaaaggctgatgcctgctcgaaacctgtaaatgaggcatctgcaggacaatctgtttctggggttactagttcagttcctgatttttccattttaaagggagaagtctgcttggatgatcttacaatgagagaacttcaggaagcatttagagccacatttgggcgtcaaactactgtcaaggacaagctatggctcaaaagacggattgcaatggggttgatcaattcatgtgatgttccaagttcaggttgtgttgttagggattataaagttattgccatgggtgccaaacaagaaataccagtggttgaagcaataccaaagatggaacttgaggctaatttggttagggaccaagtaatgaatcctggacatgagagagatttaccatcaagtctttcctatcatagtgaggagcaacagagatcgtccaagagactcaaaagagtaccaacagataatgatgaaccacaagtaactatttttgccgaacaaggaactactaagagaattagaaagccaacaaaaagatacattgaggagctctcagatattgacactcatgaatccactgggagactttcttcacctggaaaaaggcatgtatatgatgaggtgttattgagaccacggatagcgcctttgcatgaggttgattcgttgagcacagcctatcctactagagaagatactcttggagggtgtagtgtgcatgtgccttatgtttcaaggatgagaagggggcgccctaggagtaacttcattccatttttggtaattgtctacctatgcattatataatcttccagctctggacaatttgactaccatttattatcattgtgacatttgcgcaaatattcgattactatacaagtatacaggaccaacaatatatttggttactccatttttggaactattttagggatgtcctctttttatgttagatgcttcctttttctgctcctttttagaatttcttcttttgatatgagattgcaagtaccttctctatttatcaaaataatatggatttccataaagcattatgttaacgcattttggcctgtaaattgcttcctgctcagaatgcatctgacctaagaaacttatctaagggaaaatgttcttggaagccaactaactaaagactcatgcccattttcaatcaagcagattattaattttctttttcacaatttcactctttgcccatggtacttcctacaaacaccgtgtgctatatttcataaattaaatgtgggaaatctctgaactttttgttaactgattttgccattgtagtctttatttgatagtttcctcatcattgtgccaatattccatttgatctgatgtaccatattgcaccatataccaattcagaataatttaggacaaaaccatattttcatgtgtcatacgctattagatttggtataattatctcaatgtagctacctgaatcctttttttattgcatcaggatcctgagccttctgtggaatgtactgaggcccctgctgcagatgtagtgaatttggaaaaggaaggtgaacggaagaaccatgtaagcaaagccatagaagttccactagtatgatgtttcttcatgttggacaatatagtgaaaatccaacttcagaatgaagtactgactagaaatatatttgaaacacatagtacctcaatggcttaatgctgtgtaatctacttctgtattatgtgttatataatatttttcttcaacttgctagcagaagaacactgggaagaaaggagtacatgtagaaacatcttgtgaaaaggatgttcagggtctgcaggacaaggatttttgcgactctgatgacaatcccaaaacaaagcggggtgggaagcggaagcatcatcgagcatggacattgtgtgaggttgtgaagctggtcgatggtgtggcccgatatggggctggcaaatggtccgagattagaagactagccttctcatcatattcgtaccgcacctcggtggatcttaaggtgcaattgccttttcaactcctaggtttgttcgtgcattttatttcttctaatgaatcatgatgcttattcaggacaaatggcggaatctgatcagggccagccagacacaactttccactgaaaacgatgtatgatgaacaggctgttctgttcgacctactttctcacgttctggcattttttcccctttgctttgcatcttgatttatttacccaactttctctttgccactgaacagggtgtttgtccacggaagagcaatccttctgccataccgataccagtgtcgattctgctacgagtaaaaaaactggctgagatgcagtctcaagctggcgacgtgagagtgccgatcaagttttcagggcagagcactacggttgtacaggggaaagtttcgggtttcttgtgatccacgtgttgcatgcaaatagagggggaaaccactgagattgatgtacgcttttggacgtctgtgaataccacacttgtatagcaaagttgtgatcgcgactcgcgttctcgtgcaaaagaaagagtcgacgtatgtattgtttgctcctttttctacacacgaacacttcctatgttctccgagagatttgactaacgtaccttgagattgacatagtcaccttaaacaccttgttattgaaagaataaatgctcctttttcgtttgcacggatattaacttcttctctggatccgcttgtttgcatctaacccaagtcctaatagccttgcgaatgtaaaacagatgttcgattgcatggaagagcacaagagatttcttagtcgcgacagagtaaggctttgcaggcatgtacaaaccaaaactaagggagaaattgcactgcagctagaaggcaatcatttgatcgagaaaaaggtataaaagctgatacattaagtggcgttaatattaaagtaccggcacaaaaatggaaatatcagcactaatctggatataaactattaaagcactaatctggatataaactattaagtggcgttaatattaaagtaccggcacaaaaatcgagcaggagggcgagggctatgggcactgcaacacctcacctcgctcacctcaccacgcacgagcgagcagctgatagagtagcacagtctgctaatgtagcgccgaggacttggagatcaaatccagcagaaatttactttcacccgaaggatcaaccttctccactttgaccgcggtgttcttcactttgcgctcatcgccgtatgattcttctttgaccttcagcctgagcagatattcctgaaacaagcaattgagcatggtgtctgcaaaccgagggtcctcgcgctccttaagtgcgttgagctctgttgccgagcagccaagcaactcctgcccagcctcctggaatgctgtcacccaagctgttcccgagtgatcttgaatctgaaactgcaggagatacctgtagtcgcactcttcaaactccctatcgcatttgtcacaggtccaattgccattagtactctttgtcaccttcttattgcactgcctgtcgccaatcatgttagggcaagctgtgtagaagaaggactcattcttgaagaatataacggtggctttcaccgtaatccagtcaggtttgtcccccattccaagaccttcatccttgatctgtgctactgtctttcggatctcattccttgatgctccaggcgtgatatctctggatatggactgagtagaagcatctcttcctccactatcaaaccattgcctgagactatgagcttcagcagaatcagggttgatgaagagctgagttgaagaaattgtgccgacagacttgccactgaaatcactcacttttcctgctttgacagccagcacaggaaagatcccacgttcaaccattccttgaagctgtgagccttctctgttgcaaaagtcaccccacatggttacctcaacacttcgaccagacatatccttcaggttcatagttcttttctgagtttccatgccatttttcctctgtattgtggtgcaaggattgaccgatgtaacaacacctatgatgtcaaggatagcattgttctgggcatcctcaatttcattgatcggtctgaagtcaaaccgctgggtgggaatggaactgttctcatcaggacaaagatccacagttgatccattctccaataaaatctcccactcattgttaagatggttatagttcttctgtgcaggtctcaagtttcctcttgataccacatagaccttaccaacttccacaacttcatagaatcgatcaagaagagcattgaagcatgtcacccgtatctctcccccatcagaatcaagcaagtcaaaagagaatactttcccatcacctttagcattatggtatcggcggatatctcccttggcagtaactctagccttgatagcccagcggccttgataaggatttaaagcagatatggggattattctagcaggggcttcatttttcatgattgctccatggtttttgtaattaggtgcagggcgataagatggctggactgttggttggaagaccggaactttgtcactgggcctagtggcaaagttagaggagtttcctgccatcgaattttggaacaatggaacattgtcactaggctttgtggttgtatttgatgagttccctgccatcaaaccatattgaggtgctccgttaaattgctctactcttgtcggatttgggataggagatccagtttctgaaagcgctgtaggattcccaattatctcacactccgaaacaagaacttccaggttcagaatgacaataatcctacaggtattgcaacaagtcagctcaaccaacaaaaaacaattcttgattctgctctatcaaccagtagatcagttgaaaataagaatgcaaaaggctcagaatatgatgattcacactgctacatgaatactatgtttaattacaacaccttttggtcagaaacttatcttcacttttgcatttgtcgccttgccaacatgatttgaatggacacaactatgcttccaattacttatgaaccagatacaaaagaaatgcatttagtacggtgttgtgttgaactgaatggctacagctaaaagataaaaaatacttagtacttagacccaaactgttcacagcaccagacagttgcagcattaatgctgatcaatatctaactacattggccaaatcgatgcacccaaacatggcgatttgttggctagagaaaaaaaggcacacaactaaattagtgaactaaatcagacaacactgtaaagtgtgtagtagtcaaactgaccatattaccttcatcgtttgacatgctacctgccagaaatggcgaacaccaaaggctacccaagcacatatatcacactattttgtaatcgttaatactaatgccagccaattaactactgagtatcgacaaacaccaatttgtgtcacaggacagccttagttaccactgattagtactgcaataccgaggcctctttctgacaataataattcaaatcagaattaaaatcaattggacaaatggttaacaagcaccgatcaaatgatgtcataaacaaaaccattgtcagaaaaattttgatgcacctctactagtatctagtaggaaacatgaagctcatcgacaatttaccaacagaatggcaagtactaagtattaatttaaattgcaaactagctgaaagcgggaatctaaaccacacgcagactgacacacataaaaccaggggcaagcatgaaccctaaaacgaaacgggccaaaaatcgcacgcaatcacacatcgatcagaggcaggggaatgggggggaaagtggaggaggaggcaacaaaaccttctggggccgacttcgttgatgacgtactcgctgagctgcacaatgctgccgcgtcggagggcgccggatcgggcgtggtcgctgagctgcgcggcgaagagcgcggaggacgcggcggtgccgtcggagaccaccgcccggaacctctccccgcgcgtgacgcccgcgccgttgacctggacgccccgcagctcgacgatctgcagcaccggcttcaggttcgtgtcccccgccagcgccgccgccacgccgttcggcgtcagcctcgccatcgccatcgccacccgccgccctcctccacctccacctccacctcctcctccccctctccgcttcaattcaatccgacacggagaggcgcggattaacgggaaaacccccgccctggatggttggaacttggattgggacgaggaagaagggaatggttcgaggctttgagctctcgaaaattcgaaaagatgcgaggggtgaattagaaatggtccgctaattaatgagagaggcggttgatgtggaggctgctcctttcggaggaagacatcgacacgcttcagatacaccagccgttggatagatttggcatgatcgcatcggacggccacaatatcccagagtggatgggctggcctgggcagggatgagttcgctgcgggtgggccggcccatctcgtattctgatgggccgtcacgcggcgcggcgaattcgaagcctcggcccacgttgccgcagcggttgacaccgatgagtgataacgcggtccagtattgtggtgattggctgattgcttaccattttgcacattgcacttctatcattgtgcggccatgtttagttcacatcaaatttcccccaaacttccaacttttcatcacatcacgtcacatccaaaactttcctactcacataaacttctattttttttttccaaactaccaactttccctaaactttttcctaatttcagaaactaaatacagcctcattgagtagttcaatcaggtgcaggttttgggtcattggatgggatatgagacactgttcactagcaggggggggggattgcattttgctgtaagctgtgcgttgaccggtataaaagatagtactcctggagtagtaacaacaaatctatgaagaaactgtggccgtgtttagttccaaaataattcttcgaactttcaacattcccattacatcaaaggctgtgtttagtttctgaaattggggagaagtttggagaaagttggtagtttggaaaaaaagttagaagattatgtaagtaggaaagttttggatgtgatgtgatagaaagttgagagtttgggggaagtttagtgtgaactaaacatgccaaaacttttctacacacacaaacttctaacttttccatcacatcgttccaatttcaaccaaacttctaattttggtgtgaacaacacaagctgtacattgtttactcaactggaaaccggccatcgagggtggacgaaagcaaagagtgggttaaatccagtagccaaccaagccgagccgcatcaagtgatcaaggtcctagttttgtttcgtttggtccagggtttgtatgatgtcaccgcagtacaattccagcgaattgaagggtcccctgacgttcagctgacactgcagggactgcaagtagcagcagcagcactactaccaccaccagctgatcatttactgttcttaacacttgcagctgaaccactggttgcggcctcctgacagatgctgatccctgacgaccagctctcagattgaggcgtttagttaagcggctgtcacgagaaatgctgtcgcgcgccgtgacatctccctcccctacacacggaaaaccaggccacatccctgcaaaaaacacatcggatcccttcaccccaaacgcgcgagggattttaaactaaacgccacgatacagcggtaagaatctgaaactgaacgagagcgtagtagaagtagtcgccgacctcctcctgctccgtaaactaaccgggagagaactccggcgcccgcgaccaccacgttgcagggcctcatatcccgagggcgtcagatgccctcgccgatacactaaaaaccgaataatctgggcaatcagtctgtcctaactcagagttgccgcgaatgacgacactagtttaattcaacctcttcctgtcagtagtaaaatcccaactgtctaggttgcccgtgcacgcatgtgtgcaccgctgctaaaaatctcatctccacagccttttctcccagccatgactgactgaacaacccgtccaaaacgggaaaaaaaatctccattactccctccacctaaaaaaaagacaaatcctagttttccgtatccaactttgactatccgtcttatataaaattttttataattcgtatttttattgttgttagatgataaaacatgattaatattttatgtgtgacttgtctttttaattctttttataatttttttaaataagacggacggtctgggtttgtctttctcttttttttttttttgaccgagggagtacgtgccacgggatcaggtgcaagcacatgcgggcttaacacgcgagtggtcgtggtagtgggggaggcgaagacagtgtgagcagaataacatgccgtcacggcctcgtctcgtcgcgatattgcgagccaaaaccgtgcaagtcgtggggtcacctgagcctctccacgtgcgattcaccgcatgctgcactgtggcttgcttgtgcagctgatcctccggttgatgaatgaatggttttgaacgttctcctctctatgcatgcgtttcgttttgctgacgagatgggtgcagagccgcagatgtgtatacagagtagtagtacagcctttttattgtacgcgtacgtgctggagacgggctcatgtgggctctgtcgtgggaatactgggcgccgtggatttgttcaacttcgctgtcagaacagatacgtcatacagtacgtgctccgctggattcggtgatgaagatgatacagtgacagctgagtttttcctcgttttggagtaaactccagattagtagagtacgcgtcgaaaaccagcacatataggcaggtgccagtactacgaaaactgagggggtgtctgggagtagcctctttctaaaaaacataagtctctagaagagaaactaaagtttagtactaattcccaaacactctctcaggttaatttctgctgttggatgaaccgaaagctgtaacgcgggacatgtaatttctgggaatttcttcagtaacaattactccatgtggaggcttgtgtcagggaaggcaatccctgtggtgcagtgccagtagtagtgctgtggacgctttggacgaagtcaggtggcccccgcgcgtcagtggcacagctaccggtacttgagccggagactgtcacggtgctggccggcagacaccgtctcgcggcagacagcaagtgcaggctttgaaggctgcagctgcaaggaggagaggcttgtgtccaatgctgcactgtacatgatggatgcatgcatgcgctgcagactgtgtgcgaggcaggggaggagaggcgacggtccaaacgccagcaatggatcattcaatcgcatggacgcgagagctgacagcgcctgacattgtctcagggggccggcagcaattgcagtgcagttggcattgaatccatggagaccaaagcaggggtgctggtcagtcatcacagtcctccatctctccctctctctgagtgtctgcaggaaggtgcaggagtgggggcactgcagctactcctagctctgcatccagcttcttgcagcattggccggtcaatgggaaaacggttcaggggagaatagaccctgggagaatctttttgtttgggactttgcagtgataaccctgaatgctaatgatcgacagcctaaacggttcaacaagtgatcaacctagtagtaacacttaagaagaccaatttggtacttgcacagtgtactcaaccaactgacgaagtgcaagagtacggtattaagcatttccgttgctcaggagcaaagctgttttacgttgcactggtaatgtacttaaggaggggagtggagtacacctagcaatactactactcctacaccgacttgtcagaaagcataaagtattctctgaagcaggatggcgctagtgagcttttcagcagaatccagagatgtgacttactccctccttcttaaaaaaaaaaaaaaccgtgtcgaccgtccgtcttatttaaaaaaaatatataaaaaaaataagtcacatattaatcatgttttatcatctaacaacaatagaaattttaattataaaaaaatttcatataaaacggacaatataaaacggacacgttgacccaagaatccacggtttgctttttttttttttttcggagcgagtactatcacaggcagaggaatcggaaagaagaaaaagggcgttcacaaaagcgaacacgcttgtctcacaagctgctgcagatattacaaggactgacaggaaccaggcagaaaatctattcctagttggttcaggaagagtctaacctaattaatcagcccgaccgcatcattctgaggccatttcggagaaaatgtaggagtaacactcgaagcaacattacaaaaagctcaacgaaaagaagtgggaaaaaaataagaatatcatcagagaactcgtaggaggtttcggcctgtcattgatgaagtcctgaaagatcgaagcgtgattagtttggagatgcaatgatcgatcgatcgatcctggagcatcagcatgcagctcgcacgccgtgaaagaagctgttgatttcttccgcgtgttgatcacttcttggcttcttcaagagattaatcatctgcagattgcacaagaccaaacaggaagcaagttggatcatcgtcagcacggctcgccataagaatcaagaaacggttctgatcagtggagacgaaggttagtactctacgcaccattgtggtagcgggaggtggtggtgatcgggaggtcgttggcggccatggggatggacatggacagctgcgtctcgccttcgagccccatccaggagcccttgctgttcttctcatgcggccactcgtcgaagaagtggcggagaggtttctgcgccgccgccgcgtggtcgtggcccgccggcttctccagacggaggtcggcgcccaggaggaagcagtgctgctgctgctgctgctgctgctgttgccgcctctctttctcatcgtcgtcctcttttgaaagatcaatggcgtacggcgacgccgcggtgtggccgtagccggcgcccgggaagagaggcgtggtgctctgcttgggctccatgccgagctgcttgaactgccactggccgtgcccggcggcggcgtggtggtgctccctctcggtgccatcggagaagaaggcgtgctcgccgtgcacctccttggtggcgtgcccgtacgcgtactccttgtggtccatggagtagtaggacggcggcgggtgcgggtgggtggtgtcgagctggaggtggaacgggctcacctgcgcgtggtacgccgcggcggcgggggtgcgcgcggtggccgcggcgtagggcccgccgtagagcgcctggtacggcgccgcgtcgtgcggcgccgggcggctgtaggagggcgccggggaggaggtggtggtggtggtgggggcgacgccggcggaggtgttcgacgcggcggaggtggcggaggaggacggcggcggcggcgtggccaaggacatttccacaggctttcttgaacggttcttgccacggtgcatgtgcttctcgcagtacttggagtccgggtacgcctccttggagcaccgccacttcttgccgtccgtacgccggcatcgccctggctccgggtcctccgccttccgcccaaaccccatgccaaagcaaccccaccccactgcattccaaagaaaacaccaatcacaatatggactttgttagcatcggcaacaacgcgtacgtacgtacgtggaggaggatgtgtgtaacgtacgtgaaggttggggagggaaggcgagggaaggggaggtggcgagggcggagtcgaggaggaagctgcggcggagggggaggatgaggtcggaggggatgggagtcccggacgccatgtacttgtagatgagcgcctggtgctccagctcctgccactgcgacgccgtgaacgggtaccgacctccgccggcgccgccgctcgggcgaccgctcatcatcatcatctctgcaacaactacttcagctgcgaccgaccgcctcttcaccgaccggaagcgagcgaagcggtctcgcagtacaggcgccgcgggcgcgcgctctagctgctcgggagatcacgcggatggggggaggggtgagggtggtggtgtgcggcgagtggagcgggagagctctcggtggctggggttttgtaatgggcggggaagggtggggtgagggtgggaagcgacgtccgtgcgcatttaagacttgcgagccggaggctgtttccggatccagaagaaaacccgagggtaatactgcgaaatgcgctcctgcctgccaaaaatatcaggtttcggccatttattaatacattttctaattaataaacggtgggttttaattaaacgaatgtgaattctataaaacgttactgtactactacgtaaatgcatcaactatctttcaatacagtcaattagtcctgcataaaaagtatattttaccttttaaaattgcaatattaacgtatagagttggattatcatgagtctaacttatatatactccctccgtttctaaatatttgacgccatcgatttttttaaatacgtttaaccattagtattatttaaaaaatttaagtaattattaattctttttctatcatttgatttattgttaaatatacttatatgtatacatatagttttacatatttcacaaaagtttttgaaaaagacaaacggtcaaatatgtgctaaaaagtcaacggtgtcaaatatttagaaacaaatggagtattttacgtatgtacggcttagacgacggttagaaagaaaatcactcggactggcattttattgtgacatcatatgaaccagatatgttattgaagttctagacatttgtaaactagaaggtaattatctaattaattaaactttaaaatgacatatcaaacatattatacgagccctatagtccaaataagatctaatctttttttaccgcttcagcgattagggtgtttttagtgaaaagtatttcaacaaatatattatagtgtgaattaacactaatgcgttcgtcaaaatataataacccacgaagtagttgacaccaagtatgtattttcctgtttagcatgacagtttttttccctatgcatggcacctttcaagttttgccatttatattgtcggaatataaccgaatatgcaaagtgagtgtatatgtttacaggtgggtgtacgtttataatgtgtttttttttaaaaaaaaacccaacatctttagttaaggtagtgatgttattacttcaactgtttctaggccggatagaaatttatagatctttcacttctcattaacagtgagacatttacacatagggtgtgtttagttcatgataaaattggaagtttactccgtgtttagttcgaaaataattgttcaaacttttgacttttccatcatatcaaaactttcctacacacgaacttccaacttttccatcacattgttcatatttcaaccaaacttctaattttggtgtgaactaaacacagccttagttgaaattgtaacaatgtgacggaaaagttgaaagtttgtgtgtagaaaagttttgatgtgatgaaaaagttggaagtttgaagaaaactttgaaactaaactcggccataatagtttttagtcaatcactttcattctcaggactcgtttgtccagtggtactatggttgtatttagtttctgaaattggggagaagtttggggaaagttggtagtttggaaaaaaagttgggagtttacgtgtgtgtaggaaagttttaaatgtgatgtgatgtgatagaaagttaggagttgggggaagtttggggtgaattaaacagggctttgtttgccactggctactgttcttttgcttggacaagcgacatgctttatactccttccgtccttttctttgtgaaaaaaaatgtcaagaacaaaccgtaggagtaggaagaatggaaaataaccctaccgcacagtacagatttgtcataaaaggatgcttgcaaccaagcagcccacgtagtagtacgtgcgtgtgagcgaagcagaggacatattttttttttcttaaaagaaaaacgtaggcgtgcgaacgatggcctgtttgaatagtttccggatatttaactccgataatttatgtcccgggtacagaagataggtcattcagtcaagatgcagaggcagagcagagagtgcgctgcagaatctgctgtgcgcccccctcgtgggcgcgcgcagccgtaggaatctcacccgcaaaaactccacaggttcctcgcgtctcccctctccccggcgacgacgcgagcaactggccaccgccgcttgatgccgtatttactgtagtcgtaagcgctttggtcgtcgtctctatagtctagactgtcaccgggaaactttggctcccatcggatagcctattcaactaaagaaaaaaaaacaaaatttgaatttttaaacttaattttgacattgattttgagatatttttaacgtagtttcttttacggcattggcttttaaatcaccgagaacacatatataaaacttttatctacaaattatttttattctctaataagccgttttggcttactatgaaaaaagccaaacaataaggccctttgcatggcgtatagcttgttcttctatccaaatttttgacggttcgatctttgtggaaaaatttagtttcaacgatgaaccacatcagacattgatataaaaaataaaccatgatcttagcatagaactactcatccacctgataagtggttagtgcaaaggaaccttgcaaggacgatacacctagagcttgccattgctatccctcatcgagctctatcaaatacagtgttggtgtggtctcgtcaagcttcgaaattcctagctaatattgcggacaactcacctagcacaaaatggtgacggaggataaaacgtagcgccaccacagcctcgttgatatcttaaacttctggcctagtctcggtgaacaactcgtttaggacgcaacgacaacatggtggtgtcaaaatatatggtgtttttggactttgacattaccaggcttagcgctgatgtttgtggtttatttttatacatttcaaataattttgagcacaatttagttttcagataagttatattattattttttgggggctttcttctgaatattaccgcaagaacagtatttctagggtagtagtaaaatctttcgggcgtcgaatggtagttggtgcatgtagcagtagaaggcactatgggtttctatagttaatgggcaatgctggtcggtgtcagaggagccctgcgggtggatgctgccacggtgccaccatgcgcagtagcgagaggccccacttgaatgttattgtttattattattattgactgcaacggtgcaggttgcagatggcagcagcagtgagagggagacaggcagactctgacaccccacgcagatagcctgcagccacccaccccacacccacctcacactcatctctctctctctctctctctatatatatatatatatatatatatatactcagaaaaaaaactgtgcaatttctttgtgtagagtacaccagaaatatgtactgttggtcaccagttgggcgatacccaccgtataaaaaatcaggatccctcttcgctgtactactaccactccaggtgagagcatgcacacccttttggtcgaattaatgtgtcattagaagtgaacagtcattgttccgtttaatcatactgtctcgtcctatgaatgcgtcagtcacaactcctaatcaggatagcaagtacaacatcatgattacatactcctactacagtcctagttgcactactactagtattagagcaagtttaatgtactagtggtgtagctaactaattaactaattgctttaaatcatttacgatcactttaataatcaatttatacgatagttatctataaacatatcacatatactacactattaatatatggtccctattatacacatgttgtgttttagattccgtactgcagctggttacagatctgtagcccgctgctactctctctcttcttttatctcctcaatatgtatttatagttggcttataatatctgagaaagcttaatagtatagcccactactagctccaatttatctatagccaatctaatggttaatttatacaatagttgcttactatgtagtgacagaaaacacgaggcctgggagatttgcttaactccagtgcaggtccaaagctcgcctttgggtgtactagcgtgccagttgatttgtcacgccccgaactagccccgaacggaactagcctgtgacgctccaaattaacctgttaatcgataccagtctcaggaaacagtgctggtatcacaggaagacagaatatcatagcaacagaggtctctttattatagagtaggagtacagtcaagttgggctgtggacagatcccgaggtcacaactgcattacaaaagggaaagcggaagccaagacttggaccattcatcacaggcgcgacttgggaactaggccgaaaccctaaaactcatcgtagccgacttgctcctggaagaactcctcatcagcaggatccacatcatcctcttcagcaacttgggggggattatttacatagagcaagggtgagtacaggagtactcagcaagccatgggaattaagtgtttaatgcaggcttcaaaagaaaggctgttgtttttgcaattggttttatttaaactcctttttgaaacaactaagtgagtgcttctcaaacgacacggatgagacagtgtgtctcgtccggtcggagtatgtgcaatgtatcagtttttgaattgattcaaggttggcacccgtccaacagctttcaaacggccacccgggcctggctgatcccatcagccgcagatttttcaaacatcgaacccattccacaacagtaatttcaccagcagtagtcaaacaaaactacgctaggaatcacctcacatctgcccatgacagtgggcacggctgttcgaacagtttaataacctctgcagaggggatacactttacccacacgatattactaacccggatcacccagcccgtgtagaacggcaacgtctggagaccttgagactttcatgacaaggcatttcgaaagccgacacaggttcaccatatgccaacgagaggggtcctataccgacatcaggttaggtcccagaccatactgtgccaggaagcccgagggttctccccggcaccaccccgttgaatccacatgtctcttggcatcatggctcccctgattagctaattactcagccaggggcgtcccattccacctatgtggtcacatttgccttatgtttggatgaaattccaaagaaaacggtccttaagtgcaagagcgggaaaccgtactcccggtacattccccgatctacgattttggaaatttatttagttcgcaagcacctacccaggtgtcgggtttttccaagtcttttataaaaccccaagttttacccatcgttggatattttaaatttcaagggaagtgttccgatgctcgagcccgaaggcccatgcatcgaagcacaacagtcgacaaaggagatctaagtgttcaataattcaaggagggtaattgcagcaattaggattgtggccggcaagctatctcgcaagccgcggccgaaatacttgtgttaaacttattcatgcaatatttgcggaaaagaaatacttagatttaaattataggtgcaagatgatcaaaggtgacttgccttgctcgaaatcttgagcttgatcctcgaaatcctcgcactacgggtcttcgggctccgaaactacacgcgaaacgggacagctcaacaaacggcaaaaataaagccctattattgacctctaaacgtgccattaaatagatatcgagatttgaggagttttggaagttgaacggagtcaaacggacatacggttgagaagatattgaatttctaagattattggatttttgttctaaaggaaaaaggatttaattaaacccttttgaaaagaaaagaaagagggaggggaaacagacttccctcgggcggctagggcgcggcccgagagaaaggggcagctcggccaagaccgggtcaagccgaccccggtagctaatcaggggagccatgatgccaagagacatgtggattcaacggggtggtatcggggagaaccctcgggcttcctggcatagtatggtctgggacctaaccgggtgttggtctgggacccctctcgttggcatatggtaaacctgtgtcggctttcgaattgccttgtcatgaaagcctcaaggtctccatacgtggccgttctgaacgggctgggtgatccgggttagtaatgccgtgtgggtaaagtgtaccccctctgcagaggttattaaactgttcgaacagccgtgcccacggtcatgggcggatgcgaggtgtttcctgtagcgtagatttgtttgcctgtgctttgtgaaaaattgttgtggattgggaatcgttactagaatcagcctatgtggcagatggatgacctgagtggtcaagaaacgaatctgtgtgattcaggatgtctgcgggcatcatagacttggcttcccgagtggaagcggatcgttgtgttgttgggcagctggactctgggagttcgagaacatgaataaggctctaggagccgcttaatcaagtgaaatggctctgtgagccgagaagtaatgatctgacccgggaggtcggtacattacaaattgagttgttgaaaaacatctcttaaagtcgaatcgagacgcaagtcacttttcggcccaaacttagaaagaaataaatcacttagtggtttcaaaatggacttcaaacaaaagatttgcaaaacaaccttgcctctcttccaagcttgcatcaaacacctaaattcccgtgatttgctgagtacgaaagtactcacccttgctctatataaatatatatagttccttcgtcgtgaagttgaagatgaagtgaagtgaagaatagggtttcgtcctggtttccagccgtcgcctgtggtgttgggtgttagaccgttggttccgctgctgctgttgttgttggtgtttcctcgtgcgcgtcgtcggttgtattcttaggctattctgagctacaacctaagttaaggtaaataagtcttctttttatttttaaggattgcaatgattcatatttgtcaccgtgggtaccagcgctggactggtactgtgatcgcggtttcgtaggaagcggttcgcgccgtttttcctacgacatgctcctatcaggtgccgttgtacggcggtgccagatttgggtgtgacatgatttgatcgtgtaatcaataagaaataaaggcaaagaaaccgcggttaaatctataaatgatagccgatcggctaggtgccgatgacatatcatttatctttgagccgatgtcatatgtgaatcgatcggcagttgtaaatagacagtaaagaattaaatctattcgatcggctgtagatatttccaatatatagttcttatatcgatatatacttaaatcaagtgattgggatagatcggtcaccatgccgagacagtataaatcacctagatcgaaatatatattaataacagagctatatatgtttgtagcatagccaatcagacagatctagcatgtatcggctaatactccgatactactctatatcaggatattaaaataggtataatatatcaaacaaatgcctaatatacttagatacggcaatatcttgacataaagggcagatttaacatgtcaatgaagcatatagagcaaatatagttaaatcagataagatcggctgaaactctgatgctaccctaatcggcaaccagaaggcaggctagagattgagattctaatcacgacttataagatcaaactcaactgatggagctataagtatgaaaagaagggcaatatctagacaatcaagccattggaagtttcatagagtggtagataccttatataatctaagtcaacatcgatatctaacctagtcggctgccctctacagacagatgttagccgattatagattagatagcggtattgtaagatatatgataacttgacgaattacataaacgaggtcagagcatcgtaaagatggcagcactaatcccgagaacacaagtcgtcataacaagttttacctctttgttgaagatcgaaaacgatgcagctcaacccaaaagtaagaactcgtcgaaataaaactaaaacaaaagggtggcgatgcgccgagattgtattgaacgtatgtgttaaaagttacatagggctcgggtctatttatacccgagaattacaagatatgtccataacggacacgactactatctctaacaaactctaagataacataagtctttgctccagacttttgctcaatcgtatctctaaggagattacataaaacatcctaattaatagatataattgacttctgaggactctatccatatgcagcaatcaccttgaagcacctcaatcctacccgatatcatacatcaagctgcgttgccggaatcggctctatcggcttacctagtctgactcagacccagccgatcctaatcgtagccgatttggactccagccgattcctgctttgttttcgaactcgatctccgccttcgattttgcttcgatctaatcttctttcctgatgctgatgttaccaaattcggttgttaacactatgctattaatatatggtctcacatatcatacacatattgcgtcatgtagtccgtgttgcagctggctacagatctatagcttgctacttttctctcttaacttttatctcgttaaaatatgcttataagcaaaagttattatattttgggacggaggtagtaatagtctgctaatgtaactgctctaaggaatgaaagaaggatactgctgatctcctaatcgcacggtggtttctctctctagagctagagagagagtatgagtactgtactgtaatgtttctctctctagggctacaggtagcttaggttagggtgtggtagggtgaggaggggaatgggggacagcacccatctgtgaagtctgcagcgtggctgctgtgctcttctgccttttgttgctgctgtctctgaccgccagctttacggaaactcataaacaaagaagcctctctcccacaccgcccctgccctgccctgcccctgcgacgacgcacaccactgtgcacacatgtgtgtgtttcgtccgttcgattcaaaggcagcaaggctgaccaaaagcgagtcgcaaacgtaaaagaagacagcgagaagattgagtggtaggagtatgtgcgtactgcgcggcatgcagctaccaaccaggtgttggtgatggtgagagagtgaaaggggtgggagacgtaaagatgacgagccgacgcgagaggcgcagcttgccgcgttgcaggagaatggccaagtttaattagggcatgtttactttaatgttatttttaaccttatcaaattttggtaaagttatcaaaaagtggctatatttagtttactatcaaattttagagcatataagaaatcatgccaaaatttagtaaggttttttttttcatcaaagtaaacaaacccttagctccaaacttattctttaaatgttcaacttttctatcacattgaaactttcctccacacataaacttctaactctttcttcacatcgttctaatttcagctaaactttcaattttaacgtgaactaaacatacccagtgtactctctcacgcgctgcaggcttttcgccactgttgatatgtatatgcatgccattttgttccatgtgaaaaacctaaccagagacgaccatcattcaactcttccatgtaaactgctggttggttgggtggtttcatttcatttccatgcagaggcagagcgtgtgaatgaatgaatgaatgaatgaatcgatcgctttctcaacccgggcatcaccagtgcatttacgaggaggcatgtgttttgctggggaaacttcccagaatggcttgaacctgaactagcaaggttttaattgtcatatgctggatactgccatatgatatgctaccagcacaatgggtttacatattgtcttgtgagattagcagcatctgcgtgataaagaaaaggcagaaagcagcaaactgcaggcagaaccgcagaagggaatacgtacagtactgtatacctctggcttttcaggtttctctctgattttgtgcatattttaaactgttcctccaggtgaaagacgcaacaagttttactcccgtacagtagtagtggtacgactagtatttttcccctccccgacaccgatgtgatggctcagggctcataggctcgatggtgagaatgctgtttctttttcctgtaacaaaaaagaggaccaaatcttggcagtggccaaacgaacaaacaccagcatgggcattctctgcatccagatgtggcggccatgtcgccctagacgtctaggctaaacttttcatcatctccatttgaaacacttcacttccatctgagattctgtaatgtttcacttcacttcctatgcatatgcaaaaaaagaaagcaaactttcagcataggcagaagtaaattaaattatagctttaccatttgcatcaatgatagagaattattctcttacttaggcataatgatcaaaaggaaatgacgccgaaaaggtgctgtttttgcaaaacaaaagacgcacatgagcagagagatacgcgagctttcttccatccctgcagaggcgcacacacacaataattacagtacagacatgaaacgcagttgcacccccaacggtacttgattggtcaaagtagggagaaagggaggcatgcccactgacaccaacacaatgggcccatgggcctgcctgccatgtgggccagcaattggggctcagataagccaacccactggctcaatgatcaatggctaccagacagcacactcagaggagcagcaactactagtagtcctggagtatcgactctcttccttatgatgatgtgcttgacccatcagagataagagagaattattgggctctgttttggctttgcttttcttttcttatcatgctcttactaactgggattcaccggaaggttacctcctctcttccaaaataattttacttttcactcatcccacatgtaacaatacaaaataaaaaggattaaagaatacatctattttattaaatcccaatacaactattcagcactttatctactcccaataaaaatattacaatttttcataaacttcgatgcaatgattaccttaaaactaacttattttgggacaaataaaagaaactacaaataaaattattatgggacgaagaaagtagtagaactaagagtttttcttctaccagacaatcgtaggagtaatcagtactcctccccctatcttaagatataattcttccaatctagatgaggatgtgatataatttagtacaatgaatttgaatagaggatattcatttagatttattttactatattgtgtcacattcttactcaggttaaaatattttggacggaaatagtactacctctatcccataatgatagggcttttgactatgccgcttttaataaacatacaaaatttatcctagaacaactttatcatcagtctatatttcatctaattataatcatctctcatttaagttttacactattttcccctcaacccatctcttatttacttttactatctcaaaaactccttaaacctagtatttgagatgcttagggggtgttttgagagaggggctaaagtcccaaacacccccttactactagtagagtagtactactacattttaagagggaggtctccaatgcagctcgtttttgttttctcttttctgcagcagtgaggggaacagatagatggggctccacctccacaccaggagaagggaactaaggaggtggtgactgctgactgacgaaggcctctctttcggctgtgaacctgtgacactgcagagctctgcaggctgcatgcatggattgagacttgcagagcactctttcggatcaccccatggatccacaaaggtttctttcagtctttccctgtgtcctttgactatgtgccacgcattcatactgaaaaattgaacttactactcccatcaatttatcaattactccatccgtcccaaaataaataaaattaaaataaaatacaatattttctagtcggattcattctattagattatattgagacgaagacatgttcacttttaataccattttcaaccatactatctttttaaattaaagttgccaaaaaaaatctacgtttagtttgttgctagatttggtcaataaataataaatcctaccaaacttggtaagatttattttggctataatctaaacatgtccgaagggggtaatgtgtagcgtttgtcgttcttttaaaaggtaagaagtacatgcatggaaaatgcagtatgtttgggagtacaggtaggttacaacaaatctacttctacattctgttggaaatgcagccggtagtactttgtaggagaagtacacggggtacgtagaacgtttgtacttttgtcaccgcatgatgcgagcatgcctgaatgcatcatgaagcccatggcaaccacttactcctactacgaggggaaataacatttctattgccattaatattcctgcaaaacctgatcagcaaatgaataaccaaaacaaactcctcactcactcaactcactcactgatagcacatgttttgtcccccaaggcatgcaagctgggagtgtccgtccagagctcagaacagtgaagacgagctactacctcagctgaaggtcccttctctcccctacatgatgagtcaaagaagtggtcagattgcctggcctgccacagcctgcacagcttatgtaaggcttcccatctgattcacagatgcatggcatatgtgcagtgctgctccctgctggagtagacagctgccttctctctctctttctctctctgtgtcatctctgatgcgtctgcagcagcagcatgcagggacaggacaccccgctgcatgcatgcttcggcagcaggcaggcagtgtgctgcttgtcatgcgtacaggcaggcaggcaggcaggcaagcaggcggatggatggatgggcggagggagggagggacagtggcgtcttctcgtcagcgttccccagctttcgctgcggcgtcggcgttaaatgggagatgccccggtaggtggcggtggtggtggtggcgcggctgcatgcggagatgctgctgcaaaatggcgtcgatttgaccccacccacatgcacatgcgtgctcgcgtgcagcggcgccagagacgacagcgtacgtacgtactgggaggaggatattgtggagtgtagctagcgcggcagtttcaccggcgactgggtgtagacgtgtagctataggaatttgcaagttcacctttgctatttcaggcttggggtctctcgagctgttgtatttgtgttcatgcacccactggagatccaaagtttgcatccaaacttcagtccttttccatcacatcaacctgtcatacacacataatttttcagtcacatcatctccaattttaaccaaaatccaaactttcgctgaactaaacacagccaaaatacaacaatatgcactactgtttgtatttgtgttcatgctcccaccggagaaaatacgacaatatgcactactggatcaggggactcagagcaggagtagctacagaatactatttgggacgctgcaggtaggaaagcatattactgggaaggaaaagttgcaagagtctccaggaaggaaagaaggtaagagtagccttatcggcgaaggattcgatcatgagcaagcatggatggattgaagcagtgactgagcccagtggtggtggagttagtgcagtcagcagcttggggctagggaccaggcatcgtgcagcgggaattgtgtggatgcatagtggagcggggctctctagcttgccggcgacccaggagcagggaacatgcatccacccgatcagcgatcacgctttgattcggcagcgagaatagtctcgatcaccatgggggtttaatccggtggacacgccggccagcttaactatgtagcccaagctacctgcatgcatgcacgcagggaccatgcatgatgcatcatggccaagttggcacggaagtgaacagatgacgactctgctgatgcgatcccaaacacagaagatcctggtggtctccgctccgttcctcgtcctcctcctgcggcatctgcctaaaaagcttaaaaactccggcagcagcgtctttccgacggccgtggcgtggccagccaccgtacgtacactggtacacacgggggtgggggtgacgcagcgacgcgtcgtaccatggggcgacgttgtaggtagcggcaggcggcggcacatgcagcgagctagtagtagcggcgaggagggcggcagtgtgacgaccactggtcgaaggctttttccgtggtacgttgtggcaggcacattcactgcgctctgctgctgctgctgctaccgccccacgggcaaagcggagccctttcactccctgcgcacgcagcgactcacgcaggcacaccgcccctgtagcattcctcgcaaccacagtccacgtctaccgctgctttcggcttggtactgatgagtactactgcaccgaaacattgctcctagctgatgaaacaacaggctttaggctgtaataagccactgtttttagaagcgaaggcctgacgctcgacagtcaggtcttgcttgggcagttgggcttttgcctcgaaagtaatcaaaacttgagtgtactcctcatatcatccacagctcaaatctcttgatatgaagcaaaggtatattagccttgccaagctgcctcctcgtcaaactcttctttctatgcctcctcactttgataggcagataaaaaatgttaatagtggaatgctggtcaatgaagctcttcgggccggtttggtttgaggtctaaattggccttaccaatatttggcaatttcaaagtgtttagtgtctatttggtttgaagccaaattttgacatgcttaagaaaataggccatttcaatagttaacttaggctattttagcttcaatccaaacacaacttttgctttgccaaaattagccatgtcaaaatttaccaaaatttagcatcgacaaaaattagtaagaccaatttaggtcacaaactaaaccagcccttcgttcttcatccaggaagtaaaaaggaggtaaaactatgtcccacagctgtaactgatggctaagagccaaaaaaggagctgtaactgggatggctaagagcaagtttaatagtatagccaactactggctccaattcatctatatccaatctaatagctcattcatacaatagttacatactacactattaatacatggtcccacctatcatacacactgtgtcttggagtccgtgctacagctggctacaaatctatagcccgctgctcttctctctcctcatttatctgtttacagctggcttatagtctgctattattgtagctgctctaagagccaatgggtaaatgacgccgatatagtccaatatgcaaaggctataacgacgatctgtcagacaatttaaactccgccaacaagagacggcatcggaatatgcattgcttttaatgaatttatcatgctcatgtccactggccaggattggaccgtctgctgccacctgccatcaaacacaaggtctcgctcactcgctcccaaaatataaccacctaacactagattaaacatggaaaaatgcatgagcgtccagcataacaatatcctccgtcaagattcatgtcaagattccaaagctactggacataccgaactcttctctacactatgccatcactcaacagatcgaggttcaaagaacccgatcttcaaataacagtacgtatttttgtttccccctcatatacagattacattacagctgcaaaatgaacacttcagattacagacattttgcaacgcagaattaacatatttagtagtcactgttgaagggagagacctgggaggttttcctatgggacaactactacctacaaaatcttaaatggcaagctgtgtgcaacagccatgccaaattaatgtataactactagaacatcattttggctaattatccatatctggatctcaataatataccatttctccaacagtcatcggtggtttcgtccaaaccagccgtattcatttttatgggagccgtgccagtaccttaacatagccatgaactggactctttgtctggttcagtatggtttctttggaaccacatatgaacacccatacagtttggtaacccaacgttgagctgccaatgtaataaaaaggcagctcatcttttcaagatcaatatgtacagttgagatcgggatctaacactgtaatgcaaagagagagagagagagagagagagagagttaaaatgagcactagaataaatcatcatgcagtagacacctaaggatcgaaatatacttggctacatactccctccgtccgaaaatatagcaatcttggatcagatggggctcaacctatgcactatgaatctggacagaagacatgtccaaattcatagtactaggttgagtcaagtccggtcttaggttgctatattctgggacggatagagtatttcataaagtgttaatatcaaaggcaatgttatctcatggacatttgagcacggttttaacttgcggtaggtttcaactttcaagctgtaactgttggtagcttcactgtttcaaaaggagggaaaaatgtccgaaataagacaccatgctaatcggcttcactgtttcacaaggagggaaagatatccgaaataagacaccatgctattagatcagttgcacacaagatacataaaggcaaaattggtacctaggcactgcacttaattgcactgcacacctaataatcatgaattggttgctggactctgcaaatcatcaacatatgattttcttttaggactttccttcccccacacaatgatcaggagggtagcaaagtcaggtgcatcatagtgccagagaaagtgatttccattcgattctacatacaaatcactttagacttgtgcacaggaactaagtatagcagtaacattaacagttattgcctcagaaaatatccatgccagaattgccataacaaaaggagagaatgtaccttggcaaatcagctcactgaagatggttaaattcttaaaagagacttagtccttctgataaaaggagagaactaggtctgtatgtactgagaacaattgcgtgtccacaaagagctgccaacagaaaaagaaaagtccacatacattagtccatggaccagtatacaggccatgaaaagaacatggcattttgggtatcgacatggtctctgaaatacaattttgaccactaatttctactataatctatttgtaaaatccaacaaaattataacggtatgaaagtgatttttgagacatccataatgtgatttttcatgtatacagtttagtatttaaaacgattgatgtgcaaagttttgaaagtttgatatggtgcatgtccaaaaaagacgtactatctctgtcccaaaatagttgtcacaatagagtactgattgtcgaatcaatcacttctcattcaaatttctccctattctactctcaaccacccttccactcttacctatacaccatctaatgaggggcatcatagactttcttctcaaaccttaatatatgctaaacaaccaagaattacaattattttgggatggacatagtattcagtataggaagacttaaaatgctaagtgaagtatcctattcagtgttgtccaagtatattattacaatactttagtagcaaagaaacagaactagactatccgtacatgtataagctgtactatcaaaactcagaaattccattgaacacaagaagaaaagggaagactacagtttataccttcataaagggcctctcacgggtcgggaaagaaccgatgaagctctctcttaaaagcaaggaaacctgtgcaatacagaaaaaaatcattagtaacttgtatgctacacttgtaaacatgctgacagaacattttgtctggtatctgcaccacataacagctagtttatttgtccacaaagaaaggggacacagaataaccagaacaaacactatattaacaacaaaccttgtcattgttggattgcacattagtaatcgtatgagatctcaagttggaacacagcgaatcaaggtaggatctaagcactgccaagaaacctttggcagcttccacctgcaatttgagaaaattgaatatccctcaaggctttgactaaatatgaaagctcatacagttcattaaccagtgaaaaaaatattgaaccaggaaaaaaaaatcagttcggaaaaaaaaatcggacttcaactaacagagaccatgttgcaacagcaaggataagcgtgccatgaaaccagtggagcacatttatggattctataacaattatatcagcaaaagagaaagaaatataagttcaacaatatcaggatgcatcctaagttgggaacagatcacgagatacaagataacatgaagaatcaaacaaattaagaaaatacctgggcatctgtacattcataaacgggcctctttcttgctagaaaactctctcccactagtctggaatggtatggacgcagggcagaaagcaactccttctgctgcgggagttgcgggacagaagtagacttgatctacatttcaagataaaaacatgtatcagcaaatagctggttgcatgactcacatcattcttttaccagtgatagcacggtattatgtgattttctattggaaattttgtaatagatagcagggaacatatagttttcatcacgaggtcccataataaaaagataagactcaaaaaacaagacttgctgatccatttacatgtattcacaattccgcaaataattgaatatccagcaaaagagtaaaattgttggaatgttaatgcaataacaggcacctgattcttgttggcatcaataacccggcgttcactagcctggaatgtacatcggatgtcttgttctgcacaccaacctaaggaagataactgttattaatcctggatcagacagtccacacttaagggtttgtttggcactgcgctatgggctgaaatgccccctcgtttcccatgagcacacttcccaaactg

SEQ ID NO: 39250 - DNA, 1551 bp, Oryza sativa
gtgcttcaagttatacctttgtgcaatagatgagtaaagctttttttggtcctatgccaactttcccaattcattgtgcaacagatgagcaattcctttgttaattgttggcactagcggatgatttgttggccatatgccaacttacccaattcattgtcttggttcatgctgtactgtttggacaggaagctatcatgtgacttgagtaggctatagtcacatgcaatccacgcttttgtgatcatgtatatggagccacattcataaaatcacttaataagatgtttactctttcgtaactgtatattggtattatacatcgtggtatgcttttgctttattgaactatctctagcaatacaccagaaaactccttaaattgtgtgactatttatctcaagctattcatcacttttgaagttttaattccatttgttgcttcatgcatgaactggtcaatgttccttgaagattgtaacttggtcatttgtcagggtgttttagaggctgttcgcatcagtcttgctggctatcctaccagaagaacttacgctgaattgttgaccggtttggcgttctagttcccgagttgatgcttggaaggtatgcaatttatacttcattaagttaattttgagtttgtgcttcacattgtaagttgcaatggcaactttcttcttttctttttacggttttggcgatcttaattacagctgcaaatcattccatttgttgttggtgcagtctatagctgattcatgttccatctgttttggcctaaacagttagtaggtttgttagatctgatataaatgttctccaacaaacaacacttttttgctcaacatcgtggagctgatatctcttgtttgtacagcaacttgtatgtgtgttaccgataatgatattttagccattcatggtgctactttgatccagcattcccctcatcaattagagtaggccaaaccaaccaatggatttttatggcattttatgtaatcccgttattagttaatgggttcagcgctagcctagcagtttgaattaacatacacaattctggagcaactcaaacacacaatatcttttcaaatggttgccaactttttgcctattcgatgctaaattcctacatttactaccctctttcctatcctggaatggcaatctgactataagctttaaattgttaggttttgcgtgaaagtttggagggaatttatcaagggccattgggaaaaaggagctgcttatttgtttgtttttgattgcattaccttatgtgatgttatgtttaactgtgcagttatgatgagagggcattgacaaagggaattcttgaaaagatgaagcttgaaaattttcaagtaatctactcaacagattttatattactgtcattccctaatatttcttgtttatataaagagtaaatttcacaaaactacatgttttatggttcaagttgtagaaaaccacacacattgtgatacttagcacttaagtacatatattttggtagtttagtttcacaaaaccacacta

SEQ ID NO: 39251 - DNA, 3468 bp, Oryza sativa
attctttgtgctattcgatatattatcttttggcgattttcaagccgtactgcaaaactaaaatggaccattgcctgttttagttttttttggtttttctacctcaaacactaccgtattactattacttgttattctttcttcctccacatgctcatgagggatacatgtttctgtgtacttgaaatgatctggtccaattttccttccaagttactctgatctgctccctttgtgtcatctggcaggttttattatcctgtttacagactagttttgtttctagcctgttattttcatgcattgtgaatactcttaggcttagttcatttctatgtatagaggttagctactacctcgttatttgtgagcacgcttcccaaactgctaaacgttgtggtttttgtaaaaactttctatatgcatttcttttataaaatcaaataaacccaattttcaagtttttaagagttaatactcaattaaccatctgctaatggcccgcctcgttttacttgcaagtgaaaagctgtcccaaaccgttcattcgaacatagccttatacttggtttatgttataggctgcaaacgaagcaggtgcactgcgtgaggcgaagaataaacttgagaaaaagttggatgaccttactctgagactaactctagaaaggcgactgcgtgtaagtgttgtctatcattttttacctttgtgttctatttgttaattagtacttaataagatttgctgttgaggggagaccacacatgtatatattttactaatatgcttgttcctaacagtattatgacacttatatctgtcatttggtatttaatgcttccataccattgtcacatcatgagattaacctaaatgtttcagaaactgattctgtgaaaaaaaatttcatgtttaataataatcataataatgtatttcgcctcatggggcatgaactttaaaatgtaggctgctggtgaggaagcaaagtcagtagaaatattaaagcgcgacaaaatgatagaatcattaagtgccgaatgtgctgcagccaagtcagatgctcaaagtgaacatgacaaaaatcggctactccagaggcaattggatgattcgttgagagagataactatgttgcagggtagcaagattatgacagcagaagcagaaaaggagaactccaatctgaaggttcaaaggctttccttgtcattttaatcgcaatgatgcttggttaactacattttcagttattctctgctgttttttttacacctttaattgcatctctcttatttaatgatttttccattgtctaattgctgtacttctaatgtgataaagttaccacaatcatttttttatttagttttaccattagttttcattgctgctgtaatttgctgttagcaatatgcttctgtgtttctcttaattgtactttggctgaaattattctatattactctgtacagaacttagttgagtcattatcaaagaggaattcgtcactggaatatgaactcacctcagctcgtaaaggtagtgatgatacgatgaagaaattgaaagatgttgagggaaaatgcaaccatctccagcaaaatttggacaagtatgttttccctttcatttattaaaccatagagtgctagaaaaatatgtatagtattctaaggtttattgctgctcgtttgtattgggatgcaaagcatctaacagctactggtttgctaattttagattgcaggagaaacttacaaacttggaaaatgaaaatcatgttcttaggcaaaaggcattaaacatgtctccgttgaacaatatgtccatggctacaaaggcttttcctcaggttcttttctttgctctttattaattgcttcagctatctgtttgttgctgttaatatttgatctagcatttaagttcttttattgatactcatatttgggacactgggtactgctctagtttgcatctcttcttaaatagtttactgacatgctgcttgaatgcagaaattcgctacaccgattgggcttccaaacggcgagcagaagcacggatatgtaagcctattcttttgatcgacgtacagaactgctatagattcgtctgacatattggatctcaatttttgaattgtaggaaacaccaccagcagcaaaatatctcgcttcacttccacagagtttaactggatcaaggagaaccaggatgcctgttgaaaggcaggaggtaaattccacatcatatttttcatttgttaatttttgcttgttctagctctgttgataccaccttagataagatggcaaataatttgttctggacgatgtgacattattcaacaaaatttcttatgcatcttggtgatgattttgtgtcatgcaggaaaatcatgaaatcttattacgatgcataaaggaaaatctaggattcaaggatggtaaaccagtcgccgcatgcatcatctacagttgccttttacactggcgtgcttttgaatctgagaggactgctatttttgatcatgtcattgaagccataaataatgttctcaaggtaaacttacttcagactcatctattttgctgtttgtgctaaatgtttatttgcggatgtcaaataatcatggaagttctcctgttcttactccagggggaagaggctgacggtagattaccttattggttgtccaatacctctgcattgctatgccttctgcagaagaatttacggtcaaatggattatttgctacaccatccggccggtctggtggacctctagggataggtgacaagatagtgcaagtaaggaaccctgaaaattatggatcattttcttaccagtactattgaattatgctcagtgtgctgatatccatatgaagtaatattttgaaagcaatgtcctagtttaactctacattattttatcatgtctgtatattttttggacatgacctggctattgacccagtcaacaactcaacgtattgggtcactggttgaagctgttggtcactgatggggcccctggtttcattttagcggcaaaaacaatagcatgacggtgcttagtaaggtcttaaatagcttattcggttcaactggaataagtagtagctaccttagttggttaccaggcagatgcagcacacatttttggaatctttaagctggtggagctagccagcagttgtattagtctatgccgtcagttacgccaaaactacctggttttaacataggtctttggatttgccacttcaaagtggccatcaatcagatttggtctggttggactgtcatggtgaaagtgctggttctcctcctccctcctttctgacaggccactctgctgttctggggcagatctggtaaatcatgtgtacctgtagaggatctatacgcttcccataatgggggaaatggaaacatcatggcatcatgctcttcaa

SEQ ID NO: 39252 - DNA, 17324 bp, Oryza sativa
ttattattattttttttttgctgcaggtgccatcattctttatacgtaaacttatcactcagctattctcttttataaatatacagctttttaacaggtaatttcctcaatttttaaatttatccttgttacatttacatacaagcaaacaaaacagtttgcacatggtaaccaatcgatgttattgaatgggtagttattccttggatgatataattatgtcttcattagttttgcaaatagcgtgatcattgcaccttttatttatgatataagcaaagggcctttttgacagtgaactgatggaattctgttggttaaaagttataataggagatggtggtagaattactttgggaaaaatcggagatggtggtagaattactttgggaaaaatcattactgtattatgtttgagataaagttataggtaaaaataaaatgatgaaatcatatggtttgtaatgatattaacagtcctgttcccattgttccatcagccttcttcttcggcgcgaatgctgtactttctccaatggggaatatgtcaaagccgggctgtcattgctggagaaatggatttctgatgccacggatgaggtaggtgtttgcattctgcttgtgaagttgttttgcactctgagaatggactatgagaaggcctgataaaattgttagcttatcccactatatttgttcccagtttgcttatataccttgtgttttaggaacttaggagcaagcaacattattatacattttatcggtgctctgactttttcacattgctttactagtttattatccttgtactttcagtttgcaggaacatcttggcatgagctaaattatatcagacaagctgttggttttttggtaatttcttgtgcatgctgcatttgtttccatgtttctgtgcttcttttgtatgcctgccgaacatctcactaattgcataacacaggtcatacatcaaaaaaggaagaagacgcttgaggagattaggcaagatctttgcccggtaagacttgctgcatgtatgacctccgatttgtgcatatccattatttatgccatacctcaactagttattttctgctcttgttctttgtagaacttgagtgtacgccaaatatacaggatatgctcaatgtactgggacgacaaatacaatacccaaggaatatcgaatgaggtaatcacttttggattggaggctttccattttttggggattcactatgcttttttgttctgagaatttcgggatctggcaggttgtttctgcaatgagggaggaagtaaacaaatatactcagaatctcgtatcaaattcctttttattagatgatgatttaaggtatgcgtgatttcttggttaaaattttagacagcagaatcagcctttttgtgtatgtaaatcactactatccttattgcagaacatgatttactatctgttaatttgcccttgtatgtgatgctttctttcagtataccgttctctacagaggatttgtcaatggccatccctgctatagattatgcagatgtagaatttccagaatcgcttcagcactatccatcagtacagctcctagtcaagcatcatgatccacagcctgtctaatagtatggttggggttgccttgaagattcgtttatttttgttcccagttttagtggggtttcatcttttgaactgttgtatggttgttaggcttgtagtcttaagtttatccggggtgaaaaggttgtaacagaaatggtaggatgtcgtttcaaagcaacaattgttgctcggtgaaaattaaacaatcgtggaccctggttgtccaccagtcctatcttcagatgtacatagtgttgtagagacagttaagcatttgctatgaaaaatatccatgttctgtagcgttagttttctactcgtgatctgatgtttggtgcaatgtttggcaaaaacataactacctttgggctcgtcaaaacaaaaggagaataggaaaaaaaacgcaattagtatacctctgccattacccgattagtggtacctgcatcttaaaatttaagcttttctggctatggagtagtcaacactaacatattaggattatttgataactgttataacggttataaaaagacttgcaatgggttttaaggagcgagtgcgctgatgtatctgtggcaaaatctgtcgtaggtaatgtgaaatgtacgtgaaagtgttgggaaataacgggaattgtttgtattcagaaatatccagggaagacaatcccttaaattgtgcgtttttttctgactaatgtagaaatgttcatcgatggacatgtagtattatgcgggaaaactgatatgcatacgactcaattgtttaactcacgtacaactgaatttgatcagcggttgtaaacagttacagtgtatatgaacatgctctccttatataattgcatatctctagttatatatgagtagtggtgaaatcgggtcgggttcggtcggatctcactcttcccatatccgaacccacattttataatcggaatcgggttggatacggatagtatcgaatacggatacaagcacggataatatcgggcacaaatatgagacgaatacgtaccaagacggatacgaccactatcggttacgaatatcttttcggatatcaagtcaaagcaacgatcatctatactatatagataatagctatatattcaaccaaccccatataaccataatgcgactatattattagggcttaagatgtacgggcaatacgacaatgaacaattgatttttaactggaaaaattgaaagtttggttgaaattggaacgatgtgatggaaaatttgaaagtttgtgtgtagccgtgtaagaaagttttgatgtgatggaaaaattgaaagtttgaagaaaaaatttggaactaaactcggcctgacatgtgatgagctgctaacttcctgttcctgaagagatgaggatcggctctggcagcaaaggcatgtagcggcggtggccgcggctcagcggacgcagcaggtggcgcaccggtggcgctcgtagtctcggcatcattgctcaatgggattagtgaacagtaattagtatttttggttattgggttgttaggcatggtttactggttgatggtggtcattgtactagtgggccttttggccactagtgctttattgggctagacatgttatctaggtattatccggatatttaaccgggtaaaacccatatttttgctggataactcgtatccgtcggataccgtcctcccaaacccgatctcatatccgatagaaaatacccgtattcaaacccgctacccgtaaaaacttccgggtacccgaatttttgacccgaaattgtctcgaaataatacggtcaggcgggcaggcgggaaatacccgccccgttttcacccctatatatgagttgtataactggatcgtacttatagcagtagaactgaagtttagttcttttcaattgaatggctgcttttgactgaaccctcttttcatttttcacatttattattttccgggattcagcggtacaagctgaaaacaaagggaaaaaaagaacaccattttcctcaagaaaacaaaaggcaatattacattttttgctcttgggatcgaaaatagcatcaccaagaaaaagaatcaacgaacatgttactgcacctcctgcactttgcatccaccgtagaaatatgttaccactattatgtacacttgaaacgatctcgaacaatacacgctcacacgcgcgcacacacgcagtaacaggcaaattcacgccctgccgcggtcgcactttgcatccaccgttgaaatcttgagctagccgcccctgtccctgctctgcctcggcgagccggacacggagctcgcgtaccggtgctcccccttccgcatcgcgccctccgcgtgcaccgccgacgccacgtacctcctcttcgccttggccgccgccgccacctcctcctcgccgtcctcacccgcggccgcggccgccttcttcccgtcgtccttggcagcaacaacaacggcggcagcggacgggacggtgtagacgaagggcccggcgagcacgtcgccgcaggacgtctgcagcagcggctcgagcgcggcgacgacgtcgcgcatgtgcgggcgggacttgggcacgctgtggaggcagtggtacgccaccatggcggccttccccgccgccttgtccgagtagccgccctccaggctggggtccatcacccggtgcagccgctccggccgccggaggtacggccgcgcccagtccacgaggttctgctcccgcccgcgccgccgcttgtccacgctccgccgccccgtcagcagctccagcagcaccaccccgaagctgtacacgtcgctcttcgccgtcaggtgccccgtcaggatgtactccggcgccgcgtacccgtgggtccccatgacgcgggtcgtgacgtgtgtcgcgtccccctgcgggccctccttggccagcccgaagtccgagagcttcgccgtgtaatcctgcatcgcccaacataatataaatctctccgtcagccacaacatcataattaactatagctaagagcaagtttaatagtatagccaactactaactttaaatcatttataactaatctaatagtctattcatacaatagttaactataaaaatatactcacaattaataaccggtcccacctctcatacacacataatattttggagtatgtgttgcagctgtttttctctctcttctcttttcttctcgatatgtgattatagctggcttatagcatgcgtaactgctctaatgtagcattgttgatttgaacttttgtttgtatatggtgtcagcttagtctatgtttctgtgtaacataaactgtaccagactcgataatgttcacgtgtgattttgctactacaagacgatttcgtgtcaaaattcgatgctacctgccatgggccggcatgtgtgttttactcgtagaatgttctctttactgtttaggtgggtaattaactagtcaaagagagtggttagctttgcaattaattgctcggacaaacgcttgacctgtacaattttactgttctagaggctttgtagccacagtgctcatgaacagcctttgcaacaaccaattgtgtaatctggccggcgatcgatcgacaccaaaccgtacgtttccctaatttacatatctgcttagaataacacggacgtttttgtccgattaggtaggaggcataaataaacaaccaacccggaggagagtagtcctacataatttgttcatttctttaagttttggatgcactagtacttaattaattctccatttcttaagttggccgccacaactaataaagtttgccacaaagaatcgacagagattggccaaaaactatagttcaaatcgtgtactctctactctatatacgtgcgtgctgcccctgcagctaaggtatagcttatggccttattagattcagaaaattcagaattgactagtggcgatctggcgattaggcgaacgggtcgtagtcaccaacgcagattaagaaatcttaattattggagccgatcgtacgtacgtgtgcaagatagacctggtaaaactaattaagcataattaataatcagaggagtactcaccgagtcgagcaggatgttggatgccttgaagtctcggtagatcaccggagtgtcggcgtcgtgcaggaacgcgagccccttggccgcgcccaccgcgatcttcagccgcgtcgcccacggcaagctcgacagcaaatctgcaagattaatcaattaaccgcgctcagttaatgatagcaattactggttaataatgatagtgcaattgattagtgagggtgattaagcttactcttgaagaggtggtgctcgaggctgcccctggccatgtactcgtagacgagcatccggtggtcgtcttggcagcagtagccgatgagcttcaccagatgcggatggctcaacatccccaggtacaccacctccgcctgtgcgtgacaaaaccacgcaattaattagctacgaactcgactaattatcgtcaaagagtaccacggaattactctgtacgtaccagccattcgcggtggccctggtcgccttcgccgtcgaggtacttgacggcgacgtgctggggttggaggaggccggggcggagcttggcgtcgatgaagcccttgtagacggggccgaatccgccctcgccgatgaagttgctgccggagaagctgcgcgtggcggccttgagctccgccagcgtgaaggcctgcagcccggactgcgccagcgtccgcgacaggtcctccagcgacagcgaccggagccgccccgtcgcgctccgcatccgcctcaccgccttcttgttcttcaccaccgccgccgccgacgccttcttctcctcgtcacctcccgtctcgtcgccaccgccgccgaagaagcaacgcaacatcctcctcatctctggcaccgcgccgccgcgcgcgagtgcaacaacaacgacaacaacaacgacgagagaagaagtcttttcgcgggagagagtgcgggtgaggtgaggagggaggacttggtggtggaatggatggtttgacacggagtggggtatataaagaggaggcgggagggagggaggcgtgtggggggttggttgggttgggttgggtttgttcgttgggttggctctcggagtctcgtgcgcgctcgcggagtcgcgcgtatgaaacggccggattgacctgatcacctaggcgatgcccacacgccggccggacggctgggttaacttggtggtttccgcggggggtgatgtgatgctgagctctatagcctctatgtccccctatgaggccgaggccgtccaggtagcttgacataatggattgtttctctcctgttttttttgtctatattttataatagacaaacattatataattagaattatataattagagcttggctgtatcggtgaattgaaaataaaacccgagctaggttagacaaatataataggtgattggctcggtagatggactaaagataaaatactagatctactatggttccgcacacgtgaagagggctactacatatagtggaaaggagatggaagaaaaacgattgcacttttaatgtagcagagaaaattacactttaattccgatgaatattgtggaggagctataaaagtttcagagccaagacaaaactaaccagtacattgagtattttcttaaaaaaatatatatgcctaatttatgcaaaagaaaaatgtgttcaccaacgagcccagctcgtcacccaaaagttgttgagaggtggcttcgctattggatgaattaatataatagtaatgattctagattaatcctttcacgatcctcgaggtggtataattgagtgccacagtaacactaaatgtgtactccctccgtcccaaaaaaaaaggcaaaccctgggtttccgtgtccaactttgactgtccgtcttatatgaatttttttataattcgtatttttattgttgttagatgataaaacatgattaatattttatgcgtgacctgtctttttaatttttttttcataatttttttaaataagacgggcagtcaaacgttgggcacggaaaacagtgtttgtctttttttttacggagggagtactatattttcaaaacttatttaaggatcttaagtattctcttttcatagtaacgttacttcgtacatacgttacatgcgtataagaaattaattaatattttaatgcagcattcttggataactatgacaatatttgtgctggaccacactgatgttgtttaaactaagaagttgtaataagcgttggaatttcacacatttgaaaaatataaagtagtcaatctctagcatttgatggatgtaaaatggtttaaagatgatgtgactgggaggggctatgtatgttgcttgtggaaagaattaaagcatggatatggtcggcttgttgcttactacctccgtcctaaaatataactatttctagcacagtactttatcccaaaatgaagctatttttctacctacctttttctctcaaccaatcacaaccattctttttcacctactttctctttttaaccaatcacacaccttcttcaatcattctcacctactttcttaatacccgtgccaatctaaaaaatatttatattttgggatggaggaagtatgttttgcatccgagtcatggtaagacagagacatcttaccttcccttcaagtttctattagaagatcacttcatttatgttgttttctactagatggtttattttatttttaaaggggaaagcgaccatgcaaaaactaatgatgtgtttatggatcttatcatctggacttgtagagtttaaacagacctaatgatcagggtgtagaacatctgatttgaatatctatctatctatctatttcatctgtagctaactgaagccaaaaacaattcgactagggcttatgatcaaccgattgatgttgaaggattatagcaatgaacgtaacgacaatagaagtagagaactgccttatttttacctacatcaagctcgtcagttcaccctaaaacatatggatgcacaatatatagtctatctcatattataagtcgttttaattttttttatagtcaaacttttttaagtttgatcaagtttataaaaaaattagcaacatataaaacattaaattagtttcattaaatctaatatttaatataatttgataatatttttgatttgtgtttaaaatggttctatatttttccctacattttgataaaattttaaaaaaattgactggaaaaaatcaaaatgacttatgatagggggagcgcagttaattggacatctagaaagaaagcctcaaaatagagaacatggataactagctatggcgatagctaattaattaatcaaatgcttttatgctaaagataaacacgactaaactttagtaaaaaaatgcaggatcaatatcgatgttgaaatacaaatgtaggggggagttactccttaactagtggaagagcagcattctatatatattatgcatttggtgaaatagtgtcaagtgcatgggtttgcttcgaactaaactatttggtgctcgtgctcaccatgcgatcaggtagaagaatctcatgcacatgcacacatagttccaatcaaaggaacggggaatccaggaaggctggaggaaagcaaggcgctgatacgaggaacagtaaaataatcagccaaccaaaccaacccttgcactgtactagactgttcatctatctgttgttagatttgcctatggctggacgattggcctagagtaagtttaatagtatagcccactactagctccaatttatctataactaatttaatagttaattcatacaataattgcttactatactattaatatatggtctcactgtcatacacacagtgtgtactggagtccgcgctgcagctgactacagatctatagcccgctgctcttctctcttattttttatctcattaaaatatatttacagctggctaatagactgttattgtacctgcccaaagaaaatatgtttagatcaacagatagatggacacctgtaagaccatatcataatacttctggtgagaatacatgatggagaccaggatgaatgattagccgtatctgcactcgatttgtacgatgtgtaatctctcaacgattgaggtgcacatgtgtgtgtggatgggtgtttgtcgaggaatcttggaatggttgatgaaataatggccattgattggctctcgtttctcctgagtcaagtagataatcactttgtttacaggcgttgttcactcttcgccatcagcataaccttttaggttgaacgaattatttcgccatcagcataatcttccgtaaaattcttgctttttgaacgggaaaagagcctgtctattcgtgatgcggaaacaagtggatggtgttaaagtgaaaagaatgaattatttgtagtcctacagataacgagatcataggtgaaaagatagcgtgaaagccatcctgtcttcctgattttgtaaaaaactctcactctgtgtccctataagaacagagcataaagatggctactcatactgatttttcaacctcgattttcagtgatatatgtacgattggttgatgaactaactgcacgattcaccgtcacaattactcagtacattcgcattcttatccactaattaatccatcccatttttcaaaataaaaaatatcagccttgaatatatcttgacttcaatcatcgttcgctcatagtataattcaatcccagctctcaggaaaaacctgtgcagtattttttttctcataaccggaaattactactgctgctgtactatgtacttgcatcagcactaaaccattttaattttaattcgccactaattgtaaattcgggcgtgtgccctcgcggacacggtgtctggtttgatttaattttcttccaaccaaactgggccatgagacgctccccgacaaaattggaggattattacagagattctttgcagaaaaaacacaaatctttgtggattaataactaactaataatgcaaacacgttctccaaccaaccctgctcgagatgagtacgagatgaaacatggttttggatttttggagctgtaccatgtttctagaaatggagcggctagctaagacattgaccatttctgcttaacctaactactccctccgggttgataatacttatcatttcggaaaagggtgaggtcaaactttagaatctttgattatcaatcattttcaaaatatttctctttcaaatatggtgactatatgtatagattggtcttaaaaaaatactttaataagatcatatatttgttaacacttttatatatattataatagaaaataatggttaaagttgtttttttgacaccgtgccattgtccaaaacgataaatattatcaacctggagggagtacccgtatgagctagccatgattaggggaccagcactgtactactgttgcattagcacttagccgcagctacttatctgtgagatgatacttcagtactttgtttgtttcttaaaaaatggatttgggttgtcatgtagtatgagttggtaggattagtcttaaatggtattcagtagttggggatgagaaaaaacaatatcactcgacgcggaacagttcatcaagttgtaagtaaaataaaattacgattggcaattttgtaagtatatacttgtgggcaaatgtatcttgttaggtcaatggctgctttgcaaggatttccttgagctgcacaatacaagcactgatcatttgagaggatatcatatcatgtcacaagattgtaagacctcccttgtgggcctgtggcagtgtcgtaattctgacggtttatacgggttgtttaagtatagtcatgttttgaaatataaatatttctaggttttgtaattatagattatgtacatgttttaaatgtaaactttgtaaatttgtagaaaattaaaatttgagatgaaacagagattgtctggctagaatagtacaacatactccctccatcctaaattatagggtgctatcctttaagaaactaggtgataccccgcgttttgctgcgggacttatgtataagtatattttaaatattgttaaaatgataaaagttgaaatgttgagaaaataatatgaaaaagatgatttgacacatacttgttgatctctataatataatattgtagatgatgtatcatgtttgcatgaaatttaaaatatactataatagtaattgctagtgagtgaaaatatgacatgtttgcatgggattttaaatgggctagaaaagtaattgctagtgggtgatgatgtggcatgcttgcatgttgagctttagcttctaataattgttagtgggtaccaactatatagaaaatatagatattaaactcggtatttttttctattaattatattaactatatgtatatatgctaggtatatcactagatttatattttaaaataatttaatacgatgctaattttatattcattagcaatataatatgaaataaattaatgatctatcctatgcacacagaccctcacgtgtacacacgtgcacaccaactaaaaaatatcaccaaaaaatctaaaaaaaatcatacacatactttcaattgtattacatttagggttaaaatcttaacgtcaaattcattatgttttagccgtaacaaaaaaaaaacaaaaaatctgacagttttaaggttgtaattttgtcagaattttatcttttttgttattctctatgtagaatgaatttgaagatgcgattttgcacgtagatgtaatactattgaaagtacatgtatgaatttttctagaattttttgtgataatttttagttggtgtacacggtgtgtacacgcgagggcctgtgtgcataggatacgctcccctatatcttggaagatcgttcttataatttggaaggaatggatagagtaccgtacaagcagccttccaatggaagcgtagaagcaggattttagtactgtagtgcacatacatttcaacctccaccgtgtgcagatgtcaaagggctaaacgtttgacgagagctcccaacattcagaaaccggacagcttcctcccttgaagaattcagtcatgtgctcaatttgacctgtctcagtactcctacggagcactagtgcccacacggctctacagcctttggactcttcctcctcctccgtccagacaagggagagcttctgcttctacgcgttcgtgacgctggatgtttctgcatacgagagaagagaaaaaaaatgagagctctgcatggtttggtttctgtcattctgtgggcaaatgcaggccatgacggctgtaatctgtagaagtattgaatttgaccgagacctgcagtagttagttccggccgatttggtcaaattctaattttcgtctcaaagtgctgctttgcggctggcacctggctagcgagcagtatggtcctttcttcaggttcaggttttgatttttttgaaattttccccaacttgaaaatgcaaaggtttctggactttaaaagcggtatgattgtcatttgtcaacgtttgaattctctagagacctctttcgttagcggctgcggcaggtggtttaaacagagtttttgagtttcacatgcctttttaagttgctattgtttcgtatcctgaaacacttggtgagttctagctgtttcggaaattaggcaccaaaatctgctgttaggtccagtgaagattcgcctttttttatcgattgtgtgccggcttttcttctctgtgtccagttccaaattgatagcatatccaaatctcaactttgcaacgcacttttcagagagaaaaattctccggttgaccaaataggcttcgaattagtaatgttcagtccaaagttcaaatccttgccctattggtgttgctcatctccaaccaaacaagaggttttaatttacagcccacaggtataatacataggtaaccaagttgggtttcattgtttcacacgtcttctacctggtcaatgcaaagaactgttctttctcctggtttcaaaactctccaagtacgccacctaggcttattaagtatgtgacattatactttaaccattaatattatttataatatatatataaacgactacaaaattagtatcatataaaaatattttaaatacgaacataatggtgctgacattaaacacatgtattttttttactttaattattaaccaaaattcctgatatcttatattttagaatgtacagacactcataacgcacgcacactcacttctatgaacataacacacgcacgcacataaaccctatctctataagcatcttctcaacgtcgttactaccgaggctcttctaaactaggctacatgtactttcgctctaaactttaattttattctcgtttaatttcgtggcctttgcatgcatggagagctaggattgggaagctggcaacaaggagaatcagtatgcagcttcaatctgacgatttctctggacgtgtcatgtttaacaacggaagcaaaagcaaacgcttgctgatgacgtgccacgcgttgtgtggctttcagagcgtttaaagacggtttttctctgtgctctgaatatacgtacatgtgtagtacgagagatcggaggagaaagcgaaaacgacggcagctagttgtagcagtagccagtagcaagcgtacgtacgcgaaagcgaaatgacaactaaattaacctcgaatccgtgctgctcaagatgcccggagagcttcaacgcttttcgttttttttcttttgtttaattttatcacgcttaagaagataactgaaactaaaacgtgtttgcctcttcataaacatatatcatcgattaatctgcttttccgagttgtttcacgcgacgacttacgcacttacatgagagtgcaaaacttatcaaataaataaactaatatatatttttattttctgtaaagttgcactctttttgtttcctctgttgcttataagccgtgcaaaaataacgaagtaactaaaaatagcctatgcgtgaaacctttatctatgcgcatttagcaatttaaaagctaatataaaaaaaccacaataaaaacccttaaaaataagtttcaaatttaaattttggctatggcaaataagccaaaagataaacgatgtaagactttggcattgggatttctgaactcctgaaactgtacttatcgtctgtcctttctttctgaagctacacagaaattcagttcattgcggcccagatgtaaacacgtcccttttctcagtcactgtggcagcctagtcatcacgtgaagaacactatcgagctagttgcactgatcgtatctcaactcaattggtcgtgatcagataagattggcaccacacgatcaatcaattctgcgacggccaaattgcagccaagccgttgattggtttaatttcagatgttagcgtgtcaccggcctcttcgccattgatggcagcaagaacgcaagaacctggagatcgaccggtctgacgacgacgaagacgacgcacacgcgcgtagtaatcctcaaggcaagcagaggatctagctaataagtttcttgcttaattaatccatggaggggcataagaaaaatgatcaaaaatgtcagcaacaatgataacaaaaagacgggtttagctcacataattaagagatgataatgacatggcataaacaacaaagggtcgggctaactcatgtcgaaaacgaaagtaaacgggaagcacgtgaaaagcaggaagacgatgcacaactaaaccttacaaaatttctttcagtaatcgcttagcattagtcaacagcaacataagaacattcttatcaatgtctgtccctatgttaattaatctgccgagtaaaccggatagtttcacactatggagactggagataatacttttttgcaggccgcgtagttgaaattaagagggcagggctagtccatcaacgagtgattgattgcatgacatcagtgtatattcagcgccgcggtcagagacttcagggttaaactaatggcgtttttgtttagcctgacgaaactatgtagtagtagaagctgaaacacgctttaaattgcacgaagtcaggatacgtacctactagttaacctgaactgcatatctgaagttctgaaacgtgctgacaatttgtgtatgatcgttcaatccattcacattgctaaaagtccgtggattagcactgtaaaggaaagttcatgcgttcgtccaggaattgaactcttttctgtcaaatgtcagcattccagatgaacatgaaaatctagcgtttttgaaagccctgcaacaaatggtgtgtttagttcctgaaaaaaaattggaagtttgaagaaagttgggagtttaaaaaaaagttggaagtttatgtgtgtaggaaagtttttgatgtgatatgatgtgatggaaaatttttgatgctttttggtttttgaaaaaaaacatcgacagcaattgggtcggagttttattctccgactcgcatcatctccgatcggtatttttttattttctccgatgggcttgcagaaaatccatatagatgcagaaactagcactgcaagtctgcaggagaaaaagttcatgcgtttccctatgaatatttgagcatgttttctgtcaaacgtcagcattccagatagatgagtctgaaaatctagcgtatatttctgaaatccctggaagaaaacatcgagggcaaagggggcagtttgttttttcaatttccgatagcctgaacacgttggtcagtattatcgggatcggagttttaatctccgaccctccttgagtcagtatttttccttttttggagccctcaaaaacaagacgaacagattgaaactccgaaccccttcggtcgatatttcctacgagacgagacaagacatgcaatccggcccattaatttgtgtccaaatcgtcattcataaacagtccatattacagccggcagaaaacgttacaaacacaagaacattcttatcagcgtccatatgttaatcaatccgtagaactcactcactcaggtatgctggacagtttcgcactacagatagacttttgcaggctgttgtgtcgaaattaagaggcggttctagacttctatacttagctgctgacgttagtcctccaacgagtggtatgagaaaattgacatcagtattccgtgggcagaaacttaaaggttaatctaagacgttctgttagcctgacgaaactgtaatagaagctgaaacacgcgctcttcaggaaaacctatcaatcaaaggacgtgactatcaaccgtgctgacatgctgtgtaactgtgtatgatcgctaactccgttcatattgctgaaacgtgtctaattgttttgagccttttggggtcaaagatgtgacgtaaccgtggagagttttgccgatgagcagtgtgctcaagaaacgcagcagcaatcttgtgtttatgtgttcctccaggagtattttatatttgctcagtttctgtaaaacgtcagcattttaaatgaacctg

SEQ ID NO: 39253 - DNA, 1814 bp, Oryza sativa
gggggggttgtgtgggtgttaattctccaagagtaaattgcatcggcgatacacgaacttgtcagttatgtaaaatctagtgtatgaacttgcaaaatgctcattttggtgcatgaactaattatcttgtgcgtgcaaaataaagtcaaaaggacattacatgactaattttgttgatttatgtgctgattaggatactacgtaaacatatatacgagaatgttgctacttggacatacacctgttcaataaaaagatagaatgagatatagtgattgtagagaaatatataaaaaaccaagcaatgatataagggttagaaacatacgaaattcaagataaagtagaaaacaaatttataaatatagcatgtttttatgcgtaattactatacgtattcacgctacatcctaatcaatatcagctaggtggaattaaccttgccaagccattttggacctagtttgcacggattagataagttcgtgtaccaaaacgaatattttacaaattcatgtactaaattgcacccacctaacaagtttatgtatcaccaatacaatttactcattctccaacctcctttagactttttttcttttttttaaaaaaaaaggcaaaaggggcatatgcagcaaatcaaggccaaccctgccaccatgtcaatgtcatgggtcggtgtagccttgtcaaaaaggtaaaaaaatcgaggtataggggttcggagtttttatctctgaaccctcgagtcggtatttttcctttttaagtcccaaaataggtcagtaaatgttttgtttttactcgcggaagcagtatacttggtttttatataggcctgtaattttttttatggaggcctgtgaaaaattgaaagtgtaggtggtaggagttttcatctctgaccctccttatttggtgtttttttggtctaaggccgagtttagtttctaactttttcttcaaattttcaactgtttcatcacatcaaaatttttgtacatacataaactttcaacttttttcttcaaacttttaattttagttaaacttctatttttggcgtggaactaaacacagcctaaattgtccttccaaatacattggcttctgctgcgcaacaattcagcccacttttgcggaacggcccaagatggcacctgcagtaggtgcactggcccgtagccaagttttcccagcccagccatgactcccttgagggatttagggggttcggagtttcagtctctgaaccttattgagtaaatatttttccctttttggagcccaaaataggtcagtatatgagttgttttactcacaaaaacaatattagctttctttggcctgattttttttcctgatggagaggcctgtaaaaattgaaggggattgtcggagtttcaatttccgacccttttatcagtggaaaaagtacaccggaggtccctcaacttgtcaccgagttacaaaatcgtcccccaaccgcaaaaccagatatccggcgtccctcaacttccaaaaccgttcggtccttcggtgtttttggctccggttttagcctacgtggcgactgagtcagcgtgggccctacatgtcagtgtgtccacgtcatcactccctctttttcccatctctcatcctctcttatcccgtactactcagttactcttttgggcaggccgaacccgccggcgcaaggtggggagagggagggcggccggcggtggccgacgctggtgcggcgacgacggcggcggcggcggccgatgctggggcggtggcgactggcggtggccgacacgggagaagcc

SEQ ID NO: 39254 - DNA, 3727 bp, Oryza sativa
  unsure (1)..(3727): unsure at all n locations
gccccggcgacctcctcacgacccactggccggcctggtagaggagaaaagcgagagacagagagaaagaggaggaagtgaaaggagggaaggagagagagggtggtacgtggcatactgacaggtggggcccgcgtgggtcccgcactgactcagccgccacgtatttcaaaaccggaatcaaaaccaccgaaggacctaaagtaaacggttttggaagttgagggactccggatatctggttttgcggtttggggacgattttgtaactcgatgacaagttgagggacctccggtgtactttttcctatatcagttatactatatgtttgggcccaaatcgtccttccgaaacggcccataatacagcggcttctgctgcgcaacaaggaaaaagtacaccgaaggtccctcaacttttcatcaggttacaagaacgtcctcgaaccgcaaaaacagatatacggggtcccttaactatacaaaaccggtcacaataggtccctcggtggttttggtcccggttttatcctacgtgactgttgagtcagcgtgagacccacgtgggacccacatgtcagcctgtccaggtcagcttctctttctttcccctcttctctcccttcctcttccagtcttccctctctctcactcttctctctagggctctgggcaggccggcggaccgacgaggcgaggcgggagaggaggtccggcggccggtggcggcggcggagacgacgcgggagcaggggagcaagtcggcgacggcggcgagatgcccatggcgaggtactggaggcggagctccgtcgggacggggagcgggacgatggcggcggacggcgggcacggatcgcgtcgcccgcccgtggcgacgccagcgccggcatcgcccgcccgcacgcgatctcccccaccgccgatctaatgatcagcactatgcactacatggcaaccattggtggtagtgtggtactagtcgtggctaactaactggaggatttcctcatcattcctgtaagtaaacagcagcagtcaattcacaacaatggcatctcaccgtcaccttgaacacataacaggtgctgaagggtttggtagtgacgatggggtcatgcagtgttgttgccactgcccactggtgaaggctttcaccatcgattgctgcggcatttgcttcaagagattcctcaacgtccatagaatcgacttctgtctcatcagactccattggcacttcaaagaattctctcttttctgaatctgaagaagaccaattagatgccgtggcaatttgtggtggcgtccaaggaactaaagccaagaagttgctgcacccaggagatttgtcctccagcccgtgatagttcctttgcataaaaacctgatctgaaagatgagaaagaaaatggtgagaagcaatttcaaggtatggatgataatcctgtcctgacatacaggagatcttggtgggactcgatgaggaggagggccgagggcaccagcacgcattgcggcgagccgcatggcgccgggcggtaggaggcggaggcggtcaggttgaacggcgacgaggcggcgcgtctggccgctgacaggggagaagcgcaatggtggcgctctgcccctcgctgtcacctccccggtcccatctttggccgccgtggagccccactgcggccgccaccgccgccgccgtcgccggccatcgtcacggcgccgccctcctcctcttccgccttgccccaccgagctccgggccggccgccacccttcatcgccagagtcacgaccaccatcgcctcgccagttcgccgcgccgagcaacaggaagagaggcaagaaaagaggggaacagagaagatgacgtgtcatactgacatttggggcccacgtgggtcccacgctgactcagcagccacgtaggataaaaccgggattaaagccatcgagggacctattgtgaccgattttgtatagttaagggacctcgtatattggttttgcgatttgaggatgtttttttatcccgatgacaaattgaggtaccttcggtgcactttttccgcgcaacaatggggaccattaccgcggaccggcccaagttggcccaagtgcactagcccagccacgagtcaatcggtgtcactgaacagcgggccccaggagaacggcgcgttctgggccccaccctgcagcgactccggctcgctcgagcgagacagcagccaaaccctccactcctcgcttctccggtggttctcttctcttctcttatcccccggagacgccgctgcggcgccaccccctcctcgccgtggacctcggggtgggagcgtggcggcctgcacagccggagctcagctcgcccgccgcgtcggatggacgccgcctcctgctgccgcgtaagcgcgggcgcgctcccccgatttccgttctcgcttctcgaacgttctagagccttctacggtgggggatccgtgtggtgtgacccatcgtcgcttctctcgctctcgcaggtcttctcgacgcagagatgccgcttcccgctgcggaggctggcgccgccgatttcgcggcggccgttcggcacggagtcgacgagtgagctgttcgccgcgtcgacctcgaagcggcgctcccgggggcccgtcatggcggcgaagaaggccgccgagggtgagtcgacttgatcccattgctgtactgttcttatttttggttcaggttgagggtttggtgagggttttagtagggggattggtgtctatatgttggtatttcagtgatgtgagttttggctgtggagtaggtgcattaggcgtccgatttttcttgggattactctgtgtctgtggtcaatgtatatcgtacttgctctgtggattgtggggatgccagccatttttgtctggtgaggcgttggaggttgaagctggtctatggcctggagattttcgttcttgctgttcacgttttgatgggattgatcacagggtgaggcacatgattacagatattgaactcgtgtgacgtacagcttaaactggttggttaatttaggttcaaatatgtgattgtagtttccacttctgcaattgctataattattttcagcttaagcacgtagggcttattaaactcattaccaaacttgttttactgcagttttctgttacatttgtacttttatgattgatgtgtgttacttaggctcaatctgcttggtttagccttaagtatgctatgacctgggatttttgtaattggtgtacttttcagatttaagaatgtacacacctattggacttctcagttcgcaccaaaatgcacttattaggtctcaagcaccatggttggaagattattattgttttgcgtatcagattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 39255 - DNA, 986 bp, Oryza sativa
cacaaagcggatgaggtgagctataacctgaggttccaaatttgacaatgcatgaacttggtggtgattgttaccgaatatatttctcggtttctttacatcttcctcattgctccctagtgcaatgttttctagctcatggatatctgcctgaggagggagtccaacaatcacaatgctctcgaaaagatgtgatggttctctgatgcacctattaccctggtccagaaaagaattttgacagttttgagcaagaccagaacgggtacaaccacagaagaacagaaatgagaaatacaacgtcacactcttcaaagtactttccagaaacaactctacagcggcttgcatgctgaagcaaagtgactcgcaataatcatctatgaaaaacaaagtgtatataattctaaagtgtttgccacaatttaccagtcttattaacttaaaaaagctaggttacaacacagtggtatttaaattcatctgttgcactcaaataattactcggaaacatggtgaacacacataaaagtgtgcaagtaaatgagttgctctggtgcttatgaggtgttaggtatgaccgtatgaagtttgccacaatttaccgatcttaccagtttaaaaacgctaggcctttcaatggtgtggtatccaaatattattgggttctttttttttttttgaagtggagagagagcctctcccgtttccattaatagaaacgatagtagttcattacaagatataaactgaaagcagaacagcagaaaagataaagctgaactgactgctcacaaatggcgccatcccaccattttgatgcatcagcagcaacaacttttgcactttggccctacaaagtctaagaaagctgtaccaacaaagacaaaggtagacgagaaacaaagctaccctattgagttcttactgtacatggctattgcactggaataagtactcagaattcagaggcacttgtgaacaag

SEQ ID NO: 39256 - DNA, 34022 bp, Oryza sativa
tcagcaaaatgctgataagtcaccactcactacacaagtacacatgatagatacatgagcaaggtgaaagaaccaaagtaaaactttcatgcaaatcaaactcaatgtgtgatagatcattgagcctgacaagcgatattaaatgagttctggtattttctataagtaaaactccaagacaaaaaatgttgatcaaaaaatacacatagttcgtgtaaatggaacaacatagacgttgaagcgactgttatcttgtcttgtgaccatgctatgacctgtataggttgtaatgggaaagaattaagactaacatccctaagatgaactgcaagtttgaatattatgcttgaaaaacaactgccaatgaagacacactattgaacaactagtgaaaaaaatagcatatttagctctgttttgtgcactactgtactctgtcatagcagttaaaggatacaggtcactcataaattaaagctctgaattaaagaccgaagttaatctgcaaaagtatgtccaccaacatatagattgaaaatgcgatacataccagcgactttagttggaacctggaccactggcgcttttgtgttgtgagaacctccgggttgtaagatccagacacttcaggtgacgttgaaaaccctttcaggatcttcgaaaattgttgttgcagcttctgcattgggctgccactctcttctctggaagagtacaccacagatggtcgtgttgactgtacagtggctgcagaagctgcagcaataaatgctctcgctacctcttcagttgtttgcatcaggtgtgatgtgttgaatttgagcccttcagatccatcgttcttgtccaccattctaaatgcttcctattcatgcaagcaaggagattgtcactccagtagtgtgattgagcatgcgcatatccgtcagacaacatcaggacacaggacacatatcatggaaatacgtagggtaacaaacaaaacttgagcattacaccatgatcatgatccagtggtagcatctatcgtacaagtaaatcatcttctcggctttgaaccacttaaattaaattcgacagaacctatggcctacacaacctacagtcctgggaacgtaaatttgtgaaatctacctcatacagaacaataaatcagcttgtacctcactctgatatccaaccagaagccacctaacagcaaaccgtgtgcactttacctacctaaaaagcggtccacttgaataatcatcgaacttttccaaaattaatcactgagtgcatggttgaatccaaaagggcaaaaggtgacaacaaatcgaacaataccacataatccgatactactatgatcgatttatatacttcgaaagtaagaaaatgcattatcagcgaccgaagcattctatattaaaaaaaaaactagcaaaatcgtacagagcaaccactcgatcttagtgttatgacctaaaattcgcgaaaataccacatccaacagactgtttgactactccaaatccatcatacaggcgacagtaacctcaaagtgccaaatcgatagggaaatcgcaccctccaaccagagtcagatgctctcagaatttaacagtagaaaacccatacccccactacggtcgacgaaacatccccgaaaagaatctcaaaacacacacacacacagagaaaaaaaataatagggaaaagcgctccgaatcggctcacctcacctgacgcggcggcggaggggagggctttgaagcttcaccccgcgaagatctcctcgcctcggctctcctctccccgctgcgcgcgcgcgcgccgccgccgccgtcgaaatggacccgccgaactagcaacgaatgggatggcggcctcctccccttcccctctcctcctcctcctcctcctctcctttttttttccccttcggatttgtggtttaatgcgtcgatccgttcgattaaaaccagaggcgattcgtcgcggaaaaaaaattaagtggcgtgatttggttcggcgcttgggctggactggacgaggggggaggagagattttgagaaggcgagtttttcgtggacgagtgggagtctgctggaactggggggcgatctgtctctctgctcgtggggcccgtgcaaaggagggtgcctgagttgacccgagccgtgtggccctccgtgtggccgggtgcctcgcttgccgctacgccatccgacgcgtggctgcttctggctggagccaacagggagtacgtttttttttcctttccgagggaaaaaatgcagtagaagtacacgacagcaggcatgcagaacaggcctttgtatgctcgcgctattaaatagctctatgaaatcttgctatttaggattattaaatatagattattgataaaaccgattctataatctctaggttattttgcgagacgaatctaataatatatattaatccatagttagcggttgattactgtagcatcactgtagcaaatcatggattaatatacctcgttaaatttgtctcgcaaaatagcttaggagttatggaatgggttttgtcggtaatctacatttaatactcttaaatagcaagattccggagggctatttaatagccctccggattcaaacagggcgtagtagaaagggagtgtttagaactttagatcaggctataaaggtttgacgtgtcatatcgcatattatatagagtttctcactgagtgttcgggcactaataaaagactaattacagactccgtcagtaaactgcgagatgaattattaagcctaattaattcatcattagcaaatatttactgtagtactacattaatggagcagttaggtttaaaagaattgtcttgcaaattagtcgtaatctgtacaattagttttttagattatatttaatacttcatgtagatatttaaacgttcgatgtgtcagtgtgtaaaaattttggcaaagatctaaaggcctaaatcaaacgttttcttttaagatgaataaatcaaacgttttgcaacaataattgtacggtttttaagctgtttagggataaatgatactaggacgacttaaaaaccagtggtactagtactcaggaagagtccaacaagtttagtctcggcaatcaactttttctttctctcaattaagttgttttgaatattgattcagtcgttttctgcttggttgctaccgagcattacaccctgtgttgtttttgtattttttggacaactagttgtggatatgctcgataagaatataagatactccaagctcatatcttcgggactttgtttattcttcagaccctttttactttgattggaaaatctctgctcctaaaaaattgcaagtaacaggagtgtgaccaatgaaactggtagagagatgagtatataggaatggtatcctcagatttatacgtgagtcacttaactgcatttgtgattacttcctccgttttaagttataaaactttatagtattacacatttgtatagatattaatgaatcttaatacattaatatatatatgaatattggtaatgttataaagttttataattaaaacggaggtagtaagtcggagtgtgtaaaaggcaagaagctgaggctcaaactccagaatccagatgtcaaagcctctagtagaacaattctgaaggtacgagcagtacgacacatgtacagtgatgacgttttaaagccggtatccatagccatcaatgaagtggttccaccgtttggcagcagttgaaaaaaaattatgtggacacattgtacctacctaagtactcttagggagcgttgcgttcgttctggtgagttagggtgagaaagcacatcgtagtccgcgcacacgctttctaaactattaaacgatgtgtttttggcaaaaaaaatttctataggaaagttgcttttaaaaattatattaatccatttttgaaatttaaaatggtttatactcaattaatcatgcgttaatggctcacctcgttttacgtatctttccaatcttctcaatcccctatccctcaaactcacccttaggctctgttcgttctggggagataggggagaatgagtctcgttttccgcgtgcacgcttttcaaactactaaacggtgtgttttttgcaaaaaaaatctatagaaaagttgcttttaaaaatcatattaattcatttttaaaatttaaaatagttaatactcaattaatcatgagctaatgactcacttcgttttgcgtatctttccaatcccctcctcaaacaaacccttagctatgcaaagtacagtaccattctttcgctcttccatttgtagctgtactctcgtgtttgcagaagttaaactcgctaccaagatttaaaaaaccacgtggttattacgtgtgatatccttttaaattttcgaaaccacgatataactcatgataactatgtggtttcgtggtaaccacacggtttccgtgataaccattaaaccttgagccgtgaggtgatggtaatctcgtccaaaatagtttggtaaaccctgcatgctacccttgttgattttaacgctttgctcctgcgagcaacgatttttgacgttaatgagtactatcaagctgaatactagctgatcatcccattgccgcataagatcagtgagtgctacagcgacacgaactcgcccgctgatctccatctttttctctgtctgggccacgctcaagcgtggcgagaaagccgcctgggcccattgctcggaaatcaatcaatcatttcatttcattgtgaactactccctccgtaaaaaaaaaacaaaccctaaatttctatgtccaactttaactgtccgtcttatatgaaaattttttataattcgtattttcattgatgtttgatgataaaacatgattaatattttatgtgtgacttgtctttttaatttttttttcataatttttttaaataagacggacggtcaaatgttgaacatggaaactatggcttgtctttttatttggacggagggagtaaggcatgatctagttcccaactttttcttcaaacttctaactttttcatcacatcaaaactttcctacacacaaatttttaacttttccgtcacatcgtttcaattttaatcaaacttacaattttggcgtgaactaaacgcacctgaacccatgccatgccacccctttcagctttaaccatggtttccaatgcagcattcagctctgccgtttacttttatacagcagaattttcgcagaaatttctctacctgaatacggctgtgttcagtgcagtgtaaagtttagattttggttgaaattagagatgatgtcactgaaaagttgtgtgtgtatgatagattgatgtgatgaaaaaggactgaagtttagatccaaactttaaatctaaacatagcctacctgaactttcgtagagtcttgagatcgggtcattgcgaaagtccatttgttgcattttggtctggaaattgttcggcgaaaaatctcggaatgcattggtggatatgtcaattgcatcagcccatgcctgcatggtggggagctggacatgggaattgtagcacgcaagaaaacgacgggtgattgagcagataggctgtgtgcactattctgaatttctgattccaattcctggtctggtagcatgccagcccagctctctgcattgctagcctttctcaggctcagaatctgaacttcgtttgatggaggatttgggtttactctgacggaacatcctgcagcttcaccaaagtaattaaggccgagtttagttccaaattttttcttcaaacttttaacttttttattacatcaaaactttcctacacacataagctttcaacttttccgtcacatcgtttcaatttcaaccaaacttctaattttgatacgaactaaacacaccataaataaaaaagttagaagtttgaaaaaaaaatttagaactaaacacagtctaaaacatgagatgaacaaaaccaaaggtgagggatgtatactctactagcattggcaagtgtgacgatgcataaagaaagaatgttcttccattacgtggtgcccatacacgtcgatgcaattaattccgtgatagatgaagaggatggagagatgacacgacctcgcgagcctaatccgaattggatagatttagtgatccggctttacgattgctatccaaatgagagagaaaaaaaatatttttagggggctttctttcctcttgaaaaggaccacatttctttatccacgagctgttagcatcagtgcatcacgccgtcgccaatgaaagaaagaaagagaaagggaggaaaggttagcatcatgattattgagaacctgtcatagctgtcaagcagagttgctgatcgatttgtagactcagataattatatgtcattttgggccctgccaatcagccgttgcctcatcaacagatcactagactgatgaagagtgccgcgtcatccttcgtctgatggcatcattagcccatatgctgctagatgcaagaactcgatcgaggacatgaacatttcgggcttgtttggtttgaatcaaatttttgccataccaaaatcttaatagtgccaaaaccttggtaagttttggtactattaaattaggtggtattgaatttgaactattatgacaaaaaattggtagcaaaccaaacatgtatttgctactattgaagtagccaaaaaattagtagggcaataagttggttgcaaaccaaacaggcccttccttgcatatatctaacacaattactatggatgtgtttagttcacaccaaactccaaacttttccatcacattatatcacatccaaaacttttctacttacattaactcctaactttttttccaaattaccaattttccccaaacttctccttaaacttcggaactaaacacagcctatatggcaaaggccacttgctgacagatctagcaaacgccacctgctctgctgcagaaccccttgctggtaggtaaacagagtgcaggttgtgcatagaaaaaactactagttccctctgtatgcaaaaatgtttgcacttaggccttgtttagttcctaacttcttttcttcaacaagtttttccgtcacattaaacttttctacacataaattttcaaattttccatcacatcgttttaattttttcaaacttacaattttaacgtggaactaaacacagtaaacacaatacacaactgactggcctggtgttggcctggtattaccttgcccgacttctatgtcagagacattgacattgatgctctaccaaaccagccaaattatcaaaagtatcaaacccttcctctttataagaagttgttgaatagctgacgcattcttcaccactagttgccggttgaacactggcgttgcttttatctgaacaatactagcacttccacttgcattgcataagaccccctgaccttgtgttgtctcttgtggcttcaggccttgaacgtccaacaacttcaggagggtaggagagccaaaaaaaacggtctgttgagtatcattggtgtctgactgaaataatgcgtaaatgcagtaggtgagatcatagtggatatggccggaccgccggacagttcgatggatacagaagagataggctccgtgagactttctgtttcgctagcagacaggagctgagcgactaaaccggggagtactgccaacaaaacgtaaggcagatagccagatatggaacttctggactaatctgatgcaaattttccattttttagtccacgactccacatatcatctgatagcaagggcttgttcagtttgctaccattttaaaccttaccaagttttgatattgccaaattttagtaaagttgtcaaaattttggcaaggttaacaaattttgacaagatttcatatgtactttctaaaatttagtaacaaactaaacgtagctaaaattttaactactttaataaaaaaaatatggttgaaaatgacatcaagttaaacaggccccaagtttgtgaatatgaagctaacagttgtactgagccactaaacacttctcgaggaagaaaagaaaaaaaagacagatgtgcaagaccagtttaatgcagtgttggcccatgagtcatgctgaccacaagggctcgtttcgatgggcctaaatgaggcccacttacatgtatgggctagacacgatgcctactcatactgaaccgatacatcatattatcgtggaataagtccattttacgttcatcatttcatcaaatttaaattgcacccgaaaccataatacctgaaatcttcgcaccctcaaattgtaaaaccaggttaaattacgtcctttagtattatagatggttggtttcactgacgtggtaagttgactcagtcccgtcctgactagatgtttacgtggcaaaaacaagagtggaccacatgtcatgcttactctcctcccctcttctctccccctcctctcttccctacaaaaaatggcctcggagacaactaggaaccgggtagcgaacgtcaacaagcatgaccacctcaatcccatacgtccacgtcggcctgaacacgccgcaatagcttcctcctccactctcgccaccttctcttcctatcgacgccagcaccctcctcctccgcgcacctcaatgatttgtgcaccgaacaccaacattgtgtgcccctcgtacgcaaccggcccacctcccccttctccacccactccgcggtggagaccgcttcatcttactcatttggctccatcctagccaccccctagtcattctcaatcttagctcgagagccataggggatgggaggtcaagcaggaactcctagtcatgacgatgccgaattgggagatatgtgcagtgagctcagagatgatgtagaaggtcgaggatggggcggtagagggtgcgggaatctatgccaacgatgaagctcagcctccccctccaacgacggacgggaaatgggatcaccagccgcctccctcgctgccaatcgctgaatggtgtgcgtggttgggaaaaagagaagaaaaaagtggacattgatatgtgggttcatatatattttttattttcttcttcccactcaccccatccgtcccaaaaaaaaatccaattatagctatgaatctggatatatgcgtgtccaggttcgtagctaggatttaccttttttctgagacagtagtacatgcagggctcatatgttttttaattactttttgctgactaggataccatgttagtgaaatcagccatccatattaccattagatctaatttaactcggtttgcaatttagagttaagattttgggtatgacgatttagagacgtgatttaaactcgatggaaaaatgagggacctgaagtggaccttttctattctcgtcgtaaaaagatgcccaaattcactcgattccgtcggccattggcaactaatcacctccaggctccagcccagcccaaatcgttctcctcctccagaataagcccatccgccgcgcggcatgcaactcgcgcaaaagaacaccggagagcgagagcaccgtgcacgacgccgatggccaacgttgcagaagatgccgctgggcgctggcctactagtacgcgctcagccgcacacgcacacgcccgaatgctcgatcggatcagtctcctgcctgcgggttgccatgtgcgcgcgtgtgcaatgcgctgcgctcccacggcgaagcccccacggagacgcgcaccggcgcaacaagcgaaaagatgggcaaacgcttggagcccatcttgctgccgcccagtgcccccacgaaccccatgcctcgttactgctcgtcgcgtcgccctgcttgcttgctactagtccgctgccgcttggccgtttcttgcttgcctcatggctcgtcggctcgtgatcgtacctgtgccgcgagacggcgagaccgcgtgtcacactgcctcgtggcttgccgtatgcgtaacgcaggtatgggcaggccaaagaaggaacagtcccattgtttaacatattcgaggaaaaggtaaaacgctacttgaaaaataatgtcaataaaatttttatatactttgtttttaataatttagaagtaaagactgaaaaataaactataatgaaaataatataaaatttaactttaaatttaaatttaaggttgattttattttctgataagtataaacgtaaacgaaaagataaggctgtaagtagttcatcagcccatcatcccatcgaaaagccgctgcagagtttagcagctcagcatgctttgaacctcttgctacttctctttcatcgcatcctctctgggctgtttggacggcgtagaagttttgtctgtggagcgaggcagctataattaacagtggatcatcggattcagattagtcaatactcggctactcgcaggtactgtacgcaccaggcgacgttgttaatggggttgttacttgttagtgtacttctttctgtgaattaaaggagatctgaccggaatcttgaccacgtacatgctgatgagttcattcgtaatccgtttaattctacgaggacatttgactgtacaacaagtattttgtgcgtctgtactggacagtttgtagaccgggatctagttgctgtacttgatgggacaagaggtcgctcacgtagatactgcagatcgtgtagaacatctgtagtctgtagtcttcagttgaactgcgtgcatgcatgttgcacgatattgtagtatgtacctattcatctataacatctataacgcatcaaatcatctgtttctataggacttctttactgtacacagcaagtagaaacgatgaagttcttcagcctggggccggaaaaaacaagaggccaagagggcaacgcgcgacctcgtggtttctctttcaaagttgagcttttcaattcaaatggagttgataggagtgcgtgttagaggacacggtttaggccatcatcgagggtgaattgacaaacaatatttaaccagcaaaacacagctcgaaagcttatatatcacgccccctgtccaggatgcagcctttcgagcttcagctttgaggatcatacggctcaagaatcgccatcattaacccgtggaagatttgcacggcgagtcttttaaagatcgtggagctgttaagcagtgcaagcgttttcgcaatcaaacctgctgatcaaaaggctgcctcattcgttggccaaagaagcatgacggctcgttagtgccttcacatcccgtcctttttgtgtttttgttgttgttcacttacgtagtactccctccgtattttaatgtatgatgtcattaactttttaatcaacgtttgaccattcgttttatttaatttttttgtgtaaatataaaaatatttatatcatgcttaaagaatatttgatgatgaatcaagtcacaataaaataaatgataattacataaattttttaaataagacgaatggtcagacgttgaataaaaagtcaacggcgtcatatatattaaaatatagaggtaatactatttatacatgtgtctctgattgctggtagaatactactacttgatactcaaagagcaagattaatctttggctagtatcacctttgcagttgcaggctacatcagccgtggtgttaaaacagcaaaataatgtagtactatatttatcctaaaatatatctatcttagatgagacttgttctagactgctacttttgaaacggatatagtagcattttattttacatagcgggtacattggcctttatttcaacagaaactataacaacgtaacataactatatatgtttgcatcacacaagtccacagaatcgatgcccagtttcagaatgccaatgtaccaactgcttgtgcatagggaaacaaatgaatctgtttgttcgtagtcgtagacgcatcggcggcaaatggtgcagacctgcgagagtttcttcttttctgttttcatttccggccacacggtgtgccacaggagttgtgccgcggagaatcaccgattcgctttcggcccaggccgaagggatctgctgcgcttgtgctcaagatggatgggattttgtcagagaggtggacgtggaatgggccctgcgctgcagctgggccttgttaccattggcctgtataattaatgccacctttcggaagcatttgagggctggcccacaatgcatgatatactagattttttttgcacgtagtactgaactttattttatgcacacaaatcgctctagattttgagatttttggcagccgaaatcccattggaagaatattcttgtaatgaaaaaaacataattgagctaacttaaaagagtaattatttttataaaaaattatcaatttactatatattaaaaaaatacggcaattgtatatatactccctccttccctaaatgtttgacgctattgactttttttaaatatgtttgaccattcgtattattcaaaaacttttgtgaaatatgtaaaactatatgtatacataaaagtatatctaacaataaatcaaatgataggaaaagaattaataattacttaaattttttgaataaaacgaacggtcaaacatatttaaaaaagtcaacggcgtcaaatattttgggatgcagggagtactttttatcagaaaactatagctttattttgacaggttctagactctctcatcatatacacatgaaatacttatatcggtgtaagtttaccccacatattgtgcacccgtagtagataaaattataattttgtaaaaaatcaattgttattgttgttgttatgtgaaaatacccatctaaagttgtgacaaatgatttggaaaaataaagttttaacataataattgcacgaaatggttgatgcattgaccattatatcactaagcaagtcatcctcaaaattcaaaacgattgcaatacagcaaagcgagcatagctcaactgatttgattcattacggtgcgtagaacccatacatttgggttgaagtgctaaacttggcacgtgtactcacatttacgattaattactcttttagcaatatgcgatgtactgcttgacataagaacgcttgtggtgactttatcaatcctatgatatatcagcccaatatacaaaggtgtctatatgggtaatatggcaacccaatctatcatagggtacaaggccctgatgtgtgcgcgggtgtatttagagaggcactatatggtgactttataaatcttaagatacgccaacaaaatatatagaggtgtgttcattgtggtgaatgtggtgagtttatcaatatctcatgggatagggtatataggtgtgtacggtgactttatcaatctcaagatgtgcaacccaatatatagatgtactcatagagttagattacgtgtcatctgtttataggagagtgtgtgacttcggtaatactaagatatgcagatatggtctttataggtgctcatagaggtaaaatgcgcatgcatattcatagagctgagtatgtgcatttgtttatatatgtgagtgtgacttcgataatatcaagatgcgtcaatccattcgttgtagttgatcataaagataaagcgtgcgcgtttgtatgtctactcaggagcggagctagagtatatgaggggaacccgataagaatttttttaagctatatatcacctattttcactatgtgtgcactcttctcaatacaaacttagatatctaaatcatcttaaactctatctaaaatagagtaaaataagcaaatgatatattctccatttcgttatagctctaccctgtacctactctgtataccatgttgagaaagaaaaagagatgccaatgtaagcggattaaaactccacattttcagcgaagtggatgtaaaacccagaagatccaaacatgccagaaagggggaacaagtacagtcgtaccataacaaccacgagagcgaaagttgcagtcatccacatggacgtgccccctgttcgtcacccacaagacacaccaccaccaccatcaccttcacgccaaagcctccctctcccatctctccctctctctccctcccctgcgcccatagctcgcagctttgcagcagccaagccaagaagccaactcaacccatcagaacggcagaaaccccagccgcggcgttggttaaaccacagcaaagcgtcgttgatgcccccgcgcggacgcctcgcctcggcgccatgacgacgaccaccaccactcgcctcctcctcgctgccattctcctcgcggtggccgccgccgacgatgacggtgggtggccgcgtgccgttcccttttgctctgctcgcctgcgtgcgttggcgagggagggagggagagggaaggatgatggattatagtggggagggagggggttgggtttgggtggcttcgtgttttggtgtttttttagtgctgcgagtgcgcgccttttggtctttgtttatgtcttgctccctattggccggcgccgcctaagaatggcctaatactagattaatcccagcctcctgttcgtagcatctcttcttctgttcttcttccctatccaggggacagttgctgtactttttttttgttttgttttttaaatgcggctttatttttgaactatttttttttctgttttgtttcgttcatggataaggtttctatattgttcttggagatcaaatgctcatttctgaaatgccgccgctgtttgtggaagtttagggagtgttttttttttgtgtggggtttttggttatcgagttttggatccggaaatggttttaaattattttggaagttattctccgattcctcctccgaaaccagattcctgtttcctcgcgatgtttggtacttcgattctgctgtttatcaatctggtttgctcttgcgtgttttccaggacaaacgctactggagatcaagaagtccttccgcaatgtggacaacgtgctgtacgattgggccggcgatggcgcgccgcggcgctactgctcgtggcgcggcgtgctctgcgacaacgtcaccttcgccgtcgcggcgctgtgagtttcctgccaacctattgcttggcttgcctggctgcagtgcccgtggttactgacgtgttttcttgcggtggaatgcagcaacctctcggggctcaatcttgggggcgaaatctccccggccatcgggaatctgaaaagcgtcgagtcgatgtacggtggcacgttgtctcctggaatgaaatgtttctttcattcagctgcttaattagtgtgctcaactcgttctccctgtttgtttgattacatatatgcagcgacttgaagtcgaatgaactttctgggcagatccctgatgagattggcgattgcacgtcgcttaaaactctgtaagtgagattcagttttggttcgcagtgttgttttgaggatgtagaacagtagaagtaatgcgtgccgcaaccctcccctgttcttttattcaagggacctgtcctctaacaatctaggaggagatataccattttccatatctaagctgaagcaccttgagaacttgtaagatttaccctgctgaaacttggtggaggagaagtattttgcagcatttctttcatcgtaagcactgctgttacttgaatatataggatcttgaagaacaaccagctggtggggatgatcccgtcgacactctctcagctaccaaatttgaagattttgtaagttgcggctgaactgttctgagggcttaatttggatcaattctaatgtgatatatgccccagggacttggctcaaaacaagctaaatggtgagattccgaggttaatctactggaatgaggttcttcagtacttgtgagtactaagtagtcgatgattctgttccctactttaaaaaacttcttttttttgtttcagtacttaaactgcagacaatatgtaggagctattagtgctaatcagatttagtttgtgtaaattataggcggttgaacatatgtaatgtagggcaaatagttcggtaagatcatattgtcatatccaattgtgctaatctgattttcatatgacaggggattacggagcaataatttagaaggaagcctctctcctgagatgtgccagttgactggcctgtggtacttgtgagtgtattgcttccttttgtttattattagctctacatgtttgttttctttgttcctttcacaaacttgattttgtttgacttagtgatgtgaagaacaatagcttaacgggtataataccagatactattgggaactgtacgagctttcaggtcttgtatgtacataccttctactccttctgaattatgtgtccccctttctttgacatgtcaatcattcctgaccttatggtatttttagggatctgtcttacaaccggctcacgggagaaatcccattcaacattggcttcctacaagtggctacattgtatgtggtagtcattttactaacaaaaagagtatccaacctgtcgtaattaatgaaaccaactacttgaactgctatgcactattttgtaccaggtctttgcaagggaacaatttctctggccctattccatcagtaattggccttatgcaggcgctcgcagtgctgtaagtccaatgataattgatgtgcttgtcttaatttatgggctgagagtgagaggtattaccatagcccttgaatgcaagttttcacctgtaccttctatttgttgatacagtgatctgagtttcaaccaattgtctgggccaataccatcaatacttggcaacttaacatacactgagaaactgtaagcctgcccttgtgtgtgtgttttcctagcctttgagaaatataatattcttaattatgtcaagaagttaacatcatagtatcttgttttcttaggtacctccaaggcaataggctaactggatcaataccacccgagcttggtaatatgtcgacacttcattacttgtaagcctctacctttaaaattttgttgcttcttgattgttaattgattagcgcactaccctcttttgagacaatatctggtttcagagaactgaatgacaatcagctgaccgggttcattccgcctgagcttggaaagttgacgggcttatttgatctgtataactctactcatcctttatcaattgatgcttacctggaatgctaaatcagtcagtggaccatatcatttgtttttcacaggaacctggcaaacaacaaccttgaaggaccaatccctgataatataagctcatgcatgaatctcattagcttgtaagtttcatttgttctcctgaagttctatatcctctccgatggcagggcacttaactttagctttgtaacagcaatgcttatggcaataaattaaatgggaccgttccacgttcattgcacaaacttgagagtataacttatttgtaagtgttattggttttaggtgatttttcttcaagcctgctataaatttagttctgttcatagtgtctaatgatttttgttttcatcctaacttctaggaatctatcatcaaactatcttagtggagccattcccattgaactagcaaaaatgaaaaacttggacacattgtaagtaccagaagttaatctgcaattgcttttgaataagtgattctcatgatatgacgtgtttgctggatatatttgaagggacttatcctgtaacatggttgctggtccaattccctcggcaattgggagcttagagcatcttttgagactgtaagttctataatattactccttgttataaaaaaataaaataaaatacttgtatcatgtcatgacagcattctcttattcctaaagaaattttagcaataataatttggttggatacatccctgctgagtttggaaacttgaggagtatcatggagatgtaagtaccttctcacctaaatgcgttgtctgctctgtacctttgggagtaatgcagattcctcttcctctgttttagtgatttgtctagtaatcaccttggtggtttgattccacaagaggttggcatgctgcaaaacctgatattgctgtaagtctatgttttaccctctatcctataaagtagtattgcatggtttcaaaaggctgtttgcattggactgcatattaatttgagtattctgtttctcattactgcatattgatttacgtgaatttttttttgtcttttttcagaaaactggaaagtaataatataactggggatgtttcttcacttattaactgcttcagtctcaatgtcttgtaagttatacacttgaaaagcaatatgaaatgatttcacacaattttttttggccatgaacctgtaagcttcatactgatagtgtgttactgcagaaacgtatcatacaacaacctggctggcattgtaccaacagacaataatttttcacgattttcaccggacaggtattttccttggggattaatcgatcgcttgaaaaagaactcgtaatacttaggcatctcaggcctcatcaataatctgatctttaattcagcttcttgggtaatcctggactctgtggctattggcttggttcttcgtgctactccaccagtcatgtgcagagatgtcagtaaaatgttacagctgttgcgttgctccgaagtgtaacttcacactgataaactttctaattttatatcctggatttttatgcagcctctgtctcaaggtctgcaattcttgggattgctgtagctgggcttgttatcctgctgatgatcctagctgctgcttgctggccacactgggcacaagttcccaaagatgtgtctttatgtaaaccaggtgatgcatctgcagaggtcccagtccattgattttacccatcaatttcggtagctgtttggcaagtgtcctctcgtcacactcaaccttgcaaatgatctattacatgtctcagactattgcatatgttcgccctctacttgatagatgcatttggttgttaacagagtgatattattattttcctgtgatagatatccatgcactaccatcaagtaatgttcctccaaagcttgtaatccttcacatgaacatggcattccttgtgtacgaagatataatgaggatgactgaaaatttgagcgagaagtacattatcgggtatggggcatcaagcacagtgtacaaatgtgtactgaagaactgcaagccggttgcaataaaaaaattgtatgctcactacccacagagcctgaaggaattcgagactgagcttgagactgttggaagtatcaagcaccggaatcttgtcagccttcaagggtattccctatcacctgctgggaatcttctcttctacgactacttggaaaatggcagtctctgggatgttttacatggtaagtgaattttacatggcaaacaaatacataggaactgtaagcagaatagttggtatttagaacgattgttcttctggtttgtatagccgttgcctgttcatctgtcaacaagcaccacctgatcactttcatatcaacttgtttgatggtttaatattatttggattaggatattttcatggaacataaacagctgataagatttctgcaactatagcctaattagcaatttctttattattttagcaggctcatccaagaagcaaaaactagattgggaggctaggctccggattgctcttggtgcggcacaaggtctggcttatcttcatcatgactgcaacccacggataattcatagggatgtgaagtcgaagaatatccttctagacaaggactatgaagcacatcttgccgactttggtattgccaagagcttgtgcacctcaaagacacacacatcaacctatgtgatgggtactataggctacattgaccctgagtacgcatgcacatcccgcctcaacgagaaatcggatgtctacagctatggcattgtcctcctggagctacttacaggcaaaaagccagtcgataatgagtgcaatctccatcacttggtaactatttttccattcgcttgctactgtttatttgaaaacttgttcctttccttcaccatatactcttgcatttgaggttcaataagtgcacaatcatgggcattatcaggtctgtgttccttcaaggggaccacgcatgaatcctaccatgtgagtagatctatatacactgtggcggacctggtagtgtgtgattcattgtatggctggtgaaagctctatcataacttgccagtgtcccataaagcctgccatatttgtcccccgccttcaatcatgtgggtgaacatttacaggcaacacacacctgtcaaaaactgtagctaactatgactgtactagttattttgatcactgacatgctggtaacttatcggaagaatttaccctgtcaatcctgaacatctctttttgaaagaaaacggcaaaaggtgaattaaaatttgtatttctaccagcccacaggtccagtacggaatagtgcaactgtaaacagtcgattttagcgatgaacttcctggtttgcatgaatgctgtttatgctcattggttgcttctctgcagatcctatccaaagccgcagacaacacggtcatggagatggtcgacccagacatcgccgatacgtgcaaagatcttggcgaggtcaagaaggtgttccagttggcgctcctttgcagcaagaggcagccttctgatcgaccgacgatgcacgaggtcgtgcgtgtcctggactgcctcgtctaccccgacccgccctcaaagccggcactgccaccggcattgccacagtcgtccacggttccgagctatgtcaacgagtacgtgagcctacgaggcggcagcacgctctcctgtgaaaattcgtcgagcgcgtcagatgcggagctcttcctgaagttcggcgaggtgatatcacagaacacagagtagagtgactatctgaatatcctgatggctttgtgctttgtggcgttggcgttctagctaagttaccagcttttgtgtccttcctggaataagaagggacaccgacgaagggctggctattcgctgctgtaaatatgctgtcttctggtttgttaggccttcggaaagctatttggccttcctgttttgatcagtttttcttcttatcattattagttagtggggtttggatgaggtgaactgtattaaggcctcctgggagtatgaattttgtaagcacgggtcagttaaaaatatcgcagtgatcgggaaaaatccgcctcttataaaattggttttgttggataatcgcggatttttcagtacagtaaacgatgttaagaaccgctggcttgtaaagctgggagcctgggacatcccagaggcaaaaatgggtgctggtaatgatcatccgtgtggatgcatagtctgctcgatcagaatgctgtttataggtctcaggaatcattctcggtgataggctgtgttgcagagctttgtccagcgctgtcgatgtatggcacagtttatgtcactgtgattcgctggtgactagtactagtaacagtaacagtactagtaagggcctgtttggcacagctccagctccaactctacccctcctggagctggagctcagccaaaaagtttcagctccaccaaaaactgagagtagagttgggtggagctctctcacaaaatatactagagttgtagagctgggtttaggcagctccacaactccactccagactcaactcctggagttatatttaggagttggagctgtaccaaacaggccctaagagtagttagttaatggtcagtgacccactttttttttttgctgtgttcaatactctccctctcatcctgccatttgtttcagtattgaagtgtgtttgagtagaaggagactgaggagattgaaaagatacgcaaaacgaggtgagccattagctcatgattaattaagtattaactattttaaattttaaaaatggattaatatgatttttaaagcaactttcttatagatttttttttacaaaaaacacatcgtttagtagtttaaaaagcgtgcgcaccgaaaaggagactcaatctcccctatcactctgaatgaacgaggccgaatggctacccggccatgtctatcacaattcacaagtagtagggggcatggagtacaaatttactgccctttgtagtacaaatttactgccctttgtagggcccctctccccctgacggatgattgatggtatagcaagcgatgtcattcaagcacggctccatgccatggggccaaaaaaaagccagccaggcgcggcgagctcctcgtgatatgcggggctcgtggagtaatggcgctgcgcgcgcggcgcgaacgcaaatgggatgccctttccgttcccgtccggtttagtacatgctgccgcggccgcgaccgcgacgcaacacgccctgcggtgcggggtcggcgccgcgacgcgctcggatgggatgcggcttttgacagggcccgtggcccttcttcttcgtccgtccccttctcctgggccggaagaaggcccatcacaggacatcagtgtgcctctgctggttgggctgatgcggaacttttgttgggccaggaccgcaggacaccggtaagggtctgttcggcgtccctggttcccgaccgacgcacagaaaacgcagtcttaattaagtattagctaatttttttaaaaaaatagattagtttgtttttttaagcaactttcgtacagaaattttttcacaaaaaacactgtttagccgtttgaaaaatgtgagcatggaaaacaagtgagaggagttgggaaaaaggggtgccaaacaggcaaacacagcctgttgtgttcttaccctatttctcaaacccacctcttttgttttccgcgcgcacgcttttcaaactactaaatgatatgatttatgaaaataaaaagaaaactttatatatgaaagttattttaaaaaatcatactaatctatttttaaaaatataataattaatatttaattaatcatgcaataatatcagctttgttttttcgtccggggaacccatcctcacgaaaacactcaaaacagcctagtagtaacgtggtgtgccgtgtaccattgattggaccggagagtatcggacacgacccatgttacgtactagtatgttcggtgtagaggacgagagatcacctcagcaatttttcctaagccttctggacctctgtgcaaatagtaactcattacgacatcatccttgttcggtgttgaaggccatcatccggctgacggttcgtcggcggcggcggcagtatgtggaggcggggaaggggtctggcggcagggaaggaggagtccggttgcgggcgcgccgtcgacggcgagaacaactgtgggcggtggccttggccgaatcgctgaagggacaatgctgttgaccgacgacgatccttcttgtgcggattggtggtgtgggtttggacaaagaatcgcgggcgaaagctttgccgagccatttggctggctgacaacggcaacgccgtttggcgtcgttcccatccttataggcgttgttttagcatacccctttcctttccctatcatattctccgggtgaaaaccttgcttcggttacgaacgagcggtggcggcgatccacgtcgcatcctccttgggagcaccgctttggagaaacctctttgtgcaaagatattggcattggtctatgcattggcttcgaacttcagtcttaggccttgacgaggccttctagctccacattttgttttgcttttctcagtttggatcatctcttctcttgtttggtgtgttcaacttgtcttgaagaactatattctcttctggagtggatctttataataattagttatagttctttttatcaaatgtcgggatattatatttcattatctaaaaaattacgacatcatcaatccattcgtccacgcttcacacggtagtatggtactcgtagtcgtaggctcgtagtacgcacatggtttcagaggggaaaaaaataaaggaacaattgctgaaaagaacagtttttgttaccgtggagaggacggttcccagaactccacggaaaatacagggagttacccgcaagtgaagaaaacgaaaggcgtagccagaaaagaaaaggaaggaaaaaaaaaggttttccttggcgtgcacagcttctccaaaaaaaaactgtccctcccctgcacggctgcacattgaacgcaaagctcgcgacaccaatcgcacgtgccacgtggcgggcatcttgaacggtgggacccgatgtcagtggcaggatggcagtctcctcgtcctacgtggcctcgcccgctcgtgggacgaccaaccgtctttaagaaattggtctcaagggcaagacggtaaacttcgtgactggtactggtagtagagaaattaattaactgtcgtatttcgaaaacctcaagagcacactgggcatcgtgacttggagcgaaacccggcgggtttggtgggtccggttcttcctttgaacgcacttgggccgtcggatcaaagtggtcgtgttaggaccgacggttagggacaggggcgtgctgttttcgtgcagaaaaagggtaatcctaggttttataattctggagttttgcagggtttatttgcctggtccatagtttgtgatcttttcatctaggagtatataggatttaattggttttttccgtgtttaattttcatccaaatctattcacgttccatcggactaatttttagcaaagtgtttgtttatgagttgcactattggacttcacctctagctcgagttgaatttacatcctagctacgctgggacgagcccaacctagttgatataacctatagcgaatccacgttaaaagatactactacatccgtttcaaattataagactttctaacattgcacatattcgtatagatgttaatgaatctaggcacacactacaacaaaaacctcgtatagaggcacttttgtagaggcgttttgcaaattgcttccaaaattagaagttttatagcgtagagacactttatagaggcactttaaaaattgcctagaaaacttttactctagagacatttttagatcagtttgttagattttatctcgtagaggcattctttcggcactataaaatacgtctaatatgtaaaggcattttgttgatacattttaaactatgtagagacactttttagaatgataatgtgtactaaaggactaaatataagtaactaaaggaacaagcatataagtaatgacatggagttgagttggttagtgtattgaagattaaaatgatttaacgaagagattatgagttcaagacttgtcaaaagcaaggaaactattttattctcttttttggactggttttatatttttgcggtacaatttaatgtctctagaaaatgcatctaccatcttatagacattttataaaatgtctattcgtttgtagagacaattcaccataagacacttattagacattttttaaaatgcctctacattgttgtaaaggcatttaataagtgactctacagtactagaaaaatgtctctacaaagcatttttcttgtagtgacatatatgtctatattcattaacatatatataaatgtgggcaatactagaaaatcttataatatgaaacggaggaagtacgagctaaattagctactcaagtgtccaaaatagacaattttgatctgacaatattatttgggtaggcttttgaaacaaggtgaaacaatggaaaatttggagttatttatgcaaatttgctttgatacattgtagtgcatgaagctcgttcaaccaggttttcctgttctcgtgtatctaggccatgagggaagcacattttggtagaattatgagaattttgttgtacatatatagctcttgatacgatgctcaattcaacaatatgttttcagttattgtactgatttcgtgaggatttcttatgctatattaagttgttcaagtttagtaatataaaagtgccatttcgttgtataaataaactgggttacaacaataattcatgatgatgtccaactattcctgattctccaataggcggtccctctggcatcctcaaatattagttcaataaaactcaaaatctctctgagggtgcaaagatggtggacttttacaaggagatggagaatgcgataatccgtggttgtttgaatgagccagaggaggccgtaatggtgaggttggtgagatatctcaaaggtttggattattgtatttgaatgcatcgttgaatttaagtctcacaacactgttattagttgctataagaaaatcaccaatggatatagtcgtgccattaaaaaaatggacccttagctactggtactacatgatctggtccaagaagctaaagatattttggttgcgttaaaaacatatttcaagaccaatttaagcacaacaagttatatatttaatagcgaggcaaaactggtagctcgctaagtttgcatggggaatgtcttagttctctgttatttttctgcatgtgattttcgtgccgagcgttctgcatactaagcttcttaatttgaagttcgtgttgatgataaaactcctccgggattagatggaaattgagttgtagggaaattctttgtggtactctgaatgccaaaaactaataagaagaccttatgttacaaactagctctagcttatactcatataaaagggaaaccaccatgtgtccatgttactctaaacatatcaaagtcccttgttgtaaacgatttcttgatgcctctgacctcaactagtgaatatagaacagatcagggacctaagtcagagaaagcagcccatgtggccatgcattcaaagtttcaagttggccagatcggcaaaatttcaacggacccgccaccctcgtccgcgcctgcagcgccccgccgtccccggccaccatagccgtcgccgtctcgtacgcccatcccaccccttctcccgcgcccatcccaccccttcctccgcagccgccgccttcgtccgcgttctccgtggctgccgtcgtcgccgccgccgtctccctcgcccccggccgcagccgtgcgttggctgggacactgccggactgccccgtcctcacatggaagaaaaaaaagctgaaagggaaggatgggagcaagaaagggaatagagggatggtgggcggacaaaataaaaaaatatttatgttgcagtaattataatatgtctattatatcagttggctataatgtttatagagggatggtgggcgcacaaattaaaaaaaatatttatgttgcagtaagtataatatgtctattgtatcagttgactataatgcttactacagatgatgtgtccatctattgtagccgatagctggctatgttattgttattgatctcgctcttaccgatcaaccgatgggtccacgtgatttctcccccacacccagaaaaagacgcctctgccctcctggccccacgcgccccacgccaccttgatactcgcgggcccaccactgccacgcgggcggaaatgacgccttcacccctcgaccgttcaaattccgttgccacgtcggcgtgaggattttgatttttgcaatcaccaccccgcgcggcgcaaacatttcgcccctcgcggccacgttttactttccttttttttttggccattagaaaaagtgcacgtgagaagaagcgccaagccacagccaaaatttcggccatgagtcgacaactccaagcagcggccgccgcctcgctctaaccggagtcccccactctctcggtctgccaccgccgcgcgggccaccggcggcgcgccaacccgccgcgcgcgcgcgtctctcgtgctcggctccgccgccgggggggaacccggcgggggctagggtttcggcgagatgagctaccggaaggggttgaaggtgtgggtggaggagaaaggggaggggtgggtggaggcggaggtggtggaggtgaaggaccgggccgtcttcgtgctcacaagccagcggaagaaggtgcggcaatccccctcattccgtgcggtttaagtttgtgttgtactgtttgggatttttcgtgggggcggggtgtgagcagagacagggcgttccatatgagtttgcttcgagtattattcgagacgattgggacagaggcttgttttgttattagtttgatcatgggttgacatcagtgaactgaggcagttcaaaattctactaatacagtatatattttttgagttgctctggtgtaaactttgcgcgtcagagtacagggagaaacaactgattcgaaatggtggaagttgttgttacagatgtttaatttgaatctatcgctaatttacacaacaaattcgacctggttctggtggggcaccagttcgctaaaggggagtatttgaagtgtaaatggtagcattcctggggtactttaatttggattaaaattttgaaatcctttgccagttggttttagattttgtcagcttgtttgtaattttgcagaaccagtttgaagcttcagtcagagtacttctatatagttgtatgaacctgtaacttcacttgtgctctgcaatttacctggattgtatgagccgtgaaacataaatgcattgacatcaataactgaggacgattatcaacattttttttgtttacttggaaatcgctgtgctattagttaaaatttaactagttttagatgtatctgtattatgctatcctttttggtttgcaatgcactgctttaccaggattagtctcccttcggctgttgattttgtagttgtcctggcattctttataattttgtatggcaggtggaaatttgttttatcaatgaattctgatccactctgtttacacccaatggtctatttgggttctgcacttgatttctggatttcacgccgtcctcggtgaaaacattgaagtaatttcatgttgcaaccaaattatctatacttaataaaagagagtagtgttggtggttctgccaccacccctaccaccaactcccaacttttctttacaaaaatggacgtgtggtgctagagggcccagatgtcaaccactcccaccaagtcctttaccttgtgtgagaaagaaaaaagtacagtgtgggaccaaaaggtccacatgcgagtaacaaatatatacagcaatcaagagatgataataataggttaatgataattttttaattaattaatacaacagtaaaacacatgtcaatattctgcttgctctttgtactttgttaggctgtaggccgtaatctataggaggagaggacattgggatttgggtgagtctgtatgtactttgtgggctggaactcttgaattttccaagcatgtcattttttttctttttgttctttataagacgatagatcctgtttcaaccaattaaaaacaattcttttcaacaaggactttattttgctattttcaatatccgttgcaacacacgggcatttgtctagtgttgatataaccagtatttatttctgtacagaaaaaaatgaatttatagtttttttaaacataattattaacaatttatttgtttttactattaaaatttaatgtagttagtttattcttcctcttctggttttcagattacagttttggcagagaagttgctgcctagggacacagatgaagatctaggtggggggcatgtcgatgacatgaccaaactaacttatcttaatgaaccaggtgttctatacaatttgaagagaagatatgcattgaatgagatatatgtaagttgttcactggctctgttgtttttatttgtcgagtgacttgtctacaatgaaaacatattttgttctgtgaatcatcgactcgttgtcggaatttctttgtaaagatacacttcacttgcaattctctatttatcataatttgtgaccatcaacatactatatgtgccagtgttactttctcataagacaagttcactttggctgtccctatgattagacttattaatgatgattttctttcaacatgtgttgtcttagtaaatacatcttcttttgttttgctgctagcttctctttgtgacagccttttcatttttcttcttgagatagacatacactggaagcatcttgattgctgttaatccattcacgaggcttcctcacctgtacaatgagtacatgatggagcaatacaagggtgtccggctaggggagttgagtccacatgtttttgcagtggctgatgcatcatacaggtttggattacattttgattcagtttaagtgcccttagcctctgtttgcatgtacaatctgttttcatgacatttattgagttaatgtagggctatggtgaatgattcccggagccagtcaatcctggttagtggtgaaagtggtgctggcaagactgagacaacgaagcttatcatgcagtatcttacgtacgttggtggtagagctgccattgacgatcgaactgttgaacagcaggttcttgaagtaagttttacctcctgttttcttccactataataaatggatactaagagttgtgcatattttagtcgtcgaaaatatttctggttggtacttttcaaggcattttctcataactcataagtcttttgtttcttcttactagtctaaccctcttctggaggcatttggcaatgcaaaaacagttagaaatgacaactcaaggtgagtatcactcataaggtgacttgggaaatgttgttacaattatatgcaatagttagggatatattcctcaacagtacacatggttctccctctggcccaaaatatggcaacttctagcgttcaaaacttgtcccagaatatattaacttctacacctactctctcatctcaaccaatcacaaccatttctcattgagtttttccacctatttcctcaattaatcacaaccatcccccatttaattccacctcctttgggacggagggagtataaacgatatttcccagaatatactatggctttaccaattcataggactcaacctttctcaatgttttctttgcatagtcttaatttacaacactttttggttgcagccggtttggcaaatttgttgagatacaatttgatgcaaatggtagaatatctggagctgctattaggacctatcttttggaaaggtcccgtgttgtgcagattaatgatcctgaaagaaattttcattgcttttatcagttatgtgcgtctggaaaggtacctctaccaaccattgctattccatatttggctcactattatgtgcataattgtgtgagttccattactgcacggtttgattatgggctatctgtgaagtcagcattgaatgttgaagaatatgcttagagttaaattatactgataccctgttggcccgttccaatgtagacctcattcatttcgcccatttgagcagttattggttcagctgggatgtgattacgatgacacccatttctgttatataacttataagaatttgggcctgcaatttattactgaaattagttttattgtcaaaatattttgcatatcagagaagaaattgtgaaagatgtattcattgctgcaagacaataatatatccatttgaacttagttttaaagacaagcactaattgtttttaattgctgttaatgagattatcgtaatccacctcattatcaaagccttagttaagcatggagaacatagtattctagaggttgtataatctgtttcaattcagtctattctatctaattgtacagttgattccatgcagttctgagttttttttttttggttttggttttgaattttgcatatgtttgttcatgtaggatgcagaactgtacaagcttggtcacccaaggagtttccattacttgaataaaagtaagacatatgaattggaaggaacaaataatgaagacgagtactggaagacgaaaagggcaatggatattgtcggaattagcagaaatgatcaggtttctacagaatgtgaacatacttagatgttacatggaaaaagaatacctaaagaaaaccagtgcatattatgcatacttttccttttcttatcccagaaatgaatgtgtatattgtactttgttcaggatgctatatttcggatactggcagccattcttcatcttggcaacattgagttttctcctggaaaggaaattgattcttcaaaaattaaggatccaacatcaaattttcaccttcgaatggcagccaaactattcatgtatgaattttatttacatatatgattgtgacccctttttccgctcatcgtcctcatttatccataacaatgactcaaaaattgtatcaagttccaaactcttgattcttgaagcgtttagtttttaatgctccagggcattgaggttatggacgtagatgatttgacctttgatttcttacagacgtgtcacaagaaaagaatacactttccaccctatgttaatgacttactgtaaatgtggattacaacctatggttgataataataaaaaatgacatgtttacgctcctatacatgctatatgcatatgtggatattataattgaatctttttagatattttatttgagtttgtcttgatgaattttgattgcctgattagcaaagtttacaattttgaactgtccgcatttactgttttgacatgcatttctggaaacgggtcatggaataaccaccaaattaagtgagcatgttgataatgtactttaaggataatgcatgcatggataatatcttgttatgcctaaaatgtccttggtcactatgaatcatatattttccatgtagcagaaattatttaatgctctgggaacggaagtagctttccacagctttatttgttccttatcgcttcattttttctatttgaattaggtgtgatccagatctgttgatctcaactctatgtacccgctccattaacactctcgaaggagcaattataaaagcattggactgttctgcagcagcagctaatcgtgatgctctagcaaagactgtatatgcaagactatttgactggtattttcacatgccttcttttttcaaggatactgtgcatttttgtaagttaacattctttaattgtttccaggcttgtcgagaatattaacaaatctattggtcaagatgttgattccaaagtacaaattggtgtcttggatatttatggttttgagagctttaaaaacaacaggtaattaagtattctgtcatttagtttaactcactcactgcaattttatagcattccataatttagtttaactcactcactgcaattttattatatttgatttgtgaatatactattatcaaataaaaggtgtcatgttttatgtcagcatttctgttcacaatgcaccaatttacagtaattttgtgcctttttttcttgcttggttaggctggccttttaaatgtccacaagccgacaagctatttagtatgttgaaattactgtttgtgctgccaactaggcaaaattgtgggaaaagtatgggatgtttaactgctgcattttcgtctgtttcccttttcctgatgaatcatcctttatttattgctgcagttttgagcagttctgcatcaacttcgccaatgaaaagcttcagcaacatttcaatgaggtatagtgcatcatttgctctttaatggaaacacaatattaatttgtacttaaatatttatgtaacttttgtttcttatcattaaatactgcaaatctgtt

SEQ ID NO: 39257 - DNA, 863 bp, Oryza sativa
aaatcgcaatttttatttttgctggaaaacagctgtttttattaacaaatagataaccattctaatatatgttttttattttccagtatgttcccaaaatctactcatgagaccttcgcaacaaagatgttcagaaatttctcttctcatcataggcttgagaagacaaaattctcagagacagattttgttatctcccattatgctgggaaggtatgttaagtaattttaattattttttcctgtatcaggtatcaacaataacaaagtcgaccttttgcaggtgacgtatcaaacagaatcgtttctggagaagaatcgagattatattgttgcagagcactgcaatcttttatcttcatcaagatgccctttagtttctggactttttggttcattaccagaagaatctttgagatcgtcatacaagttctcatcagttgcttccagatttaaggtatcagcaaaaatttctttgcttcttggtctttgaaatttgtctgcttacatggtttatttggtcacatgtgccataagatattatttactctagaaaataatgtggttaaatgcatctacttccaaattatgatctaggtagtgatgaatagtgtggcagatgtaaggaaaggaacaaaaagaaaaatctctctccactatcccacctttgcaagggattttcatgtaaaggggattgaacttgttagaagctatttttgttgtatcatagcaatattttgcatgtgtttttcctccaatattgctgtttccttaaaaataaaaaaaattacagtacatatgctcattgttgatttatataggctgatcttcacttttggaaattatatgtttccttgaattcc

SEQ ID NO: 39258 - DNA, 733 bp, Oryza sativa
ccaatggttaatttgtttccttgtgagcttgaacacaaaatgcttcaagatctcaggatggggatgtaagttcaggatttctatttatggcataaataatattttagattgcatccaaagttcctgcgattgtctctgctcaatttgctctttgttaaacattgttgtatgagtgtctttcatgctatccagatctatacgcaatattgatattctccttgatgccacttcttttgcatatgactttcacaaacagtattcttatggaagagcgtctcgaatggctcactgatggggttagcttgcttacatcattatcacctgaggaaacctgtgaggatgatgttgtctgcgaaggaactgaacttgcaacagaaaaacaatatttcgatggtcatgcagtagatctggaaaaatcctctgaatcaagtgtgggagtttgttcaaaggagctgtctgacactgacagcagttctgaatgtagagataaccaattggacttaaactgcaaagaagttcaacaggaatgtgtagtacaggatgatcttgtaacaggaacagctcctcagtgtgatactcttgaaaggcctgacaattgtttatcagaagatacaactgccgatcaatctgggattgagcttcatgaactggattctgtaccagttatcctgaaggaatctgataccacagaaaattgtggctattctttacaggatgatgtgaacgatgaaca

SEQ ID NO: 39259 - DNA, 715 bp, Oryza sativa
attcctgcagccccactgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaatccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgacttaaccagtaccaacccag

SEQ ID NO: 39260 - DNA, 9748 bp, Oryza sativa
  unsure (1)..(9748): unsure at all n locations
nnnnnnnnnnnnnnnnnnnnnnnnnnnnnnnnnnnnnnnnnnnnnnnnnnnnnnnnnnnnnnnnnnactgtcgtggtggattgaaattcagaggccagggaaattaaagatggaaagaggaagaagaagaagagagtgtgtacccaatgacatgtctgccaccgtcgtagacggcctgggagacgaggcccatgaggccaatgctgccgccgccgtacacaaggtcaatgccctcgcgacctgcacggaaacaacaactcctcatcatcatcgtgcagtgcagcagcaaattcgttgcagaggcaacaatggggcagcgttctcctgttcccataaaacttggggatacacatgcagacaggagatgcagaggaacgcatgggcgttgccattttctgacatgacaaaatctctgtacatgctgctgtacttgtcttgatacgtactagtactcctttgcagaacagaacgtagacctgtccctctgtttcctttttctttcgatgaaggaaaaaaaacaaagggaggcacgcgaaatactataaacgtctgaatttcactgtcgaatacaaccagtaccattgtagtgtttcttactgtaccaccgaactggatattgttcgaacacgttgccacaatatagtctcttgattagtagtgcatacttctcccccgtcctataatataagagattttgaaagggtgtgacatattctagtacggtaaatctagacatagagcctatctagatccattgtgaatatgtcaaatccctttaaaatttcttatattatgggacagatagagtagttttcaaaaaaaaaagtgatgatggatgtaaagcagccatgtagtccaattgaatagaaaaggggacgagggtatcgtgtcgatctattggaagcaggtttccttatccaatatggatggggttaccactacctggcagtaaccgaataaaaacggatgaaaccgaataagttttaccaactcttaaaactttgttgatatgttgagctgttcccgttacagtatccgttagtaagtggtaaccgatagtttgtagttaactagtacaatatactccctccgtttaaggttataagacgttttgactttggtcaaagtaaaattgcattaagtttgatcaagtttgtataaaaaaagtagtaacattttcaatccaagataaatttgttataaaaatatattcaattattgatttgatgaaactaatttagtattataaatattactatatttgtctataactttagtcaaacttgaaacaatttgactttgatcaaagtcaaaacatcttataacctgaaacggagagtatctttttagacaatgaatagataaaattcggcctctacacaggcgtggatctttaattttgattttgataacacaatatatattgtgattatatatatgcaggtgaaagatagcctgttttgccagcgcatatatatgatcacaatttattaaagatccacgcctatattaattaattataaacctttgcttcctgctttgaggtgtaattatggaaaggaaccgcaatctaaacaaaactaaagagagagattcatgatatgctgttaaacatagatgcatgctatgagagagtgtagttgtgtaccagctctttggcgaggtcgacggcggcatcgcggtaggtggtcttgttgccctggctactgccgcagaacacgcaggtcctcttgaacctgctctcctgctgctgctgctgctgctgcctcattctcctctaattgatctacctttgtaaactgcagacaatgcagcacccagagctagcttaagttttgctctctttgtgtttgtgtttgggtgcgccatggctggctggtttatataaagaaaggatgtctggggccgggcgacctatcttgcaacagcgctagctgcctgaatggagaatggacagtaacagtgtagtgctagctagcttgtgcttgatgatgaaacacacgtcccattcgcctctgctgctcgttgcctgttggtaccatagccttgctagccacctcatttatcttattattatcatactactgatagcgagcaacagtgttctaaaagaaaacatccatgcaggtaaattaaatacaacaacttgacgcctaattagcaacaagctacgtaagtagtggtgttcaccttttcattcttgtagttaaatactactagcatctacttgtttgttttggtcagctgatctgatcttatcatttttgttttgtttggcaagaataaggataggaacactgaaacatgtgcttgatatgggcaaccctttgacctgataacagtaggaacagatgattatttgttactgttataatttctggtcttccatccccacctctctggcgttgatacgtacatatggtttcctcctgtctttaccaaacaagctggcaggcacgctcttaattcgccggtacagtgacctcatccacagctctccagatcgactgttttgctctctctgctggggcctctctagaaagcgagtacataacgtgcaggtaaacagtttgttaatgtttcaagaattaatatccatgttaattagtgtatgtacgtgttggggctatcttagctagtgcgaatatagctagccaaatgatatctaagttgaaggaaaaaggatgagagctaaagagcaaacaaccctatgatatctacgacgtactttccccccagcctttggttactcacagttttatgtgtatgcatcaggatccaggaaatcgaacctcaaatcgagctttgtccctcgctttatatctagccccatgataagagattgtatgttgtgtctgctacgacaacctagcttttatatatatatatatatatatatatatacatacataccttaattagctcttaataattcgtttagcagagttgcatgcatgaattgaaatttagacaacaaattataatactagaaaagttgaaggtcttcaattaccataagaaacacgtgtgatggtattttcattttataaagaaattatgcatgtatactggtcaagtgagtgacagagatgcatggcaggtactagctaggtacatatatacatgacattgggcaagcaaagcatatatacgcgttgagagttgggtgagagtggtagtggcgaccccggtgggcaagggcaaaggatcgatcgacagatgtgtttttcctacagaaaccgcaacaaggcgacacaagtaattggtggtcgtcgcaaaagcgaagccgacgcgacaactccatcatgcatgcattgcctgcctgcctccttccttctcatctgcccatttccaattaaccaacggatcgccgccgcgttaacactgcaccatccatcagttactcctagtaattaactcttcaaattatataaattttcatctaaattcgactctatatagttatagattaaaagatagactacaaagtaaaagctgaaaaaatatctttttctaagactcatatctcagtttgtaattactaaaaagaaatctgtttctaaaatctcaagctccctaaagaatgccagagcatagcagcagcaacacaggacaggggcagagtggaggaggatgcgtatacggaattggatggtgtggcctactcctgcatgcatggatgatcttatccaacacccaggaaaaggtcgaaagctaaattagctaatggcgtttaatataattttttatctttttggttgattttgtaccgagtcaaacaatataatgacgtttctcccgagcaggttggggctgggaccaacgggaggtcgccacgtggatcccgcaggcgagccttttgcacgcactcacagagtgcagtccatttccaagggctttcggtcaaatctgtgtcgaggtctagctatggctgttgagctcgtgtgttttgtacgcctcatacagtgccacgacaggagcttttatcttgctatcgatcgtgctaccgctgcccaatcgatggctccatttgtctggctgaaaactcaattcattcagagataaattaatggagcactcatgtattattatgcacgcatcctttttagtcgtcagtgaccaaagatgaattgctaggtagctgagcctgagctgccttggggtttcaagtttcaactgctgcaggctggagcacactaaaaacatggatggatgcgagcagcggaccaaccactcgatcgagaggtagagctgtcgagtgccgagtgcgaggaggagcaaagcagataagaaaagaagagataaaccggtgatagggcaggggtgagtgcggggatttttttttctttttgaactttcttgtttttaaattttaaaaataaacccttcaaaaacttatttctagaatttgaatcttttggcaacgccaacttgcctagcgtactaaaataatattgacacgccacacacaacggacataacagggcatggccaaataacgctgtcaacgtgcgaaagagcctgtagcctagtggttacaagagcctcagtagcaccttaggtcctgggtttgactcccaatgagagcaaatttttcaggatttaatggctttgtgctttcagtggtacgcgacgtactcgtcgacaacgatgcgtctgtgttgacttcgtcaatctccagaatggatttgccggcctattcttcgaagatgctcatagagttaaggtttacgtgcgtgcgctcatacgggtgagtgtgcgtgcgttgtgagtgtctacgttgtactgtgtaattttaaaaaaaaacgctgtcaacgtgacgtgatcaggtaacgttggcatgccagccagatcagctcaaacaggtcttgaaaataaattttggaagtgtttatttttaaaattaaaaatttaaatatttcaaaataaaaaaaaatcgagtgcggattgagtggggtcgtgaagggcatgtcaacaggcaggcaggcaggcaggagagatatgatccaaaatgccatgccattgcatgcttgcagttgcaggtgtaatattgcagccccggcaggggagggacagaaagcgagggatcgagcctgcagcgctgccgctgtcgccgcctttggccgtggcatcatttcaattttctcgccgccggcggttgcgtaggcaggcagctcgagtgttggactctgctggagtgtcctccgattcactccccacccattccgactcagcagctcaccggtcggtgccatagatcaatacgatgattgatgagccaccaatggactaggagattcatggccgatgattttctaaccctatccaatgcacgctccaaaaacgtccaacaaatcgatctaacatcactaaaagttaacctacacaatctttcttttaaaaaatagattaaaacccagcctctacatctaaatttgaaattagtcttccagtgttttagtttttttttttgttcttttgtggtgttttttgttttctcacttatgagacttggaatctagtattcctgtaaactttagttgtatgtcacttgtagatatagaggctagatttctatccattttctaaagaagatgttatatactccctccgtcccacaatataaaggattttgagtttttgtttgcaacgtttgaccactcgtcttattcaattttttttacaaatataaaaaacaaaaagttatgcttaaagtactgtatataataaaataagtcacaaataaaataaataataatttcaaatttttttgaataagacgagtgatcaaatgttgcaagaaaanactcaaaatcccttatattatgagacggagggagtataatctaaactctcgacagtgcctacgaactattgggcatgcagacaaagaaccacaaaagataacatttaaagttcagcaaaagtatatgtgcatatcttattttattgaattacacatactaattgttaaccccgtacatattgtccgtactattgttactaatatcagaaatattaaaattttaatcatatatagaaatttgatggaattaagagagatccattgggcttctcagaggaaaaataaaaaagaggtttggattcgtggaaaatttttttcgcaaacgcgtaaaatgattgcacgtcaatatattagaagaaaaagagttttagttacacgacgtaatcagctagactgtcttatgctaggggaaggaagaaaaagcaaaagaagaaaaaactgaagcttagagaaattacggcggctaaaaacagactccaagcagcgagaaggactcatggaaaaatttcctatggaattggtgcaatggatagcaattcataggagtatgatatgctcaaatcccttttttttcaaacaacaaaaggaaaaattcctaaggcttagaatcctttgaaaaatctttgaatttccttcaatcaaaggaacctccaatctaaatcattataacatgatttacttaaatcattagtcagatgtttctaatacacgtgtaagttttctcaaagtgctcgattagagtatatatgttggcacaccgtttcaatgaaccacatcattatttataaagaatccagtgaaatacatatgtatcgattaacgtaaaatgctggcaccaaatcaacttgataaaaattcaattttttttagagtaagtcataaaaaaccataccttagttccaacttaaaaaaatcgaagttacagtgcacacttttttttttaaaaaaaaaggggttgtcacgggtacatgtaagcataaaaagcccaagcctggtcagaccaacaggcttaacaggccagacccatgccaattcaacacaaataaaaccgtactcaagtaggaataaacttagagattttctatcctatcccacattattctctagctattttagcaacacaatatttccatggtagtgtcaataacccgctattgctattgcgagtgcaatagcgtcactatcacctctagtaggaataaactagagagacgttctctattttatcccatattattctctagctattttagcagcacaatattctcgtggtagtgtcaataccctgttaccattgttgcaataacaatagtggcctatcaccactattttgtatcaagttgaggatgatattatatccatcacattattatcccaacagttttgggctacttgccgccaacaggaattacaactagtcgtcaacaattgtgaacaaataacccagatatcactaatcgtcggatattattgtcttacgtaggcaatttacttaccatagaggcttgggttatatatatggttctagttggcattgatgacgttgtcactgatagttcgctgacggcctgaccaccgtctatttcatgttttgatgaattatggatgcatcaacgcaccacagcactcacagcttcattggtaccggtccgtcacctctacacaaggttagatgacactgacatcccaacgcaactctctatcctatctgctatcgagtatcaacgcactgtcactccatgggcctagagtcgggggaacaacgatctcttctacagttctactgttctacatcttttagtgcaactatgagtgaaataaattctagcaggggaaaaaaaagagagaactcccatgctctaaacaaggcttgaatgttgaatatggcacagcaatagtactatttaattagcaaacaagtataagttctgtttagggatgagcgtgagtaccctgtcccagcctaaccgtgttgattcctaatcttgctcataatttaccccaccaatctctaccatctttccatcgagtaacaaccattagacagtggtaaacattgttaccaggtacatcttgggatttaacgacagtcgtcaattcgtcattcaaaaaacttgccaatgcttaattaaagggatgcacgatccaatacgtcgtatttgcacagtaagtaccaaaagtcgtgaccatcttcatgaaaaagagattgggagggtgacagcggttaggggtcatatgatctgagaaaaatacctggaatttcccggttgcagacgatgcacgtgttcacagtaacgttctgagcctgtctgcttctgcatctgggattttcgcagggataatatagcatcctcatgttgatgatagctccatgaggttcaagtaaagttggttgctggcgtgtccaagatgcattggaaaccgtatgcacaaacctgacatgcatatcagaatatcaacaaccatcgtgctaaatctgatcctgaacatttaacagagtcaaactgccgatcgactggcttaacgtttttgccgtatgtaaagtaacagacatactcgtgccagcgtatctggctatcaggttcatgtattctacatactttggaagctggcgaatgctattctaacgatgcatccttactggaaacgtaaggatgctgcccttgttgcacttaataattcataatctcattcgtggtattcatgatccggcaattctagaagaaattcaaaatactgcacgtgcaggaaagacatcctaactaacttctctatatatgatagaatggtgttcagaaaagtctggatctcacaaagcaccagcaactcagcgagaagcaatgcatggacgactagatcaacgcatatagagtaagagtagtaactagcacagaatgcatccatccacccacaatattccagttttaacagcatcaactgaatcctgtaggacaagatcaatttgtttgataaaatctattccgaccttttactatagataggaatagccacaagtttgttgtttgtgtcaaaaatttcaaatggtgctgttaacatggtcgaatggctgcacttgaggtttggctgtagtgctgtacaaatcatatttcaccaagttcgagcccattattagttggaataactagtttttctccttgagattaggtgagtgtgcatatgcagggattccctacgcatattttcaaatttctccattaaagtcaaattcagggtcttacatgttttttttttttaaaaaaaatggattcacagctattttaatgataagaggaagaggaagaggggaggggattgccagcagtactctttttcccagaagaatatgtgataacagaacgtgcacaagaaacaacagtccattctgagtaaatatgtccccaccagtgccactgcaaaaaggtcagaatatattagcctcacattgtgcatcatcacgggattacatcagaaaagtaattgtgtgccaacgttagcattctactattgtttgacctcatttgagctatatgaacaaagtaatagcttgcatttaaagtcaaagtatcaaatgacatatgaactgattttactcgaacaggcacctctggttagaacaatataggtcaagactctaaccttgataatagggagcgcaccttgaactaaatttttcttaacaccattaaggtcttcatgtgcagaacgacaggctggtctgaacccgtcataactctaattcccctagcaatcatggataccacatatgcatggccaatttggtctgttcaagagaagaataaatcacttcctaatgcctgttaaaggaacaacattaaatttagcctttacccaacggtatgcacatggaaagttctttagataaacagtagttacgacagcacatttgtgtttgttttttcacgtacgcgcaaaagccttgca

SEQ ID NO: 39261 - DNA, 2141 bp, Oryza sativa
cggtgaaatattcacgagagcacatttgtgaaaaaagaatcataaacagtcagaactatgaacaacattacatcagactatcatacctcgtaaaatcgaagtgccaatatattgcccaaagatggtgtccctatagtcaaacaagtccaatatgaaaaatcatcagagtatgaatcctaagacatgcacattgacactacacagagatacttaaacgactgaaccagcgattttgaatggttagatcaagtatgccgtatcaaaaaaggaaaatggttagatcaagcatctgaacaattgaaccagcgattttgaatgggtgtaaccaatcgagcgctagctctggaaactagttgacccataaaacccaccaaaacccagcggattatatatagtgaacgagctattcagtgaattccactaggcaaatccgcgtcaactccccaatcccagatcaagccgccgaagggtctcgagaaagctgatcgcctcgaatcgccacaaacgagagagccagcctgatcggaaccgaatcgtgcgaaccaggggaggctacgagttgagagatcgcacctgcgtcgccggcggaggtgagcaggaggagcaccaagcttctagaaggttcgggaaacgagagccgcgcccgagcgggggagcggcggagtggtgcgttgaggagaggagagtggcggcctggtagtactgggagggatacgacacggacttcgtctcgggctggggaagtgggccggaagctaaagcgcatctcgttgctgatttgagcccaggtttgaattgaattcatctcttgacgacagctgctgtgcttacacgtgggccttgttgggccgattggctcagtacactggaagccatggcccgcatacaccgtttttatagacacagggaataaatatatcatattcagcacagtaatccatgactagtggagtaacatactttcaattgctactgcacttgctttaacatatggactccacactgtagtatgcatctgccaccctgtatggctgtactgtatatatatctgaggggcggagacaggagtagggcagctagggctgtagccctactcctgatcctaaatatgcattgaaattccattttaaaacttcaaaaactagaagataaaggcaaaattatataaattcaactaaattgagccctatgcttgaaaaaattctggctccgccatctctgactctctgtctattagaattgtttgtaatagaggtctgactgaaagacacagtattatatggagttaggcaaataacctaacacaagtaacctaactgcaagaaaagaatcaaggtgtctgatttgttacaaacaacataaacaaatacagtacttcgtccatttcatattataggtcatttatcttttttttcaaaattctttatgtttgatcaactttatatgacaaatagcaatatctacggcaccaaatcagtttcattaaatctaacattggatatatttttgatataatatttattttgtatcgaaaatgttactatattttattataaacttggtcaaattttaaaaagtttactaagaaaaaagttaaatgacttataatatgaaacgggggagtattgatgatggatctttttgatatagtgaaatattagtgatggaaacagagcttgtttatttcattagaaaaaaatctcattaatacttggcaatgctaaatttcggtactactaatttttggtaagataattatgcgatgtttggtttaataccttatcaaattttgattgaagttttgtgagtggaaagtttcaaattttcaaaagttggtaggattgtgttgttagagtgtgtttagttcacaccaaaattggaagtttggttgaaattggaacgatgtgacggaaaagttagaagtttgtgtgtaagaaagttttgatgtgatggaaaagttagaaatttgaagaaaaactttggaactaaacacggccttagtgttataattaagtttgctatcttaccaaatgttagaaatgtcaaaatttataaatggtaaaaaagtaaacaagcccacacagggagagagagagaaggcgcagttgcaaatgttccttcccaagcttaatagagtacag

SEQ ID NO: 39262 - DNA, 35326 bp, Oryza sativa
gtgtggctgttaaccacaaggtcggaggttcaagccctccttctagcgtgtttttagaatttttttattattttgcagatttcgtgtttttaaaattttttattattttgcagataaacatctatacatatttttattcttcttcttcaaacgtgggttttaatattatttttaaaatttttattattattctgcagataaacatctatacatatttttattattcaaaattttattattctgcttcaaacgtggtttttaaaattaaatttatattattctgcagataaactattaattattctacagataaacatccattaaatttttattattctgccgataaacttttaattattctgcaaatagacctccatacatatttttattatttaaaattttattattctgcttcacacgtggtttttaaaattaaatttttattattctgcagataaacatccatacatatttttattattatgcttcaaacgtgttattttaaatttttattattctacagataaatatccatacatatttttattattctgcttcaaacgtgtttttttaatttttttattattctgcatataaatatccatacatatttttattattccgcttcattcaaaagtaccatctaaattatttattattctgcagataaacatccatacatatttttattattcattttttgttatcctgcttgaaaatatcatttaattatttattattatgcagataaccaccatatatatatatatatatatatatatatatatatatatatattatgcttcaaaatacaatctaaaaattttcatttttatgcttcattcaaaagtaccatctaattttttttgactggtcaccaggggggagcttctccccacctatattttcattgaaagataggagaagtacacagctttagattacattgtgcaaaaggggaaggaaagaattgggagtagctatatttatggcgccatatttttcaccaaaaaatagtcggtatgtatttatattgtaagtccctaaattacatatgtaattttagtgtatttacaatgtaagtcctagaattacatatgtaagttctaaaattacatatgtaaatactaaaattatatactaattacatatgtaagtggtgtgtaagtgtgatgtaacttgtataagagaagatatgagtgcaatgtttaacgctaatcaacaaacaagattagggcttgccgcaatgccgccgtgtgtgaaaacatccaacgaccagcaaatactcgcggagcaatcatacggccagcgacaccgactaaaatcagcccaaaaaactggcgacatatttttagcaattccgaaagaatttgtttccaggattctacaacgatcctgtcagcacaaataagtctctttgcccacaaagttgcatatacacctagaagctagtctatgcagagagggggattctccacggaagacaacatcgtgacggattccataattaccatctaaattcaaatttattattctgcttcaaaataccatctaaaaatttccattattttgcttcattcaaaagtaccatctaaattatttattattctgcaaataagcatccatacatatttttattttgttaccctgcttcaaaatatcatttaaattattcattattctgcagataacatccatacacatgggtggatccaacgtgggtgcagggggggctcgagcccccgtacacccacaagacccatggatacccccgaagcacccccttcaattttttcaccatgaataataaactaaaggtccctaaatgactagaggttgaaaaaactgtgtaattgagtccctcaattttttgtttctggatccgcccctgtccatacatgtatctatattttattattttgcttcaaaatatcatcttgcaaacagataacatccatatactctacactgagcattattccgtcctcaagcagctaatttattgctgctgtttatcagtccgcagtttctgaatctaagcattccctgcccaactaaactacccgtagatgatatgcactgtatatgtttttatgattgtgtatcgtatataaaaagcaagagcaagcagcataagccaagtgcgcaattaattaagctgatgatacacattaattaatttaaggctatgcgtatatatacgtgtgattcatccatccattgaattaattaatagagctgcatgcagtaatcgctcgcgtcttgcagcgcagcacaggtcgtgtcgaagctctccatctctgcgatattaatctccatgccaccgtggcctggagcttgctcagactcgaacgaggttggagcttggagcactgaaagatctagcagctgctgctggtgctgttcatcgtcatctaagaaaaagtactgctcatcacaatgttggtgatgcggcagctggatggtgaagagccgatcgtgatcgctcatgatagttggtgcaggtgagctgatgagtgactccaccaggtgatgagcaggtggcgaagaagtggctagaggttgtccattgctgttgttccccttacggaacaccctgcacagcacccagtcatccccctcctgctgctgcatattctgaatctgcatgcagagatcagtgtacatacattcagattaattagctacatatataatgcatatatatataatataattaggagtaattacatttgggtttggatgatgatgatgatggaggaggcggaactcgtgcatgacccaggcggtcttgcggccgttgggggcgcgaccggagtagaaaaccaacgtcttcctggcgccggccaccgtcggatgaaggatgggcttgtctttcccggtggccttccagtacccttgcttgctcgctctgttcctgcgccaccccgtcgcgtacttcctctccctccagctgaagaaataccactcatccgaaccaaccttcgccacctctacacatataggagtatatgccaatttcacaaagtttatcaattaattaattaattaattagtctactactgtacgtagtagattaactggtaagtattatattacctggtaggtcccatggctcgcaggcatggaggtcaacctcgacgagcatggaggtggccgccgtctgctgctgctgctgctgctgcttgttccgaaggtagtagccgactagctcctcgtcgctgggatggaacctgaaacccggaggcagcctcgactcgatcgccctcacctcaccacccatcatcatactatcatcactgatcaatccatccatggattaattcttcgatcaacaagctaccaatactatttggatgaataagtaatatatgagctcaagaattaatcgaacactacgtgcagctctgccctcggatatggtcgtatatatatacacataccaagatatacctagctataggtaagctacgtacgtacgcatgcatatccatcatgcgtgcctaacttcatacttcctccgtttctaaaaattcaacgctgttgactttttaaaatatgtttaaccgttcatcttatttaaaaattttaagtaattattaattctttttatattatttgattcattgttaaatatacttatatgtatatttcatataagttttacatatttcataaaagtttttaaataagatgaacggtcaaacatatgctaaaaagttaacggtgtcaaatatttagaaatgaagggagtatatactttgtcggtatcttattcgcagctggctggttttttatatatattggaaaattaagattcttattgatcttggaagcttgtagatagcaatcgatgcatgatgagctaattaatcaaagatgtactgtactacatgtcgttggctgttctagtctgaatcatctctacagtcatacgatgcaagctgctcgatcggtacgtacgtaatagttagctatagcataattgcattgaatgtgtgctattatcaatcacttcgtgcgtgagcgtgtatatttgcaacattaagggcgcttaaggctgttcaacgacacaaaactgactatactgcacattaatctcttcccgtcgtgatcttactggtggataaaccatctttgctcggttagccaaaatccacaatagtcccggttgcaataaaaaccgggattaaagattatctttagtcccggttcaaaagtttagagctgctttttaatctttatttttagtccaccaaccgggaaaaaagatacctactatatttagtcccggttggtgtactaaagatctatttttagtcccggttggtaaccggaacaaaagatcgtagcggagagtatgaggcatctgccatctgcgagatcgaggaggaggagacgggcagccttatctcttcacctcttcctccactgaccttatctcttcatcccatctcttcatcttcctcctcctcctctcctctaactcctctccttccctcccccataatcccttcctcttcctcctttctaactcctctccttccctccccatcatcccatcgggcggccggcggcctcgcggcggcgcggcggggcggaggcccgggcggcggcctcgtggcggcgggcggcgcgccggcggaccgcggggcctcgcggcgggcgacgcgccggcggccggcgcaacaacgcccgacagcctgtgtttttttttcttttttttaagaatttgtgattctgatctgtgtatttgatttgtgtgtgatgtccgtgaatatgtgatgtatttgtgatgaattttgtagaagttgtgatgtaattttgttttaagattttgtgatctatttgaatatggccgatttggggatatgagaattggggataatttatatttgggattttgagatggggatagagtaaaatcaatatattaaaaacacaatgaagaaaagaaaataataatagagcaaccgaatctagctagctaggctagctctatctttagtcccgcttggtgttaccatccggaactaaaaaggttctacaccaaccgggatgtatttttactctcggttttttcacccgggactaaagatagtgatcgatctttagtcccggattggtagtcccggtttgaaaaccgggactaaaaggggttacgaaccgggagtaaaacccctttctccaccagtgtctatatacgaagtctgcgtgttcctggattttttttacagcacagaattgaagaataagaaatcatgtgttttagtatatatactcaccttaactaatttctaaagattaattttcctttttctaaaaagtaatttacactagtagttaacaaagagtcaaggactgcagggtgaaaaccagtgtgttgatctgatcgaatgcccaaactgatcgaactagaggaaatgtatatacggggaatgacatgatatctatctgatgatgtattccctgttaattttgtgtgcttacatgtgcttataattggttatatattcaggcaagcgaaattaagggaggggttcgctagccttggcttcaaacgaatgcgcgcgcgatagatatctttgctgctcccgttgctgctatagctactccctccgtcccaaaataagtgcagttttacattattcacgttcaacgtttgaccgttcgtcttatttgaaatttttttatgattagtatttttattgctattagatgataaagcatgaatattactttatgtgtgactaaatatttttaaatttttcataaaatttttaaataagacagacggtcaaatattggacatggatatctacagctgtacttattttgagacggaggtagtactactcactgaattgtattgatgagtattttttttcaggttgttacgtgtgggagaatgtgttgcaatgcgacacgacggaggctgtcacaagctattagtactagtaaggatgaattttcttccctttccttatcatttctcgtcattagatgatgatgtactgtcctgtttcgccagtttcatatcatatctttatcatacttaaatgaaggcgcgttcttttatttggctgacttcattcatgatatgtacaacagcagtgcaacttaattacttttagtcagtgtaatgtgtaaacactctgaacgtacacacactagtcccaaataagtactcctgaatgtgacaaagttcagattggcagtctattttcagttcattactactatcatttccagttcatcttcatagaaaaaagtgctagctcctagctagattgttgttgtacagggaccatatcttatcttacctagtgaaaggtgaaacccttcttgcaaaagtaatatgccacgtcatcaactaaatatagaccgctcgattttctccccggatgttacaggggtcgttggattctctgaatatcttgatcatggcccttcaagaaacttccgtttatcttcagtcctcccacatccttaaaaaaaaaaaaaaaccgcctccgtgggggaatagaatgcagcaactacgtactcgtcggcgctgcggcgacctctccggccgctgaattcttgcccccgtagaaatttccccaaaataccgtatcgagctcaaatatgtgaggcctcctactgctggccatccttttcctgctcaccaacatgaaccacacggttgttgtataggtctgatatgcccttactgcttctgttatgagcctaaatggaatttgctcttctaataaatgaaaacatatcttgctgagctattgtaatatatatggactgcaaacagattctaagatgcaagaaagacaattcacacaataaaactttacagaagaagctcagtctgacagtcacaaaagtttgctccagtatgttgaatgaacagttctatactgaaacatgactagccttggttgcataattttccttcagttttattcaatactaagagacagtgcatcctacttttaattcaaaatatctacaagtgctaaatattgttctcctcttttttggcaggtcataaagctgcatgcaaagtttgagctcaaagtaacgagaaaattgactgcctccttttaaaatttcaatcatgaaaacaatgcctcgatcatcagcatctagatctttaattaatcaatcctaaatatattttactcatcattcgtaaatcatccctgattctttcttattaatcattatcaacttagtgatttcatctgcataatcatcaacttcgttgatcaagacattactgatagatcatagatctcatctgatgatgtatttccataacaaagccatcaactaactataactgttggcatcagattgacaccactttatttacgttaattttacctggcgcataatatcttcatgcacaaaacaaaaacaatagaacggttaaagtggtgcgaatgcgccacttatacgctagtatatatgtatcgaattaaggaacaattagagacggtacaggttactgtttgcttcagaaaacagcagagtacaaatctatgagtagtactccgtacttgtgtagctgatcatgcacgaatgatgagctagctatgtgttaacacaattgtacaactaactagcaaacttgtcggcagctgcaggtggtgatgcttgagcatgtgtttccatggtttttgcttctgccacggtgctactataactgacaaagttctcaactgtatgcttactacgaccgttgctgagacttgagggcttgaaagcaacaccagcggccctcaatctgtctgacatgcacactcagacaagcttatgaatcatgcatatttgccatgttcaggtggcgttgtttctccccacatatactaatactagctagctgcaaaaaccacgtcgcagttaattctgacaatataatgttgtaaatcgaaaggactgtctaattctcggttaattacttgaaaacaataaaaaaatcagttaattttttttcgaggaaccgacggtgggagtttctcctgccgaaatttatagaagaagagaactggcctagttaataagggaaaccggattcgaaaattgaataagcacggttaattaaacgggaaactggcaaaaatctataaagaaagaaaaagaaagcaactattgagacctcataaaagttgtcgttgccgagcttaccaaaggtaagcagcttcaacaacataatgaacgaggtctccagaaccaccaaacatcctctagcagggcagaaaccttctgagcgaagccttcaacaagataacaacattaagggtgctatcaacacccgttccgaaaagaacccggttttcacctgaagggagagagagagccaaaacggcgatatctccaaggagaaaacggagcccacagacgtgcatatcagttaatttttggatggtcagaaatatcctgagagatttgagcatgaacagtaaatcttatcatctctcttttttttttcctccccccacgcatgcagcgcacaacctagtgctaaccttcgaaaccctaaagtactctaacctcatcaaatcagcaccgcgccgtaggtagagaagatgacgatctacctcgctgtcattgccgccaccgctacggagtggccatcgtacgtgtttccttccctcctccttccaattccagtgctagctaggttaagggatcgaattccagtctcattcacctgcaaactagcaaatctcaaattaaaaatatgctagcaactgaggtggaagtacgtgtgttgagtccctgtcagaggatgactttgagtttagaatacattggcggtgtggagcaaggtagctcaacagtttgcatcacatatactgccatgcaatgcacatacatgaggaaagcatccatgaaagaggaaccaagcaagctgtacgtagcaagctagctagctacctagctactagtagtacaataattagttactctccatgattggatcatcgccatatatatatcccatagctagattgaccgtgactccatgacatcgaagaggaagggtgtgtttagttgacaccaaaattgaaagtttggttgaaattggaacgatgtgattgaaaagttggaagtttatatgtgtaggaaagttttgatgtgatggaaagattgaaagtttggagaaaagtttggatctaaacaagggctaaaggtagtagtgcattatctgagaagcaaaattgccccctgaacacacaagcttctgctagttataaattcatcattttaattagttacgtgcttatatatgcaagtatatgatctatcagtcctacactcctgctggtctgataacagctagctaatgtatatatataggttcatatctcatcatgtatggacaaacagtgatggactggtgtctctattaattcatgaatgctgtatatactccctagctatacatataggacaaaagcatcagtatctaggtagcacaggatgccaagatatatgtgatggtggccggcctagctagctagctgatgtatgtatataggattgctgtacatatatgatctcctgcatggcttgcattgcatgagaatttatatatactaagctctgaaactgcaatcagttggagctgtttttaattaattagtttgacgaactgagctagctgcaggtcagcggagtcgttgatgagctactccctccgtcccacaatataagagattttgagtttttgtttgtaacgtttgaccactcgtcttattcaattttttttgcaaatataaaaaacgaaaagttgtacttaaagtactgtagataataaagtaagtcacaaataaaataaataataatttcaaaaatttttgaataagacgagtggtcaaacgttgcaagcaaaaactcaaaatcccttatattatgggacggagggagtatttgatttggatacaggacttcaggagccctattaattggagacttggagtagagtacgtagctcggtagctgctgatcgagctgagtacgacgtagaagtattgttggaattaatgaatgggccttagcccactcgaagattaattctttggaaaatcacaaaagcccacctcatgggatggcatgcatgtggagtttagtaccaccttgcttattctaggagaggggacctccttaaaagggaggatgccctcctagccacttgaagcatgtgtggtggagagaagaggggaaacacgcgcgcgctcgctcgcctcgcctggcaggcggcgcgcgtgcacgacgtacgcgtcgaatggtccgaaaaattggctacgtcgaatggtccgaaaaatggctcctcacccttgcgcagatgcagcctccttttgcagttttgttttgctgcaaattcggattcgtttttgttttggaaacgttccgaaaaatccgatgcgtgcaaacggcgtggagtccggataagttacgcgcgacttatccggttcggttacgcgcagtagagatcgtgcgggcgcgtgcacgcgtcgaatggtccgaaaaattggctacgtcgaatggtccgaaaaattggctcctcacccttgcgcagatgcagcctccttttgcagttttgttttgctgcaaattcggattcgtttttgttttggaaacgttccgaaaaatccgatgcgtgcaaacggcgtggagtccggataagttacgcgcgacttatccggttcggttacgcgcagtagagatcgtgcgggcgccctgatcaagcgacccttctctatataaaccgacccgccgtcttcacgcaatacatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatcattatatgcccataatctcaacaagtataaggtcaattttagtggagagttttattttgtgtgtggttttcacgagtaccatataatctaaaaattaatgtttgaattgatgaatgaaacaaatactccctccgtcctataaaaaatcaaactaatattggatatgacgcatcctattacaacgaatctggttatacatctgtctaaattcgttgtattagaatatgtcatatacagtcctaaatttattttttttgggacagagagagtatctctagtgcacagtttcattaatttatcacttgtagcatttaattcttgaatggtgttgtgaaactatttagtcacagtagggttttatttccgttttcaagactatgatcaatgaaaattcattttattatttaattccaaagcataggtaagtgtgtaaattatcaagtactccgtatcatctagataaaactcattccttctctcttcataaatttattggccatcaatttgcctaagagtaggtctcatggtctcaatcagtttagccaacctagctagagtaaggttgtccatcatgcatggtaggagtagtatagatggagtagtggcattgattgattaatgccaatggatacatgatcgagatcgatggaggcggcggcgccggcgagacaagagtggactactattcactcgtcgtctcctcgcgcggcaattaagcacattaagcatattaattgcaatataataacaatgcggaaaaaggcctgctgcaaaatgcatgcaaatgctccattcctccatgatccaaaccaattgcacacacgtgcatgcgtgctccgttttcattacactagcttagaattaaccacccgatcaatacattactataatcaatacgttgttttttttttcgtttggtagtggaatccttttgtcagtgcatgttcatgatcagtcgttgtggcactctctggtctgatgatgtcgaacgcatgcatcaagacgagaaaggatcttgctgaccaccaatgatgcgtgtcccccagtggaacaccagaaaggtgtgtgtaacagcaacgaagggctatttggttctgaataggagggcctgtttagatctatttgaaatggcaaatggtaaaaagttttgatggtaaaagatttaacattacaaaagtattagttggtatttagatacatcttaaagttttaccattttagcactagagagagagagagagaggtggtgtggttccggagcactttttggcaaaatttgctaccatagactagcaaatgccaaataccaaattgttaacttttactactagtgtttagatctaaaatggtaaaagttttaccattttggaggatctaaacagggcctgaaaggcagtcattggaagatatttactctcaacaaatagaggccaagacggtgatctatttagcgttcctgaatatacatatcaaacacacaagatttgaaatatatccagctgaatgacaaaaatgcccaaacgaagggcacagcgttcacacaaggaatgaaatgagcagcccagcccatacataagccaattcaatgtaaagccatagcagggtcattgtaccatctcaaggtccttgaagtactcatgctcaagagcctgtctagctgtgatccttttgtttggctcgtaccgaagcattttctgacagtgaaacgagacaacgatgatatactcttcttttttgggggggtatattatgacatgctaatgaacaaaggtgagtggtgttcgacttacagagagaaggtccaaaccagcagggtcaagagtagggacaatagttgcaagagcctgggatgaagatttcagtcaaggaatatcagtggcacagtatatggatgcagttcacccgcctaataaaatctttatgctgttttgtcatacctgtgcctgccacttggggaaagcagacttgtagtcaggtaatgagctaactcctggccaactttgttcatttggagttcctagtacccttcaaaagtaaccagaacacaccacataaatcagagagttggcaaaaacacaaataacagaacaaaaaaaggtaatctcagtacgataatagaacctgaatatcttaaataattcatcaatctcagaatcaccagggaacagtggtttctggttcaccatttctgcaaagatacaaccaactgaccacatatcaactggtgtagaatactgccttgatccaagaaggatctctggagctctataccacaaggttacaacctgaaaaatacttcccatagacatccattgtgagttaatgtgctagtgtatagaaaaggtaaatgaaaaatgaactttatgacgaaaaaaaaatgtactttatgaagaaaacaaaatgttgaacacaaatctatagtacctcatgagtaaatgtgcggacaggaattccaaatgccctggctaaaccaaagtctgcaagcttcagtgtattagtacgccgatctatcaataaattctgaggtttcaaatctcgatgaagaactctatgagaatgacagtaagcaacgccgcggagtatctgatagagatatgactggcgaaagaagaaaacagtcacattccaagatgcaaccacaataaactaatacactttctggtcaagcatgaatgcaacaggaatttagacacatatttttcgcatgaacaggaatgtagacacaataatgaagaaaagcatgaaaaacttccaatcatgccaatctttactttgtttcactgtataaggcagacacttcgatcaagtaaggttgcatcaacttcatactactaagctacactattcaaaggataaaagcatgttgccacatttcatatttaagaaaatttcatcatgacttccaataccttatgaacaaagattcaaagtatatgcgatgctaatgaggacaagaaaatacaggatgagttgagaccactttgacccaaggtcccagacttgactgtcagaattgatagttctgacccaaaaaaaatagtggaaggaaataggatagtgccagttctttgtgcagtaaattctgaatagttacccaaaaacaagcatggcagcaatgattcctatatggggaacatgcagtactgagctggtagtggtggtgccacgctgccagacacttttggccatggagagcacagaagtattataaaacaatttgcttatgaactggtcctatcatgttactgataggcgaatgagaatacgaaaagcccaaccttacccaaacaatgtcagtccattgcatctctaaagttttttaaatgcacgtagccacatatatgtccaaagagcacatgcacatttttcctaaaaaatcatggcagtcacagagcagcagtccaaacatgaagagtgcatgaagtaacatacaaatgggtcctatttcccaaattgtgcattctggtttatgctaagtatcgttctagtggaatgacaaaccgggcaccttcctcctatgatatgtaacaccgcgacagaactagtcaacagtccatacaccaaatatggagagcataagatgtactgcgggttccacatacatctttgcaccaaaatcttgaataacatcggtgctgaattctttcagatgaaatgagaagatacaagactaacattttggtctatgcagccaagagtaattctttagtaaggttacttataccaccttcacattgtttccaagttataaacaaaccattgatcaataatgctcaagccaatgctttgagttcaaccatatgcagaaaagaataaaagtgagtcatgacaagatacttttgcatttagggccgctcaccttaattaaagtggggttttttgcaaactctggacaagagtccatgaacttcttcaggtccagatccagatactcaaagacaagacctatgcgcttctcactgtggataacatcgtgtaacctgcacgcagtgatagagtttatcagcaaagcaacaatgcaaatcatctcgctgccaaagtgacagcattattactacactgcacaaaactatgagtaatggtcctaaaatcaggcctagctagtgttgtagctcaatgcattgcctgcacatcaatcaatgaatcaatcagtccgtgatgactactcctaataagtgaatccaaagtcctaaacaagagcagcagagggttggttaatagagaggacctgacgatgttgcggtgatgcatctccttgaggagcgagatctcgcggatggcggtggaggggacaccctcatcctcctgctcaagccggatcttcttgagcgcgatcgtctcgttggtgaccttgtcccgcgccttgtacactaccccgtacgtgccctctccaatcttctcctcctcgtactgcaaaggtttgcaggatcaaaaccccgagtcccccaagaagaggaatcgaatcagatcgctggaagcgcttacctgctccatcaggccgtttgccgcccaatgcgacggcggcggcggcggcggcgcgagtaggtaggggaggcggagaaatgggaggaggggattaatcggaggagaggtggggaaaagcggcagcggtgggcaaagctgctgctgctgccgccattgctcgctcctcctcctctccttctcccaactcgccttgcctgcttcccctaactgcgtgcgtgactctctttgactgcgcctctcctttgctgctgccaaggtgccaacgctatccccttctctgatgccaagttgcaaaccaatcactatttccaataacgaagggatattttgggaattttttttactccggactaattttacattacgatcttaggattgttctttttttaaaacggagagagagtgccagttctttatgcagttacccataaacaagcatggcagcagtgattcctatatggggaacatgcagcactgagctggtggtggtgatgccacgtgatcagactttttggccgcagagaagccccactaacatgaaaattcgtcatgacctttgttatgggaaaactattaaaatatagggtccctgtccccgctaacatcggcagtatcggcctccatcaatccaagcacataacctttgataaatggtggacagaatggtcaaagcacttattttctatgtattagagtgctacctcatcagagtacagattggatcggcgacgattgcgaacgcgtaggagaactcggagccggccatcgatggccggggcgccatgggggtgggctcgatggccgagcgcgacctcgccaccgggatccaaggcccaaggccaccgctattgcttcccctgacaatcttgactccccctaccggtcaacctcactgtcggcatcctctcggcctcatcctgttgccatctctactgcaccttcgactcgggatcgtcgctgcctccatcggccggccgacgacctactcgccgacgcttctctgcttcctcctgacgcggcgtggataggaccatgggcggcgcggcgaggtcgcgctcggttgggcgtcgagtggcggagggagagaaaagaagaggagagaggaagagaggggaggggaagaaggggctgacatgtgggacccacgtggccccccctaaggataaaaccggagtcaaaattgccgagggatttagtttgtactggttttgtaagtcagggggttttacgatttaaggacgattttgtaattcgatgataagttgagggatcttcagtgcactttttcctttttgttcagtccattgaccaaaccgtcctcccaacccagcgcagcccagcccagcccagcggtctactagtactttatgtaattccgttccgagcagatggatcgttcggggcgggggcgagacgatggaggcggccgggaccaagcgcatgcgcaccgccgccgccgccgccgccgccgccatggtaaacctaaaccccctaccccctactggctactgctctctccctccaccttctcctgggtgattatttctgactgctagatggcgaggttgccatggcattcatccgcgcttgcgttttttccttgtattttttttttgggaaaagttttgggtgtttgttgtggggattggatccagtcgtcagctgcgttcgttgctttgatcgaaccaaggccacgcgattccgttccgatcgacttgttccatttcatctactgtctcaatcagttcagttgttaaggcgcatttgatttttgattttgggggagtcggtcgaaaatttgatggttgaatctaatctgagttttgggatggatggatggatgcgtgtagagcaacggaggagaaggagaaagagagggagaggaagagatggcgagccaggggagcgcgggagggggagcggcggcttcctccggggtcgccgtcaccatcaccaccgcgcccatgacggagacggaggacgacatggccgtcgccgaggaggaggaggtggcggcggcgtcggcggagacggaggagcacgtgcagcgcatcctcctcgccatcgacgccttcactcgccaggtccaccacctctctccattcattaatttcgccatttgtcattcatcgatcgattatgctggactggaatgcaacgcagcaggtgtcggagatgctggaggcggggcgtgcgctgttcaagaacctcgccgccgacttcgaggaccgcctctgctcgtaagaccaccatccatcacaaataataataattgaattggcttgcttgatgacaaacagcataatcaatctggtttgtttgtgaattaatttggcgcgtgcaggatccacaaggagagggtggagaggtgggaggaggagatccgggagctgcgcgcccgcgacgccgccaacgagcaggcacgctccctcctccacaacgcccagctccacctcctcgccaccgtccgccacgaccacacctgacctgcttgctccctccagctccacccaagtcaatagcagcagcagtctcatctcagttagtagtgtagtaaccaattgcacattccatcgtttacagcaagcagcagcagctgcaccacttgtgagttggtcagcgactgaaatttactactactagcactatgaatgtatgtatgaaccaatatgcatcaccattctaaaacagacagacagatgctaattcactcgatcagcatatgtgtatgcatcaaaaccggtttcacaaaccctatctacatcaatattagatggtgctatgtatgctagcacaaatttgacctgaaactgtctctgctctgtagagctctttctaggactagacgcatggcacatcgtgcagcgggtggcccttgatgttcctctccatcaccctcctggcgagggacacctgcttccccaccgcgaacacgaacgccttgccgttgcccgacgcgccgcgggccgtcctgccgacgcgccgcacgtactcactcgggtcgcgcgggtagtcgaacagcaccacgtggttcacgttcgcaaagtcgatgcctcgcgacgccctgcatgccacccaccaaatccaatcagatcatcgcttgaaaacagaatcgatttcatgcgcttcacttcaggtgatcgatgccttacctatctgtgcacaccaggaacatcgagtcagccgtctgcttgttcaggaactctttgatgttggcgattctctgttgttgatccaatgcagcatggaaggggagcactttgatctgcgaagccttcctgtccacccgcctcagcgcattctcaacctttctgcatgtctcaatctaacaccaccacaaaaaaaaaatccatctgtcagatacactgcaaactctttttggttgcagatcgtatgctggaatactggagaggaactaccttgttgcagaaaataattgttttacggacaggagattcctcgattatctttacaagtgctgatttcttgtttgagaacgccgtctccggattcttttcctcattgtcatctccactgcagtccacgagaatctgcagttcaacctctcaaatgtaaatatgtaccctccaaaaggtatctcctgggaacatttttctcaaaaatgaagaaagcaagaaatggccaacctcttcaagacgagagcttgttcggtggacgcctggtcccatgattagttcacagtccggaaatgtttcaacaaccttgttgtagatgtcgagaggaagagtggcagtgacaaagagatattgcgtggtcagtggtgcaacagtaatcaattgatgaagcacttgttcaaaactttcttcaccatataaaatatccacttcatccagcacaacactgttcataagtatgttcactcattagtttgatgtgttctcagatggaagttcaagctgcaaaatgagagaaaatgaacaacaatggcataccatctgaggttatttaattgcacaaagccttcttgaagcagatacaagaaacgaccaggtgttgcaataagtacatcaagctcttgatcaagactttctaactgtgtcttctgtcgaaatccaccagttgcaaccatagacctaaaaggtacccccgatttcgatattgaccggcagttgttaaggacctgagagattaaaaatgttccaatgagcactccagcttttcctaatttggcataaaaacaatcactgaacattggcaggatcacattcaaggtgtaaaatacctgagaagcaagctcagctgtaggcgtcagtactaccactcgtgggttcctaggagaagacctatggagcccctcaacttcttccttcctcaggttttgtactactgggcaaagatatgccaatgtcttgccagatccactttgatcaccaataatgcagcttttcccctccaagacaggtcgatatgccatcgcctgaaataatgcaacaggctagttaaggaaaagatttttaggcatagtaaggaaagctcattgttatagtgcaaggattaagtgcagacatacacagtcacttatgacaacaattcaagatgttcttcttcacaacaaaagagagtaaaagcttgagatgtctgccccaagtagagaattttgttttgaaaagttatttacctgaatatgcgatggacgagggaagccaaaacttctcagtgcacctagaatttcatcactacagccaatttccttaaaagatcttcgactgaaaaacccactatctaaagggcccttttgcctttgattctgtcgtccaaatgtaacatcagaaatgttaccccatcttttggagccagaagtagcctctgatcctggaaaatccaagtcatcagcacctctatactgcctcaagacagaattcagagaatgcgcaccacgggttttgtcgtctctagatctactgttttgccttgtgtttcttgccctatctctttcaaaataagtgccatcttcgtcagactcatcagaaggagattcactgaaccggctggtgcttatgcgaccagaatcctctctcttaaggtgagctgatctccttgctaaaactttaactttctgtgccttgagtctgccaaaatttccaatacttgtacttctcccattttctgtggtgtaaaaaaaatggcctcatttttgggaaagtgaagcagttcttactaagcaaactgagagagataacacatccatcacacaatacaggaaaatctagtgaatttcatgtctgatgacatggcatattggcatgaaggaatgcgtgttccgttgctaaaaggcgttaaaattaatctcatacccaacctgttacggccaaatgttggcataatgcaccgggaacatatttactttgaagatgaaaaatcattgtcattgcacaactgtatagtaagtggtattgaataatggaaccttttgggcggtcggggacgcgcgtggtcgtggagagcaccgcgggggagggcatgctgacgtcgtcggtgccgccccacacgatgacgctgcggccggtggcccggtcgacgaggcggtaggcgccgggggtgtccatgggcaccctctcgtagccgcgaccctcctctcctcctcctccttccgccgtggccgccgccgccgcccagctccggcgggcgccgccgcaggagagggagagggagccccggagggacgcggggtgacggaggaggagggggaggatgccggcctgagcacccgccacctccatctctcgcagcgccgccgtctccttccttcctatccgatactcgatagagcggagcggagagccggagatattgtcaagtgcggtgtttgggcttgtctgctttatgggcctgtacgggctggcctcgaccaggtcaccactctggtttaaggaatagtctactttctctcccttcttgattcccattgggtcgtttcgctcaaccgcaaaaccggttataacgtttcccacatttttaaagccggtgcaaatcgactcctttgacggttttagaggtggtctgtgctgatgtggcatattgattgtggttgactcgttgaatatagataactatgtatatatatatcacatgagttatcccccgtggggacggggagtcaagtacaaatagttttgcaaacagacctcttgaagatagccaaattagcataagctcttgaaatttactaggaagaacttctaagaaactagaaaaagcaatcaagtcctttcttctcaatcaggtgacaagctgaatgcaacggtgacacataaacaaagagtaactacatatgaaagtaacaggaagcgtatctaaaaggggcctccatttgaaggttacggcttctatgaaaaacaataaaaacgtagcttcttacattaatccaccatcgatgatggaggcttgcattcctgtagtagccttattggagatgaacaggatagtcggtgcaactttgtatgaagcaaacctgccttagttacagctgggggcgttcatggtaaatctggagaccattctatggatggatttggccgaaattgatagaaagccaccgggataacagaaatgtgacgccggcgaactcttgcactaaaaaaacatcaaaagaaaagagaaaacaaagaaaaacccctactacagaaagaacccgactacttgtaccccttctcctgtcgccgacggccggagccgccgaaatcgacggaggaaagggccgaaggaagaggaaggagtcacctttgtttcacctgaagaggagtcaccgctgttctccgctattgagcagctacgtttggagctctattagacttcaatcaaacccagtgagcccagtggccctgtgtacgtactgtgtgtactcgtgcgacaacgccatgagcccatgactttgcaagtagcgtacaacgatttgccttgcctactgacttgcattattaatgctgttgtatacaaagatttaatcgtgtttaacagtttgagaaatatgaaaataattaaaaaaaaggagctaagtaataagttagtcaagagtactgtcatgcaatgctgttgcatgcatgcgacgaaggaaacatgtatatatacctacgctgaggcggagctagaacgaaatggagggtggtgccacttgcttaatttattatacttgagatcaaatttaagttgatacgggtgtctaaatttatactaagggggtgtatatattgtgaaaatagatgaggtatagctaaaacattttcttgaccggcttcctaggcacccctaatatactctagctttgtcgctgcccacgcatatataatgtgaaattgttaatttggcaccgtacgtgtccgtacgccacgtcgtcgtcataaaactccacaagtatacagagacgcagcgagagattaccagtactccctctgtttcaaaatataagtcattctatcatttttcacattcatagtgacgttaatgaatctagacatatatatatatctagatttattaacatcaatatgaatatagaaaatgatagaattacttacattgtgaaacagaggaagtagttcccaagagcaggaacgaaattgaacgcagatttatcagagttgaattaaccaaacccggtgagccgtacgtacgtatcgatccttactgtccagtatatatagtacgtggtcctgtacgtatacgtatactcgatcgtgccacgactctaagtacgtcgtgtcatttttgcaagtatacggagtactgtacaacgatttgccttgcctaccaacttgcacatgcatgtactatactgttttttaccgcgcacattgcgccggttgcacagctgctatacgtacgattattttgcgtacgatatatacttgtacgagacgtaacgtgtgccagccaaatcccatggcattttctggccgtttctaacgaaccaacgcatactaacattcaccaccgtatgcaacgtattttcgcattatataatagagctggccgacaaatcagttgataaatgatggatttaattcgaccatgacaatttcgctgccacaattaattacctgctgtaaccgagtttgactaggaacgcatgcagatgaggaaacagtggcgatcgagctagcccgtcatgccccaccaatgccgcccatcgcgcgcggcggtcccatcggcggccggccgcaccacacaaccgtggtgtcatctgtgttcccgtcgttggtgtcaccggcgccctcgtggctctctgccgccgctaggctcgccatccatggcctactacatccttaattccgtcacttattgatgcacgcacgtcaaaccccaacgcgtggtcaccaccttagcatgcatgtgcaccgtgccgatgagctatatacttaaagttaaatggcacaatgaatgtatcatgcatgtgccatgttttcaaaaacaaccggcggtaatattatagtctccattccctaggaaatatgtatctaacaactcatattattcgatctgctcctgacgtttgttatattttagaaaaaaagtaaataattaggatgtggtgtgcactcgtatagatgggagaagcaagtaacctgcttaatctgatccattaaaatcaatcaatggcttagatcacctgaaatccactccccccctctctctctctaaactcatgcattttattgaatatagataactagatacatatcgcacgagttatcccccgtggggaccgcaagaaattgtaagtataaacagttttgcaaacagaccccttgaagataacaaaattaacataagctcttgaaactaggacgaagaacttctaataaactagaaaaagcaatcaagtcctttcttctccaccaggtgataagctggatgcaacggtgacgcataaaacaaagagtaactacagataaaagtaacaggaagcatatccaaaaggggcctccgtttggaggttgcggcttctatgaaaaacagtaacaacgtagcttctcgctgaagatccaccaccgatgatggatgatgcatcgctgtgattgccttattggagatgaacaggatagtcggagcaactttgtataaaacatacctgccttacttatagttggaggcgttcatggtaaatctgaagaccattccatggatggatttagccggaatccatagcaagccaccgggataacagaaatgtgtcgcatgcgaacttttgcactacacaaaaacatcaaaagaaaagagaagacaaagggaaaacccctactacagaaagaacccgactacttggaccctcttccccaaatcgctgatgaccggagccgtcgaaatggatggaggaattaaaggggctgaacgagcaggaaggaggagtcaccgtgcgttgttaccactccactgctctcctctattgagcagctacttttggagctctattagactacaatatcaaggccggtgagcccaatgtgtccagtggtcctgtgtactatactatgtactcgtgctacaacgtacgccacgactttgcgtacgtcgtgccatttttgcaagtacggagtactgtacaacgatttgcgttgcctactctactgacttgcacatgtactgtacgttctctttgcgcgcactgcaccatttgttgcactatacagctggcccatcgatcagctcacttgattggagtactctatttgttttagataatgatcagctcacttgataaatgatggatttaattcgatatctcgatcgtaatttacaggccacagtccgaccacgtatgctgccctcctcgcccaataatacagagacgcagcgataaaactagatatcatgctcaaattcctgttaatttggcgccgtaactccaaacagcatatagcgatagagcgatatactcgtatatatatagctctcgatctcgccggctggctggccggagatcgatcctctgtgtcgtcgccggcagtagctagctatgctcccgtacgcgacggcggcggaggcggaggcggcggtggggcggggcctgacgtgggcggaggcggcctggttccgctactcggcggccatcccggactactgcctctactgccacaacgtccccatcctcctcctcgtctacaccctcgcgccgctccccctcgcgctgctcgagctccgccgccacctgccgctgccgcacaagctgcagcccggcgtgcgccacccgccggccgccttcctccggtgctacgctgccaccgcgcgcgtgctgctcctcgccgtcgggccggtccagctggcgtcgttccctgcggtgagggcggtggggatacggacggggctgccgctgccgtcggcgggggagacggcggcgcaggtggcggtgtacctgctggtggaggactacctgggctactggatccaccgcctgctgcacacgccgtgggcctaccaccacatccaccgagtccaccacgagttcaccgcgcccatgggctacgccgccccgtacgcccactgggccgagatcctcatcctcggcttcccggccttcgccggcccagccatcgtgccgtgccacatgaccaccttctggctctggttcgtgcttcgccacctcgaggccatccacatccacagcgggtgggtactcactgtaaaaacctcgtcatcgctgtatatatttctattccctccgtttcaaaatgactattaggacgtcgtgtcagatgcagcgtggatgctgcaaaaactcaagtcttccttatctcgctggaacatcattgagaaaaggggaggggggagaatagggagagaatatgtcactaaagatcgtataagaaaatatagcccatattaaattgagacatagatcgtatttatatagctaatgaacatttactagtccttagtttatagactagtagcatttagcttaattatccgaaaactctacttgaagcaggttcaagttgccgttcgatccgaccaagtatatcccgttgtatggaggagtggagtaccatgactaccaccatttcgtgggaggacacagccagagcaacttctcttctgtcttcactttctgtgattacatctacgggactgacagagtacgcactgcactagctctacgtccaactttctctgttttagcagtaactaaacccttgcaattaaacaactttattatatatagctgacatcaaagttaactcgtgttcgtttcagggctacagataccataaggcaagcttgtcaaaggtagtagctctacaagcagtttttgagctttcacatctagcttcaattaattatccgttgtctttactagatgagaatatttgttagagcttagacaaggggaaaaaacaaacgtcgtcgttatcaattttaagttacttaaacaaccaaacttgttgctatttgtcatattcctaacgctctatctctctctctttctatttgtcctccttatggaatagctgaaggagatggcaggaaaccacgttgagaaaggagatgaaaatggattcggcaacgggaaacaagattaattagagaccaactgcaattgtaggcaggttggctcatgcagcatctgaagttttctacacagccctcacacaggaaaataatctgtgtcatgcagcatataaccaaactttgaatggaaattccctgttgtcaataacaaggttttcatcatgcccctcgcttatggaactatgcttgatcctacaattaaagatggaaattccacatgagtatgacccatgactggggcatgtagcctcggtgtaatcgatctggcccaattgagagttgagacttgtgtggatcaccactcagctagtcagctgtcattatctactgcgctcttgacctcttgccaaagcaaacactagcagtaaacaattcaaaaaataaaataaatacttgccaatgcttcatggtgggttgttgcaacattcttaaggagatctagaacataagcattgataattcaagcaacaatcacaagatttagctttcagtactacgtgtatttcgtaagtagttactgccaagtctcaggctctcagccggatatatgagctggaagatatgcgatattataacagatgtcacaacatacccgtatgtacgcacaacgaatagacaaatttcagggcacacaattacccttgcaactgagattgaacaattttgtatcagtgaatgcaggttgcaggtatatcagtttgttaataacaagaaggggtttctatttctgatatgacacacatacattctgaagtggagtataatacagtaaaacaaaccagtgattgcttttcatcattactcttttatgacctcactttggcgagcctttcccttatctgttcaagctcgtcatcgtcatcgtcatcgacggcttccgcaatagcagttctctgcacattggcgcaagttccgggtaaggtatttcagaactcagtacattatttttgaaacacgcagagatatggaagaatccctagaattgcaaaatgtgaaggatatgttgaatcgttggacattacctctgcaggttcacttgttgaaggttgcttcatcttctccttttccttcctgacagcgtctggaagctcagaggcagtctccccagcaattgcagagaggaccttgtcaacctcctcttcaatctcctcctcaatgtcctcattgtccagcgctgaatccacagcatcgttcaccatttcttccattacaccagcctacaccacagcaatcaggaagtaagaactagtatgggcatacaggacaagaaaaacctttggaagagatgtgatcatttcataatccataccttggtcatctctttgctgaattcctgcatggtggcagccacctctggtgctttcataaggttattgacaagtttcatcacctcagtactcttggataaatggccaacagtcctggcagtagctgaaaggtgataggttgcaatttattgtaagtacaaacatcagtctggaagatgaaaggaatacacttacaaatgatactctacaaaatgtaatatgagggggagaaatataatatgcacatatgtttttgtaacatgtactcctaaatatgctcatatgattgtattctttcctgcaaactgaaaagaagaaaaaaaaatccaaatctcagtggaattcctgcttccaatcacaacccaaactgatattggttcactagagcctacagcaacaagatatagcttaaccgttgtattagtaatattctcctaacttatatcaacaagggctttgctggtatgctaattttcagcaagcgcattgcaaaatgggggattggattctcaaacagttgggcataaggacgatgggtgtgtgtgaggagatataatatatgagagtgattcgttacctacgatctcgccaaagtgcatggagatggagttgagctgggccttgttctcgtagaggcggttgaccgccttcctggacctcaccacctccttggccagcgcctgaccaaaacccaacacgaatgcgcatcagcaaaccgcaaacaagtggaatcgaatcgaatggatggaagcgtaggggtaccttggccgatccgatgtcgttgcgcttggcggcctccctgatggacttctccaccttcttctcctccctctgcacatctgcgctagctccggattcaaccatcagcatcatcgctgtatggaagggcagatagatccaagagagaatggaagaatgaaaccccaacctcggatctggcgatcgatgttgcggccctcgttgcggaggcggcgctgccactcgcgaagctgctgctgcggcgtcggcttgggcttgaggaggctcttcaccgcctccatgatccctcaccggagtccagctgctctccgatcggaattcggaagcagcagacgactgcgtggggaagacgcacgcagatgctctgcttccttcttgctgggttaggccgcccagcctgggcctccattccaactcggccttcttcttatcatgggccacaaagcccactgaaattagctgtttgcctcgtttgttttagcccattattatggcccagaccgaaacttaccacaccaactcaactgtttaacggagtaacgggcacttataacctcttaaacaaattttggttagtttgcatgtagaagccagtattgaaattgagagggatattatatttgatttaatttgtcggacaatgcggccaaattagggaggttgttatgctgtatgtggcatgggtccctggccggtcaagcgccatccattcatgattgttatctagtagtgcatagtaatcaaaactgatttgctcattttccattaaaaaatatagatattctcatgtaccaaccaactgtatactaactaacatacactaacagtcagtttggcatggcgtgcatgcatgtagctcgatttcatgaaacagtgggaggacaaaattgattaattgaagctagtagccaacgcgagatatatgattcattatatatccatcgaatacgtacgtaccaacagatgcatctacaggaagctaaggtaactagaaccaccaattaatttgatttgatcgatcccctaatttttgtcctcctgcacatactgcggcagcctcgatgactggatcgtacaacctctgcattacattctgcttaattgaaggagatcaacgagaaactgatgaaagagattgataattaattaattaagctcaccggccgggcggttcgatcgatcgtcgccatatgattgcacacgtactgtactgcttgccatgcctccgacgatcgatcaatgtcgcgtccatatgcatgccatatcatgcaaacatatatatagttccctccgtcaaaaaagaaatatgattgtatcatctcctaaatatacaacgttgttaacttttacatatctctttataccattcatcttattaaaagtatttatttttgttgcaacttaattattttatcaccgaatgataaatttgtatatttatactaaatttttaagcgaactatcaacaattatcaaacgtagtattcaaaaatcagcagattcatatatttaggctagctagtcttgttagttaactttaattaggagagaggtcattgtccaaattgaaagggcgagctagcaatattagctgctaggtgccgtacatgcatgcaggtggttgcattgctactacagtacatgtggatcaaaacatgcatgcatatcagcatatgtatctgtttctgcatgcatgcttgcatggtttatgtgtttttctcagctaattatattggagcaaggaaaaggatcggatcagaccttacaaaacatgcataagttgacaaaatgttgttagttaagttagggccattggcacatgcatggtcggtctgactgaccttccatgctaattccactacttatgtcatatatatacatactcgtacatgattaatttgcattaattcatgagacccacgtcgatcttataattgatcataataaccttatgtatacatatgtgtaatcatattcagttacatatatacgtcttatctgcatatatattcagttcgcatgaaagtttgtcggtaacacgcctccaccaagatgctgctgggcgatatgagatggaccatagcttccttcgcacccgatatcatgcaacggtcgtttcccttagtctattaattgctgttaggagagtccgtcaaagctacttcctccgtttcatattataataaaactttctagcattacacacatatatgtgtacgtgagtgttaatgaatctagacacatgtatatgtgccttgattcattaatatttatatgaatatggataatgctagaaagtcttataacctaaaacggaggtagtagttaacattatccgatccataattacattacagattacttgaaaagatatcaaaggtatcatattttttaagtgtaaaacttgatatttaagtttttaacgcaaagttttcatacttacatatacaatatacttttctcaagtagtataaaatttttcagcattgaaccactagatgaatgaaggctaggtgatatgatattacagacttacagtagtacgtagtactgatatgatgcaaaccgaaaaggagatatatatatatatatatatatatatatatatatatatatatatatatatatatatatatatatcgaagggccgtgcgtacgagccagtaaccgctctcaactgtttcagtctccatcatctcctttttaattttctccgattaattcgtcaacaaagtgatcaatcgatcgatcaaaggcgcaacgaaacgagatcaatcatgcatgctttgacactgactgctgcacgatttgtaacgcaactaccctgctagctagcttggcgctgaagctaaatttagttgagagtttattgcatgatgactgcaagcatgtatacatgactctaatactcactttataattagttaatgattaatcttatatgactgaaattatatttatcgatctattccagttaagtactggcttcacgcgtgctgcaggacggtggataaagggaagacgtacgtacgtacgtacgtgtttattggatgtggcaaagtccaagatttagattagctgctttaattcagtgcttaattaagcccatggcaggttcactcctggttggtacagtacattaacatgagctgcaactaacaccgatggaaagcggatgatcaggaggaatgccctaaccgcccagcagaggcaaagtgtggtcgaaacctagccatttctgccacttctagaaaagtatattatctccgacaataacatgacgatggatgggcagaccaggccctctgaaatcaagtcatatactccctatatcctataaaaaaacgaaaattaaattagatgaaaataaatttgaatagatgcttgtccagattcgtagtaataagatgtgccacatccgctacgttgtttttttatgagacagatggagtacaacatatatacatatatatgcaaaataaattaaaacgagtattgaaagatgtccacttttttaacgaatgaattaaggggctgttcggattgtatccaaaataaaccttaccaaattttagcaagttaacaatattattaaaattttggcaagatttcttcaaagtttggcaacaaactaaatgtaggctctctttttttttgacaatattatcaaaaaatggtatggttgaaaatggcatcaatcaacagccccttaatccttgcagttgatgtatatcaattgtgttgattagttataagatgtgagatttgtgcaaattaaataattaagagctgagctaacacgggcagcccccacagtaagggaagggaaggttcatcattcattttgtgtctccacctgtgcctaacggctaatgactaacgtaatgtaagtgaccatgcatatatgcatgcatggacgattattaattaaagcaggagctacgtacctgtggttggttcttgcaagttggagagctgatcctatataaagccggcctcatgcagtgatgctgcagaccagcaggagctagtcagtagaagaagagacattatttgtaggcagcagctagaaattaaggacgattatcgatggagcagaagccaccagcagttgctgctaataataatcagctgctgctgatgatgataatggtggtggtggcgtgcagtaattatatgattagtggcgcaggagcgcagccatcgccgggatactacccgagcaagacgatccgatcgatggcgttcggcgaagggtacgacaacctgtggggcgggcagcaccagacgctgtcggcggaccagacggcgctgacggtgtggatggaccggagctccggcagcggcttcaagtccaagcgctcctaccgcaacggctacttcggcgcctccatcaaggtcccctccggctacaccgccggcgtcaacaccgccttctacgtaagatattgtcttctcgatcgtattgccggcggccggcggcccgccattgctagctgtgaattcatgaagctacttatcatatatgtgtagctgtcgaacaacgagctgtacccggggcagcacgacgagatcgacatagagctgctggggacggtgccgggggagccgtggacgctgcagacgaacgtgtacgtgcacggcaccggcgacggcgccatcatcgggagggagatgcggttccacctctggttcgaccccaccgccgacttccaccactacgccatcctctggaaccccgaccacatcgtcttcctcgtcgacgacgtccccgtccgccgttacccgcgcgccgccggcaacacattccccgaccgccagatgtgggcctacggctccatctgggacgcctccgactgggccaccgacggcggccgctacaagtccgactaccgctaccagcccttcgtctcgcgctaccgagacctcaagatcgccggctgcgaggccgccgcgccggcgagctgccagcccgtgccggcgtcgccgtcgggcgccaccggcgagctcagcgcgcagcagaaggcggccatgaggtgggcgcagcagaggtccatggtctactactactgccaggactactccaggaatcacgccaactaccccgagtgctagtggttgagccatgcatcttcagtttcacatcgtttcatgtgttgtgtgcaccacgtagtacgagcaccaacacgtatctactattaccctcatcataattattgtgtacgattggattgaggtgtgcagctgtgtcacccaaaatttcacttcgacctgcaatgcaagcatgtgttccaaaaacatctgaaaattttcatggtattggactctcggtaggttaagttccacactcaatgtaaaaccttgcttattacaggcatcaactgtcaaactgtcattgcaagcacggaattagtaagctaggaaacgacaggtgtattgcacatcatatcagtggcattactgcagttttcagaacacagggcgatggttgttaccattccacaactgctctctgctttcaggaagactgtacatagcaaaaggccctgtttctagctttcatatctacaaactatttatgttcgttagcgtttagcaaagctacaaaaaggtcagagggaaaaaagagcaaaagctagactaaaattaagtttccctcctgacatgctacctaattctgaaaacctgcaacttttccgtgctcaggtacccgagatacctccctccggatgaactttctgcataccttagatccaggaccggttgctggagggagctgagatcagaatgcatctcaaacgatggtagtcgccaggtccggaccccacgcagcgactcatctccataagcaaacagatgttggttgtttccataaggtataattgcggatttcgacatgcgaatttcgctcacaagtgtgctgcatgtcctatcttcggtgaaggatgacgagttccccgccctcctgatgaaggaatgataccctaatttccctccaccagagggtgttggtgtttgtgatagat

SEQ ID NO: 39263 - DNA, 8549 bp, Oryza sativa
aaaaaaaaacaaaaaaaaacgcctccagtaatgctgtaataggagtttaatgcctttaaactgccacttttttgcatacctgccttgaataccatcagtatcccacatgcaggggcctatagaagaggcagagagaaactttctagaaccgttgttatcaatgaccgtatggagagtatgaaccgggtgtgtagataaacccaccatagaatgcaacggtcttgaggtttgacggatatcaaagatgataagattgccattctgcagtacataagaaagcggttcatgtcaaactttgcgattacatgaacaaatcttcagatcaggagatactaaaagattaacctgcaatccagcacaaatctgacgcgaagattcatccgcagaacatgaccagccaggacactgcatggtattgtaatagagaaagcaatattattaacaggaagtattgtctgaaggtgcttcgatcaatttgtctatggatgattctaatcattttcatccaataatgcatcctcatttaagtagcagaactgcattaggctacttcatcttcactacttacaattttgtttcctttttttttttgttttctgaaaacagatacaactttcatttatcaatgttccaaacaggctaaccaagtaaggacgaaacaaacattttcactgcaaacttctcaggagtataaggatagcagggttaaataattaccggcaaatcacactgaagaacgacacggtcagccgtcatgctggattaagaatattatgcagtgttataaaaaaaatagaactaatacaaagtaacagactactaaattgaagacaaacctaaatgacgatagtttcctgcccagtgatgtaaaaatagcagagccactaggtaagatacatatgtccctgacagttttagtatccagaggaagttgtatattccgagcttcgtgatgggaaaccatgctaaactgtagacaagaattgcaataaggtgaatattgtaaaagttggtggtgataagcacaaataacatgtattcaatttggcaaagctaccgatttaaaaaatgtaccttataaagaacatgttcttgtcctatgcctggtgcttttccagaagcaagaattgtttggttaaatgcatctatggccatgactcgaagtccatccatgaagaattctttctacaaaacatggttatcaattgaaaagaatggaacacttcacttcagtgtgaaataaatgcatgcaggattcagttgcaccacaaaatattttttttttgtccaacatttgacactacaaaaattcaaggataaaacataataagctgttttattataataaactattataaatacctaaaaggtgaaaaacatagcttcccatgctatcactattgtctaattttcttaaaagaaaagaataatagcaatggctacaaaattaagtcatgcttgctatgaatttaagatttttggcaaccttccaaaaacataagatgtagatttacaagtactacttcctccagagtaatcaatcaatattgacacatattgtccattttacatgtcatagaagctgggaaggaatcatgaatcatgaaggattagagtcttatacactagagcgtgtgttctatctgtacattgtttctttgtaacctcccccctttgtttatataaaatttaaactgataggagctgcctggtagtggttccattcagaaaagaaaaattatgaatcatgaagtccccactgaactccattttagctttgaaaaattacatcatgaacttactacaggtaccatacagtatgtttcaagttagcataacatggataagtaaaatattcagtgtacacaaaatgtcaaaagcacgtcaaaggaaactagaacaaaagaataagagcaccttgaattattataacatacataagtttagaaagagaatcaacctgaaagacaaaatcgcaactgttgctagagttaaaatctgctgtgactgaggttggtggctccagatatgtagttccagccaaatgctctgccaatttcttcggtggaataaaatagtttcatgagaatgttcaggtattaaccattggaaaatttaaaattagatggcattacctgtctctttgagctaccaacgttcattaatctctgctctgacagaatctgcctctgcaaggcacacataacaagtaaatatatgaacatgattctagtgaaatgaaaattacaacataaattatctgaggccggaacaatcagtgcacacgattgccatcatttagagtttgaataggagacagcataccttctgagcacttgtcaactcaaccaatctctcattcatctcctctatcaatttctcatgtttcatcacctatcctcaatgaaaaaataaaaattgttgattccaactataaagagaaaaggagcatgcaggtgaggtgacccaaagaaattgtaccgtttccccaagggattcagctttcccccttagatacaatacttcctgaagaatgaaacagggtccggttcatgatggaagaattgtccgagagcagtaactagcaacaaaataaagtcgaaccttttccagatcattatttggaactgcaacctctggtgcatagagattggtaatgtccttaggtctgaaccttttcccacactgagggcactaaaaatcaatagcaagagacgatttggttaagcatgagaacctgtccattgtgaaaaattgttattaaaagctagtagtatgatcgattggcatacatacggttgcgctagtgttgcccttgtgcctcaaccacctctccaggcaagatcttccatagatatgcccacaaggaatacaactacacatagaatgcaccttgtcaacaatttgcatcaaaagaacattgggaagtaaagctacagtagcaactagcaaagcatacagtgcgagtatatattcttggattgatgcaaggcacatgacacgaatcgaacaaatagacaaggtctaaggcagaaatttggcctcaccagattcgatgagcgccttgggaggcccaggcctccatacaaacggggcaggcgttcttctccgcggcggcgccggaaaccctagcttgtatggccggcccgcatccctccccgatactctcctgccccggcaccacctcctccggttcgttgtcctccgactccgactcctcttcatcgctttcctcctcctcctcctcttcttcctcgtcgctgtagttaacctctacatcgaagaggtcgtcgtcgaggatctcctggatgagcggcggatgaggaggaggaaggcgccttccacgggggcgcgacgccatggcaaatcggtggcaatggcggcggaggaggagagagagcgggcaaagcaaaaccgcaacaactactcctctcttcttctcgacggaggcaggcagggcagcgaagggagagagagatgaacagcgtaaaaaggttgggctgcgtcctgcgtgccgagtgggaattcgataccacaaactcatgggccgaatctaactcggatcctcaaatacggcccactacgattgcccttcttcatttccatcttttttgtttggaaaataccttttttatttccattgatagatgagaaaacggataatatgtcactctattcgtttagatgaaaagccaatcaataaaatgcacaagataaaagccaaaatattattcactaccttgcctacagattaaaatgccactatggagggttttcagaccaaggtggccctgactagtgtgtgtggagagagagttagagggtagcggcactagaggggtgagtctagtatgcgagtattagcagacgacgaacggtttcatcagccactgttttcgagatagcctctcgttccgatttgtttcacgtgcaaagttgcaagctgggccaagccaatccacaggcttctatctgcttttcctcttctttttttttatcaggccttagccgaaccactccttggcaagcccaaaacacatttacatctacactctatacgtataaaaaagtttatacatagaaactgtaaacatatatactttatacattgaaactttgtacatgtaaattttattcatgtaaaatttgtacatacaatttaaaacaaatgcaacagtatataatctctctctaaaaaatatttatacgtaaaagagtttacacatacaaactttatacatagatatttcctgcgtatatactttgtgcatagaaagtttctacatataaaatattgcacctataaactttgcatatataaatttcaaatgaattaaaaaaatcacaaaaagtattaaacagtataaaaccttgtacatataaatatctaaattaaaaagccaaatttactgctcataaactttctattagtaaacggataaactttccattagtaaacggatgaacagaaaagaaaatcccgcgtgaaccagaaacggaaatccggatacatttgctgactcctctccccgcgaaccttcgcacattaggccactcggcactagaagccacgccctcgttgctcctctagggagccaaagagcgcgatcttcccacccccgcccgcgtgtgtcatcgctttctcctcctaccttcacccccattatctctcctgctgtcaccacctcttagcaaactctccagcgtgcgggtgacatgtggcgtgggcaacactggaggccgtgcccttgatactcctcccataagctacagagggcggagggcagtccacgcccacactgttgcttcgtcgcctcctactcctccctccaccccgtcatcccattgtcggcggccgtccagccctcaaaagtggcattttaattggtagacaatataatgagtgaaattttatcatgtacgttctactaagtggctttttatcaaaaccactcgaattgagtggcatattgtctgttttctgttgatagacaagatacaccctgaaacgaaatatcacaaaatttacagtgtttcttttaaaggaagtgcgcgtgatgatggagatcgtacttctcggatgcaaaacccatataaatatacagttttgcaataatatattatctaagtatatatagtttcgacaataatatcatttaagtataatataacttattgaagtataaattaatatgtgagtgtctgtatttataatgtgttttatataagtaataaaaacagagtaggccggaggagcgaaaatcacccaggctatagctattagccaattatagagccaaacgagaattcacttgcaagtaattttcttacatcagcgctctctacaaattaaattaacgaaccccaccacacgaagctagcaaaaacatgcttgcatatatcgatcagtagatggatgcatgagacgagctagatatggaggtttttgggagagcgcggatatgatatcatggacatccttctccaaatattgaacgagatccatggctgcaggcagctgtgtagccatcatcttcatccgctccgtcattgatagcaggaatgtcttgagacttgattcaaggctctcaaactgcctgcccaccgatttcacgagcacatccaattcttccaaatccttgccttgtttagcgatcgtcgactccatttgtgttttcagcccctcgtactcacggttgtaatactctcctacctcctgtacgtacgtgcacaacaactaattaattactctaattgattgacaatatctatatataaataaagtagtaattaataattatatggagtacttatataagtaagtaactaacattcgcatggtttttgcagcaaccgtcccatatattgattcctggcgcgtagaggttggtaatgcggtgcggctccaactcttcaccgcattgaggacactgcatgctcagtatagtcactagctgattagttgctggcaacgcacaactaattaattagtggagtagtaatcactacctttgcttgtccagtgccgcgttgaagaacatgtaccagccacttctccaggcacgatctgccgtaaacatgtccacagggaatgcaactgaaagaggaaatgcatgcagttaacatatagtattgattacttatcaaattactaattactaaaaaaaatcaaactactaattagcaatcgatcgagtagctcatcaattgagatgtgtcatgcatgcaggaacgtataatatactttctccgtttcacaatataagtcattctaacattttctatatttatattgatattaatgaatctagatagatatatatatgtctagattcattaacatctatacgaatatgagaaatgctagaatgacttacattgtgaaacggagggagtataccagatgcgatggtcgccattgcaggtccagggttgcagacaaatgctgcaggtcggcgcctcctcctcctgctgctgctgctgctgatcatcaacttcttcaaccagctgcgtcgtagcagcttgttggccgacgagtcgccgccgcttgtgacgacgaagaccatgtccctcctccatcgtcgccgtcgccgccgtctcgtccttctgctgctccgcctccatccacggcggcgacggcatatcgtttcggactccaacaacttagagagagagagaggacaagttgttttttttgccctccgatccgttcaataatacactacttggaagctgcaagcaaagtactcctatatgatagcttaatttgctgtctctaattacttttcttcctttgacagcaaattgattaaggttaccgtactgtgtgtattagattagagagaagatgattacattccgaataggtttacattttcgacctctatatctatacaaatacaaatatacgagttcgtttcggtaactacgtatggatgatgctttgctaattaaggcttcgttttgataatgggtcggattttttttaataaacgtatgtgtaaaagttaattgcgtcgtctatgtagtatctacgtatattcattaaacgggccgagttttctttcgacgaagaagataactactacatcgtgggctcaaatctatctcggcccatcaaacacagagtgccatcgctcacacggccggcggcggcggcgatggcgaggggcgtctcctacgtttccgcggcgcagctcgtccccatgctccgggacccccggatcgccgtcgtcgatgtcaggtacccatgctgccgatcgctgtgcgcctgctttccagtgctgacttgacttggttttggggttaattccttgggcggaagggacgaagagaggatctacgacgcgcacatcgccggctcgcatcattacgccagcgacagcttcggggagcggctgccggagctggcccaggccaccaagggcaaggaaaccctcgtcttccactgtgccctcagcaaggttcactactctcctctcttttcttttcttttgttttttcttcatttcgtattattcaacatcacttgtaagcaatctgcggctcagcatcaggtggcttcgtatctcacaaaatgttccattgccatgcaaccacccacttgagcttcacaagcctgtggttgaacttgtcttcatgaactctctgatttagttagagcggacatcaaagggcttggaaactcaagtcctcaagttatcttttgttgcttgcttgctttccatttgaacaactctaatttatctcttgcacattctgtttctcttgaacaaacagtatatcctttcctcctctgttgatctcctgtttgtagcagcaagtggcatgaggatggtttttatttccctctttctgggttgcaactatatactcctttcaaaatgtttgataccgttgactttttagcacatgtttaaccattcgtcttattcaaaaaaaaattgtgaaatatgtaaaactatatgagtacatgaaagtatattcaacaatgaatcaaatgatatgaaaagaataaataattacttaaattttttgaataagacgaatggtcaaacacgtactaaaaagtcaacggtgtcaaacattttgaaacggagggagtagtaataaatactcataaaacgctggtgtggatgtattgggttctaatacagatgtttcatccttatctcctagccaaaacagtaatctagccatttaaatattctacctgagttcctgcaatagttttccacaggtaggtaaaaatcttgcatatcagtgtattaagcaggaaaagagctgcaatttttcatcataaaacaatatgatgtactcttaactatgcttcttggtaaatgcacttacggttgtccagcaatggaaatgcaataagaaacctaaaccaagccatatgtgctatgtttcctcctatattcggattttggtcaattgtgttctttcataccaaaatttaagacacttccactgtttttttttcttttggaaacctgcaggtgcgtggcccatcttgtgcgcaaatgtatctggactatttgtcagaggct

SEQ ID NO: 39264 - DNA, 10488 bp, Oryza sativa
ctccttgcaagggtgtgtgctcttgagtatccatatgaaactatgcatttacctgtgcatttcaaatttggttgctacctgcagacttcagggtagccatttatgctttatggtcactacagcacattaaaaaccgtgtatctcactttggtggatccgcaattgtgctattatgtggctctatcaattcagtggccgttaatgtcacttcacgacatgtaaactgaaaaccacattggtaattattgaaaatcttctgcttccgttccaaataatcattctatggtcaatccatgtcgtgtcttttagctgaagttgtactgaattttgtgttcccttcggtatactggactcatttttctatcacaaatctttcatttgtaacacttgtttcagttactcgttgacttgaattccttttcctggctacaatggacgaatgttcattcagggttcagactagtgtcactttctgcttcattttattttgaccacaactttgcttgcttgaatcgggcaacttcattgctctgatatagatatcgctcgcatgaagttgagggatttctcactggctgggaatagttgtatgcactgttattgcgcaagacttagtttgttactatcgtgattaagagttctcttgctcagaattcggcgaggtgttcaagcagtaatgctttatacttctctctgataagggaagaaactttgtagaatccaacagtatgttgaaatagaagggatcacatacagcaaaagtatccaatcatcagctttgtttggacctgagaggcagttatccggtgttgttcattgccgatttgcaggtgtgttttgcaactcagttgtgactaaaaactgtagactgtataaaggctgagaggaaggaggatcgcgacacagatttcacattttcaggttattgtctgctctgagtttagcaaaagaaatttgtgcctttttgctacatggttttatgtggttattgccaatgaaaaattggaattatcaaatcatgagacacgaagcgcgtgcctttgtgcctaccgattttctttccccgatcccaatcgttttctttggcccagcttgtccaaacaaagcgttcagacaacaatttttgagatcatgtgttgaatcagagtttagaattcttcaagtccagaattctgatgacctgctggatcccttgctatgttttgttgataccatgtgttcaaaagaacacctttctgttttaaaagaattgggtatacaatagtacaacattgcaaacatatccgaagaccttcacagatcatcgttctataacacaattttaatctctctctctctcaagaaaaaaaaaggagattcacatttctcccaataataaagaataaactaattccctgcacagagctcgccaacttgttagcctagaatgcgcttctctgattgcacattcaaattacttagtcaattgccaactacacagttcaccattcaagaatatgattgaatgtgagaaactggcattctgaatttctcatggagaaggtccttgctatggatggtgtcgatcaaatattgatttgttttgtcagttgagtggcatgtgcaagctgcacgtcattgttgtcacagctgcgactgatcacatgccacatttcagcaagtagggaaagatccctcccctctgtggtcttcacctcttccatgattcaacatgcctcctttgagaacggtctagcaaaatctcaagctccctcagcacttgccatgtggcatctccttcttccatcggacggttaaaaaccagtgctttccgcttcacagggtcccacaagttcttctgtattacagttaagttggtcgctacaacatggtctagcaccatctcaagacttgcaacatccttctcagccacttgcaacgagatgtctaaccactgtagtacagaagggaacggcaggcgtatatcatcggcaattatgacaggaatgcagccaaggagaaccgactccacgagccgtgggctccatggagcccatcctagtgggcagaggcagaacaaggagcgagccatctctgatcgatagttaccataccgctttcgcttaaggtagaacttgcgattccttccgtacttttgtagcagctcagtcctcactttcctgttgaatgtaaaaggtaagagctagtaactgtgacctaatgaagtttgattttctgttcaggattcagctatccatatgtggaactgatgaaactatagtggttatggatgatacctcaacctaaggtttgtctttgaattttgccaaccagttaaagaaataacattttatattgcagaaccatgatatttattattagccctgtgtagtactgactgcttttgagctatattgttatgaacagatctagaagtctaaaatcagcaacatgcgatcggagtttttagaagacacaactaaagtgagacagaacctgaggaacacacaaacaaaaaacgatctccttgctagcccatttgggataattgctagatgaagcaaccgaaatgagggtttgcagtatatgcttacttgctgtagaagcgcccactaatgttcttggggtggacctccatcttgccccggaagaaggcaaaaatatccctttgtgccttctctggctcaggtagctcgagggccacctccggaggcacatgaggcgggattaccacatgatccgcctcctggcacacatgagtgccctgtacgccgaacgtttgtagcaggattgacctcttgaggaattccggtatgccatccgcaatagctacgtcctcctgatcaaatagattgaaatttcatttggtgggggtgttttcgttgaatcagaaggcgatcagcaaaactgtgaattctgaaacaactaagttgcattgtgagttgcgacaagtgagaacatagacgaagactttgcatagttgattcttaggcatgcaatgcaatggatggtgaacttctgtgttgaattcaatcccaacgaactaagctccattgacagcaaaagagaattttgatgcttggggtgagaaatatgttcggccaagctcaattagggcaagagccgatgcctatgaatcttcaattggcctgaatttgggatcaaagaactggattacttgccctagagctaggttggacttggcattgacccctaattcaaagtggattatcacgaacagctcctatgccatttagatagatagcaacaagaagcaagcaagcaacttgcatcttacaagctcaagaaatatcatgcatcatctagtaagtagtccgcctaacgcagacgcaaccagtggagaagagatcgaagctgaccatgggatggaagcaggcgccgaagtcgtgcgacgcgacaacacgtggtccgcgccggcggagcggttccagtagggcatctgggcccggacgaggtcgaccgcgtcggcgagcagggcgcgggcgtgcgagagcgaggggaagccgttgtcggtggagaagttgcaggagacgtagacggggacgaagaagagggtggcgtcgtcgggacgcgcggcgcggccagcgtaggccagcagcgcctcgtgcagcgcgacctcggcggcgaagaggtgggtggcgcagcgcgcgtcggcggcgacccagtggcggttgaagcgggcggggaggtcgtagacgtagatccggagggcggggcggggggtggaagtggaagggaggaaggcggggcgtgggggcggcggggtggcggagaggaagaggtagagggagagggcgaaccagaggaggaggaggaggaggaggaaggtggagtgcctcctgagcttgtcggcgacgtggtgggcggcgccgccgtggggagctgaagctgaagctctccgctgcttgggatctcctctcatggccatggccataggcggttgctgcgctgttcttgacttttagcttcagctgcctttcctttcccttcccttcccttcttctcgctaattaattgtactaactagagattataattaattaagtgagttcttagttcatgcttaattaaatactccatatataatcacaattagtactactagtatgcataattccagcctcttgtcatctttattatgtactccctccgtactcgtaaaaaaagtcgtactccctccgtactcataaagaaagttgttttggacagcgacacggtctcttgacctcttatatctataaaactatttattgaaaagtgatatatgtatacttttatgaaagtatttttcaaacaaatctattcatataactattatattttcaaactcaacaacttgagagttattcatgatttatattcataacgtttgacttaaacattatcataaacgatttcctttacgagtatggagggagtatcggataacaaatccactaccactagttattccgatgaatcttttgatcatttaacaagtcctttcaactaataaatcttaatttattatgctatcttcataatgcatcacatatattaatcttttattccacaggagtaatttagacaaaatatgtccgcggttattttggataaaattcgtccatgagttcacatcttccgaacacctattcttgttagagaatttatttggtaatctatatgtgaatttattactctagtagatttttcacatacttacatagttcattgtaacggaatacctatcatggacatatgaaattgtgccttagctatttctccctccgttttagattataagacgttttgattttggacaaagtcaaacagctttaagtttgaccaagtttgtaaaaaaaaattaatggcattttcaacccaagacaaatttattatgaaaatatatttaatttttgatttgatgaaactaatttagtattataaacattactatatttgtctataaatttagtcaaacttaaaccagtttgactttgagcaatgtcaaaacgtgttatgacttgaaacggagggagtaaatattaactttgtatgtgtttgcttgcgctatatattgcaactgttaggctgctgctggctatatcaacagtactagcagcacaaaatctactgcaagtgctacaacagttgcgctatgcagccacaaccatctcatctgaacacagccttctagcagcgttgatactttatattggttgtggctatgtagtcgtagcaactaatataactacgtgtaattcaaacttctactagaggtagtagctcaattgtgtcatcacatacaacaaataacataaaagcgtaaactttgtaagaattttgtaaggagtagttagcctttgtaaagtggtgcatccattaccaccaaatactatcacgttgtattgtctgttatcgaacatgatgtaggtagcttctctaactacatgttactactatgtaacttaagtttgttgagaggttgtgaaatggtaaagctttaaagtttaaaggcataacatatttcttttgagccatggtttttcataataaaaaaaaatcattataccattagttatatgatgtacgttcacatgacgtactgtctttatcttttcctctatcacgacacgtcacattagctacaactattgatgagcgtgttaataaggttataacattatgtgtaaacaactgcgttaataaatgaggccatgtttagatcccaccctaaaatttttcactttgtcgcattgaacatctgaacacctgtataaagtattaaatataagctaaaaaataactaattgaacatgttgcgactaatttacaagatgaatcttctaagcctaagtgctccatgatttaacaatgtggtgctacaacaaacatttgctaataatagattaattaggcttaataattttgtctcgcgatttactgacggattttgtaattagttttattagtgtctgaactccccatatgataccctgtataataaccgatgtgacacgctaatactttacacccctcttagattagatgacgagtgcacgaaaccaatttacacggacgatactgattgttttttatttttcctttctggaaaatggtaggacgagggacatgatggatgccgtcacgctcacgcgccggtgtcccaagaaaaccacgttggtgaatggtgatgaccgatgagatggagatgtgatcccgaccaacggaggaggtcgcgccagctgtcccgagcgctagccgtcggattgccgtagcgtgcatgaggcgtcgccgtccgatcacttccgtagaaggggtcaaaaaggaaaaggctaaaagtggggcccactcgatttagctaagagccaaaggtccacgtcgaaccatccccatcgcagcatcgcaactccgtggacacggcctataaaccgcccccatcacccgcgcgacacgcacacaacaccagcccactacaccgggtccacccacctcacctcacatcctcttcctctcgtctcgcccccggcccccttcttctctcctcttcgcggcgactgcgaaagccatctagtatctccttccttccttctcgactcgcctacgccaacgccaacgcgagatatttttgggctcctcggcctcggcgtcctcgctcgccgtcgcgcccgcgcgggcagggcacgggagggaagccatgaactgcctccagaacctgctcaagtaagtgagtgcggtggccgaggccccggcgcctcctcctcctccccgcttcgattcgattcgacacttgtttcgcctgttcgtcactgctggatttcctcgttttcgcccagggagcctccaatcgtgggatccaggtccatgaggcggccctcgccgctcaatctggtgacccctcttccattccattccattcacgtccttgttttttcccctattattgatggatcggctcccttatttgttcctctttttgatgtccatgatgactagacgatggttcgtggcgggagtcgccgatcaaacactgtcaaaaccgtaagcattcccttcacctgcatatgaattgatctacccgagattagaggcagttaactcgtcaaatccccgacaataataattatcatatgatagaatccgctgcagtgcagcctgcatgtttcaccccattgtgtaaaccttgtcctgtaaacattccaggcatccggggcgtctacttctagcgccgagagtggcgcagtggaggcgggcacggagaaatccgatacgtacagcaccaacatgacgcaagctatgggagcaggtaaagacccattatgccttacctgcaatcaatactacatgttagctgtaccacgacttgtcggattgtactcgacctgctgctcgctgactttaatggttccttacccagatgataaatggggaaatgcactaacatcatgtagatgtcaccatcaaagtgttgtgccaccggtgtgtttttgtgtctgtcggtgcaaactcacatgcttgttttacttactccctccgtttcacaatataagtcattctagcatttcctacattcatattgatggtaatgaatctagacatatatacctatctagattcattaccatcaatatgaatgtgagaaatgttataatgacttacattgtgaaatggaggaagtagcatttatgtgtcatttttctccattcctcatgaacaagtcacgacgcattcacaattttttttcttactcttaccttccccttcttccaacaattgaccttgcagagggtgcattagtcatgtgtacaaacattgttctgccactgatttttatcttaaaagtattcttgcttgtccattgtcttaagattttcatacaactttatagtttacaccgaacagttgaaatattatttctttgaggacaatggttgtgaccatatttatggacaggcttgtactattcactaagcttttactggattactgtctatcattgatcactcctgagatcatttcctttttttctaaatcatttctagtgttgacgtatagacatgagcttggaatgaactacaatttcatacgcccagacttgatcgtgggctcctgcttacaggttctcaaatatcatctatctcaaccaatttacagaaggaaaaaaaaacacttcttaactctgtctgattagctgcattcatgtgcagagcccacttgatgttgataaacttagggacattggtgtaaaaacagtattctgcctgcagcaagatccagaccttgagtatccctattattgatttttttttctcatcatgcttataaaaagaaaggagcatgccaattatgttgcctggtttagagaatttgagcctcttgattcttgaaatgtatgctgtcacttactgtgaatcacaccaactatatcgaagagaattataaaattctggtgatggctttttatcaaaataactattggaatagggagtgcttttatgtcagcatgccttcttcctaattatgttactgtgctattggacaataaccataattctattgaacaattacatttgctcctcacttccctgctactgtacttcttctgcagctatgatattcagcacaatgcatattgtacatctcataaaaatagttctattttatactgacagcatagttgcttgttgtttccattgctgcccaatgtgttctttcagtgaatagttgtattccatccttaaccagttcagatattttggagttgacatctgtgccattcaagaatattgtctacaatgtaaagatatagagcactgtcgtgccgaaattaggtacctaaagttctataacttcgttttactttgagaaactaagaattttggtgatttggtgtagtctatgtcaaatgcaatagaaatccctttattttcattaataatgtctacaagatggcatgatctgaacgtctatctcttttcccccttctctttccaattataattcctatgctcttctatttttggaatagatgattcatctttccttgaatcagcatttatttgtcaaatgtaacttttcctgcattgacttgaatgccttttccattgtctgttctgtccatattttcaaagtcttaaagtggcataatgtttaattacaccagggattttgatgcttttgatttgcgattgaggcttcctgctgtgattagcaaactgcacaagcttgtcaaccataatggtggggtaacatatatacactgtaccgctggacttgggagagctcctgctgtgacagtaggtttccatggtcttttcttttttgtttcccaagaattcttataataggtttaggtttacattataatattgtcttcttctttcctgttcagttagttgttggcccacccacaaaaagggaagaaaaatggaaaacacatatatacattcccaaataatgaacattaactagtgtctagtgagtcctagactataacataatcatcacaggtatagtcggtaaattgttctatttgcacaatgttatagtacttaaataatccaatagtatcacaactgactttcactctcatgatattgctgatgcctgtccaagtttcacgctggattgatgattatagtatcaggatcctctatgatttgatggtgtccattatcttgagagcagcaatattctgatcctgataccattatataaattttcagttggcgtatatgttctggattcttggctacagtcttaatgaagggcatcagctactacaggtatcttatactgtttagaacagtacaaaacaatgtgtgtgggaaaataattttgtttttataatttgtgtgcactggtaataccaatggataccaacaggttgcctgtgtgtacatctctcacaactatcttacaaagtaaagtctgttggtggtctggtgtcctgttaccacattgctactagttatgttactatgctacttgcttcccctgaacatatgtttcttctgcagagtaaacgagcttgctttccaaagttggaagccattaaattggctactgctgacattgtaagtgaacactcaccaatatttctttttttttccctcagtgtgtagttatgatggttaagataaaaggcactgcttgtacaattttgtgctaagtgatgactctcttaatgtttagctgacaggcttatcaaagaattccatcactttgaagtgggaaagtgatagttgttcttctgttgaaatttctgggcttgatgtcgggtggggacaggtatgcttttgtgccaactatggtagatatattaatgtcgaaaactcatccactcggtggagttttttttaaagaacttttttaagtttactttccagtgtaatagaagctaactgtggtgttagcaccttttttttttttgcagaaggcattcttaattgatttcctgtttatgatttgcatttgttctgcttactcaaataattcctttgacataca

SEQ ID NO: 39265 - DNA, 13797 bp, Oryza sativa
tttgaaccgtatttgggatatcctaatctcatatgttgacactggaggcaatcgttttggtcctttccctttacagttattgatttgccatatctgttacacagttggactcgattttacagtagctaacttcacactcacttttccttatacatttgccttgtgtttcccgaaggaaggaaggtatgaatacaaatatatagtggacggcaaatgggtgtgcaatgacaatgagaagaagaccaaagcaaatgctgatggccatgtgaataactacgtccaggtgagttacttcccagctccctagttccctgtatctgtggacgtgttggataggataacgtaacttgacgtcttcattgcaggtctccagggatggtaccagcgatgaagagagagaattaagggagcgtttgactggtcaaaatcccgatcttacgaaggaggaaaggctgatgattagagagtacttggaacagtacgttgagcgatagaggtaagttgaaatttattcagactactagtattgtgttgcaggggttttgctgattatgcttatgcatgaacatatcattcggattggactgcactaatctgcagaattgacattggattatcgactcgttttgggctcgctgtgcaacagggaagacctgctgatgatcaacaacagatcatggagcttcccgatgaacagagtagacggagcttccaaatgttatcatcttgggtcgccatgtcaatactattaattaattagttcaaatcaaccctgtaaatggtttactcatgagtaatcacgagtcgtcgctgtaaacaaacgatgcataagacgagcaatatgcgtttgctcatagtaacactgtggccgtataacaaggtagaattaataaggctgttagactgtaataagggctgttaattaacataacaggttacaaagttgtgtaacatatatgttattaatgctgactcgtgaatggaagacaaattaattttgtttgggacagttgctcccgaagtgatgaggtcggtctctgggtctcccatgatgattgatgaccagaattgaaccactttgttgggttaggtcgtcccccgcaacctaatccacagctggagtagcatcaggtttggtggtgtgcaatccaccaggttgaaatgctgctgaaatgcaaaaggtccagactaggttgagtgcaagtcaaccgtcaaagtcatccgttcttggctgcctcaccgccaccggggccccctcccagtttgaagtcaaagctggctggctggctggggagtctatgttgaccgggccgaaaggggtaaaaggaagtaattttgacagtgtaataatgaattggaaatggaatggggacgcccaagatttggtcttaagaagggaagtagtccaattaatagtaataattttatcattagacaggagtatactacataagtgtaagcaaattaagcttttgattcattgtacaactaaatcattttgagcatacatactgactgaaatcactgctcgatcttacgtgaagcttggcttgattgctgatacatacatacatacaaatacaacactgcagctcgtggcggtaacgattactcctagactaaaatcctactactactaatcctagtagtaagaggaaattaaagcgaaaagagattgattatccaaagaagaagaagaagaagcatttagtatataatagtactagtatgcactcggatgaatgaagttgaagtgcagtgaggtcaggtatgggtgggcttgttggtttggaggtgaaggttggcattattggtgatggggcggaagaggcgctccagctcgtcgagacgcaggctgatggccttccccttcccctgctgctgagctgggtcgaagaggagcttcctgcaggccaccggcctgggcttccggggcgccggcgggcaggtggctggctccctgattcccggcgttggcgtccggcagcagctgtactcgtcgacctccgtggtactggtaccggcggcgcaggagggcgagaaggccggcggcgagggcctgtagaactcgggcgaggcggacatagctggagcctggagggtggagagggaggatggattggagtgtgagaagggaggaaaaggggaaggtggaggaggtatttgtagaggggaatggcggtgcgggcgtgtgaaatgtgatgggaaatggagaagacgcgtgcagtgcaccggaaggaaggaaggaaggaaggaaggaaaccgagagaccccactcctcatgggcggaaacccacctgacccacagcttcctcttcttcttcttccctagcaaggaaaggaagcagaaggtaaagtaagcaaggaggaacttttcagcagctaacaccctttttttcctcccattaagatacaaattttatcttaatttatgttagcatcttttctaaattgctaaaaagtgtattttgtaaaaaacaactttttatataaaagttactaaaaggtgtcctgccaacatgcttgtctcctctcattctctccctctctcagaaaacaaaataaccctatgagtacatagtaaaaaaatggtgtggtgtggtgttggattggatgtaggtccagctaagcttctcatgctggacaagaagataagctcacagacacaaaaaatgacccacggcacctcaccgacgatcgatctcacttgtcagcgaacctgtgtgttttgccctgcaacctgcaaactgggcctcgccgtctgtctatctgctttcctgtagtaggaaggaggaagctgcatgcttcctcctcaattattgcacgtttatttattatatgatgactgcattcacaaaaccatctgctgctttgcatcccatgctcatgtaggactaacccatctggaggtgtactaatgatagtgtatcactattgttagtattattattcggtgcaggaaaatgccacaaactacatgttacggagcactacagtttagcgagcggcagttaaattaataatcaatcaatttaggtgcggtgcggggggcgacaatcgcaagtatacaggcggccggctttatttgtctttctcatcgacaaccactgtactttgcctaatcctgccagatactccactgtactagagtatcatcctcgttcgcttggcttgggttgggacacctgcacctgccaatttttcatcaatcattaaccatttaatcacacctaaatactccttcctttattttttactcattccacacgtactaatacaaaataaaatatatatatattctatcaaatcccaatacagtaatttctcaaatatatataaaatatactcaagctgtttattaacttgcagctctttttttttataatgaaatagaatatcctggcctttactcaacgagttacaaccaattattacaacgtaacacacaaaaataaaaaggttgacacacaaaaaagaggacaccaactgtgaagaaaaagcaaactaaagactaccaaccaaagataaagagtacacaattattgaattctgtttgtaaatctctatctaaaattgataaacagttacataaccgttgcattaagattacgacataactactccctctcagcgtgtctgttgtgttgagccagctaagtaccaggagggtaccagccaaacctgataattccaatcggcttcgtttctccgccgttgattacttgtgtttgtgcatcgggatcggaacgcgacatccccaccaacgtgggacgcctgatgaggttaatagaaaaagaacagaaattggtttccaaacgggatttcattacaccaaccgtgcgcataaaatgaaaatactactaaagagtatctccataattaattaagatatactcccagataaagaaggcaaacaaaaaaaaagtagtaataataatccaggaacgggataaccggagcggtgcgcgtgaaagaaaaggaaaagaaaatgtgaaaaacgcaaggaatcccggagcgggattgcggcaagcgtgcgcggaattttttattttttttattttttgcttgcttgcgtggaggggaggacgctttcttcttctttttggctgtgtttagttcagcacaaagtttagattttggttgaagttaaagatgatgtgactgaaaagttatgtgtgtataacaggttaatgtgatgaaaaaggactgaagtttgtatttaaactttatgggtggacagacagaacaatatacagtgcactaatgtgcaggccagcaaacatgcataaattttgacatcatctttctctttcctctgatgagcagaggctatgcttgaatgcttaacgctaagctgaccaataatgaaggcaataaaatgaaatgaaaatcaagcagcagttgctgctgcaagtctgctcaactcagataacacttgcactagcaaagcttcttctagtgacagtgacagacatggaaaaagttgctaatccattgagtactctactaccatggtaaaggggacaaacagataatccatactctcatcactataaacaaggggcgtttgcctggtgcaagacgtctcttctacctgttccgtggaactgtggggttcctcttgtgcttatctttcattcttccttttgatttagtaacaaaccatggaaatctgaatttacatcaccataacacctcaatttgatctaaaacttaacaacaaagcacaaatgctaaataattaccctgagctcaaaaattcaaactacaaactaataatgctctcaggagcagattcggacatagatacaggaacatacaagcaggctcactcacaacatgcgaagactactcctgaagaaaagatcaaatctgcagacgaagtcgatcaccgtgtgtccctggagcggctggcaacatgcctgagcagtgcctgccctgactgatgcgcgaaatgcttctgcctcagctgcacgtacgggtagcagaggctggacaggatgtgtgctggcttcgagaaggacatcacctcgtaccacacctgatcgtcttcgtccagctgcaccgagaacctctcctcccctgcctgcaaaccatcaaaatatgatcatccaactcattcagtaaaaaaacacctgcaactctgcactgcattctgaacattttacattactgagtagtgagtactacaatgtttcattgttacttgatgagattaggaggcaggcgtaccagcagatggccttgtagagtgccgctaccataagcaaaaacgcagccttttccatggcctgaggagttgcctccattgccatcggtcacataggcaatctggaggggcaacatgacccaagggatcagctccttgtaacaaatgcagaaccttgttccagccttcaccggtgtgtcgggttccacatttgcccagcctagtgccaaatgcctagatatacaccagtttgcttggttatggagaccagatgaacaacataacaaaatttgtagttcttgggctttacttccaggagagaagcgcggatttggcatggttgaaggtggtagtgccagagccaaccagaacacgtgaacggttcacgaagaagccgcgctcgacaagcgctttgtcacttgcttcagtatctcccgcagtcaatttagctactgattttggtcttgaggcaccatggagaggcgcatcatagttgaaaccaccagcagctgaaaggcatgacttctgttggtcctgtgagggacggctgaagctcaagaagagacctccccatgccatggatttctcgctgcaatgccttattatttccgaattaaagatcataatgtgggcaatgaaacggtaatatggatatttattttgcatggcatggggagtagtagtgatgacatctccattactgatgacaaaatgagtgctagtatgtgtgaatggagcattctatttctctcctaaaattaagtaaacacactatacatactattttatgcatgggaaatgaggtttgattctgaaatggtacccaccaccaccaagacctcgacacaggggcggatccaacttgggacatgggggttcagttgaacccccaaacttttgggtgaacaaacaaactgttattacttgaattatttatttaagagaggtttaaggctatcaaattaaggaggaggagaagatctagaagagaagctagtagggtttacgaacgcaatcccgcaaattccagtcccggtggggtgggagagagagagagagatgaatcagaaagaagacgcaccaggatcccctcccctccgctgcgatggagatcgccgcccggccctcccttgttcagccgccactcgtcttggcggcggcgcaaggaggcaaggagcggaggagacaacgagaggtttctttttgagaaaattcgatctatagcatagaaaacaagtcggtaaccaaaaaatagcatggaaacttcccgctttcgactagaagcattggccacttgtttttcttcgatcggtagcacttccgtcactgctgctgctcagatcaagtgtttagccgtgagttcgtacggagaaagaccgatttgcccttggttctatctgtatagcattcgtgactggtttggccgtgagaagaggcatcacactcagcggaaaaatgacaacaactgctgctggtttgcgcgaccatgaggacggatggcgtgacggccgacacaaaccacaacctactctaaccggatccaagaaccacgcaaaaccgaagccttggcgcaaaggttcctgaacacgaaccacatccaacatcatccgggaagcaaaatcaaagaaaacaaatcaaagtcagtagagaagaatctcactgtccaataatccacccagggaccacgaccacgtacgaaatcggcattggaactctcaaatccggggcgcacgatatcgctgcggcagcagaccagactgcccctgatccgccgtggctggggtgggaactggagctctagggtgcgagcgattccagcaaggggtattgctctagggtttggattgattggtgaagcggggaggagaagagacggtgacagatggtggtttgtttggtacagcggcatgcgacgagcagaggggatcgagacaacggcgggcggaggggagacgatggtggagcgctgcttgctcgacgctcgcggccgggctcgcgccttgctcgtgacggggaggaaattgggtttggggagtgagtggagatggggatgagaaggaaggagatgagctgggcaaattagtccgacatgaaatttctttacgctagaactaacaccgtttgctcaaaatgtgacggaagtgctacggatcgaagaaaaatagatgacatgtgcttctaatcgaaagtgtaaactttatgtgctattttttggtacctgcttgttttctgtgctatagatcgaattttctctttctttttctttatctcaagtagcgatactccgcccttatctccatatttttatttaccgctccctccgtcccaaattaagtgtagttttttattacggtttacatccggcgtttaacttttttttatttaaaattttttatgattagtatttttattgttattagatgataaaacatgaataatattttacgtgtgactaatttattttaattttttcataaacttttcaaagacggacggtcaaaagttttgacacttattttagggcaagctaatattttaaaagctatttctttatataactggtgacccacgcatcatcaatacttaggaaaaaaattaaaagattgtgtcgacgacaaattcctcataccacctgcaactgctaactgtcactctacgcaccgccatcaccgctctttctccatgagctaccatcgttcctcccctttgccttacatgcgcagccttaacctctagtaaccgacaagtctttttctcctcccctatcatgatgcacactattgttatgattgcaattgaggtcggagatgtcgggcttgcagggactttggaaggcaggagctgacccgacgaagagcgaaggcgctatatccgggctctttcttgctagatctatcggttatccaactgtcagatgaaagaagaaaatggagagagagagagagagttaatgtgcgacgtgattactgagtcaccggacttggagatggataaaatatggtggtccaaattaaaatgtaaagttagctattgtgtaaatgaaaatggttaaaggacaacattatatgaaaatttgtaagaattttttagaatacatagtatggattgtaatttactccttttgttccaaaaaaacgaatgtagaactggtgtggcacattctagtacaacaaatctgaacatatgcatgtctagattcgttttactaggatgtgtcacatccagtcctaagttggttttttatgggacgaagggagtactttttttttctagcacaattaaagataattgtccattacctgatagtctcgtgatatgctaagtatgatattttttctctagcacaattaaagataattgtccattacccgatagtctcgtgatatgctaagtatgattacgccggtgtacttagctataactaataatctcatgatatgttgatgcatgacgatacatgcttctactaacacgggctgattaactatatttagatagattcctctaaaagatgataaaaataataccatcatttttgctcaataataaagcatttgactatggtcttcttttctcattgtattatatatgataactacattagtacgtatttccgtaattctttcatattgttttttattttctacatatatgttgatttggactaatatatttctcataattaaatagataatacatcatttttccatagttctcctataaaatgagaatagggcattttataatttgaaaattatattataagtgtatgtaatttaatgtgtaagatatggacttatagtataagatttaactttttctaaaaatgcagcttcatagtagataggtagttaactgaacaaccataaaaaacagagacaatccactgtgagtcactgattttgtccttactctacaatatgtcattgggtttgtcaagttctaatatggcatcgtattttgcttaacttctatagtataccatcgtcgtctagttagcctccgttagcattgtacaattttatcacacagattgtaaaacttaaagagtttgagatgggcaacttctctacctagtttataatatgatatttcggaattttcggccaaattttggaaatttttgtcctagggatatttcaatcattaggacaaaattatacagtactaacggaatctaaatggatggcgatggtatattatagaatttaagcaaaatacaatgacatgctgtagaacttaataaactcaatggcatattatagaacaagaacaaagtcagcggcacacgatggattctctctaaaaataatctagttaaattgtttcttttttatccaaaataaaacatcttttacctaaatacgttcagagaacttcgaaagaagtaagaaaaagagtaggttagtcactagcccaaacacatgagggtggttgctcacatccatggtatggtatatagtcacattaatcgataatatactaatattattaaaattgttctttgcagtgaatggtgtgaaactaaaaactttaaacttatattcttctgttgttccatcttcttctttttttctcattcttatttattttttataataatattgctacatacaacacaacactattacttgcacaagaatactaagcagctagctcatgtgtgtgtgctccgtaatatatattacctatgtttttacatgaggaataataactattatctttgttaatgatattgtatttataaaaggtacctggctagtttttttaagagaaagatatttttgctaaatataatctagaatgctataaaggttaataatattaaacgatatagtcatataattttttttggataaactagtgatcaacacttgttatgaatctaatgatcataatgcactatatatattgttcaagtgagttgtgatattcactatttactagttacatgcctatgcattacaatgagatctacaaataaaaataagatttagtttatttctaatctggtttttatgatgtattggatttttttacatttctttagaaataatattgtataacaattaaatattttattgttttataaacaaattagtttatcgtacacccatctataacatcatacgtctgtcactgcctcgacagatagattatgaggcatttataatactatcaaggcactaattatgtattttcgaaaaaggaagaaaaaataggtggaatataaatcaacatttgggcagaattagagggcagatggatatacgatacgggtgtaaacaagggtgtaaatttgaggagtgaaaatgtaatcagtggtgcgatatgtgcgatgggccgatggcaggtagggccgtagggggcagggcatcaaattatttaataggaagagaaaagaaaagggatggatggagtgacttgagtagccaaatgtgtttgaactgaactaaactgaaatggatatacttgtagttatacataagagaatatacttgtagttatacataagagagactagagacaagagtaatcaacgttgaagagaaagattaaagaggatgaggagtaaggccggacaaaataagaaaggagctaatctaatctagatagggagatgcacatacaggatatattgcggcggctagcacagatcgaagaggacggcgccctgtcctgtcctgtgggagaccagcgcggcctgtgggagaccggcgcggcggcggcggtggcggccctccctcccctaaatttctcggtgaggtgaggtgctattgctgcatgcccttttgtgcttgattgcctaaatttctcggtgaggtaaggtgctactgctgaatgtcttttgtgcttgattgaggaaggaaggcacacttgggcctccactccatttgaagcccatggcccatctctgtgctcagcctcggccccactgctgatctatcccattccggccgggcaccggcgacgacgatgcagctgtactccgccaatctccgcacttggattcttgcttgctactgccatcaccctacccttccagcttctagtacttagtatagtattccattccggccgggcgccggcgacggcgatgcagctgtactccgccgatctccgcacttggattcttgcttgctactgccatcaccctacccttccagcttctagtacttagtatagtattctggtatcatttttttttcggaatatgcaaggagcgcatctttgtattaagaggagtaaaagtctgtacaggtgaaagagaaaaacagaaggagacgtgattacaggaagtcacccaagaacattaaaccctaatctcgcggcacaatgttgcgacctaagtgccctaaaggcatggccggcatggcagtattggcgagccgccacagcgctgcctcttccgccattgcccttgccacttctgtccagtttctctgcttttggttgaacaccctgttattccgttccttccaaattatccatgctgttagtgtagtaatggtatcgaacccgcgccgttgagagctggagaaggtttccctcttgtcacacaaccaggaatggaatgagatttcattgacgggtaagcattccgggtgactgatggccgaaagcaatagccaccagagttatcttgattctgggcatgcgaccaaaatgtgattgatgctttcctcatgctgatcgcataagacacacatgctggggtgaggcaagcctctgatgcttaaccagtctgccgtccagcagcggttgagtgcgactagccaaataaagtagcggcatcgcagcggccccagtgatttccaaatcagcgtagattggaatgggattcgaccgaggaacaatgcttggtaggcagagtgataggagtagaggcccgaactctcccccttccagataaattgattccgccgatctgagagctctatcttccgcaacaacgaccagagattgagatactctacgatggcctgcaattcgagggttcctcgtatatcgtggatccaagtcctgctgagtagcccctctgctaccgttcttcgtcgtcgggttcgcttgggaacgtgatcatagagtgccggcgctagtgagcggatacaggatccatctagccaccggtcttcctagaaaagagccgtcgtgccatcaccgatctggcaagccatagatgcagctacgaaactctgttctttcggagaacatgggatggaaaggccttgccaaggcttctcctaggaagtgcgatgcgaccatatccacttagatcgaagagcaatccccatgctcctcgcattctggtatcatcctcttctagtacgacttctctcactcttttattcatgtagccatgtaggatcaacttactactaattgctacactacacatctatctacggactactatacttgattccaaacattccttgcatatacacttttccatctcataatgctatcttatttatgtgtacgttcataggtgtgagtgtgcgcacattgtgagtgcctgcgtttgtactgtgtttctaaaaaaaaaggaatcgaattaaattgacacacaggagtgctacaagtacacaaaacgcacatactgctaatgatccatccatccatccctccatctcggatcacttttttttcattaattgcgagcctacttactggattcaaagttgttcgatcctgcctacaagaccacataccacattacccaattgagatcctctgcagtactactcactaacatgtgggaccgagatgctgtggggcccacatgtcagtgagcagtactgcacatgcagtactgcagaggacctgcatcccacattaccatgtactactctactatcatgtaggaatatgctctgtcagtgtcaggtaatagtacaagaattaaacacgggtggtctccctcacaaaatggtaatagcatcatccaaattaaatccccttaggggtacagactgcaggcaaccaaaactgaaatgcaacaaatgaaaacagtaacacaagggagttcattcaatcaaagccgaccaggtcaccttcaccgagatagaagccacctcctcaagctttacatcttcgctggcgcatccatgcagcttacatgaaaaggagcagcaatgctcaacaccattggaccctttctgatctaccttcaacttcagctgcatcagtgtccaagtagacagccaacacaaaccttcttaggccacacgcctcaccaatactgccaccgaatatctgaaactctttactttcatcgtattcgtaccttgaacttgaaacaacacagctgatcgatagatcaaaaccattcaccatcagttccgatatgacaacttccaccgttgcctctactccgttagaaacattcgctaaacacaggtcgacggagccagaatcgccattgatgcgagttgtgtacggcgtctcgggcattctcatttcgtccaactctatcattccgtcgatcagctgtagatcatcttcttctttctccccagttttgattctcatgtcaaactcaaacagacattcggggatcagtgcaatgcctctcttagggccag

SEQ ID NO: 39266 - DNA, 9368 bp, Oryza sativa
taaaattgaacagtatgtatattattaaggaatagctctatgaacaaactgaaatcaaaggtatatttgttacaacacattcagaattcagaacgtaatccaaaatgattgcagataagtatggatgtatatacctggttcacggcgatgggatcatctctgctgcgattgaaaacataattaagcattgagtcgacatgatcccgtgctgcaatatatccatataactgtgttggaccactatttatactagtgtgagccaacttcaatgagaaaatctgcaccatttgacatgtcatgcatagacagttttccagatcaggattgcatcgtgtggccactgagtacctcattggctccaccggagcttcagcaaagaagatcactatgtaagcaaaattgtctaatgaccctatgtatgcatggaaaactgacttgttcttgttaagagttttttttttcttgtacatgtggcttcgttgggccgagcatatggcatgtaatccagtaaaaataatggaacaaaaatgatgcaacttaccttaagatcaggtttgtaaatcacatatataggcttggtaaatgtggcaattaagaagaaaatacatactccctccgtcccataatataagggattttgactatttgcttgcactgttttaccactcgtcttattcaaaaaatttgtgcaaatataaaaaacgaaaagttgtgcttaaagtactttagataataaagtaattcacaaataaaataaataataatttcaaaattttttgaataagacaagtggtcaaacagtgcaagaaaaagtcaaaatcccttatattatgggacggaggaagtataatacactatagcataagagaagagcgaggttaaaataataatatcacttactctcttcacggttagtgacatcgatatcataattatttttccaataaagctggttgttgtatatggtgccatcacggtggctgctaagctgacaaatgtgttgagtccagaacaaataatgttccccaaaaacaccaacagtagggttgatctcactgctatcggtaggcctctggttgctctcctctgtaacgtcgttaatttgaggctgaatgatcagatcgctgctcttgttcttgtcagttttagttgccgagtagcgttgcacgctgttactggagcagggtataaaagcaaatctatcacaacaaaaaacataattatacactagtattatatatccaacgtagtaaacactaaacatgccatatatccagatccaaaagtagttcacccccatagatcaaggcacgaatttgggaagcaagtaagaagaacactgaagaccaaggaaataaaggagggaggcaggcaggcagcgaaaagagaccggggaagcggaaattggagtggcgatgaaggcagaggagagctgatgaagaagaagaagccgccgactttggcaattggcagggcgtcggcagcgtgagaggccttgcatcatctcaattctcaactgcaactgcatctgcctcgccaatcgcctcgtcttgcgcagtaagtacaagtctcttctctagcttggcccacagcccagggatcaggtgaatcccggcattatcggcaacttatgatatatccataactaattaattaattactaatcaatatatcaatcaaccttatttcacaagaaaaagaacaattttttttcacaaacgcacaaaaggattacacgccaatatattagaagaaaaagaattttcgttacctaaagcaatcagccagaccggcttatgccaagggaaagggaaaaaacttaaactaaagcttcggaagtactgcagcggctaaaaagcaactcctaacagcggaaaggggtagagccatgctacactctcaagaaaaccctagaagcggcaaccccgtctaaggaccacatatgaccatccgaaagaatagactccaagaccacatagacagaagagagaaccctggagttccatttcttccacagctgccaagagaccaggagcatcaaggagtcgaaaccggctcggagatgcccaggtaagtaaaccctggaggaaggccaccaatcgtcgctgatgaataagtgaggatgaataagtgatgatggtatagcagagaagtgatgaactgctaatgatggatctcaaggatcacttatctcattatgtagtagtagtatagtacataataataggccattaatctgttagcaaccatcagctcaaattaataaggtgtagatataactaatatatatccaacgcagtaaacatgcagtgacctaaatagcatctcggtcttgagtttaaatcttcacataagagaatttaaaaaggctgcatatatccgttagatgtagaggccaggtaaaacatacccttcttaaaaaaaaaaagaaatctaacgcagatccaaaagtaaagcaagtcagaaccctgatgaatatggtactacaacggagaagtgatgaatactgctaatgatcgatctcaagggtcacttatttcattaatgagtttgcaaggctaatggattacaagttattactcctacaagagcacattacattagcatggatgctctgtcaggcactagaattattaaaacatactatttgtgaaagtttcacaattactcgtagtagcatctcctaaattaaacccctactaatgtagtaaagtagtacaactccagcatccaaaactcaaaaaggcttcagtccgacaaagctagtactcatcatcttcatcatcttctcttcttctatattatgattaggcctgaagtaactgtgtgtcacattatgcagtaagctcggactacctcgacgataggcgcacggcacagtgggcatttgcccaccccgtggagcagctcgctcgcgcactttgagcaggtgcacatatgcccacatctgatcatcgtatgcaagtacaacaaggtgttcatttaatttgtcagtcatgaataacatcattgatcattctactgttagtttctgaaagagtacctgtaaagaagcgagtcaatttgcctgtcacagcagatgcagcatgttcctttcctcgctagcttccactctgatccatcctctaacatcccttcttcgcctgttaagaatatcaagttatcatctcagctttgtcagatatgtacagtgagatagcagaaacaggttgaagagatcaacttctgacctgcaggaacggctagtgagcggttcagagcagcagagacttcttgtttgatggagcgctgcaactccatctgcatctccatgcaagcttctagcatctgctgcatgctggtcatccctcgctgtagtccggtcaggtcatctcgcagaacatggatggcatcccagtcctgccaaacacattccttccattcatgataaccctatctatctactactcctatatgctgtaccatgtctgaaccatactgaaaatctgaaacttttcagcaagggtgaatgaaggctcacaagttcagaatgacgcatggcttgttgactccagttatgatgatgatgaggcagttccatctgccaatgccgttgctgtggaagaatcgacggctggtgatccctggtgtcagaaacagtctgatttgttgcttcatcgatcctgtcttcaccttgatcgtcgctgtgtaacccagtagctgttccctgcctttgataatcccaatcaagaggatcatcatgctcttcttgtcttcgaacgtacgattgtatcagctggtccaaactttctcggaagccactacgaagaagattagagacgctacgcctacaaaatacagtaatctggttgtgcattattcaaacaaaatgtgtaaatgccatttcatgttcttgtttcttggaaaaaagaagaagtacctgcttaggagttctctgagctccactccatatacatcatcgtccggtggactgaacctgttaatatttcggttggaagaaaaacttggacctgacctccattgtgcttcagcttcttgagaattcataacattccattcatgatctccatcttcactactagatgtctctcttgaccatagcagattagtttgctgctcgtaagtttcttcttcttgttgattgctattgtcagatggactggaagaatcagattgttcactggcctcttctgaggaccctgaatctggataatcttcatatctgtgaagctgttcttgaccaaagtcactttggacaacatcatcattactggttgttatacttctttggatatctacagattcattttccattgattgatgtgtctggatttcattgtgagtagcattctcttggcgatgatcattttcatgtaagtgcagatctacaatagtatccatgggtccagtgtggtttgttgctgggccatttgtggtaacttctgttcttgagcgaacttcttccctaggtcaacaacaatattgtgtcaccatgatgctggaaatatatatatggaaaaaggtatatatttcaaaacaactaccaaaaatttgttcatttggcaacttgaccagaagtggtcctttctatgtactagatgctgaaattatacttataacagtcatgtagagtgcaaagagtacttttgaagccaattaactaagtcagtgaaactctattaagcaaggtccaatctttggcaaccaagaaaaccaacattagagcagatgatgcccggcaagggaagccatacctgaatctagagactggatgactctgtctaagctgtcctaattctctggctgccatagagagtggtctctcatcatgcatagggcttccactatggaaggatctacctcgtagaaaagactgtaaaatgataattatcaatcccatgaaacaaaacatcgttttgtcaattattccaaggggaaaaaaaatctgtcattagcacttgatattttttttgtttactctaatagaagacagtttcagattttttttcagaaatgtttcagagagcaatactgaaactattcatggtagggaactagctagggatcacacaacagcgttttttttggctgaatttactagtcaatgaaggattaaacttcacatatttgataagtacttcgtatttaactatgtgcaatgcggcaagtacagaagaggtgcacagaagagaggggcagacatgaagcaagtacaagtggggacttggaaaggaaggtgctcgggcaaccttttcagctgcttgtttagcaggtccattagaattatttacatgagaaacaattccttgatcaaaagagttgaaagaaagatactcttcttttatgacacttgacatgattaggttgcagcagcagctagacaaggcatgcaattgctggacaagactcaattagagtgaaacaacatcaactcatctgtactatatatatggggtggtaagtgctactacaacgtagtagtactcagtatattagcagttgttttggtgagaattgaaggttggcattcattttctcatttctgcgaaatgaaatgcaaccgcaatgcagactacgactagtcaatttcatcagatttgcattgggaataacaattaagaaaatcctaagtgaagctaagagatggcatggcatgcagatgtgacctgaatgcgggcgcggtgagcgaaggcggagacggcgcggtggtcggagaggccctgcagctcgcgctggcgttccatggccatgcgcgtcaccacgtcctgcccatgccgcccacgcccacgcatcagcctgggcgtgtgcgcgccaccgtgcccctgcccctggcttgccatgcgcacgcgctcccgcacggcgcgcacccgctgccgctccgtctcgccaagcagctcctcgccgccggcgccgcccccgcgcggggacgtccgcgacgacgccgtccactcccgcgcgatcctccgcaccagcgcgcgctccggcgaacgcgcacgcctgccgccgccgccgccggcatcgtcgtgtgcgcggaggaaggaggcgtcgagcatggagacggcgtggaggcgcgcgagagcgagcagctcggagtcgcggtcgcggcggtcgatcacctggtcgtcgcacgccagctggcggcggcgcgccgcccactgcgcgatgatcctggacgacgtgtcggtggcggaggcggagcacgcgcggtggtccttggcccggagatccggctccatggtattactaactgggtgctccatggtatccactactcactgtcactgtgacactaccactagtagctagctaggggctagggcgggtataagtagtagaggaagacgagctaggtagggaagatgcatgtttcagcgggcggggactactcgatcgatcgggagagcagaggcaatggagcaaatcccgaggcgtacgtggagtggagctttgggatggaggaagaagacgatcgaattaagcgagattgaattgagagcagttgcgttgcgtacgcgcggtggtagtgacgctgcgattattaatagcccacacccacacacttttcttttttaaaaatataaaaacaggctactatactacaggaaccccttgggatgatatcagatttcttatagctatcggtatcatatctattacaccgtaggtaccgactaataccccatttatattgactgacaccagtcagtaccaggccaatacgtgttggtcggtattaggcctagtatccacataggtatcgggtgatatctgtcaggtatcaaatgataccttgttgaaactgatcgacatcttggtgataccagctgatacccatcaggtatcatatctaagctgagaggggaagagaagaagagatcgaaatggttaccggcaggatgactacaattatgtggcgcttcccatccttcctcgacacctcctcaagacttagaccgagacctcctcctccttttcctctagaagcttccacataccacagctcgggatccacctccatgcgtggccatggcgatcagggaagcgccaccgccattgtcgccaaccacatggaccgtcgctgatagaccctagcaccaatggccccatccaccatcgctgctaccatgccacacgctccatctgcagcacaagctcttgcaacatcccgtttgctcggtctccgtctctaggtcctcgttaccactggcactacagcatccgtcctcatcaccatctacttccatccttgttgccgccacggagggtcgaggtcagcggagaaggatttagttgtcctcgtcgccctcatcgccatctgcgtcttctgccattggggattggggtcaggaaagaaggatctcgttaggtacagcatggacattatcctaacgtatagtcttttcccaaaaaatcacacaaatagatgtgaggtttcaaattgatataacatgaagaaaaaattacaatactacaatcatgtaaggttataataaaaaagtaaaatcataccgcctatacaccagctcgataaaagaactaacatcaagtcgattgccgctatgcccacaccacacatacgtgcatgatgccacgatgatattgatatcaaaataaggatttttgcgcataattttggacacgctagttgagttggatattatacctctcttaacttatatatatgttaatatatttttatataattaatatgtattaaaaataggattatatttaatatacaattattttcttttttttctttacattctacaaaaaccattactatcaacctacactctaatggtttagattttaccatttttcttcagttaacgtagtaaattcaaggcatccagaatgtcagctagtatctaactagatctggtgatgccatcgattgtatgccattttctagccatccgatttagatcatgaacgattggatggccaatgactacttgcacccttcatcaaaaaagaatcaaatttcaaaaacgaatcagaaaaaaaattatccagattcgtttttttatgaagggactatgtggctcattaaaaaaaggagcgaatgttttctcctggacaatgatgatcagtgtggagggtactaacactattattatgatgtgtcttctttcccatcaaatcattccggcctcattattccagcatgcatctaaaattatagctttaatcctaggaaatgtgtttaaaatattgtgagtaccccaacaaaatagggctctcaaaatatttttagtgatcatttaagaatatgtaagaaacaagtgaatatcgctcaagaatgaaaatccatctccttaataatactatattatcgatctgatcatcagtacgagttgtctcaggcatgcatgtacggccacttggataaaccaaggagagaattgtagcctgcatgatgcatggtttgtactttgtatagtaccaattccgtctcagaataattttatttttcactcatctaacacatacatatcaatacaagtataaaaaaatagaattaatatactccactttattaaataaatccaatgcaattgttattcatttttaattatctagtctcaatatattatcatttcacttttacaaactctatataatgaaaacttgaaagatgaatttagtttggaacaaattcgatggtgaaaaataaaattattttggaacgaaaggggtagcaagcaaagcttatcattggcaaccatgcatacatgaacatgctgaatgtgattgtctgcattgtcggatcgcatgcatgggcggggatgggatgcaaattaaatcaatcgcttgcacagtttgcacgcgtggatagtctctgattgatcaaggcagaaatatggagtatatccatgtaggcatatgcctgcctgccccatgtctgtaggtttactgatggatcgatcgaactgcagcagggttgctagcttctaagtccctagctgccaaatccacgagtaatctcgagaggccttgcctgcttgttgcctacctccatggctggattcctggggatccagttccccttccctgtaggccatgcatgcatgcatccatccatccatggcgatcgatctccactgtactgattgatgtactgacaatgacgtacggccgggtcactctcctctacctgcagctagctaccatatccatgcatatcgtgctgttgctgcatatgcttctttcttcagaactttcatcatcccttttctgctcggatgcacgcttttgcgtagctcatgtacgtgtttaattccatctgcatatgtttattaattccattactcgagatctgttaactgcatatggtgtggtcagctagtataattaatccttat

SEQ ID NO: 39267 - DNA, 3392 bp, Oryza sativa
tttcgaaacggagggagtatgtcacaaccaaccaatgtgcgtgcgtcccttttttttattagacgcgatcgatcgatcgatctaatactgttcagtacagggtactacatgtttacctctctcactaggctggtcattgttaccatttattagtattatatatgatcttcagggtccagttaatcgtatccatctttctttgtcagcttcatttagctgctgtcctttgctggattcactcactatatcatcatttctatcattattagtggtatccaatgtctcgttttcttcttaaaaaaattagtggcatccaatgttggtttctgcatagtattattatttacttaattaatgttcattaacatcttcgcggaaacagcaccaaatgattctgcatttttcaggaaaacgaaaaaaaaacagaaagctggattactttatacagctgcacttttcatgctcatgatctgaagatcaaatcaggtttccttggaggaagaaggtgcagcttcctgcagacaggcaggagggaacaccggaatgaaatgcatgcagaattgcagagaactaattgcagatccataggaattaagtgaatttggccatgccccatgatccatagtataggaagatcggatgaggagaggaaggagtggtggtgtgtccccctgaccaccttacataccctacggtttcagtgacgatccaagttccaaggccagaaaaattcaggccatatcatccactgcctgcttttactcctctgtttcagtgtcactccacaacaagtcggccattgttcatcttcttatctgattctgattgatcatccttcattttgcttggaccttgtaaactggagtttagtgatccaagagatgcagatcagttcttcagtcagtcaggttctggaccaccaatgggaactgggaacaagaacatgtacctgcatgcctcttgtctgaattttcaggcaatgatcgtcaacatttaggttaacagactattcaagttggtgatcatcgtgtggtaaaaaagctggacacatgtcagcaaacagatagcactgtaactgcacaattgcctatgacgatcatcgatcgatctcacctgaacatgcaggcacaagtggatgtaatcatcatgctaattcttaaacttcttgagaagcaggtaagaaagagaacagtgcctgagaggctgagacaaataacaatgaggcacctggttacaattctgctacactgaaatgtagtgcctcgttaaataaagtgctcatcaatcctcattatacaagaagattggatggatgtcatgaaacagaaaaggggcataacccttgatattgtacataatgctttttcattattacaataaataaataatttaggagagtatggtgactgtactactaactaaatctcttgacacaatcacactgttctcagggagagggaaaaaagagctaatacattttttatcaacagttaagctcactcttgctggaatggatgtaatcttcgggtgatccgagtaaccatattaacaaataacgttcaccctccgagtcaatcaagaaaccggtataccggacaaaaaatagacaagatattacacaaataataatcaatcagttaaaagggcgttatcttgataaggtttagtggtagcctttttctccagggagaagtcacagactcacagttcaccctatcaccaagaccttcagtcttttgcagctcatgctccagtaccaactagcatagtctggtgcacatcacatctgcttcagcacttggcttttgctctcacatgataacatactgtcatggtgcagacatggctctggttcatatgatgtccatctgcgaaagtagaagggttttacactgggtactagctagcgagttcagttataacagattgaatgataagaggcattctgtccaccatggtacacaatgggatcccattagtcacgagctcggatcagcttcacaagaaattttggcttacgcatccaaactacaagtatcaataactggaagcaacctatgtgacaagaatgtatacacaggtacctgtgatgtcagtctctgttatggcaggcaatagttctacgacaacctagaaccaccgccctcctcctttcttggtagctttcagttccatcactaatcgttcccgctgagcctctacctctgcatactgcaagctcatgttgagtaaccgctccttcatatctcttagctctccttctagttgcaaaaccctttcgttactactctcattgccattcccagcagcacactgcccatcaggcatgggactgtacagaaaaggaaaaataaaaataaaacaagaatatcatgatgttctgaatggaaggcagcagagattatcagactaggtatgaaaaagatttgccaaaggagatatgctgtccaagttcaacagtattgatgatttagcaaaccaacaaaatgaaacatttaacatagtgtaaacatatggcatcaagatttatgttcattaacattgtgtaattcagcttaaatatcaccagcagcccaaacacatcatgtgggtgtgtgtgtgtgtgtagcagactgcagatgccattgtaagaatatcaaattttgtttcaaaggttagatggataactgtaacaaaggaaagaaatgttcttctatgatgtgttgttctaggttgggtaatacataacaaaaggcatgtaagtttggagcagaaggaatacctctgctgttgagctctgtacatcttattctcctctaaagcctctgcaagcttagcttccaatacttggatcttcaaatgaatgccagattcctcatcaactggagaaccaccaatatcctgcagttacaaggaaatatatggcagacagacattaaaaaaaccaataaaatcaacaaaaaataatcatgataagcactttttagggttaacctgctttccaaggtcctcttctttgatgtgggccatctgctcgagctgacttgtaaggtcctcattttcctgctcaagagattgtatctttctctggtactcactatttgatctcttgattctattaagttcattctttagctctgcttcatgtacatgcgatgcttccactgcagatagatcactctccagccttacaagctttgcctgcatagctattctgcttcgtttttcttcttcaccattgtccaaagtctcctgcatattggacattttatctgtcagcatagccttctgtgccttcaattcttcacattcctcagtaacagaacgatgtagctcctccagttttcctctttcgaacttagcctcatcaagagaacttttaagtttgagaacttcgtcttgaaggctcatta

SEQ ID NO: 39268 - DNA, 717 bp, Oryza sativa
ttagaattagatctcctcagaacctctgaatcatcttgtgcttcagacaattttctctgagcttcctgttgtttttgcttaaactcaagcctttgagtttccatctctgcttgctggcgctctactttatctttgagattgacgataagtgatttagaatcatgtatctgcagctcgcttgactccttttcatttgtcatgtatgtcaactgagcttcgagtccagaaatgcgttccgatagctctatgttttcctgttccaggtccgatatatgtagctctaggtcagctttgcaactctccagttcagttacctttctttccagaaccttattggcagaaacatgggaatctatgctgcttgaaagcacaaggatatcttgccgcacctcatccaagcattttgaagaaatgctgctttctttacgtgatgcttccaggcattcctccaactgactcttctctgcctgaattttagaaataacgctttccatttcaactttggaacatcgcaaatcatcattttcctgctgctgtagctgaattttagccttcaacacatctgtctcaggttcactatccataccatttctaaattggtatcctcttgcaccactagtttgaacaccttcccctgccatggaatgggaactgtcaagcttctgcctcagctcagataactcaagatttctttgttctagttcctcttggcttttt

SEQ ID NO: 39269 - DNA, 3933 bp, Oryza sativa
  unsure (1)..(3933): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttctagaaatagctttgcacactaaatcactaattcacttgaaagctttttgcttgctggcgatactaacttgatattcatgacttgtttcatacttcttatgcacatgcttagctaggcttgagcacatgcttgtatctgtgtgatccatgtctaccttttgatgcctttagataactctcaaagctctcaaaacctaaaatttgcaagtttcatctcatttttatcttgcatttttgtctcttttgatcttgatggcatcattgacaaagggggagagaaatttgcacttattgaaaattaaaacttgctttaaatcttggtgaaagggggagtttggcacatagggggagcattcttgcatttgcatttgcatcccttttttcttcttgtcacttggtcttgatttttcgcgatttcaaaatgaccaaagttcgcttttgcaaaatggtttgctttgtgaatcaaaaatcaaattttcaaaattttgcttgagattgtcaatgttcccatcaagggggagattgtgaaaccatgtgtggttatagttcttttgtgatgggaaattgacaagtaccggatgtgcaagaagtgtgtgtgtggactaacgttggtcaggttgcgacatctgtgccaagacaacggttgtttggttcatgtgtgtgcaggtgatcggggtcgatcttggtcaacggcggatcgggactagactcagggaggagttgaggtccaaagcgatcaaggatgccgggtgacaagattggacacaaggttgcacacggtggacgaacaccgtgtgaaaaggtctttgcaacaggcttcacaaggccaagtgtgcaagcatcggattcgcgaagaaatcagaagggactgtgcaagtgcattgctgctacagtacttgctgtaggtagcatacatgcatgtacacgtactgtacttgtgcaaggaggagcttgcactgtactggttgctactagcatggctcggtggaaaagtcaagctagctagctgtgcatgtgcgctgtgattggttggcagggaggccaagccaatccagccgttccacgtggcccaagatggtgaatggctcggctcggcaggcctgcatcgtccaagcagcgacggcccaagacggcggcccatggcgcatgggctcaggaggtgcaggcagcttgcatgcgcaaggacgcgcgcggaaaaaccgtacgcggcaacccccgtttcgcgtgactcgatcggaggcgggtgcaggagcgcgggacccacacgcgattttgcaagcgcgcgcgggagcggctcagcgggacgcgtggcggcttcgggctggttgggcgctggcgagcgcgcgctgaggaaaaggagacggaacgcgcacgacgcggctgggcaacgtggcaagtttggattcgtcaagacggagagcacgcggattcatcagcaagaagaccatgtgagggttcggatcgatgaggtggcaatcatctggagcttttcctttgagtagaaggaacaatggatggaccagatctgttctgagttagggtttcgccctaggggtatttgagacaatgtcttaggggtcttaggctataaatagagagatggatgcaagggtggaggttgctccttttggtaatcattttgagatgctcggtgagagagtttccgtgtgagtttggagtgtgtttgcccgagaggcttttgtattaggattagtttggagtgtgtttgtccgagagattttaagtttgtgttaatgttcctctgaaggtgtatgtttgctcctagttgagcggttattttgcatcacctataaatgaaatgatttgaaggatttcatttttgccttgtccatttaaattccgcaatttaaattccgcttgcaatttgaactttgcgatgatgagttttgctctctctttctcacctcacttctagtttcgggaattccttttctcttcctcctctagtttcgggaattccttttctcttctttttctctcttcttttctagatccggcttctctaatagccgcgattctagtaaggattttgagaaatccggcttgatgagtattttcgggggcaagatttgaattgctatattcaccccccccccctctatagctgttcttggtctttcaggtttggatataatagtcctcacaggtgatgcagaaacccagctatcttcttgttgagatctcaattaattcttcatcaaatgatatttccttccctctcagaaagtccattgttggttacaaggcaagtgtgtggaaggcttggaaaactaggcatcaatgttttacctgcccgtgcagtgtttgagttagctcgtaacaataaagaagttcacttaaacatcaatgggatttcagatctctttccaggtcaatctttatgttccaagtgatgccatacttcatgcctcacctgtcgctccaaacgaagtaattaattgcaagaagttcttgtttgacagtggcaaacaccactgctactacactaccaacaatgccgctttaagatttatgcaatttagttatttttgttaagcacagaagcaccacttttaccattttgctcgctctatttgttagtgcagaggacaacagtgatatagtgagaagactcagaaattttggatgtcgttgtgcaatggttgggcatgaatttcttgatcatgattccataggtgaaagtcatattggaatatcagtagctgatgccactgattacaccaaaagtgagtccgatcttgttttgactcagcctgccctgatacctatttcttcagccgtgcaaatcagtagggaaatttgtcagatgatgaagggctatatggtaagtcaattttgatgcagttcaagagtttttgttgctggcaaggcatttgacgtgtagatgacaaaatgggtagtcagttgagatgcgttgcttttgttgcagatctacactgtctcatcaactgtccatcttgtgagtacaaacagtgattatgttttgaaaactacagcattatgcaatgctaacattaataattatatttattgaagttcggtgtccatgccattttacttttatggaacttcgacttaccaagtttcttgactctggtgattgctgcttttaattactgtgagtttcagctacaaaaggccaaccttactctacaatatatattgtttgtgcccttgtttcttttcatgattagtaagtattacttgttgcttttatctgatttcacgggatacactgagagttaagaaaatcattgctagcggtgctgcttttggtagctacattgttctgagtacagccatttttttcagggctgcaacaatgacaggcttcttttcagtaagcaccttttcttcttattaaaggagattattttggtctggaaaattgaatgagctgattatttaggctgtggacagtgcaaaattgaacataaatcactgatggacaccgatgaggaaattagagctgctttgttccttcagatgagcattgtgaatcaggctgttgcactgtttgcttattcagatgattgctgccatatcagatgtcctggacctgttgtaacatttgcctttatttttacccagatggtgagatcgttaacttttctctttctgtttttgccgagtccatccttcgtttgctgcttgttgatttcacggaacttctacctactggtcagaaccataatttagcaattggccactttgtttgtggctaggattctagaaataattgcctaactgttattttaccagcatcgtctaat

SEQ ID NO: 39270 - DNA, 8284 bp, Oryza sativa
tcaggtggcaacccgtaaagctgtaggaggtgacttggattttgctattgcaaagggtgttggttggctcaaggctggattgatatggctgtacaactttgtcctgctctttgtccctgttgatttgtaagttgatggtttgggaatttgacattacaaattactagattttcttttcttcactcccctgttataaccattagtttcctcttcttttgcaggtcagatatggaagcatgcaaagatgactggagaaaaattgttgacgaagcgttcagccatcctacatacaattctgctctggttactgtacataatacttgatgtcaggctacagaagcctttctccattaaagaacattcttgtagcatgtcatttcacagtgtatcaccttaaatgcctaagtaaatatatctcggtcgcaaattatacctctgatctatccctcttgattcagaaaacctattttgcatttgaagaattctggaggcgacagcagttataacaaggcggccacaaacttcagcagtaaattggtctccttataacaatgtccaagctatcctttatttttcattttatgttagctaatgttgcaagagtatttgcgtaacaagattttggcaattaaaaacatactccctccgtcctaatatgtagtaatctatgtccagattcgtagtcttaagatgtgtctaatcccatcctaggatgctacatattgggacggagggagtatgtcagagtataagcttcattcggtcttctcattccagagagaattgggctctagcttttctcagggttgaatttaaccattttcatatgcatcctttcaatcatttttattttttattttaatatttattttttgttttatcatcttattaaaaatcaatttgtggattctgttgttccaaaacaaaattttgtggattccaagtccttccaaatatttattgacttgtccagtatgcatacagtaaagttcattactaacattgaataatattgaaagcactattcagaaaaggttagtcttttaagtgatgatggattaaaattggactaaccatcttcctttctcattttgatacagtaaagtttaattgttgatctactgtgtaaatatagtgcgtgcgtcatcatgtaaaagaatgcagctttaccctctgagttgtcattcaggtaatttctcatatatttcttctattaggatgactttcaactttacatgattcatatggatacattatcttgacagattaggggttaatttagtgattacattgccaattgtgcaggcatgtatgacctagttggctgggaggctatccaactagatgcatcaactggtgtctgcctggctgcctgaatagttttatggtggtgcagttagcatgtctgatgatggcattggcaggtgagtttccagcgtcactcccatacaattattatcgttatacaaatatttatacattggcaaaaatgtgttgtcggatgcagaacgccagtactgaggtagcatcgttgcatgcatcatccttaaaaatgccatatgaattaaaaaatgcaatgcacatatttgcacagtggagaaatgtgttgtcggatgtacaggaagtctcttgtaatagaaagactgcatcaccttaaaaatatagcctgaatttaaaaaatgtgttgtcggatggccattggagtagaaagtagcgaggtttgcatcatcctgtgaattatagaaagaggggtggttaggaagatatcacgttatataggagaaagtaacctatcgttgcttaccagtttcctatcgatcgagaaatgctgttaattaattgcctctttttgttgacgtttttccctctgagaagaatatgttcggtcctgagatatttgctcatgtgctgtacacatttcagtttggaatgtcctattatgagaaagatagaacttgtgaattacaagtcctaaggccgtaaaaaaatattacaagtccaaaagcatatacttagactaaagttcgcagaactttgtcaccaacctgtgaaaacacttgccattacatatatactccaaatccaagagatgccattcctctccttttatgtttttttcccttttttatgaaaaaaaaagtagctgtctttcaataaagatggcatttgaaaaaaaaaatgcacagttggtgacagtggcggatccccagccctgttaatgcaattttgaattcatgaattcggctcgtaacctaaagacgtttggaacacaagatttgcatgccttcatgaatttgggaacccagccgtttggaacataggaggtgagaaaataaaggttttagaacttctcctcttattattgttctaacctcttatcatcaaaaacaaaaaccctaatataaaatgtttaatttgtaatgagccgggtttaatctttcgttttcggcgtttgtatcggagggtgccgatgtgcaaaattttaaacataatttgattaaatacaaaaaataaaaaataaaattttcagccgaattaataccatatcaagaagtccgatagaaccaaactttccgaatacataaagagcaatgatgtcagtaatttcactgcctaaaaatataaatgtactactcggtttagagcatttaaaccctcttaattactactccctcccataatataagtcgtaactactttttttttcagatgttccataatataagatgtgcatgcatacaattaattagtacatcttctccattaaattatgattttttaaaatcctctacccttaaaatctctaattctattgggtgcatgcattttatttattagggtgatacaaattaggaggtcttggtctttgaattaagggtggttatgacttatattttggaacggaaggagtacagtcagtggtgggcaaacaaattaaatatacacaagcgtacactctaaaatcttctattttctggctgatgaaagtacaagcacagtattcagcatttttgccggctagtggatctgctgtgtgctggtgtgtaacttgatttaatttatatttagaataagagtcggattcgttgctttttaaatgaagggaagtgagatttgcctttggaaagcgacacttgttatttttcttccttttgttaatgaagagggcacttatcattttgctttaatttggaccagagattccgtgattgtgggagtgccaactgccacagagagttcttttttgttcttttggaatggcaacaagagcatgcatactgatattttaaggtagtacaactctgcatacatggagcaattaattaagtatagcatctctatgaactgaggtgacattgaacagactaattaattaataaacctaaagagagagagagagagagggctacaaatatttgtttgaacaagacatgctacatactctatacgattgagatgtgtagaaacattttttttccatgtattttgaggaacatgcacatatcaacatacatgtaatacgatgttgaattaagcaagcaaatttaagcatgcagagtgcactgcttagcacacactgcatgtgttgctagctagctagctccatctagttccctctcttctcatcatgattgacacttgataaaattaagcaagatttagctagctagctgagctgatctgatcaccatgcatgcatgcaagcaaggccaattcaatttcaagctcgccggccatacaccacacagcacatatacggtgggtaaaacaaaaacaaaaaggaaatcatacacaacattgattcattcatccattctcttaattaattgacttgaggttgaggagcatatatatacgtgcgtggcatgcatgcatatatatggtacggtggtcgacgacgacgacgacgagcctagcaagcttggatgtttgtcgatctcataattaattaatttggatgggtcgatgagatgagatcagatcttgccgatgaggggtatgccgacggcggtgacgatgagggtggatgggacgccgaagacgatgtgctgccagaaggtgaggtcgtaggcgttcctgggcgccctcctcgcctgctcgcacactatcaggttcgccgccgaccccagcagcgacaggttccccgccaccgtgctcacccacgccagcagcagccacgacgtcgtcaccgccgccggcgatatcagcgccgccgccttcgccacctcatcacccataagaagcactgcatgcatgcgcatatatatttttgtatgttaattagttatacttatatggagtagtatacattaattctggattaatagaatgtataattacccgttggtacgtttgatgcgaggttggagaggaggaggatgatgacggagaggacggagatgccgccgacgctgttgaccttggagtagggggccatgaagtcccagatggctcccgggaggcccgtcttgttgaagccgctgacggtgatgaacatcccggagaagaagacgagcagcgagtaggacacggtgtccaggcacggctcggcgtcgcggaagtcgaccaccaccagcgccagcgccgtggtgatggccgtccacgacatgttgagccccaccatgtaggccaccaccatccccaccgtcaccacgtacgcgaagctcttgaggaacagcttccgccgcgcctccgtgcactgcatgaaccatgggtgcttggtcgttatgttctccgacatctccagcgacatcatcgtgttgccgttgccgttcagctgcggcgtgctcttggccgacgccggcgacctgccttcctccaccgcctccatctgcttgccgtcgacgctgagctcggcccctccgcccagctccctccagtacatgcagagcagcatgaccatgttgacggccatcccgacgagcatggccgggaggattcccatgaggaacttggggaaggtgatcttgctattgaaggcgatgaccaggttctgggggttgccgatgggggtggcggcggagccgatgttggcgctggaggcgagggcgaggaggaagggcttggcggggaggttgcgctcggcggcgagctcgaggacgaactcggtgaggacgacgcagcaggtgtcgttggtgaagagggcgctggcgagggcggtgacgacgcagacgcggcacatgaggtcgcgcccgccctggctcttccacgccagcagacgccccaggtgcttgaacatcccggcgttccggaggtagctgcccaccaccatggtggcgaagaggaggcccaggattgggaggtcgatggaggcgtacgcgtcgtcggggctgatcacgtggaatatcaccatcagcaccgcgctcagcagcgaccccgccgtccgcccgatcggcaggaacggcaccgacgggaacaccgccatcatccagaacaccgcgaacgcgatcgatccaagcgccaccttgggcgccgacgcaagctcactcatcttcttcttcttcgatcgaccaccacctagcaggtaattaagtgtctgatcgagctagctagcagattatagctagcttagctacttgagctgatgatctctctctggtacgcgcgcagtagctaagctgctagtgcatgcgctgctgatgcttcctctcgcttcctccatgccggctataaatactactcgacgtactctcgtctgcctagctagctgatgtcatgaataactaatacgcatcaacatgtagctagctagctagggtttttattcatttctaattactactccctccgtttaaaaatgtttgataccgttgactttttagcacatgtttgaccatttgtcttatttaaaaaaaattgtgaaatatgtaaaactatatgtgtacatgaaagtttatttaacaatgaatcaaatgatatgaaaagaataaataattacttaaattttttgaataagacgaatggtcaaacacgtactaaaaagtcaacggtgtcaaacattttgaaacggagggagtaataatcacctctagctctgtccgaaagcaaagctagctaggtagcgtacaaaccctaagagtcaaagccatgagatcaaaagggtaatgtaaactaatcgatcatcccctctcgtcacactgcaacccggctttattattctcgcttcgggacaaattaataaccacatgtgtattaattaattttgtaatgcaaattagtgcatttaatttgtacacttaactgcatattatatatactagcatatatatcgcatacaaattcatatatgtacattatcaatctagctaattctctctcacacaattcacaagcatacataatgctagctctgcgcgtttctgcattgcatgcatgccaagtagaatgtctccgtcgatctacttgtggtctcactcaaaattacaaaaggttaattatacgacttaaaatggattgtcgtggccttccaaattaagcaagcatgattagcagtcgatcgagagttggcacgcgcgccagttagaagcgtcggccggccatagctaccttggttaatcgcgagctagctgcaatactccctccgtttcaaaatatttgacaccgttggctttttagcacatgtttaaccgttcgtcttattaaaaaaattatgaaatatgtaaaactatatctgtacatgaaaatatatttaacaataaatcaaataatatgaaaagaataaataactacttgatttttttaataagatgaatagtcaaacacgtactgaaaagttaacggtatcaaacattttgaaacggagggcgtatattaattcagtctcagcgttaataacaagtacgtatgcacatgtgacatgtaggattagatatatccatatcgatatggagcagttaaatgttgccattatttaactatttaattaaatctaacatacaataatcagcttgcacactgtctctttcagatcatgcatcatcaccgccgcgcccttaactaaactagctagatatatacatatgtgctgtatatatttatatctgttaatttaaatatctttctgttttctttggtttctacatgtgtgcatttaggcatctcacacacacaacaacaacaacaaccacaacaaaaaaattagcaaaacatctacaatacctaattagtgttactaaatctaatatttgaattattttaatactatatttattttgtgttaaatattaccgtgttttttagggcttgtttggttaatttgcaaccatgccaaactattggcaatgccaaatcatagacaaatttttgccaatgccaatctgttggtaatatttgtgtggtattagcaactattggtagcaaaccaaacattgccaaaatcactatttaaaatgccgatatttggtatggcaagtttaatttgacttcaaatcaaactagcccttaataaattttgaataggaaaaagatcaaactgttttataatatgaaggaacggagggagtacatcagtgcgctgctatgcatgcgccgaccattggtcggattaatttactccgatgatcagcaaagtagttagcaaggcaggtactgatgagcacatcatataattaacggtagtaaataatcatcaaattgccgatcaaggcgatataatgcatgaaactatctatgaacagactgaaaaaaatatctacaggtgcaacgcatatatgaagcatgcgtactctcgtatatgactatatgactatacgatatcgtcatatatcaaattaactccctgcaggccactcaccttgatacatgcgacaactaatagttcggtttgctaccaattaacacaaatcgacatacacatacgacgctagaaaaaagctaaggaattaattgtgtgtttcatcaaaagttcagatcataaaggctagtattagctaaagccgacgagtcagaagccactactaatattacatcatattatatccgctgcatgcaggaggctgctagaatgagccaggccagctgatgggattccatattcttaattttctgtaattttagcaactgcgacatgatcgacacgtcactaattatatttaactacttaaccaaaagcaggcatgataagacattcttcttttaactcgatcgggatatgtatgcatgcatggctggatcgattatcgctcggagatgcttacctcatatacatttatagcttgatcaatctcatctatccatggttatatatatatatatatatatatatatatatatatatatatatata

SEQ ID NO: 39271 - DNA, 3230 bp, Oryza sativa
atatatatatatatatatatatatatatatatatatatatatatatatatatatatatatatatatatatatatatatatatatatatatattctccattatatatatatataaaattcttccatcccttaaaaaaaaacttaacgtggtactagactgtgatacatcctaatatgatgaatttagacatgggatatatgtcatattttaatactaagttaagtttttttttttttgagacgaaggaagtatgtatatatcctagataggtagctatatatatatatatgcatgcgtgggtgattgtgtggacaatattggcaggcaaattaacctagctgtctaatatgccaagctagctagctagtgtacgtacatgtgtcttagtgattgaacctgtccaacgatcagagccactgagatacgaagcagtagagatatattagctagatatagccctttgattaattaattacatgcatatatatgtgaatgatttgtcaggaagacatacattacattagttgatcgatcgatcgatcatatcatgtcacgtggaacacgatctcatcattaattatatttgtatatatagtcctggaatgcatgccctccacacatacggtctcacaacaattaagttaagctattctttggcagcatgcaggtgtagctagcttcgaatgcatttggacagacaaaataattagattcagagtttcaaacgaactcattctctcaagctcttttcagctgtttaatttctaaagcctatctacacgggtcatgattaattaatttaccaacctagctcgcataaatgtagttctcgatcgatcgatcgatcatcgcgtgaagatcgatgatggccatacatatgtatcatggtggaattaattctcaccattaactgaaagattagtgcacacgcatgcagatccaaagtaatatatatacatttggacagttatatatagagagagaattgaaaggcgacatagatatatagatgatccagacttattctgatcagttctaaagcctagtagctaatcagtacatggcctgattcgcgccaaatcttctcttctgtaatctctgcctgtgtcgtcttatctgtcccacttttaacctgactggcagcagagaataggatagcagaccaaacaagtcatgaaatggccctcatataccctttaatttagactgtttttttcctaagtaattaccatgtttataggtgattttagtgcggaatgttgggtaaaaagatgatgaattggtggcgaatccagaatcctttacttggcatatacacgttgttctgtcactgtgggatctctctacaagttcaattgagttttgagagcccatgcatgtttagaatgggtcgggccatatctcctttgcagtttgctcccccggcccgccaagtaagccgttcgctgcatgctgcgtgcctgatactatgggccgtcggatcgaaaataggcccaggtaaaagtggccctaaactccaaacgggcaccatgcatctgtatgctttctcggattcaaagtttgtgtttgctattactcctagagtattatacattttttacccacgatagaacaagttgataggttggttgatttagtacgggaacatataaatgcaataacttgttaagctggtgtgctctaatataaaaaacttaataatttagtattttagtgtagtaacttggctaggtatgtgctattttaattagttaacgagtgagtctttttccacgatatcaagatgtcatcacatagtactcatgtagatattgtcttacaatttttgatgtaatttataagaattgtgttgctcatccattttacaccacctgtttggattttttttccttcaccatctcaaatctcaaccgaaaaaatttctacacactagaatttagttgacatttacttactagaatgataaaaacatattatactcatacaaatctgcatgattatattaaaaaataggtacttaaaaactgaacgtgcatagccacataatgctcgaaataattaagttgttgcaccacttattaagttattgtactatattaaacccatttgctaagttaatgcactattacgcttatttctcaagtttttacattaaattatacacacctcaaattcatgtaccatgaatgcaatttatttatttttgaatgtgtatgtattttaatttgcataattgtacctgatttttttcctttgtattagtatacctttattatttatacgatccgcgcatgggtcatggatcccatttgttttgtgttttggtgatctgatctcatgaccgaacacgtacctaatgacgacagacaagagaagagaggcaggcatacaaatgccgcgcaggaaagaatctgttaatcaatttaattaatcaattaacatcaactgatagacgtactatgtgtagcctgtactaactaactaattaacaaatgcaatgcaggcatagatcgattggtgcacgtacgcactgtaggtgaaaggaaacctacatacatgtagtgtacaatttaattagtgcagcgagtggaccattgtacctgaacttgccccttctaattgccttttactgaggcaccagcttcattagctcttaatcattgaggcagcaattaagcagctgggaaaataattcgcaatccttaattatacataggaccagtgatgcaccaattcttgctttatttcattagtttcttgttgagagaatgagagagcaaattagcaatgcatctgatctactactagtagtatgtatgtagtgctacctgaatgcctgcaaaagacaggcacatgtgacaagaaattaattaaagttgcatcgtacactcccaacgggccgagccagccgtggtccatgcaatgcaatgcatcaagaaagaaaagattgaccttatgtgaccgcaactaattagatatcaacactgtatttctatcatcaaaccaacctaccaattaaacacctcgtttcaaatgtaattaacctgtgccgtacctacaccagtatgatcgatggggatacttagtacggtttaagagacgacggttttcagttaactgaaacattaactagctagatcctaaaaattctgagaaactgggaacatttttgttaggactgtcaagtgtgaagagatcagccacctgattagtgattaagctagtcgtgg

SEQ ID NO: 39272 - DNA, 729 bp, Oryza sativa
ggccattcccatggcgcgtggacgacacgacaaatgcccaaaaatgaaagggagggaaaaagcttactagtaatagcttggcttagcgagcagctacagtagcaggagtggagtggagtattagttaattaattagtccacggcgttaatgatactccaccgattgaaagagtagcagcaaaggggaatcctttccaccatcccacttccacctttcttcttcttcttcttcttcgcggcgacatggcgcgcgagggggaggggtggatccatgaccatgagtagcttacgaggattccccaagcccaccacccaccacccaccgccaccttttgttccgcaaccgcaatgatttcttcttcttgtaccacactgcttctgctgctgccgacgccgccgccgccgccgccaccagcaaaccccaatctcgcctgaccaccgttccccacctcgcctcgcctcgcctcgccgccgatacacgatgttcaagctgcaccgccaccgctcgtcggaccgcgtcggccagcgctttgacttccgcttctccaacttccgcgccgtccaggtaccatgctctcctctcgatcccccattccttcttgccctcctcaccttgccccttgggattcggattcggattcggattcctcgcatggggaatcaatcgcttgctttgcgacctcgattcatctacgtagctcaccagcatccaaggtttcgcatttcctg

SEQ ID NO: 39273 - DNA, 9005 bp, Oryza sativa
  unsure (1)..(9005): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttctgctcatatttgccttttattctttgcatttttcactctgattttcctttttcctattctatgccttctttttggcacagatttgcttattctttgtttctgttgaatatctatagttgctgctgctgctgcttcaggtcatgatcctttagacttcattttctcatgaacacagggaacttctcaagggtccactgtattatgctaccactataacttttgccacttctatattctggagaacctctccaatcgctatagcccttatttgcaacttatgtgctggggacggtatgtgcgtatatctccagtccttagcttagcgtaaacaagctatgcatacttaccttgcagacattccctccccccccccccccccccccactacactttcaggaatagcagacatagtggggagacgtcttggccaagaaaagcttccatacaaccccaacaagtcatatgcaggcagcatagcaatggcactagctggtttcatggcttcaattgggtaattatttgagaggcttttactgaagttttctgttgcatatgtgtttttaagtcattcattcgcatattgttcaggtatatgcattacttccagtcattcggtttcattgaagaaagctggtccttggcttttggcttccttgttgtttctgtaactgcagcacttgtagagtcccatcccatcagcacacatttggatgacaacttgactgttcctttaacatcattcctagttggtagccttgttttctgatgtttacctttgaaggaaaattactgggagatcttctgacatgtaaggaatatttcaataaggaactttggttccaatggtatgaacaaaattgcccactggtacttttaccaactagcattatgtacttccttgtgaaaaagaaaacattatatactttgtacagatttagctagatatttgaagtatgtcaaaaaaacaacctgctttttatttcttccatttgctccctaggttgatgtgcgaataagcattctaaaatgatccccattgaattactggcttatcccaaacgcttaagtgatgcactggatctgttcaactagcatcgattttcagtatccaggacggtaggttcatgtccctccttgtaaggctttttttctattgcaggttatgaaacagtgtaactttacggttcccttattccgataacctatagaagtttctctcaagttggtaagttgataattcggctatgctacagcggaggtagacaagcctcccagcatttcagtaatcctggcaagcattgagcatacctaatcgattactctgaactccttgttgggattcaccttcatatttgtgttggatcctgcaagcaaatcattaaccctaaaccatctagcctatatttatgcttcggccttcgccacagcatgcattcgtgtgcactatacaactcgcatgatccaagttgtggttacaaatatgacaggatgacatgactgtgacttagaatgtcccgttgagatccaatccccagctgttaccccatcacagtcaaccttacacggtcactttacgataaaagagatggttctccatttcgaggacctttggagggggaatatactgaagagcgatcccatgggaccaatctccagtattcagatgcaaactgtacctccgttgtacagatcatttttcagataagaaaagcaggatgccatggaaatttatatctgaatagcatggttttcttagctacagcgtacatgacatgattcagccacatgattaatcaaacaattgcctgcttttatttttgctagggaaaaaaatgcctacattgacctatgtatacaagagagttcttatcaatggtgacggtctctctttttttttttatctttatttcgtagtggaattggattctcgaaactatgtcttatgtcttaaatatgtagttttgtgatactttatattaatgtgtactccatccatctctaaaacaataaccttttagctatggccactgtccaagttcatagctgaaaatacacttttttagagacgaaacaggtagtttcgtaataaatttggtgttaaatttatagttatgttatacactgtcttgaatttataaatttacaatagtttaatcaaatggtttttctgtttcacttgcgatagctttttttggctcctatctttcattttttcatccacaggatcttgcatcaagatttgttacactcacaccgaaaaatttatagttacatgtttgtttttttatttgtttatttcatttaatacgggccctattcattggttaaaaattctataatatttgaagctataaatctgacgaaagattaataggttagtcccatcatttgaatgtacctttgtaaaatgtacatactcaataccgaagactaattttgatgcatctaaacaacttggaattggacacagtaccgataaatagatgaatttcccaactaaagctggcgactttactgttatgtatcttaaatcgaagcccctaacacattccaaaattggagattctcagctgaaaggctatctagcgggcatccgcatggctgcccccacaagcatacatgctggagtggaccactcacatgtactgtcagcatatcctacgttctctcctgtatcctcccgtgcatcggacctcggttgacaagcagttcgtttgcacaaaaaatcgcaaagaagtttaagaaatcaatgaaagacttaacaagaggttaaggaagaacaaactgtatgtatccctccatagtctaaccatgggccagagttgccctggttgacccggaaaccggctacggctccccacatttcgtccccacctcgcatcggttcaagcgcgcgtcatcacgactcgcgagagctcgtctcaaaccaataattaaactcacaaatcgccatctcggcgcggctattaaacgcccatcacaacgtagctagccggccacttcgcgttccatcgctcgctcgctctctcgctttgcttcgagctgagaatgcacctaaggatggcgtcgccgccgcagcccgggccgtacatgccggacctgccggcggtgccggcgtggctgaacaagggcgacaccgcgtggcagctggtggcggcgacgttcgtcggcatccagtcgatgcctgggctggtggtgatctacggcagcatcgtgaagaagaagtgggccgtcaactccgccttcatggcgctgtacgcctacgcgtccacgcttatcgtgtgggtgctcgtcggcttccgcatggcgttcggcgaccggctgctcccgttctgggccaaggccgggccggcgctgacgcaggacttcctggtgcaacgcgcggtgttcccggcgacggcgcactacggcagcgacggcacgctcgagacgccgcgcaccgagccgttctacgcggaggcggcgctggtgctgttcgagttcgagttcgcggccatcacgctggtgctgctcgccgggtcgctcctggggcggatgaacatcaaggcgtggatggcgttcaccccgctctggctcctcttctcctacaccgtcggcgcgttcagcctctggggcggcggcttcctctaccagtggggcgtcatcgactactccggcggatacgtcatccacctctcctccggcgtcgccggcttcaccgccgcctactgggtaaacacacgtgcaaccgtgcattgcatgcatcgtgttcgactgtttgttgcactattcacacgcctccatgttacaacgtgactctgacaggtgggcccgaggctgaagagcgacagggagcggttctcgccgaacaacatcctgctcatgatcgccggcggcgggctgctgtggttgggctgggccgggttcaacggcggcgcgccgtacgcccccaacgtcaccgccacggtcgccgtgctcaacaccaacgtcagcgccgcgacgagcctcctcacctggacctgcctcgacgtcatcttcttcggcaagccctccgtcatcggcgccgtgcagggtatgatgacggggctcgtctgcatcacgcccggcgccggtaacaaatctttcgtccgatcaaaaccacagcacacacacagttcatgggtccaaatcctcacgtacgttttgcatggacgcagggctggtgcacacgtggtcagcgatgctgatgggcatgttcgccggcagcgtcccgtggttcacgatgatgatcctgcacaagaaatccaccttcctcatgaaggtcgacgacaccctcgccgtcttccacacccacgccgtcgccggcatcctgggcggcgtcctcacgggcctcctcgccacgccggagctctgcgctctcgattgcccgatcccgaacatgcgcggcgtcttctacggcagcggcatcggccagctcgggaagcagctcggcggcgcgctgttcgtcaccgtctggaacctcatcgtcaccagcgccattctcctctgcatcggcctcttcatcccgctccgcatgtccgacgaccagctcatgatcggcgacgacgcggcgcacggggaggaggcctacgctctgtggggggacggtgagaagttcgacgtgacgcggccggagacgacgaggacgggaggtgcaggcggcgcgggcagggaggacaccatggagcagaggctgaccaacatgggagccaggggtgtcaccattcagttgtagaagacgggaagggtgtgcttgctcgttccagtgattctgatgatgtatggcactgatgtatgttactttcaacgtttagtgttaattcggtgatgtaatgctggtgtagtttctgttattgttaactgaattagttcatcgaaaacatgagaattatctggttaacaaaaagtttatgaggtgaacttacgtactcccttcctttcagattacttgccattccagcattaagatttttattaaaatagattgcatgtcataaacttagattgaagtatatctagatttataaacttggtttaatataatgtatcatatttaagttcatggtacaaatgacgtagcttgggcactgacaaagataaggattttacatttaggactatcttttacaatatgctttcaagtcgatcctcaaactcaaatatttttctgcatgacttatgtaacgccccgtaataattagataagaaaagaaaaataaaagcaagcagggagctaaccgtggaattttttttatttatactttttttattaaaatatttacaaaaataatttgttgtttcgaaaatttacaaatctaatcgcctgccgccctttgggagggcgatttttaaaaatcgcccttccacagggcggcaagggacctaaatgtaaattttccagcataacttgttagctctataattttacaatttaaaattatattatataaagtcagatgaaataaaactttatatcaaaattgtagagctcaaggagatctacaactttgtagttaataactttttcatttaagatgttttagatatccaaatattcgttacaaaatataaaacacattttaaaaaatctcagatctacatttcaaacgacattggatggagataaactttatataaagttgtagatcttgatgagatctataactttgtagtttatcacttttccatttaaaatcatttggagtatcgaataagcattattagtttttaagcaattaaaaccggtgggaagggtttgatcacaaataaaaattttgtatttaggtcccttgccgccctttgagagggcgatttttaaaaatcgcccttcttaagggcggcaggcaattagatttgtaaattttcgaaacaaaaaattatttttgtaaatattttaataaaaaaatgtataaataaaaaaaattcgctaaccgtgcatgcagcaacagctctgctgttcttgggcctagcccatggcgactagctgcagcagtagtagtacagcgagggaaaaagtacaccgaaggtccctcaacttgttatcgagataaaaaacgtcctccaaccataaaaccagatatgcgggatccctcaactatacaaatccggtcatccaaggtctcttggtggttttcaacctggttttgtccgacgtggcggctgagtcagcgtgggacccacatgggccccacatgtcagctggccacatcatcaccctctctcctcctctccctttctcctctctctctcactcttctcgtttggtgctctgggtagaccggcgccgccggccgacagggtgatgcgggagaggaggtccggcggccggcgacgtcgcggcggtggcggcgacggcgacgacgacgcgggagcaggggagcaaggcggcggcggcggtgacggcgtgggagcaggggagctctcgccgtcgtcgccgagggcccaaccacgatcttgtagcagcgtcggtgtggcgacgaaggggaacccgccgaggagtgctaggaccacgtcggcgcctggctcgctcagactgccggaactcgcccagcgggtcgtcggactgcttcaccaccgccacgctgccgtcgagccccacaccgacgccatcgtcgccgtcacggcagtctcctggtttgtccgtggcatcgccgttgctgccgttcttctccttcctgtcctcctgtgatggcaacggcgatgacgacggcggcgagtgcttcttgtcgtggttctggtggtggctcttccggccccacgacgcgacgctctgctccagctcgctgagctcgcgcagaaggccggagaagctctccggcccgtagtcgccgccgtcatcgtcgaactccaccacggagcgctcccacaggaaggacgacaacgcggacgttatggtaagagtgtcggtcgtcgtcgaccccgacgggttcatcccagcgctcctgcgccgcgtcgccgttgtcgacggcgtccccaccaccggcgccgagacggacacgctcttcgcgtccttgcagccgcagccgagcgtgaacctcacgccggcgtggcgcttcttggccgaaacaccaggactcatcataccctatgatctcgtcactcactagctaagctgcatgtgcaaactgtgcgtgcgttgcaagctcaaaagagacttccggtttctctcgtgggctcgcgcgctgcaagcatataaagcaacggagatggcatcattgccatttgccatggcaagcgtgcacaagtgcgtggtccacgtcgccgccgccaccgccgacttctcctcccactgcctcaccgccgccgccgcggtgagttcttcctcgtcgtttcgctgctccctccgcggccactccgccgcggtcttccgcctgtaaaattaaaggtgtttttggttattattctgtgacgaacaattggacattggagattattggttttgttatttggaatttattcacgaagtggttttggagatgattggatttacaggtgaatcgcaggatcgttatttcatgtgaccggtcagaccgggcagtgtgtgccggtcagactggtgtgtaatgcgcggtcagactggcgcagcccgcggtctgactggccgacactgtgtcggtttcggtttcgggttgtttatttggatatccgagtttatttcatgattatggcttctagatggatactatacgtatgtaatactattgtttgctgctaatgagtcaagttggagatagcttggtatcggaatatggtttctttgtttgtttcatgtgtaggtgactcgatgtcttgggagagtatttgcggtgatggaccgggagtcggcttggggataagacgacgtccgtgatggtcagagatcatgcgggatacttaggctagagttgatgcacgtggttgatggagattttatatggcatacgatggaggtgttgtgtgcgtatgggatgcggagtcgaatttggaaggagtccaaatttggtacgattggttatgtaaagtttctttcttgtactagagggtttcctaaggtgtttaggactcttagtatgagtttggttcgtggctttaggctgcctacctcatgtataaatagagggggagcgtgaggcttcccggtatcgctttagagagcaattgagttgagtttagagttagggtttcgagtttagtcgaaatttttgtaaggagtgctgttggtgcactttgtaaacacagagagaatcaataaagtcgtcatctactttaagagttcttcaatttgtgtttcaccgggtttcggcggtctaaccggcgatctaccggcggtcagaccggcggcaagcggcggtcagaccggcgggtgcacggcggtcagaccggaggtgacgacaggcgcggcaagcagcttcagcggtcagaccggttgatctataccggtcagaccgacgacatccgagcggtcagactggcaaggcaacttcggtcagaccgatctccgtcgattttgagggtaacttttatttccgctaaaagttttcggtttttgggtataccaaccattcaccccccctctggttggcttagttcttgtgattcgatcctacaccgccgcccgctccgcgcgcgaccaggcgcacgtcaccgcccgcctcgccgtcctcggccac

SEQ ID NO: 39274 - DNA, 2267 bp, Oryza sativa
tccatctccatcgctccatcaatttgggtttccgccaccttgggcagagtgaagaggacggggcgagcacggcggcctcagcccaaagcgaagagggcgggggagaccggaggccgccgccgccgccgccgcctttctcccctgctcccgccgccgctgccgccttgctcccctgcccagagagccacagagacaagagtgagtgagagagagaggaggaagggagagaagagggggagagggatgaggctgacgtggccagctgacatgtggggcccatgtgggtcccatgctgactcagccgccacgtcagacaaaaccgggttgaaaaccacctagggacctcggatgaccggttttgtatagttgagggaccccgcatatctggttttgtggtcggaggacgttttttatctcgatgacaagttggggaccttcggtgcactttttcctacagcgagcagcagtagctggccttgggccatatagccgcaagcaacagcagcaagcagtgtttagcagcagcagcaagctaaccggcaagcaagaggagccaatattaagggcttgttcactttgctaccattttcaaccttattaagttttggcattgctaaattttagtaagattgtcaaaattttggtaaggttgtcaaattttggcaagatttcgtatgtactaaactaaaatttggcaacaaactaaatgtagtcactttttttttaactttgccaaaaagttaagtttaaaaatggtagcaaagtgaacaagccttaatattaataccatctcgccaatttgaaagagagggagcagcttaaatactttctccgttccaaaatataagtacttttagacttcgacccggttttcgagatgctactttgaccaacaatatttacaaaattttaaaatgtttaaataaaaaattgcatattatgatagtttgtttaatgataaatctagtaacatcaaatttacattattaatcttttttatttctttgctattaatactcagaatttaaaaagtttgatttggtactattctaaaaatgtttatattttgggacggagggagtaggagactggcttgcccgaaaggccggaaccttcaacacagggtacgaattctttttgcatgaagcgttgacaaaaaagtagtgtatcgtagtatatgtgtggttcgactgaatgagttgggcctaataccattttcaggtcttgggtgtcacgcttgtcctaagaatttaattttttggatgccaaaatgcgcttgacgtaacaattttttggatgtcgaaatgcatattttttaatggtgacgatggagaggagaggaggacacatggagatggatgctaggggagtaggattagcggcaaaatggcagtgagatgatgatggtgtagttaatggtgatgatgcggttgacaatggcggcgggattggtggcgcctttagcctttgtccaatctctaagcgcacttagggataagcattcggtctaaccgagaaattcgattctgtttctcggtctttttaaaatttcggtcataaaaaacttaagaccgatcggtcaaaaaaaaaactgaggaccgagcacttcggttttcagttagttcggtttggtctcggtcatgaccgaataacccgagcagtctcaaaaaaatcacaaaagccaaataacaaatataaggttgacaaatcaaaagcaactcaatagatcaagatgcatatgcaaatgcagattcagaaagacaaatcaagctctagcctctatgtttgaatcccgtcaatctccaccaggtgcgccgaatcctacggccgcggtggtgaaggacgacgccggcgtggtggaggcggaggcggcgcgatggaggcggagggcgggcggaggtggaggcggcgccgacgcggtgggccgaggaaggacgaaggcggtgccggcgcggaccgcgcggtggagggcggaggcggaggcggaggcggcgccggcgcgatgctggaggctgcgccgacgcggtgggccgtgagcggatggaggtggcaccggcgcggtggaggcaggcggcggcgtggcatggtgctggagtctggaggctgtgagcgcgagtgtgaggagtccgggcgtgcggcgcctgtgagaaaattgcatatctaccatcccataagaatggcttcgctagaatactattatgaaaacgggcttcgctggaataccatcctcaaccagagtgtcttcgccaaaatgccatcccggacgg

SEQ ID NO: 39275 - DNA, 12123 bp, Oryza sativa
gacctcatctgcacaggcgctggcggggatggcagggagggcagcgccccaatcgccatcggcaaggcggcatcggcacggcggtggagatggccatggccgccggcgagctcttcacgcgcgggatggaggaagaagaagagccaggggcatttccgtccgggatggcattttagcgaagacactctgattgaggatggtattccagcgaagcccgttttcataatggtattctagcgaagccattcttatgggatggtagatatgcaattttctcggcgcctgtgtggagccgagtgggagacgggagtagggttggacggttggtgatctagggtttttttagtaccgggcctcctagcctcctaggcctattgggccagttcggttatttcgggtatttcagttaaccgagcccaataaccgaaatgcccgaaataaattcggtcttttgatgttagggaccgaacagctacccggatttttgggtctcggtcttttcggttcggtctaattttgcccacccctaagcgcactcatcgccgacgcccacgctaacgacctcctacagccaccatcctcgcccgtgccataatactgttgcgcaagacagccacaatgcatcctccatggtgttgagctcctactcagccgtgtacagatccactcccaaggcaccaaatcaagagacatgagcactagagtcgtctcacgaccaaaatgccaatagatccagctaccacttacaacaagagccagttagcgccaccgtcaggaccccaacatggcttgctaccatgatcagggaagactatggggaggagactccatcgccgttatctttggctggcatgccctttgggtggcgtgctcctgtggttgtgaggtggagggtggggagggggagaaactggatacgggtgtgacagcaatagtccacctagatagtccggattataacaccatgttccgatcatctttcgagtctggctgtctctaaatccgatgaattgggtgtagtcgcacgttaccatttgatttacataagtggtattgggaaaagccacataagcaatttccttttcttggatcactctttttgtgtagccttcggtgaaagtaaaaaaaaaaagtggcccttagatgaaagttaaggttaccgcaaggctatgagatgcttatactgttataactcttttggaacagaattttcgaaggacttttccacgaattaaattagttcgtgtaaaaatccgttaaaaattatgcgttcctaagggtcaagactaaaaacaacgcattaggcatgtactagtagatgatttctgcaaactcaacagccaattgcaatgggaaaaaatattaataagctttcaatgcatcaattggtggcgcgggtgcactgttcaatgccgcctctgctcctcatgactgggagaaagtctttataaccgtgggaaggccggaaacatgcatgtacacacgacaagatttgcacttctcgtttttaatacagaaatgatgacgccataggcttccaaattatcaaacacaaatgatgtacgcaaaccagcccccaacataccaacgcgagaaacaacatgctatcaacaacggcgtcgtcgacaaaatgcggaggaaaatcaggtggagaaaaacaaatagaagaaaaaacgcacacggaacgctcaaatactataggccacttgtgcctcggctcacgttgacctgccttaggccaccgttctcaccggctggcaggctcgcgcgccattggttcatgccgatcacgtactatctcatcttcccactcaaattccacgtccaccaaccgccgcttcgcccttcgctgctgccgctgggctccaaactatttttaagcgcgtcccgcgtcgccagtgagccgcgtcgcgttgcacggattattgcaatcgatccaaacaatcacgtcggtcgacgagaagaagtgagtgatggcgtcgccgacccggccggggccgtacatgccgcgcccaccggcggtgccggagtggctgaacaccggggacaacgggtggcagctcgcggcggcgacgttcgtcgggctccagtcgatgcctgggctggtggtgctgtacggcagcatcgtgaagaagaagtgggccgtcaactcggccttcatggcgctgtacgcgtacgcgtccacgctcatcgtgtgggtgctggtcggcttccgcatggcgttcggcgaccggctgctcccgttctgggggaaggccggcgcggcgctgacggaggggttcctcgtggcgcgcgcgtcggtcccggccacggcgcactacgggaaggacggcgccctggagtcgccgcgcaccgagccgttctacccggaggcgtccatggtgctgttccagttcgagctcgccgccatcacgctggtgctgctcgccgggtcgctcctcgggaggatgaacatcaaggcgtggatggcgttcactccgctctggctcctcttctcctacaccgtctgcgccttcagcctctggggcggcggcttcctctaccagtggggcgtcatcgactactccggcggatacgtcatccacctctcctccggcatcgccggcttcaccgccgcctactgggtaagataagctctcgcttcctctaccatttgcaacgtacggtcggttggttaattctggtcattgcctggtcggattttcttcacaacttttggttgttcggtttgtcacgacccgccggggtttacttttccggtgcgcgctcacgggtcaggacttacacgagtacttgcacccgtacattagcagtacatgtgacgtgtggactttgtggtgaaacgttcggggcacgcggtcgcgggagcacggagtcgtcagcgcccggggtagactagtcacttgcgtgtattgatcgagtgagacgtgttttggacatggacgatggtgaactagtactatggaaagaaacgattcgatgtagcttaggctcgagcctaatttcctcgtacctgcaaaagtacatatatagacgagttgctagaaagaaaaaaaaaaaaaacagtgctggctcagcttgcagaatccagattctagaacagtacgtggcacgaatctcgacggcgttaagtgttaaccacgtgacggcgattaataaatactttttttgtgacaggtggggccgaggctgaagagcgacagggagcggttctcgccgaacaacatcctcctcatgatcgccggcggcgggctgctgtggctgggctgggccgggttcaacggcggcgcgccgtacgccccaaacatcaccgcgtccatcgccgtgctcaacaccaacgtcagcgccgcggcgagcctcctcacctggacctgcctcgacgtcatcttcttcggcaagccctccgtcatcggcgccgtgcagggcatgatgaccggtctcgtctgcatcacccccggcgcaggtatcagctgcttcctgctagctttgatcaattctagaatccaactagattagcaatttagtactactacactgtgattagccagttgccattcacatagtttcattaatgaggtcgttgaattggccattcgttaattaattcagttggattaacgaactagttgtgtgatggcatgcaggtctggtgcacacgtgggcggccatactgatgggcatctgtggcggcagcttgccgtggttctccatgatgatcctccacaagagatcggcgctgctccagaaggtggacgacaccctcgccgtcttccacacccacgccgtcgcgggcctcctcggcggcttcctcacgggcctgttcgccttgccggacctcaccgccgtccacacccacatccctggcgcgcgcggcgcgttctacggcggcggcatcgcccaggtggggaagcagatcgccggcgcgctcttcgtcgtcgtgtggaacgtcgtggccaccaccgtcatcctgctcggcgtcggcctcgtcgtcccgctccgcatgcccgacgagcagctcaagatcggcgacgacgcggcgcacggggaggaggcctacgcgctatggggagacggcgagaggttcgacgtgacgcgccatgagggggcgaggggcggcgcgtggggcgccgcggtcgtggacgaggcgatggatcaccggctggccggaatgggagcgagaggagtcacgattcagctgtagtggtggtagagtgggcattttgtcgcaggctttgccgcactgcagctaaactggacgttgaccatacgataattctcatctcgtacaggtagatcttgcaactagcaagatggagtagcagatattactaaacacatatgcttcattattttatttctggagtaaatcaagattcgttttggggtagtggtagatatttgcaatctgatgcagtcagtatgcaatgtgtcctaccctgggagtcccaatagataaacaaacttttgccagcattgcacacaagcaaacctcacggtaccatggtttcagtggaatctactgtaaattggttttgcttagttagcttggacaggtctgagaatatctcaaaactgtagagtacgcgaccgcacgtggacgcctgatctgagtctgaagaactgcagaagcaagcctgaagacaggccagtgcaaactgaaatatgacagcctaacagatcaccgaagcaattcatcacttgcatcattcgataacattgcacaggcagtgttagcaataggcgtcaaacttcttgcatatacacaacaatcgtgtgcctgtgaaaggaatttagatacctgatctcacaagttaacgatacaatgagaaaacgcaatccgaggctagtcgaattgctcccagtcggtgtttatttgtgtggaagaaacccgtggtgggggtgcattcaagctgcccatgccattgtcgaacgtctcccactgcgttgtcactgaaacagatttgttttgatcgctgaagggattggcatttcttgccttcagcttatccaacgtctccacaagaccttggacacggcgtacctgcaatgcaagtcatcgttattgtgagggtatgtacagcatacaatgcctccagtgactattactttatgacaacaaaaagattttgcaacagggaccaaacccgtggtcagatggtcatagcagcaacaattattcagatatattaccgtcaagcaaccaaaccaactccataaaattcaaaagggcaaaataaggattctttaaactgaagaaacaaatgaattttgactttattaatatgttacaatacatataagatgttctaccgattaagcttggctcaacaatgtttttgaagcaccctgcgcatgctgaccatttcactggtcttgttcttcaatataatagggcaacaaaaaagtgaggaagctacaaatagcatttcactcttgaccaacaaaggtcctaatctggcaaaattctctcgaaaccaacactaataaatggttataaacctcaggtctatcccatatcagaccaggcatttattaagtataagctccagcaggttttgcattagaagctggattcaaaccacacagccaagttaaaatagttttgtgctatactggttacaagcctaaggctaaatggaccgtcttaatgtggaactgctcaagccacacaactagttcattacccataaccaagaaaataatcattggagtacgggggaaggtcaaagtcaaacaaagaaactagaattagtcctggaaggagttgggagacacccttgtgatgcaaatgaagactataattgattcagcatagcagaaaatagctaaatggcaagctttctttactagatgtgccgtatgtattgtcttttcatggcttttaagccatggtcctataaagggcattaataagatttatcattacagggtagcaatgctacactacatggtaaggaacaaaaaaattccatcatcagcatagatgtatgttgattcatcaggaaaattccatcatcagcataggtgtgtgtggttaaattttagtaaataaaaggaaatcaggtttgagtaatagtatgtgatagctatttatcaacagaaaataaaccattttgaaagcttaggatgaccaatatttcagcaccagtactagtaattgaatttgtattatatgagataagccatgaccaatcatgttgagatgtataatggccactgtacctcagccttcctttgtgcccttgcttctccctctgcctctatgccatcaagtttcagcagctccatcataagaagctccgtcaagacaacaaaatctttatcctcaatctttctccctgcaaacacactcttctccaaatcacatacctggtaatagaacaaaaacaaaaaccgtatcagcatcaagatataagaagagttaatgtttaatggaagaggctggagaaacattattccttcaccttggcagagagtctgtcaacttcagctcttacacggccaacagcctcacaagccttcatcatgctctcatccataattactggctcggccctctgctctacattggcaggggcaggcttctcaagtagaagaagttttgctccatccttgaccccagctgtatgcaggaactcattgtcactcttctccttcccacggaagaagagcctctgcctttcaggctctacgccagttgcctgggtaaggacccccttcaattcaccttcatacaaaagagtgaacaattaatcctaactacatatcaaagcaatggaaaccagttccttctaaggaagcagatcatgatgtactgcttctgcgaactactccaaaaattcgataagagaaggcttctttcaaacgttgaactatataacattgagcttccatctgtacagaaaatgataaaatagtgtaaatttagtaaatcacacaacctcagttgagccagtatgtgcacctatttaacgtcatgaatgaacaggagtgtactaatacaatacaacggtacaacagttttaacgtcatgaatgaacagaagtgtacaaatacagcggtacaacagtaattcagtgtgggcctaatggtggacggatatagcatgacgcacagacatgtcgtcaaatatacacttaaaaactagtatatttttgtcgccatatacctaggtacatctgcttgccacagtccaagaggatattatagttaaaagagcaggaccataatccatctgcctgccccctgccacacaagcacatagtattgcaatgcttttgttctgaatctagatttgcatccaattcgattcacggaaaaggagacaaggacgatgtgatcttattaactcctcgacgaatcgccgggttgactggtcaagatccgtagctcaagtgcaacatagcagatcgagcatggtggtcgctgctgtaactaaccgggagcggcaattcgtcgtgcactttccgggcaagcgtttgagcttgcctacatcaaaaatactaatcgaaacataaccgatcacaaggcaccctcgttgcaatcgcccacggcgagtttcacgaggagggaggaggcgaggatcataccgaaggtggagtgcgccggcacggcgacgtcgcggaaggaggcgccgtgggagaccctgagcctgacggccggacccgtgtcgccgtccctgcgctgcaccagcatcccgccaggccggacctcccactcgccctccgcgtccctcccgcccgatctgcctcctccaacgccgctcatcatcgccgaccccagccgcctttatggcgcccctctcctccccccacacgaccccaccgattcggtcgcggcgaaagcgacgcgcggccggagggaggaagggatggagggaagatgaggagaaaaggaggatttggtggcgcgtggcttttgcgaagggtggaaggctccctccccgcggggttccttcccctccggagaagcaagaacagccgcgcggcagtggcggtagagcttgctcgcgagcggcagcggcagcgagattttgcgagagctgttttttttttttcgccaagtacaactttggattctcgcgaggccgcagggggaaacaaaggaggctcgctggcgtggaggcctcgtctcgcgtcgcgtgctgcctccgctgcggataggacgggagagttcgcggtggggtcggtcgacgcctcgcggggcgcgtggtttttgggccctcgtgacacgtttggttcgtgagaatgtgagatcgctcgcgggacggctcggtgcggtgcgccgcgtgcgcctactggtatcgccgagtcgaactctccacagcctcctcggactagcggtgcagataagtccacgattcggttgcagattttcttttttcaattaactcccatctgaaacctgaatttccacttgtacgtacaggataaaatctcagctttgttcatagctgccgttcacctgatgattaaaaaaaatgtggtactaacgaggagctgtcgtgatgtttggtgtgcctaatccttgtcttcgatggccaagggtaaacgtcgtaattaaggcccacaaaggcacaaaccgtgattacgcaatgatagcagactttatggtacggctaacatgatggtatggttgcgccgacactagatggtaaagtactgcaattagcggtagtaagtagtgtagtaccactacagaagtacagtactaacattgttaggattttgcagttgagatgtgggccctgtgagctaaattatgaggcccacaagacagtgtaatgtcctcgctgggaaatggaagcgaagccggaagcgtggcaaggccccaaggccggtggcaggtcggtgatagactaattaaattaattagtacttgacaaccatccttttttttaacttacggaggactgctagacagccatctgatgcatatgctccgaggaaaaccaatgcatgcatgtatatacagctagctagcccacatttacgttctcagaaagtaattaattccaatattctaaaatatacatagccctttaaattttagcagcatagctgatgaggacatcccacactattacccgctggcagagacgctaaagtcgagcggcgaccgtgtgagcctctgaataatcccacattgcttagcttgggaggaggaagccaccttaaaagggagagccacccttcccctattggactagtcttttaggaagattgggcatttccccgagtgggtgtgcctatgaactgttggggtccgggtaaccttaagttattgggcctcggccaaccccacctgggggcggaagggactaaaaggctgggcgggactaaaaatatctttagttaatattcttaccaagataactggaagccccaaccgctaagaatcctagtgaacctagaaaaagaatacaggcccagaaaaaattacctctttttcgagaacctttcagaagttctaaaagattttgactttactttttttgattctgaatattcttaccaagataactggaagccccaaccgctaagaatcctagtgaacctagaaaaagaaagctaagaatcctagtgaacctagaaaaagaatacaggcccaaaaaaaattacctctttttcgagaaccttttagaagttctaaatgattttgactttacttttttttattctgaaatcgccttcgccaactagatactcctgtaaaatagttggttagatacattaactttctattcaaaaagcggaagggaggggggcgggaagggactaaaaacatctttaagggagggggcggaagggaccaaaaacatctttagtcccgctttgaaatctaaattcgggcggctgggcggaagggagggggcgggaagggactaaaaacatctttagttccgctgggcagaagggaggggggctttgaaagctaaagtcgggcgggaagggactaaaaacatctttagtcccgctgggcggaagggagggggcgggaagggactaaaaacatctttagtcccgctttgaaagctaaagtcgggcggaagggagggggggcgggaagggactaaaaacatctttagtcccgctttgaaagctaaagtctattaggaagggactaaaaacatctttagtcccgctttgaaagctaaagtcggacggaagggagctaaagtctattaaggaagggattaaaaacatctttagtcccgctttgaaaaagtctattaaggaagggactaaaaacatctttagtcccgctttgaaagctaaagtcgggcggaagggagaggggcgggaagggactaaatagtcccgctttgaaagctaaagtcgggcggaaaggagggggggtgggaagcgtcttgcttagcttggaaggagggcggaaggaagggaggggggtgggaagcgtcttgcttagcttagtcttgcttagctttgaaggagggcagaagggaggggggtgggaagcatcttgcttagcttggaaggaagaagggggattaaggaagggactaaagacatctttagtcccattttgaaagctaaagtcgggcggaagggagggggggtggaaagcgtcttgtttagcttggaaggaggaagccaccttaaaaaggagagccacccttcccctattggactagtcttttagggagattgggcctttccccgagtgggtgtgcctatgaactgttggggtccgagcaaccttaagttattacttattgggcctcgaccaaccccacctgggcccttgtttaagggggtgggaatgatgaggacatcctccactatgggcctcagccaaccccacctgggcccttatttaaaggggtgggaatgatgaggacatcctacactattacccactgtaagggcatcctccaatattaaggaagggactaaaaacatctttagtcccgctttgaaagctaaagtcgggcggaagggaggggggtgggaagctttgaaagctaaagtcggacggaaggaaggggggtgggaagcgtcttgcttagcttggaaggaggaaggggggtgggaatgatgaggacatcctacactattaaggaaggactattaaggaagggactaaaaaacatctttagtcccgctttgaaagctaaagttgggcggaagggagggggaggaagggggggtgggaatgatgaggacatcctccactattaaggaaggactattaagcgctttgaaagctaaagtcgggcggaagggagggggaggaaggggggtgagaatgatgaggacatcctccactattaaggaaggactattaaagaagggactaaaaacaattttagttccgctttgaaagctaaagtcgggcggaagggaggggactattaaggaagggactaaaaacatctttagtcccgctttgaaagctaaagtcgggcggaagagagggaggtgggaagcgtcttgcttagcttaaaaggaggaagggggtgggaatgatgaggacatcctccactattaaggaagggagggggtgggaatgatgaggacatcctccactattaaggaagggactaaaaacatctttagtcccggtttgaaagctctatcaaccgggaaaaaaattggcataagcggggtggttgcacgcggatcggatcaatacaatctcctcctctccttttttaactcatctcctcacagagtcacccttatctcttcctctccctcctcccttcctctcctcctctcccccctccctcctacccacctccccacctccctctgcaacgaagggacgcggagggccgggcgaggcagcgtggcgccgcgctggcggctggcggcctcgcggcggcggccgaggacgcggcaggtggcgcgcggcggctgccggccggcgtggtggcgcggcgcacggagggccgggcgaggcggcgcggcggcgtgctggcgcgctggtggcggagccggggacgtggtgggcggtgcggcggcggccggcgtgtaggatcgagatgtcgactagaggggggtgaataggcgatttaaagaataaataacacctaatcaaatctaacctaagttgctagtccaccgctcaaccacaaagccaccgcacgcccccttcgtc

SEQ ID NO: 39276 - DNA, 4889 bp, Oryza sativa
aaatgaaaatgcaatgacctaatgtggcaattgtaatcatctctttgctaggtcattacccctcttaatagtacggcgaaactaaaaataaactagcaaatttgatcgccttacacctcgatcaattctaaattaaagcgctagttttaccgtcttctttctctttgctttgcgccgtcaattttaatccatcgataatcatccatgcgcacatatgatgtggacctaacttaaaatgtatagctcaaagacaacggttagtccacaattagcgcttgtcattaattaccaaaattaacaccgggggcctaaatgcttcaatctccccctttttggtaattgatgacaaacaccacaaatatatataatcagacatatagcacatggacatatattgtattgacaagcaaaagctccccctaaacatatgcataacaatcacaaatagcaaatatggagccaatgcacaattcaatttcacatttcaacatatcacaaacacaagagcaatatctcaatgtgaacttaaagaaatattcatccatgggcataagatggtcacaaatatatcaatgtcacaccaaccatccatcatagcagaagttcacattaagaccacataaagggctcacaaataaatataggctattacaagaccacgaagggtccaaatgacatagagaacaacaaaacgaaaaaggaacacacaatatagagtaatagcccatacccataccaaatatagcccaatcctccttagcctattaaatatgaggtgactaacctcactactactagtcccaacccacaaaacataaaacacactattctcccccttttggcatcaagcaccaaaaaggtcttcactcttgtggaggagaaggaggacgcgccgaagtggaaggatgagaagcatcacggtggcgatgatagacaaaagcttgggtactctccaaggtttggactcgagaatccaatacacccaccctagtatgcaatcttcccaccgaagtattcaagttgcaaacatcggtgcgcaagccacgaacatcctcatgcaatgcttcatgcccggtggataagcgttgaatgctttcacttagggtattaatagccccaaggaccgggttgaagaagtcattgggttgcattccaaagtaggcatattgtggatggaaaaaaaaacacttggatcatacccttgaggaggaggggggctgcacttgagcttgcaccttgatcgaatgttggttggcgcacacgaggagctctaggggaggagagtttgagacgaggcttgtactccttatgttcttttaaattgtgaccaatttgtcccaacttgctttgaatcaacctcattatgtagggagcataatagattccttgtccaagagtcccctttgagatggcaatctccttcatcataaggttgataacatcaaaccgacgaccatccataatggcatcaataacatgccaagcaactccgcgtatgtcatcattgttgccgcctcttgggaggatggtggcccttactatgcggttgatcacacttgggagagccctcaaacccgccaccttgccatatgtgtgccttctcccttcttcataaaactgagaaaagtgatcaatggggaaggggttgtgggtgtgctcatcatgaaggtcatccccgttgttgaagcgaatgtgcaagagctccttgaattcatggcggttgatagagcatcggagggtccccgacatccacttcattgcatcacaatcgccggacacccatacggtggcatagaattgccggatgagatcttcatcaaaaggttgcttcatggtgacaattctatcaatcccaacggtccggaacatctcttgcaaattctcaaactccggtgtctcaccaatgtgcctccaagaaatccacttgtgctcggcgaaggctttgttggcatacacttgtgcatacacggacttttggaaccgtgtatgaaatcttggatcattacaatcgttaggcctccggaattgatcatgatgacggaggatagtgtattgttgagcattcctcaaattaagcacaaattggatggaggaatcgagaggactcccatcatcacttgcctcatcatcttcaccatttccactcccattgtcatcaccatcatcacttacttccatctcatcaccctcaacattttccatattgtcatcatcactttgaacatactcatctccgcttgattcctcattctcactgacgggatcgggcgtgggctcacgacgaccatggcgagtgcggggaggcatggctgaaaaacaaggagcaaaggatggataagcaacaattttagaagccacatagtgaagagggaggaatgggggtgctgcctgtcaggggcggtcagaccgagagccaaggccggtcagaccgatggccaacggccggtcagaccgacggccattggccgatcagaccggtgtctcacggccggtcagaccgacggccataggccggtcagaccgccgctgacagtagcacaaccgaatccttccacaatccacacaaatgattctaaaaattgctaggacaaagttccacaagattggaacatgaacatcaaggtgtaggtctatttcatagagattgaagcaatgggggaaactacccttaaccctagagatttagatagaccaatttgagagcaaagcacaagagggagagtgatgtaccggttgaaggagttgaatcacaccaagaaaccaccctctattggtgcaaatcgaagaacacctcttccttcacctagtgttccatgccatggatcacaaactcaataagaactcaaatcaatccatggaatagagagaggaagaggaggagattcacttacggtgtaaccggagtgattttgacggttgaaccggatggatttggtggagggaggtggctagggtttgggagaggagagaggaggagttttttcgagttggagaagagaagagatgagatgggatgaggaggggtcgggtagaaggaggatgaggaagaaaggataaagtcctgggcccaccatcctaggccggtcagaccagctttacgcgtccggtcagaccgccgggttgcagccggtcagaccgagccctagtggccggtcagaccgctgccaccaggccggtcagaccgcgcatatagcgccggtcagaccgcctggccccccagccgactgtgcacagcccttgcacagttggctgcccccactcaataaatatcaataaaattttgatttttggagcaattttgaaatgtgtgagttgaaatattgccaaccattcataatatttgaaatttatgaagatttgcaacaaaactcacttgagtgctaggaggtggccttttatggtctataggggtttttggacgaatttgattttcaaacaacttttgaaatatttggtttttgaatatgatttgaatacctaaaacatttcaaatactcctctctaccaactttgttttgaatcttttctcagattccttctcaaactcattatggggtttaatctcattttggccaaaaacaagaatctagattcttcaaaagagagccaaaatggcatttttcgttcaaaaatcatttttctagcaatgtgaggcttggaaaacatatagggacccttttgaaacattttccaagaaatagttttcaaatttcattgattttgcaaaagttttgacttatgttgacttgggcattttgaaaaacactactagcacttttagttgatttgctcacatataaaaggaagtagagcacatgcaagagtccaaaactcccccttaatgtgacatgctccattttcacaatgaagaaccaaatggcaataagtccaaagcataagagcaaataggagcaaatatacaaaatgcaaaagaagcaaccatagtgcaccatctcaaaccacattagagaaatctatgacatttaactcattcctcaacttacaaaagcgggtttcatcaagaggcttggtaaagatgtcggctagttggtcctcggttcttatgtggctaatgactatgtcacacttggcaacatggtctcttaggaagtgatggcgaatgtcaatatgcttggttctagaatgttggaccgggttattggctatttttatggcactatcattgtcacataggagtggggttttggtgaaggatatgccatagtccaacaaggtttgtttcatccaaagcaattgggcacaacaactacccgccgaaacatattccgcctcggcggtagagagggctacggagttttgtttcttggatgaccatgacacaagggatctaccaagcatttggcaactaccggatgtgctctttctatccactttgcaaccggcataatctgaatcggaatagccaacaagcttaaatttagcaccttttgggtaccacaagccaatagtataggaatgctttaaatccttttcacggccactaagtgacactccttaggagcggcttgaaaccgtgcacacatgcaaacactaaacatgatatccggcctagatgcggtaaggtaaagcaagctaccaatcatggaacgataaagctttaaatctaccggtttacctccctcatcaaggtcgagatgtccgttggttgccataggtgtcttgatgggcttcgcatcctccaaaccaaacctcttgagtagatccttgatgtacttggtttggctcacgaacgtcccatccttgagttgcttgatttgaagtccaaggaagaagctcaactctccaatcatggacatctcaaattccctagacatcatatcaccaaattccttcaacttgtgtgaaaccttgcgccaccaaccttgcct

SEQ ID NO: 39277 - DNA, 7140 bp, Oryza sativa
ttcacaaatcgaagcgacacgagatcgagtttgaacacccttactaatgtcacccaacacttggtcaattgggtgatccttggaaagagcggtgtgtattcttggaggcataggtggatcttgtgccttctcctcctccacttcaacttgagcttgacttggcgaagcggaagtagatggctcatcttgagtggaggtggatggcttgtcttccacttcaatagacttgacatctctaatagacatgttcttcatagctctcatcaagccttcatcacctacaacatccaaattctcgtgcccctcttgggagccattagtctcatcaaattgaacatcggcggtttcttccacaatacctttgttcttgttgtagacccggtatgccttgctatttgaggcataacctagaagaaacccttcatcacaccgactttcaaatttggttagtctaacaccatttcggtaaatataacacttgcaaccaaaaactcgaaaataggcgacatttggcttcctcccaacaattagctcatagaaagtctttttcaagagacgatgcaaataaagtctattggttgcatggcaagcggtgtttatggcttccgcccaaaaagaatcggaaacaccatattcatctagcatagttcttgccatctcaatcaatgtacgatttttcctttccactacaccattttgttgaggtgagtaggtagcggaaagttcgtgtttgatatgaagatcatcacaatagtcctcgatattggtattcttaaattcggaaccattgtcacttctaattttcacaagagtgcaactaaattcattttgggccctttttgcaaactttttgaaaaactcggcaacaatagacttatcatgcaaaaagaacacccaagtatagcgagaataatcatcaacaatcacaagacaatgactattaccaccaatgctcttataggttgttgggccaaacaaattcatatgcaagagctccaatggtctagatgtggacatgatactcttagtagaatgagaacctgcaacttgcttgccggcttgacaagcactacaaagcttatctttctcaaacttcagatctttcaagcccacaactagatcacgttttgaaagtttgctcaattgattcatgccaacatgagctagcctcctatgccaaagccaacccaatgaagtttttgcaactaaacaagttttcaaatttgcttcactagaattgaaatcaaccaaataaagatttccatatctaaaacctttgaacacacaagacttgtcaagaaggctagaaacaataacttcttgtgggaagaaggcacatgacaagccaagatcacaaatttgagcaaccgaaagcaaattaaaatttagagatttaacaagagagacattttcatttgacaaatcattggagataacaattttacctaacccaattacctttcctttgctattgtctccaaatgtcactttctcttgttcattctctcctacttcaaatgtggtgaacatagccctatcaccggtcatgtgttgagtgtatccactatcaagcacccaatggctcccaccggtgcggtagttcacctacaaaagaagatcaagctcttttaggtacccaaacttgtttgggtccttggaggttagagaccaaagctttgggcacccaaatggcattctttttaccaccgagtataggggaacccacatatctagcaacaatactaccatcataagccttcctaagcatataatgagaatcgaacatgcatgtcttaggaggcttaccaccggggcaatcactcaccaaatgcccaacctcacaacacttggagcaatacttaccattgctcttgacaaaacgagtggcatggtgagaaggtttcttacccttctttggagtgaatccaagtccctccttgttaaggatgcaccgttgctcactcaaaatcttgtcaagagtgttcttacccttgaagcatctctccaaactcttgttgagcttagccacttgctccttaagctcattgttctcaacaataagtgaggcatcacaaatagaaacacaagagctagagctagagctagggctaggcatatccataagatcatcccaagaggtagaaatgctagatgatgcaatatgagcaatatggcaagtagcactatcatcaagcaaatcacaagatatgccaacatcaatgtgagctccatgttgagtagtggaaaggaggttgtcatgagcttccttaagcttctcatgagaaatggtgagtctctcatgagaggtctttaactcctcatacaagacctccaaagaaacatgatccttctttagggccttgaacttgacaatctccttctcactataagcatggagctcctcaaacatactcacaagctcatcataggaaacatcatcacaatcatcatcactctcactatcactaagggatgttaccttagaggagccctttgccatgagacaaagtggagcgaagagtgatggagcctccttgatgggaacaacggccatcttcttcttcttggagcttgcatcatcaccaccttcttcctcggacccggatgagacggagctctcctcatttgagtcccattccccgatgaaagcctcaatcttcttcccttccttcttaagcttcttcatgagcttgtagcctccagtcttcttcttggatgacttgtctccatcatcatccttggaagggcacttggaagcaaagtgtcccttctcaccacactcaaaacacctcaagttggagagagtcttgttgggtcttctatttcttctcctatttgagttggagccccttcctctctcctttctccttcccaagagatcattgaactttctagcaagaaggatcatctcttcctacaagtcctcattgacttcattcaccttgctcttgctcttgtcttcaactttggcttggagagcaacgcacttcttggagggtgaggcttcctccatctccttcttcaacttgtacatgtcattggtgttgatcttccccaagaggcttgcgggtgtcattcttgacatgtcggagttgatgagcatggtgacaagggtctcatacttctccggtagggctctaagcatcttttgggcaacctcaagatcggtgtagtttgccccaagccccttgagatcattcacaatgacattgagcctcccatacatgtcattcacactctcatgaggcaacatggagaatgtctcatattggatcttgaggaaatgaagcttggcatccttgtactcacttgtaccctcatggatctccgccaacttgttccaaatctcatatgcggtctcaaggttgctcactctatcgaactcctcttggctcaaagagttgaacaaggcattcatggcttgggcattgagttggaggttacggtgatcactctccgtcaagggtgtgccggtgatatcaaagcctacatccacaatactccaaatatggaagctcatagctttgaggtgagtagacattttaattttccaagtggagtagtttgtgccattaaacatggaagccttccctacatggttcacctcgttcgacatcttctctctaggcggtgaagcccaatcaagagagaccaagctctgataccacttgcaggatcgagatgtcgactagaggggggctgaataggcgatttaaagaataaataacacctaatcaaatctaacctaagttgctaggcttggtgagggtgaactctaactaagcaactaatttatgttttgcaaacctagggtgatagtggctcaattatatctctaggaaagtaaattgcacaaatgtaaatgcgacaatcaaatgagacaatgagacaagagatttttcaccgaggttcggaaactcgccggtttcctactccccgttgaggcgagcccaactccaccgctcaaccacgaagccaccgcacgcccccttcgtcaaggggtgggcaaggcgggagccggcccacggagaggactacccaagcctcgatcactcggggtagttcttacttcactccgaaggtggtgaactccaaaccactcacaaaccggcgccgggcctcctccacaatcttctcggagaggtcaccgggcaactcctccacaagccgtctaggagacggcaacctccaggagtaacaagcaatgacccggtgtggagatgatcaagtgccacactagctctacaatggaagcaaatgcacttgactcttggctaaacaaccctctaacacactagatggatgaacacaaagctcaagtgagtgtgagaaaggtgcaaggagtgtatgcaattgaattgggtgccaagagagcccccttgctgctggtggggaagtatttatactcccacccaccaaaactagccgttgggggcgaaatcccccaactctgtgctctgccggtctgaccggaggtatgtggccggtcagaccgtgctactctgcaacggctagaaaactagctgttgtagccctgtcagagggccccatctgcctggccggtcagaccggcatggggtggccggtcagaccggcctcggctcggtctgaccaaatatggctccgtcggctctgtatcggccatcccgagcagcaccatcccggcctccagggggccggtctgaccgcgcaaatgccgccggtcagaccggccttatgctccggtcagaccgccttcttgcggccggtcagaccggccagggcacgccggtcagaccgccactatgtggccggtctgaccgcccctggtcaggccgaacccagtgaatttgcaagtgaatgtgtgtgtgatgaaaaagagagcacaaatgaaaatgcaatgacctaatgtggcaattgtaatcatctctttgctaggtcattacccctcttaatagtacggcgaaactaaaaataaactagcaaatttgatcgccctacaccacgatcaattctaaattaaagcgctagttttaccgtcttctttccctttgctttgcgccgtcaattttaatccatcgataatcatccatgcgcacatatgatgtggacctaacttaaaatgtatagctcaaagacaacggttagtccacaattagcgcttgtcattaattaccaaaattaacaccgggagcctagatgcttcacggcgacgcggcgggcggtgcggcggtggctggcgaggcaacgggccgttcgtcttctttcttttttttttgttgagaatctgtgattcgtgtcacaccctaatctgataccgccgtacaacggcacctgacaggagcgtgtcgtagggaaaacaacgtgaaccgcttcctacgaaaccgcgatctcggtaccagtcccaggacatagtgctggtacccacggtgactcccagagtccagctgcccagcagcacaacaatctgcttccactcgggaagcctaatctatgatgcccgcagacatcccgaatcacacagattcgtttctgaccactcagatcgtccatctgccacataggctgattctggttacgattcccacaccacaacaacttttcacaaagcacaggcaaacaaatctacgcaacgggaaccacctcacatccacccatgaccgtgggcacggctgttcgaacagttagttaacctctgcagagggggtacactttacccacacgacacgaacttactccagacactggccggtgtcagaggttcgcgacaaagcctttcccaagccgacccagggatacctcatgccacatagaaggatcaaatcctcacataaacataggccattttaggcgttcacaattcaaactccaaccacctcgatcggtaattcagcaagcttctcgttcttgcattaccaggaacccggtttggctccaaccgaccccgccccggcgttcccaactattggcatgcgaggttttcctgaaccgactagttacttagccagggtgtcccatttcaccttgtggttgcactttgattatgttcgatgagtttcccacaggaatcggtccttatatgcgaatacgggacagtgccacataggcacaacccccgcatcgcgagttttcaaaattcattttgttttcaaacacaccgacaccacatgtcgggttttgaaggcttcacaaacctatttcccatgttttcgacaaacaacggtgtatgtgggatatttggtatacgcgctcagagagcacgaataccgaggtaccacaagggtggagcgacaaggaatcagggtagtacgacctacggaaattagtgcgactactgggtaggtccgtcggtttggcacgcaaaccgaggccaagcaagttaagtgtgtgattctaataatgcaagttgcaaataaaataataatgacttttcaattataggggcaattgatcaaagggtgacttgccttgctcaaggtcttcacgaagcttcacgaatcttcgggaaaacccgcgatcgacgaaaaaccgataaccgcaactatacgcaacaatcgaaaacctaaacaagagaccaaaagaaagatcctatttagactaattagtagtgccattaaatagatctcaattttatgaaaatactggaagtggaacggagtcaatcggagttgcgaattgggtgatatgaatttttagaagtttaattggagtttctggaataggagaaatggtttatgaaatttataatattctcaagaatattattgacagtcattgtcacgcgggaccaaaggaaatggtttatgggattttggaataaggaattgatttatgggacaaaggaaaaatgatttattaaatccctgaaaaagaaaaggatggagggatgttaattggacttgggccgagcgaagggacgcggcccgaagagatgcgcgggcgcggccgaggcgagcgggccggcgcgcgggagggaggcggcccaaggccgaacgaggcgcggcccacgcgacgcaagccggtggacgcggtccaccgtgccgggcgcaaggtgggacccacaaggcggcgacacggctcacgcgagcggggtgcacgcaaggcggcgcgttggatcggtggaccgggagacctttgaccggtctccgcggggccaggcgg

SEQ ID NO: 39278 - DNA, 2424 bp, Oryza sativa
tcgttggagctgaagcaactacgcgaggtcgcgagctcattccaccggttgagagggcacgggcgacgccgatagaggccggcgacggcgagcgacgcccgggacagagcaagggcgcgcggcgagatgtgacacacggcggcgggcgcggcgcggcgtgcgacaggggaaaaggggttcggtggggagctcaccgacgagagaaatggagtcggcggcgcggatggagtcgcggcgaggcggacgcgacggcggggcggcgcggcaccgagagggcgcggccggggaagaacagatggagaggcgcgaggatgggggcggcgcggagctcctcgtcgactcctcgtgctcgcaagttccccgacacgcacgacggcagaggagggcgagaacgacgacgaacggcgaggcggcagtggtgtgatggaggagaggaagcgagaggtatgggagggggtgtgggttttataggtggcgatgtcagtttgagagaaccgaccttggggcggtcaaggagatgaggcgggtggcgcgagcggtcaagcggcgcagaggtggtgacgccggcggtggtcggggaaagggaaaaaaagaaggggggaaaaaggggggttggtcctttgccatattgaggagaggggaagcagctgcttctcccattcttggacgatgcggcgtggagtggcaggggccatggatgacgtcggcgatgacggcggcggtcggtttgtcatggagcgggggcaaggcggcagctcgtggcgtcggcggcgcaagggctgatggcggcggcgttcggccggtcggccacctctcgagcgagcgcgcgcgacgcgggggtgcagccggatttcgaacggcggcggcgggaaatcggcgctgaggagagggagaaaggaagcagagagagagagcgaggaaagagagaggaagaagagaggcgatgcctctctctctctctcggcgcatgcagcgcacgtgcggggaggaggtgaagcgggctgagaggagatgggctggggaagaagagtcggcccactgagccagagggaggtaaaatagactttcacagagaaggctgatttggagagaattggagtttggatttggattcaaattcgatattcgaactcgagggttcagggaggaatcaaggaaagctcaagatagggtttggtatttttcggaattgggagcgagtgtttagcgaggattcaaaggatgcgactgaatttcggaatttgatttggagacttgaatcggaagaggaatttgaggtggaggattttgatttcgatgagagggaacaatgtgatttgagatgagatcttggcacgacttagactctcacacaaagaacgaaaattttcgcaattaggattttgccgaattagtttttaacgcctcacgaaaagcggagcgttacaattcgggtctgagacgatttgtgtgtgatatgaatatgtgatgtatttgtgatgaattttgtagaagttgtgatgtaatttttttaagattttgtgatgtatttagagatattgatttgagaatttggagactattcggggatgattgatttgggattttgggatgagatagagtgaatcaatatattaaaaacaatgaagaaaagaatagaataaagtagcaaccgatctgttaccaaccgggactaaagaaacaccaaccaggactaaaaatggatttttactctcggttttttcattcgggactaaagatagcgatctttagtcccggattcatagtcccggttacagggggttacgaaccgggagtaaaaactccttctccaccagtgtcttttagggagattgggcctttccccgagtgtgtgtgcctatgaactgttgaggtccgagcaatcttaagttattgggcctcagccaaccccacctgagccggattgttatcaatagcctttaaattttcttttatctaaatcgactatgatcatctcttattattaaatagataaaactaaacgtctagctctatcgatttgactgcatggaccaagcggagccataacaaaactgagctcgtgctgtgaggcctcatataaatatacaacgagctggcaacttatgaatcgagtcttcctcaccggagaacacaagaatcttgcataatgcaaaaaaaccgaagcataatatgagttgatgcatgcagaagtacatattaggagcaattataaatttaccgctgtttaaattattgttgtaaaactgtcatttgaatacttgtaaaaactgccataaactaccactcgtgtggcatttttacaaaatatcaaaaacagtggttggcttgcaaatgcccctaaatattatggtcacgttgctttcatgtttgggatttttttttattaattaggatagcccaacatgatgacgggttagcatt

SEQ ID NO: 39279 - DNA, 52675 bp, Oryza sativa
tactccttccgtcccaaaataagtgcagttttagtactatttatgttcaacgtttgaccgtttgttttatttaaaaaaagattatgattagtatttttattattattagatgataaaacatgaatagtaccttatgtgtgactaatttttttaatatttttcataaatttttcaaataagacggatggtcaaagcgctaaacacagatatttatggctgcacttattttgggacggaggtagtagaattttgttgtaacttatactactgcattcggttaattataccctaagttaatgtgtaacactttgttataagttgggagtggattttgatccctcgaggtgacatcccctcgttgtttgcgtgtcactctaatagttataaaaaaattgagaagatgtactaacatgtgatataacactccacaaacatgcaagttcaaatttaacttctacatttcgcaacgaaaaaaacaaatttaactgtgaatacatattaacttgttgtagtttaattttttttccgttgcaagatgtagaagttgatttttgaacttgtatatttgtgaagtgatatatcgcatgttaatacaacttctcaattcttttttcaatttttgtcataatcatttgagtgatatgcaaataacgaggggagtcccctcgagggatcaaaatagtttcctgttataagttaaatagtacactctttatctcaaaataagtttatttttcacttatctcacacatatcaatataaaagatcagagtacttttactttatcaaataccaatgaaattattcatttgttaatttgttcctaatatatttattttcatacttttacaaacacttatgcaattattatttaaagaatgaacttattttgggacaaacgagaaaaaagcaagttaaaaatgaaattattctagaatagagatagtagtaattagtactccttccgtttcatattataaaactttctagcattgcccatatttatatagatgttaatgaatgtaaacacatatgtcttataatataaaacggaggaagtaccaaaactaatgcattgtcgacaattttatttgtcacatccaaaacgtcagttatttgtgacgggagtagctaagttagctagtattatctaagctttcataatagtataacactatatgtcgaagttatatcttatctattattatatattaaaagtctattaaatttcctacaaacgctctcaagccgccacgtgtaaatcctacaaacgctcctaagtcgccacatggtgttttaataaatttaaggaatatctaataattcttaaaaggtaaaccatagattttattttaaatacggtggacccactttaaatccgtatcgtgtacgtgcactggtgcacgtactgtgtgcacgtacgtacgccatatatcctttctctcctcctcttcatgctatattatgtagaaaatacataatacatcattagaacattagaatatttaccaaaaaaattatagttgaagacccaaactaactatatttagtaagtaaaagaaataaaacacatttatagggaaaatcgtatagatattttaacaatctatttagcaacacatatattttaaatagaacaatatgcaataataaacaattttaattagaaaatatatatttaataagtatagaactttgggtcattattatgtttgtaaatatagataactcaagttggtgaaaccaatgaatctatctcaaaggaaataaaactcatctcttcctaatgtcgggcgtacctgtgcacgtctcctgtaagcaagatcaggatacatatatctaatctatctttactgatccatatgtaaatatatgtataacaaattacattaatatgaaccaattaaaaggagggctagcttgatggtccattattaaaaataatattttttaagatttgttaaaaaaatcccaaaacattcaatctaaaaagaaaaaagcaccttatttttaatttgaactattagacatgttttctaaacaaactaagtctacctcatttttaaatgatgaagaagaaaataataattacttatagagatgaattaaatattacgtagtatgaagataacaaatacctaatgaaaaatatttgagcaaagccagcaaataaatttatgaagaaaatgtacttctgatccttataagtttttcaaatacgggcttatgatatacttgcccgcgtgaatacgtgagctaccatccttgttgattttaaaagttcaaaccatctttttgtgaccgggggagcgagtagtaatgtactccctttgttcctaaatataagggattttggttagatataatgtatcctaattctatgaatctagatagggagcatgtccagattcgtattaggatacgtctcatccacctaaaatcccttatattttaggacgtagtgagaagaatatacgtactatcatacatgccgcaaatggaaaggaaaagaaattaacacagaatggagctgaacgataaacatcagactaaccgaaatggtgagatagcaattaagcgatcgagcaaacaagttcagatttcagaatgatatctaggaagcatgcacgcatgcatgtaaaacaaagctctgttatgcattgctccaacagaaccccatgcatgcatatatgcattcttacagaaatcaagagtctagctaatttaagggaccatgaccaaccggtaatatattggttgacgacctaggtaagctaagtagagctagacagctagtgggtagagccaatattcgagcatacttaaggaaattaactacctaagcaagccactgtctcactagctagctaataagatccttgcgcaccagactcctcaccgtggacattgcacaccgagtagcacgaggggtcagtctcctggacgaagacacagcaaggcaaaggaggcagctgatgagcgccgcccatcatcagctgccccgctggatcgagcgcttgctgcatcatctgatgagccgggccgtcgccgtagcccaccgcctcttgcatcggcgccatctccagcgtcgtcatcccggcgtcatcatcgccggcgccgccgtggcgatggttcagctcaagggccagatcggcgtcggcggcggagaacgccgcggcgacgtcggcgtgctggcagccctcctcgtgctgcacgagcgcggcctggtgcagggtgacctgcgccttgaggaacttgacgtagtggatggcctgctccagcatggacaccgtgtccatcttgctgccgcccggcacgaggctgcggagcacgcggaagcggtcgctgatccggtgccgccgctcccgcgccgccacgctctgcgggtcggtggagagcttggcgccggggcgccgccgcccgccgccccgcatcctgccctcgccgaggccgccggccgtggggtggaggtggtacggctgcgggtggatggggaagccgcgtgggtcatgcatgttttagtcgtggtatggatccatagatggtgcgctagctaggagatggatccgcgctcgtggctagctagctgcgcgtacaaacacaaatgtgctgggtttgtttcagcccctggagctatttccgcttgctgggaggagacgcgcggtatgcatatatatactgcgcgcgtacaatcgcatgggagagtataagcacatagatgcatggttctgttactccgcgtgatcttttttaaccatgtatagtacaaattataactggacaagaagttttatcagataaagcttcttatatttgatcgataaagctttgtcaagtacggtttgatatttactttgttcctagattctgtaattctcgtgctcataacttaccctaagagggtagaagttggaacccgggccaatatgttatttggattaaccatcgtcatggccaatcttgtaagtgatttggtcaatcttgtaagtgatttggtggttcagtgatatcactgaaccaaatcggttaataaagaggaaaaataagagaattggtgttgagattcatactctaagacttgacaccaacaaattaaaaacgccaatcgaagagacacagcatgaagtgtgtgtctagagcttgtagggatgatctagatggctaaaacctaaaggtgagcagagaaattaaagggcgtcgttatattattccaagcaatgaattgaactggatgaggcagtggtagattccactagaaggtgagaaagaccaagtatgtttaggtatgtagtagagggagtgtgtcgcataagccactacagacaggaaaagtgcgacaagacgaatcaccgacaaagaagaaaaggggggcacatgggagtattgctgaagaggtggggaagagagaaggggcctttagcgacttcattggtgacgagagcgtgacaaaaatgtacaatgaagatatcatgggttatgtaataggaccaggaaatatatattagattacgatcttacatgagtccgatgtaagctggctactcttttaatttgattgaatttttatattggacaatagacggtcccctcttaagaaatacatcatgcactgttattgtattttccccctctagtctcatagtttgatgctttgaattcttatagaaaagggataggaactctgccaatcaattaagaagaaaatagggttacagtcaacccacctaagaccagggtttgaattgattttaaattgatgagtttaattaatttaaattgatgagtttaattacgtttgaaaaaggatcaacgcaaggcttcttctattaataaaaaaacgtaggcaatgttttcgtaattggcctagttatttctgatgatcagtgcagtgggcagaaaaattgtgctccgtacctactcaagtgcacgtgcactcgtttagattcatgttttttgttcttaaatatcaactgaatggttatattttttaagaaaaatatcacaacatttaaacaattaattaatacatatatctacaactttgcaaaattaaagtcctaatttgtactatacagcgagagatgaaataaacagattcggtcatgaataatgttgacattgttagttcacaatacatgctttaattcatgaagaggtacgtacatggatgggatagctctagtctctagagatctcgactttaatttttactagcactcatacagtaccagtgatcgaaagcccgctatatttttggtgaaaagaagcctagccagctagggtcttcggaagccgtacaatccctttttattgagtgcctttgtgaaatacatgatcacatgattggtacctgtgtcacattcacccctttgtacacatgaccacccgggaggtaacacatccccggagatggtggcaaagagacagcatagaataatggctctttattcgtttctagctagcttcacctctagtcttctgtctactccagttgttttaccttgtacagacttgtgtttggtggatatttgaagccctgtacgtagccgatgctgtcattgaaaaaaatatttcagtcattgggtcatataagctccatgagcgcttatgggacttattagcgtggtctactcttggaagcattactttggacgatccctccattcatttctatcgggaattaccatcgtactcaaattatttttgcttaagcaaatgctagcttattatagtttaagcaaataggagtatgagacaagttatatatgaccgcagcaaacacctccctacttataaattttagaatttctggctctgtgatcactaggataataggtaaccacacatatatacgttgagagaaattaattcaaatagagttagcgggatttgaaacacatattttttttaaaaaaaactattttttaatataataaacgcgaaagagttgaacacactgaattatcacttccataattatcctaagaaagttcaacgaattttggaaaaccttcggcttccaaacaagatgggatttcactgtcgagcttataacttaacgacacatgcatatatgcgcatgcatggttgcacaagactcgagtcatccaaatctctgatcatcatcattggaaggatgttatagcactttgaggaaatcgttgaatcgaaggcgcccgataccgtacgcctacaagcttccaaccgagcgtgcgcgagtacagttcttggaaatggaagtcgctgtgacacagtggctacaagtacgtgtactttctattctattcggtcgatggccatgcatgaacagtgcccagccgcttcgcggtgtagcttagcttagcttccatatcgacgagtacgtacgtaccaggtatatatttccttctatatatattggctctgcttgcaacaataggctatatagctactcctaccttccgggcctctggaagattaagtgtgtgtttagttcacgttaaaattagaagtttggttgaaattggaaagatatgatagaaaagttgaaagtttatgtgtgtaagaaagtttagatgtgataaaaaaattaaaagtttgaagaaaaagtttggaactaaactcggtcttaacacgtaccagctatctactgtactgtagcattctagcctgcaacgagtcagagcttctcgtccgcgcgtgtacgtgcatgccttgccgtgttacatcgcgcggtcgcctcgatcagcttaaacaaatggaggctaggcaaagaggaggagatagaggatgggaggcagagacaagccatgcatgacagatcactgcagggcggaggcaagtaggcaacggaggcggctaattaagggggtgtttgtaatttacctcaaaatacactggtaaggtaggaagtagctagaactgccagaaggtgatagtgttgtttatattttagaacggatagagtagaaatgcttatatatgataaatggagagtacgtgatatttttctctccatcaatttacgttaattggattggaacatgatgtgcaattctattttaattagggatttgatagatttcatacggttaaggagttatacattttcagtcatctataattccacaatgcatatatctaactacaaatttgtcgttatatatgattttttttactttatatttaatctaagttaaaaaaaatgcacgtaaattttataactttttattagctataagtttatttcatgtaattttatattttttttctggttagagtaacatatttttcaaccatgtatctaaagaagtgactttgtttaaataagtgtaattaggaggtgttggcaaccattgtattatcatccaacggatgaataaaataactgaactttaacaaatttggaggcactcaaaatctattctaaaatatatttaataccaggccactgatcctaggtgcccctatgtatatttcgggttaggggcgactagaaatacctatcttttttatttttttccttcatgtctagagtagtagtagtttcttagtcgatttgcctgaaaaccggttagtattttttaaaaaaaaatctgctcattgcaaattaatccaggttctttgacgactgcatgtattttagacttttgacgccaacaatttcattgcttcaagcttctccattaaatgggaaaaactcctggccgggtgggtgattgtgtgtttaagatgtcacaaagctgacggcaatgagcatgtttagtgagtctagctataggggctttgccatgcgttattatactccggacctcatcttaatttcgttttgggaaaatctcaatttccaatttggaacacctgatgatcttttagttctagtactcctactccacaccgaacttgctatggtcgtctcggaggcacggctctcttccgtgacaaagaatagtctatgaacacattgaacagtcagttctgtcaggcccagctcgccagcgagaacccggacgcgcgcaacgtcgtcgtacggaccgaccgcgtcgcgtcgccgtgaagagattgccatgtgacattccggcctgtgtacgtacgagcgcgcgcgcgcgcgcctaggaccgcctgcaccgagagcgagacgagacgtgatatgatatgatatgatatgatgtggccgcgcgcgcctgagagtcgctgacgacgctgcagtggcactggcacggagtagcgacatggaaaatctggccccctacctgcccccgcagcttagcttagccgtgtgcagtggtgcatcctgcattcgtgctgcacgggccggtgccgcacatgtacggttgtgcacatgcaatgcaatcgcgtcgcgcgcaccaggccacggcgccggccggtcgggcggccgcgagacgacgacgttgctgcttgatcgtgtgcttgtcacgccggtgccttgatttatgggttcactactgccgataaaaataattaaaaaaaagatagaaccatcgttgcctttcctatatattaagaaaaaaatataagataaagttttattttgtatgattagtgtaaaacagaatcgaacctaggtaacagaagattaatcacctgagttctaccagtatccctacaaaataaataaagcggaggagaggtagcagggaagcgaattaaatttgaaaaatatattgttcatctattttttttttcaaaatatttcgaatgtaaacttttttgcgataatataacgtcgatctcgcacgatctcgcacaaccgttgcgcgaaaatgacgtggatgtgacattgcagacggtattgcgcattgaaagtacgagaccgcaccgtgcacgataattaatcactaattattattagctaatagttaattatgtacttgatcactaattaaatggagccggttaatactgtcgcagactgtttcagcaagacctcgctctttcatttcgtaagaccgcgcggtctcgcacatagcccacgcgataccgcctgcgacgtcacgcatccgttattttcgcgcaatgattgtgcgagatcgacggtatattttcgcaaaaaaaaaattttcatcccaaatattccttaaaaaaattaaataaacggtatattttgaaatttaattcgcggggactctcaaactctctcaatgttaaaaccctaaaagctaagtcgtccaatcgaccgacgctaatcgtgaggtgatcaaaaaattatcaaaagagatgttgacgcactctacttctcctacgtcagcaagaaccaagagaagaaggcaaccgaaagattaggaagaagagaaaaggaagaacggcagcaagtaaattaaaatgaccgattacaatgacttcatcctcatgacagtagattaataaatttgacattaaatagaagtgatcattctaaatcattggaattttgtaaattagactcccaacacacctgcgctcgtcctagcgcggcaagccgacgacggtgtcattgcggacgaccacgaaccagacgcagatagtactgactgtaaaggtataatttcttgctgatcgacctatcgagaaaaccttccaatatcgtactacgagtaccaaactacgattgtatataactctgtagctacaataattaatttttttcaaactttcaacttttcgatcacataaaaactttcctacacacataaactttcaacttttccgtcacattgttgcaatttcaaccaaacttccaattttggcgtgaactaagcacacccaagcataccgaaattttgggtgtgcttagttcacgtcaaaattagaaatttggttaaaattggaacgatgtgacggaaaagttggaagtttatgtgtgtaggaaagttttgatgtgatggaaaagttggaagtttgaagaaaaaatttggaactaaggtcttatttagttccctaaaaactttttccaaaaaaaaatcacatcgaatctttagacatatatacgtagcattaaatatagataaaatgaaaaactaattacacagtttgcatgtaaatcgcgagacgaatcttttgagcctaattagaccatgattagtcataagtgctacagtaacccacatgtgctaatgatggtttaattaggctcaaaagattcgtctcacggtttccaggcgagttatgaaattagttttttcaatcatttctgaaaaccccttccaacatccggtcaaacattcgatgtgactactaaaaatttttatttcaccaatcaaacaggttctaaactcggcccgagttaaaatacgagcgctagctgaatccggcctttgcatccccctgtgtatctgctgtccgctggtacgccttgcatcatgcctgcaggctgcagggattgggctgtgcgggaataaagggcttcattaacgaggatggcgacgtccacccgtgtgatcagaggcaaagattttggcaggactgatgctatgtcacgcagcggccgatttgatgttttagggagttaaaattatttctaggcaaaggcagtaggctggtattcctcgattcatcaggaccggctagcttgctatagctgccagacttgtctagatagcctccttgctccagcgtacggtttgcccttccatgccgctcgagtggctcgacgctgtctccgcgggtccggctacaatgttgacattttcttttatattatacctgcacacgcacacacatccctcggcatgtcacatcacactcatgcaaggatttgaaatattttaggcacctttaaatcccagcaatgaaaaaataaaaaaaaataggaaaaacacagcattatgataggaatacaagcgtaaaacagaaaattgaaaaatacataaaaaaaacacaggaatgaccatttgattggaccgctggaaaaacgtaagaatcagattagagagataggctcaaaagaatttttccaagaaattgaacctcttactaactttcctccaaaatctctataggattatttattccataggaatttcaaagtatatgatatgatacgatatggtttccataggaatttttttcccataggattaaaatcttccaaatttcttatacttttcttacaaatcaaaggggcccttagaactactttaaaacgcaggatttttaaaacacggggtggtagaaaaaaaacactagtaggattgaagtgcctttgagcccatcttaaatcctataatagaaaaacacacaaaaaaacctgcgaaaaagaccttttggatgaaacacaggataaatataggaatcagaaaagagatagacacaaaggaattttttttccagaaggttcgaatttatgtcaaaaatccaccaaaatttctatggtttgaggtaatcctaaagaattttaaaggggtttaggagagccattcctagtttcatttcaaatgaccacataggaattatttctatagaaatcctatctttaaaatttcatctaaattaatttatttgttccaaacgaaccccttggagtctgaaagttttctttatcttaaaaaaaagcccaaacaaatcttattttgtgaaacgtttgctataaaaattttgttcacaagtcataaaaactatttaaattttattgtgcgagcctaggtggcactataaaaaaggatttttgcatgtggtcattttttccatgcaattgggtcgatcacccgtatgcctctaaaaaggtatgcaaaaataacgattttagagtttttattctaattttggatatttgtgtcctaaagttattttggttatttgaaaaaaaatgtagtatattactaacggagactgaccggatggtgatggtaaatcgtagaagttaagcaaaagtcgatggtatattgtagaacgtgacaaagtcaatagctaatcatagaaatgagacaaactcaatggcatataatggattctgtatattgaccctaaactaggcccaacacgtaagctgttcagcctgttgtgttttttttttacccaactggtagaagcgtgatggtggggcattggagggatcgatgcagcttaggatgtaaataggtcaacccgtgaatctatttataaataaaattattggataacctataaattaactcacggttacctactaatttgatctataaattggtttacgggtatatccacttacatctatttcggctctatttgcaatgcccatcgcctcagattgggcctggcccatgggggttagggtgttgttattaggtcagtgccatgccgatcgtggtgctcctgtgactgtgggagaaaatgggaacgagttcacttcatgcagtggtgcacgtatgttcacagaactagctagtggagtctgtgaagacgtggctcctgtgcaaactttcaagagtccaatatggtctacacggacaactggagaagtgaatatatcaccaaattttggacctcttcactttgatgccattttcaaccatacctttttttttatattgttaaaaaaatatctacgtttagtttgctaaatttggttaacacataagaaatactaccaaaattttagtaatattgtcatcttgctaaaattttagcattattaaaacttgataagatttattttggctacaatctgaattggtcatttgtgtatctagacaaacccgtcataacgatgaaactgacccgcacaaaccaatcaaataggactactactctgcctagatggttctttcagctgctagcataatcccgacatgtgacagtagctcagcaagcagtaccatgcatgtcagcacgaaccaacgacagccacacaaaactcagcgaagaataataacaccgattaagatgcttccagaaattcaaagtaaccgcaggaggcctctgtttttccacaaatctgcatattgagaacaaccaatcggtacgtgaaacattcctgggaatctctgtggtaactgtcgtgtcccactctacatgaacagcgtcgagccaacagtcgctgcctcatttcttggcccatgaacgactagccttcgtcaaacgtaaaagggaaacaagctaggaaccaccatatcacacactcaccggcacaccgcgcattttgagcaccggctggggacagggatcgccgagcccgcgttagccacgtaacgcagcgtcgcagcgtgcagcgaaccgcacgcgcgcgcgccttaaattttgttccgccgaggcgcgacgaacgacacaaaccgacactacgtgaatacgtgacgtgtgcgtgcggctgctgcgtttggactttggctcagccgcgtaggagtacgttgcacagcatggcggcagcgcaggacgcgtcgtcccaggcgttggggctccggtggcgctacggcgacgtcgacgacggcaacttcgcggtgcgcggccgcgcggtgccgctcctcgtggcgctcctcttcgtcctcgtctgcttcgtcgccgtctccctctacctccgctgggcgtgccactgccaccgctacggccgcgacacgacgccgatgcccgccaccaccagctccggcttctcctcgtcgcacgctgcggcgaccgcgccaggttcagcctcatcggtgaccggcctcgacgacgcgacgatagcgagcatgcccgtggcgctgtaccgggccgtggcgtcggctgcaggtgatggcgacgacggcggcgccgcgcagtgctcgatatgcctcggggagttcgaagagggcgagaaggtgaaggcgctgccgctgtgcgggcacgggttccacccggagtgcgtggacgcgtggctccgctcgcggccgagctgccctctgtgcaggagctcgcttctcccggccgcggccaccaccaaaccggacgtcgccgggagcgatgctgtctgatcatatgcacgcacagggctcgctcggtcgtcgcatgtaaactgcgccgtgcgcccgtacgtgcacattccattgcattgcacccgccggtgcctgggctgctggtccggaggttcaggcggtgggaaactgattaatttcttagttaatctgtacatcagttagtaagttcattaatagtatagttaatatgtgcatcagttagtttattactactcctacatggtttcgttaacttagctcacagcaacggatgccacttgcagtttctgttttgaattcactgtcaccaagaggaaagtgatgcactgatgtcattgcaatagagcgttgaacttgccctcaaagggcgctttagcgttcagtttctcatgatgttaataggtactttcttcgcgaaacggaacggtcgaacggacgcaatacataaggatacgattgctgtgcgagcttgtgctgcaacccagcgaacgatgtttctgcatgattgtttcgagacgtggacacacgaaacacctgtctgcaccccaactaccccaactggcttcgtttagtccccaaaattccaactggcttcgtttagtccccaaaatttttcccaaaaacatcatatcaaatctctgaacacatgcataaaatattaaatatagataaatgaaaaaactaattgcacagttaggggaaaatcgcgagatgaatcttttgagcctagttagtccatgattagccataaatgctaccgtaacccacaagtgctaatgtcagattaattaggctcagaagattcgtctcgtggtttccaagcgagttatgaaattatttttttcattcgtgtccgaaaaacccttccaacatccggtcaaacatccgatgtgacccaaaaattttcttttcgcgagttctaaaaaaacgtcacatcgaatctttagacatatacatagaacataatatagaaaaaaagtaattaacaatttgtatggaaatcgtgagacgaatgaacattaaatatagataaaaaaataattaacagtttgcatgaaaatcgtgagacgaatttttttagcctaattagtccatgattaaccaaaagttaattcatggcccttcttgataaagttgccgccacaagcagtacacgacaaatcgaacgaaaatttacagcgaaaacaaaacaatacggctagactgagacgggaactctactattgaatctatcttggagaaggatcaacgcaaaggatggatgaaatctaggagtaagatgaaggagtacttgcttgcttggagcctgaacctgaagagatagggatctttgaggaggatagatttataaggcggccggcggcggcgagcagcttcagggggcgttctctaggttataaacgagctcgggccccggggaagaaatagtgggccgggcctagaagaattagtatggatcaggccggcccatgcttcctatggctttccttaggtccatgcaaagcaaatgtagtacttaaaatcgttgggaaacgaaaatcgatcaagtttaagtaatggtagtgtattttcctcacagaaatatactactagtagagtagtatagtttgttgtgtattttaggaacatgattatgccttacactctctcactagcagttaaatgtgccagtcggtgaatgcctgaatggtatgtaactctggggccttgagtcttcagtaatcccttgttctttttataagactgatgactgaagctgtggcttccccactgttgcaattcttaaacctgcatgggccgggcctagtagaactaatggtccatttaatggtcccaattctgaaacctgcatgttggcaaaatggacaattttctggacattcgactgcatagacacacgctcctacacttgtcgcatctgatatcattcgttgcacaaggactccacagctatatgaacataggactggaaatggaaaagggccggccaaatcgttaaattcgttaatctgactatatatctgttcagtttggtgcacaggacgcatcacgcattcacgcatcgtcgagtgacctgtgctcataggccatagctactccaaccttgctgatcgccgagcaccatatcgcgcctgatcttacacaataaatgaggctgatctgctgagctggtagtacgacgcgacctcatcagctcgatcggtttcttcctcgtgcacgtactagcagagtggcatgcgggggcgggagtatacgagatctagatgcccagaaacccgggcattaaaatattttagctataacttatcttttttttattatgtgcgcatcctcttaatacaaactataaaatcaatttaaaataaagtaaattaaacatataatatcttccttcatttcattttaactccacactaggtggtacggcgaggttcgttacacgtaacaacttttatttctcggaattgctaaccttctttcgacagaaattacatatccaaatcttgcagattttgggacactggattagcttcaatattcatgctcctggccttctcctccaactccggcgacctcctcttcttctctgacgctggcgacactttagactccggtagaggaccctacaggttagtgtcccggggtggggtgggagggggaggaggaaggggaggagttcgccggctctatagagatggccgggggagacgacagcccgacggtgggcggtggatcgggcgggcggtgaggcgctggcagcgacgctggagctgtggtgttggaagagggcggtgggctgatgttggtggcggggcatctcgtcgttgacggcttggggaggcagtcggcggcacgatggggcggtggcggcaggggatcaggcatagcggagaaatgcgtgatggtggcggcgaaatgagcgatgcgaggggaacgggaggagagctagggttaatgtctctgcacaaatcttaaagcatatccgatggtacaaaatttaaaagataaaagtggcctaaaatttaaaagataagaggtaaaattttctgccaacggatatagacagtccctttatttctacagagaagacaaagcacgccccgtgctttatctcccagcaactttgctcctcgcatacatggaacggcctcgtcgacgtgtggcgtgtccagtgtcctacctgtcgcagcagcagcatcttgccacgacaaagaggatacgcgagctttgctaccgcaacgaaacgcatacagaaaaatgcaggaaactaagaagcagcaggcttgcatgcctcagctgcatggacggctcgtagtggagctgtagtccccctcctcaactgttgacaggtggtgcttctttttgtcactcaactttcaggtagatgattttcaggctttacatcgaaatgatcaactgaaagtgccttttcgatctgtttcccgtgtgtaagtagggaaaaaaaatacccggagaaaagaacagatcgagcagagttttctgtcatggactcatgggtaggcagtaggtatccccacgaggccaccactactcgatctgcagctggacgcatgaagccgtccgtttctctgtaaaccatatctgttcatctctttcgctttaatccttttcttccccaatgtacagtttggtcaggaaccttacagcgcatctgtgcacgcaggcacgtaacgtacgcaagcatggccatcccattagccatatatataaccatatactgtatcgatctcttcccacttaacctaacccctgaagaaaaagaacaaatgaaagacatcttctgacagcaggtgaaacggccagaaaagaatgtgaagaaaagaagaagaaaaatctcttttcagtacgatgattgtgtataaccaaccagctctgcctatgagtaatccggtctccgtaaattcttggaatttgctataccagctgcggcctggacattatcctggtgtagaggatgaggttccagatgtcagggacgccggggaggcaccagtggatgcagtcggcgtaggtgccagggtcggcctgctgctccggcgtcagcaccttgccctgccggatggtgtgcacggaggtgtgcccgtccttgcgccgctccgacatggtggtcacgtcgacgaaggtgatgggcacccgcgtcgccgccgtgcgggacacgttggccgccgcgtggaacatgtcccagtccgtgcccagccagatcggcccgtgccagttgagcagcggcatcgtctccttggcgcaccggatcccgcccgggttcccccacacctccgggctgcagagccacgaaaacagatttttcagaaaccgaattaacgaccaggatgtaagttttgtcagtttgataacggtgaaatcatgggcaaattatttagcagacctatgcatagtagcataagcatggggatcgtagtcctcactccgtcccacgataaatttgacaactcgtcttattcaaattttttttgcaaatataaaaaacgaaaagttgtacttaaagtactgtagatattaaaataagtcacaaataaaataaataataattttaaaaaattttaaataagacgagtggtcaaacgttgtaagcaaaaactcaaaattacttatattatgggacagagggagtacatgatatcggtagtacggagtaattgtgctttggttgaccaaacttttaactgtatctgttgacgtgacatgcctccgaacccaaagaagccaaaagcgtaggttcctcagttgtagacgcaatccctactcggaatagtcaacaactttcgagatcacacagctggacacggcaaatgttttttcggccttcttcctaatccaagaaggaaagcagtaatactactagtaattaactgacgataaaaccccggtgatttgtttgtttaccagatgtgacatgaacctcggcaattttgtccggttactagttaaccatattctcgcatcctctttcctacaccatccgtcccaaaataaatgcagtcatggttttccgcgcccaactttgaccattcgttttatttaaatttttttttaaaaaaactaaagatataagtcacgagtaaagtactattcatgttttatcatcttataacaacaaaaatgctaattataaaaaattttaaataagacgggcgattaaagttgggcgcgaaaactcatgattgtacttattgtgggacggaggtagtatacaaaagggaatcattgacttcaaaattcgcagacaaatcaaagtggtttgcttcacgggaccctaagcacctatcagtttcaggataagactgttcctaatattagggattttcaacccaataactagtatggtgtccatataattaaataagttgccacgtagaacaaaaaataatgtggcaagtgaataaatgaggaaagagaaggaaaccatatcttgtatgagacatgatttttacacaacatccaagacatcatgtgagataagtagcattaaattgaagtacggaatagtggtgtttgcattagaagagtagtgtctagtactagtttcttgatgatgtagagttgaaaccatatctagtgttatgggttgggactgtcctaaaagtttttatagagggagagctttcgtaaggcgtcatccgcgggccatgccaatccttatcaagcctaattgacatcgatccgcaacagtaaccagcacaaccttctgttcgatccgatactaacaaagcagcatctgtcccttcatcgtaaagtacgcaataatacacgtatgggcatcgatctaccaggccttatttatgtttcatcacacatatcaattgcaaaccaccatttctttttgttcagtcttgtaagtttgaattctccaccagtagaacacggggttgaggaactctcaagctgaattgcacaagaagaaaagcaaatcgtcaaccacaagcgacgtgtagtagctaggttcagccaaccagatttgaattcccctctactaatcttcaacccctatatatgtgtcagattagataatttatctacttgctccgtggttcaatgcgttctgtactccgagatcctagaattccggtcacaagatgatgagccctcacaacgatgatactagtatttttcaatatgtcatcacgaactacggtgcccgtcctgcaggtctgggatcgtcgtcgtcatcgtgggattcactcatccacggctcgcaaacggcggccaaatgggaaaaaaagatcgtgcggagaagcttccatctcggactcatgtgcaaataattctcctacccatgtgagcgaacaggtacacacaactatgcatatatacccatggcgcagtaggggagtaggagtattaaaattttgggaaatgcgagatggccacaacaagcagaaacaataataggggcgcccgatagtaacctcatttgattggacatttgcagaccgggtcagttatgtgacgcacattcttgggcgcagaaagtgcgtgctaagtgagaactggaaagaagccacagcttagctaagaagatgccgctccaagtgatacatataaaagcgtagttttcaacagtggtgtggttgtgcaaactgctcaagtgtggtcaccattggggtttgcagataattttaagcttttcagcaacggagctgtgtgtcggttagccgtgctatggtgtactggcaggagtcatttgctggccggcatggcaaggcatcccgtgtgagcgtgttagatactcactctctctactttagtctacagatgatacgccactaactgaaatgtcaaaccctataagtaaattaatgggagttggtttgctacagttgtcgcggtagcatgttatagcaggaccgcggccacgttgaagtaattaagggacggtctcatggccaacgccaatgacgaataatccatgtgttgcgtccggtgctcacggtgtgctagtcgcctgacactaattaacacgaatcgtttgcacggtttaatctttataattaccaccacaagtcaagacacatatgtagggtctctgacatttccacgcgcgcgcacaactacaatctggctcgaggcggccgggtgactcgtctctttctattggcctgggcccgcttcgattcgtactgttcgtttcgcccacgggaaccgactcggtcgcgcgtagccggccgagacggggcgcccactccaccaccaatccgtgtaaaattctctgcaggacgcacacgcacgcaccatatgcggtgcatgccgtctcgttctttttctttggcagtgcgacgccaacagcaagcgtgcgtacctttactttgggtttttgcatgcaaaagttccaagattttggcgtttcccactctaccgtactaccgtcgagacttgagatatactgacacactagcttaattgattgctcaatcgtgcgttcgtacgtgccagctatactccaaatacttgagatcgatcgtacggtagaatacaaaaaatgcgaattgtaacaaggtaggtaggctggtttacgtacctgatgtgaagaggggagatgctcatgaagaagacggacgtgcgcgccgggtcgatgttgtcgttcacccagctcgcccacgtcgtcagcaccttccgatacgcctcgatcctcacgacctcgtcatgctcctcccagctctgcccgcccggtctcctgcaagatcacccctatcagtcactgtcatcccacgatcgatcgccgttggttgcacggcacggcgttgtgatcgatcgatatatcgtgcaacgtaaatttagcgtacatgatcttcatgttgagggtgttcatccaccagatgtaggtgttgaagacgaggtagtcgacgccgcgccagttctgtgcgtgcgccgcgatcgcgtccgccttgatgatccggtgctggatgctgtggatcttggggtcgtcggagttggactccaccaggaacggcgcccagtagaactccaccgtcgcgttgtactcctgcacgcacgtacacacgcgtcccgacaattcagaacacaacaggccacgacaacacactatcagaaaccgacccggcggctgatcgagcacaagttggttcaccggttctagctagccgccgccaccaccacacaccaactgctccctggtctagtcgcagcagccgtgcgcgcgcgcgtggacccggcccgccgttggctggcttggctagactagacagatggggatgggtatgtatgcacgttcatcatgcgagcagctcggtacgaatcttaaagacgggatggatggatggatggagacgggcggagtacgcaccacggcgtggaagacgacccgctggtcctcccaggtgacgtatttcttccccggcgacatcgccgactgcaccaggcacaccatggactcccactggttccggttcagcgagtcccccacgaacatgaaccgcttccctcggagcctctccatgaacagcttcgcgtcgaacctgaatcaattcgtacaaattcaaaacttgccgtttatacttgcgtgtccagctggctggagcgtttccatttcagaagaaacggcgcatgctttcccgcccggtgcaaattacagattgtgattggtggctcgtcgtggttgcgtacctgggcatggagcagtctttgggctgccaccgccacttctggtaggtgtcgtcgcggcggccgttcctcatgcacgtcacctgcgacgtgaggaactcgcactgctcctcccggtacagagggtagctggtgttgtcgaacacccactcgcccttggacaggtcgcacgtctccggcacgccgagcaggcccccggctgccgccgccaccgtcttcttcgccggccgcggcttcctcggcttcttcttcgtcgtcttgggtttcttcggcttcctgatcttctcgaccttcgggacctccttcgccgcctccgtcggcgtcggcgtcgccagcttcggcctctcgtcgacgtcgagcggcaacgcggcggccttctccgcggacgagacctcgcgccgaggagggttgacccgggcgacgtggcgctcctccgtcactaccggctccacgatccgcgccggcgttgtccccgcgcgcgcgatcgggtccagcgtgagcgaccggatgtcctcgccgtacatgatgatgacgaagatgacgaagaagacgccagccacgtacaccggcagccgcccgcccttccgcagcgacgacacggcctgtttcgtgccgaacgggtcgaacaccccgccgccgccgccgccccccgcctgcgagaacttgcgccggttggccatggcgacggcacccggagctagccccctctcctcttcgctctgcacggtgcgcgtgcgtgagagacagagacgcgagcgagaggggcaagctaagctttatggagatggcgaggaagtagtcagcatagcaaagctatagagggaggctggggatttggtgaggggaagccatctcacacttaaaatttcgcgtgatgcttccccctcccttctcctccgtgatcaggcgttgaatcggccactaagcatgatttaattggacgggtggatcggaaacagggagggttttattccttaccaattcaaagcctcgcagacttggccaatacgaggcatgcagaaacgtggtacagcacgccactcatgggagccattattaagtactgtgtatatctgcggcacaatactgttaagctttggtgaggattaggtgttctctccagaacggatttagtaaaattttgggctggttaggaaacttaattatgcttactatacttgatttcggcgacgagcagatttgctccgcgcgaccccatatagcggtttatctactcgtattatcgtatatggtactaaatcattatggtcaacgtggtggcttatgggtacagattggctgggagggagcagagaattaacaaacatgcatacacattacacgattacatggtgacgttttcacatgaggcagttggcccccttttttttcttttgcgagggaagcagttggcccttgaggccttgattcctcctttgggtttatttttggtagaatgatgcgagacgtggagttcttgcagctttgtgactattggtaccacacgtcgagccaactgccggtttgagacttctagacctgaagaaacactgtttgtaaatatatataatgttgtcaaatttttacatgaagtgtgactattcgctttattaaaaaatattgtatgttttgttttgattcgttttattattaattatattaattataagcatgacttatgtttttttgcaaatttcaatattttttaatgggataatagctaatatggtccctaaagtttcgctcctgggtcattttagttcttaatctttcatattctccaaataagtcctttaaatttgtcatgtaggctaatatagtccttggtcccaccaaaatcgccacatggatatgccatgtcaccttcctatgcaaaatctatatgatttgtccaatttatccttacgcatatgaaaataaaaaaacaaaaagaaaaggttaaaaaaatatatggtatatgtaagagcaaaaatatacctcaaaagggggaaaagataagtatttttttcctatggttatgtctaattcacccttatatttatttttctatgatatacataagagtaaattagacaattcatcatatattttatatgaatgatgacatggcatatccatatgatgattttggtggacctaaggactattctagaccttatgacaaaggttaaggatttttttagaccatttaaaaggttagggactaaattgatcatacatagaaactttagagactaaagtagctattctcccttttttaataaaattaatggtcaaacggtatgtctaaaagccgatggcatcgtgtatttaaaacggaggaactatatattatagcattgaatatgatttgggttggtttcagaaataaatgaatatgatcctggtgacagtggagtcaaggcctagatcaccattcaacctttcttcttcttttgaaaacgaaattttcttatatttttatgaaagggttacctggctagcttttcggtcaagaaactttcagggtaagcattgtccgggcgtacaaagcgacaatagaatgccagaaatgttggtgattccgctatgttggtgtcgctctgtcgcttctcctgttctcctctcatgcatcgacaggaccatgggccatctgttgttaagcgagttatttgttactgctacttgtagcaactaaatctgatttcctgggctgtctcttactctgttgcattccactgcattagttattcccatttgaccaagtttcttcagtaaacatgtatatgttccttagcctaagatacggagtttgcttctgcaaatgtataccatctccacattgtcatcgctcgattatacgttatgactacagaagaaggttacgttttcacgccaaagtcaaaaaaatcaaggtgtgtttagttccacgccaaaattaaaagtttgactaaaattggaagtttgaagaaaaaagttagaaatttatgtgtgtaggaaagttttgatgtgatgaaaaagttgaaagtttgaagaaaaagttagggctgtgtttagatccaaagtttggatccaaacttcagtttttttccatcacatcaacccgtcatacacacacaacttttcagtcatatcatctccaatttcaaccaaaacccaaactttgcgctgaactaaacacacagcctaggaagtttggaagtttggttgaaattgttacgatgtgatagaaaagttgtgtgtgtataaaaggtttgatgtgatggaaagttggaaatttagaaaaagaaaactttgaaactaaacagggcctaaaccaggcctaagagctctgcagtccattgaccaggctgaccgagctagccagtaactaaaaagtaatactaatgtatgttgattcagtcaaacaagatcaattgttctataatctggatcaattatacatctcgcagttcggttgcaatatccttttcggctcaacggcgtcgctgtacttgtggggtgacacttcaattccagttacgccaatagcccaaaatgccagagagaaaaggatacacctccggtggtctcgggtgtcacgtactttacttttcttcgtcatctccggtatttttcgtcctggaacgtactgaatcttgaattattaactcacgaaatcgatcaaataggaaataaggccaccagcaaggccgtgctagccagctgaatatgacttcttgtccagccgtttctgatcgacgagttgctatttgaaggcactcaaaacctgacgaatttgctgtttcgtaactttgaaatgacaagcagagtgcacctctcctcggacctacggcaacccgtcgagaactttgacgcaataatttggagctaaactactgtcaattctaatggtctaccagattgccaaccacctaatacgaagtagtaatgacaattctgtcgccgctctcactagcactattcttgtagctttcctgaaggaaaacactgtttttgtatcggttcctgtagtcctgtgatctccaggaaccttggtttttggcccctttatagctgtttttctttgctctgcctaccggccagaagataatttgcatcgtccgaaaatcgtgttcgccattacagcgatgtccatggcaccggcactttgctaatggactcctactattgcattttccttgtcttgtaagatgatttgttgaccgattggctctacttgtgctgtcctgggacgcaaccggcgttggttaatttgggggcaaattagagagcgaccgggagcagaaaagaaaacgccattggccgtccgagtctggtagcccaagtgcaagtggtaatgtgaggaatctgaatttccttttcctattccgatctgatagaccgatgcttttctttcgctggtttactgtttcatccatggccccgccgggagatgattggagagacaccgctttaatttcaacttccattcctcggttcagagaagctgatcaattgtgaacaggtgcagttttggacactgtgagcaaagtacggtttttgacctatgaccaggacagccagcaagttgtagtgttgtaccagcaacttagcaagtacaaactgcaatgctgctgctctaatactataattagtactctatgggtggggatctaacaaaaaaatttagcagcaggattacagagaaacatctctctattcttagttgatcgagtgtaacatacgcttcgggctgttgagccaagtttcttctgcgtgaagttcatcaggatggctggatgagctcgcaaatgagatcttcaacaagtgccggctaaccaagggacgggcagggcgcagccgggacgaggagggttccgtttgtacccatccgatggtggttcgtaaacgacatggcctctccgtcatgcgggctggaaggaccacgtacgacactggtcctgattagacggggcttcccttcccagccgcccgcatgcgcgcgcgcaacctggagtgtcactgcgtcagcttcaccgggagggaaggagaaggacgcccgcgtttgagttgggtgttgacaggatcagggattggacgtgccacccatcgatcagtcgctgctttggcagaggatgaatataattcaggttaaatagcactgtagcagtgcctttcttgatgatttcattacatggattcgattttacttctataagtaatctgaaggtatgtgtggttctttggaccttggcatgttcccgttttgtttagagacgtattatgttctaggtagtgtgcatcatatcgccgccagcaaaacgtctctaacatggtgcgataatgtaatctatcattcattaggattgttcgtttgtatatagtattgttgaaataattccttttgttcttttgctgaagcaaaccctttactgattgggatttggggggaggcatgctttttttttccgttgagctggagccttctcttgtgaggaaatgtgcaaacatttcttaagtgtgatgtggcttggtagttttctttttagtgtgtaggtttggtcacacgtgaatatctgctcttccgtcgtagtcatgcttggaaaatggaatgaatcaacttatcaaccgcttcgcatcttagggaaacagctagtatccggatcggagagattttttttccctggttttgtcttgtgcagagtaacagccgtgcgtgccgcccacgattgctcgatggttcagcaggtgtgtttagcttaaccagaagtgggttagccacagtgcattttctgtaccactatgaacacacaggcataacatacccttaaaagaataattaaccgtaaatacgaacactcgtttcaaatctagaatttgaaccgggtgaactggtttaaccaaatgtaatctaatcagttgagctatgctaacttcaagttattaaacacataattaattaaacgttacctaaaatttttttaaatggattgatatgaatttttaatataatttcttatagaaaattttggtaaaaaaacatacattttaccaatttaggaatcgtactatggaaaacgagggcatatctctgctattataaaaattgaatatgtttttgctgttactttggtacgtcatccatatttgagttagtttttaagttcattatttgcatttggaaatacaaatccgtgtttgaatcggtttttgagttcattcgcttttataaatacagaaggagaaggagaaggagacatataagaaatctcttttaaaaacttgcatactaatttgagatgattggacttctaattacagttcgatcatgcaaattcccgcagtgaattttactttagttaaaccgaccaacaataatatgattaaaatagcgtttacccgttgtaactcacgggtattttttctggtaaaattataaattatgatagggtaattcgaactcacctgggctgagtttaaaactgagttaaggattgactaattaatagcatggcaaacgaagcatgctggccgattcggccgaattttgtatttttatactcatgttttccactgatcggagaattgtattgctggtatgggccctgacggccttggtggagaaatttctttctggaggttttttactgtccagtagaatttttgaatttttggtgcggggtacctccccctttgttcgcgtgtatggaactagtggaagggcagaattggattttcgcgtggttagtcaattttcatagagacggtacaagtccccgacctgataatctgtctcttcccgatccccttccgtcgtccctggcggcggcgtagccaatctcgccggacttcacttcctccctcactgcaaccaaccgtcaccaacctgcccattcccaacttgcccttcttgtagccggtccaggtccggccgccgccgacttctgggagtcgatctatccctggatgacgacgaccagcaaagcaatgtccagcaggaaagaaatacgaaacattgctttgctgctatattcattggaagaatatgctatgttgatgggagaggctgagtttgatttatgttgtgtgccaagttctggacctagttccttgtcttttgatatatgtaatgaacctacttgattttgctgaaagtatgaatgtaatagtagtaaaaaagaagtagattttctgaaagtttgtagtttcttggtctgatgtgtaaactgttctttcgttgtagaccttaagcttactgtttcatcttaaacaaaatcaacatcggcggtcattgaacaaattgtcaactatcttgaataaaagggacactattacaactagtgatcccataaacaaacttctgaaattcttcgatctcttttctttgcttgcccaatttcttcttgcttgtgcgatccatggccaaacgcctttcagacatctcaatatctagcttcgtttttttcttctttctgtcccctccttccagggttgctagtgctcgcgatccaatgcataccacagcgatggcgattccacgaacaaaggcttgcgatggtgtcggcggatgagctgtcgaggccatattcgccacgctgagcttgtcgccatggtcacctcttcttgtttgcgcattgaggtcgtcgtcatccagggatagatcgactcccagaagtcggcggcggccggacctagactggctacaggaagggcaagttgggaatgggcaagttggcgacggctggttgcagtgagggaggaagcgaagtccggcgagattggctgcgccgccgccagggacgacggaaggggatcgggaagagacagattatcgggtcggggacttgtaccgtctctacgaaaattgactaaccacgcgaaaatccaattctgcccttccaccagttccatacacgcgaacaaagggggaggtaccccgcaccggattcccgtacctcgcggtaccgacgattgtgggtcgtttgatctggctgaatggacggttacgattgcagtaccgcgcggtaccaaaaattctgctggacagtaaaaaatctcttctttctgggcctgatggcccacattcatactcttcctactccatatggtacagtagaagttggcctgctagctcaacatgtaatcgtttgggccttgctagttgctgcaaatggtcttttaggacagaaaaaagtatactttgactccctcaactattgcccgagtatgattcatgtccatcaaccacaaaaccgggtatatcgactcctccatctatcaaaaccggtgcaaacaatgtccctcggtggttttggctgacgtggcggtcttgaccaagtctttgtcctacatggcgcttacgtggcattagaataaaaacaaaaataaaaaatatgtgggacccatatgtcattcaaaaaaaagtattgtaggacccacatgtcatcctccctctccttcccttcttcctccccatcgccacagcgttgcactccttggctgctgccatcctcgtccccaccgccaccgctgtcgtctcgaccgccaccgccgccattccggccaagagaaaggccggggggagagagagagggggaggaagaagggaaggagagagtggatgacatgtgggacccacatgacagcgggtcccacaatatttttttgtgtgaataacatatgggtcttacatattttttttattttttttattctaatgccacgtaagcaccacgtaggacaaaaactcggtcaagaccgccacataggcgccatgtcagccaaaaccacctccaaaactggttttgataattggagttggagtagtcgatatacccggttttgtagttggaggacatgaatcatgggagtcaaagtatacattttcctttaggacacctttccagaattttggacctacttatggagcaatgctaaccagcgaaaggtccaccgtaggtccctcacaccggggtctgagtttcctttaacgttcgcatgtgcaatcagagcatccccaaatatcaaaaccagagcaaatcgagtccctcagcggtgtggacgacaaactcatcctacgtgacatatatgtggcacattaacttaatgttcgtctgacgtgacaatccaaccaacaaaaagttaataaaaaaattatagggtccacatttcatttcatactttctttctactatcttcttttctctctcgacccggccagtcaccccgactcctcactctcgcctcttaggtgtcccaaccgttgcctgcccaccatctattgcgaacgagaacaaggacagctggcgctgcgggtgtccaactctcctctcctcgtactagagaagggggactcaagggcagtggagaaagaggatttgaggtcatagctcggcgttggagtggagaatgtgacgagcggtagacggatgattgctggccaagaagtcaccaaacgatggcaaccatgccatccttctcctcccttcttcttcgtctacccttcctctgtgtgactaaatttgccatcaatagaacattgtatccccgataattttgtagcagtggaaaacgggtgacaagcgtccatcgagaggagccaggcaatggccatagttagtgaacacattggcatagctctgggtggaagagagattcgagcaacttatcacggattgtagcgtgggtggaagagattcagtcgacgctcgagggtggcggcaaggcaagatagcaaccgtagcaataatatcctcgttcgtcgctccacaccaccatattggtggtctaaggggcgatgctagagataggagccccagcctgattacccatggccctagcctgaaccacatctcatcaagtcacgtaccgtttccagccacgtcagatgaacgtttggtcaacgagtcacatgatgctgcgtaagatgaaaccgttgtctaaagcgtcgagagacttgatttgcacttgtgttagtaattaggggatgttatataactggtttacagttgagctgttgggggacgtgaatgaaactcaaaccatagttgagggaacaattttccatgctaaccattcttcttggagtagcccacggttgctggtttaatctagacctctgaatccatgatccaacgactaagcacgcgaggcatatatttttctcccttttttcctccggtagaagagatcattctcttcttgattatttaagatactagtaggtaataatggcttacaaaaccataaagatatcgctggaaaatgatgaattaatgtaaagaaattctacttgtataatgtctgtcactgatggagatgttgtccaacctaacaccaaaacgcatgaaactggagcgtcacatcgctgcagacaagcttgtttccgggggaaggtctcccataaaaacgaatttgtccctgcacttctttttatcaaaggccaatatatatcaactctaaaggactgcaactacaaatttctcaaatatcgcccgtgcatgaagacaaagcaaacagttctctttaacagccgagactacagcatacacacgggcaataaaatagcaaatgctagtacatgatactgactatgcaagattctaacagggcactaaaagacgataatagaatggacacccttcccataatttaagcatcgcagccgcaaaagtccttgaaatgtactagtactagtaaaagagagctcggctctgcatgattcgccaaacatgttgttctttccctgcattttgtgtcaccgtctacaatgccatttgtccctgtcgatccattcgaccgtataataatatattgaaacgacaggagaaaagagatcgtcgtgccagattaatcgcacgtacgtgtgcgtatccgacaagtcccacgacgtggcaagatctctgaaggatggcgaattttcacgtctcgtgctggtctctccgtccaatggagacacgaagcgttttgattttgtgttcagcgatagaaagctactcctaactaatcactggggtcagctcttaaactgctaaggcaaacggttgctttcttgaattacttgacaatttctcagacgtcgttgctcgtgtatttaggacatatttttttcattttgcagaaggtgtttcgcagtatgaaagctacaagaacgacacgcatggccggctgccgggctatgtggaagaagcaacaatccaatggtcgagatagatatacctgtcagtcgctgtggagtggtattggactattggtccttttccttcacttatccggttcaacattttcctagtttatgggctataaatgtgaaaaattctcaagcacagaagctaattgaggctattccgtttccatttcttcatgctagtgcagagataatgaaccaccgaaaagaatacaaattgtctcgtagaagtaaaaagtacgagctgctacattttgagagaaaaacaaggtacaactgaaaatttggaggatttttatttgcaaattcacaaaaagcaagctaactaagcagaactgagaagagggatttgtgggagtagttgaggtcaggaataaagccctgttccggcccatcccctgcttcgccggtccaggtcggctcaatctcctaaggtggcccaccactctcgcgtaagatgggcccacactgacagaccaactagacccgaataaatcgcctcctctcccacgccacgccgccaaggcgccaacgcctcccaccagccacgattcccagtttcctaccaaaaacttgtttctcctccacgtcggtcgagtccgagtccaccgctccggccgccgtctccatggccgcctcctcctccaccgccgcagcgtcatccatgtccggcgccaacggaggaggaggaggagggagcgtgttcccaggccctcccccgccgacgccgtcgaaccaccaccacgcgctcccgtcctccggcgccgcgggtgggggcacggacgccgcgctctcgacgatcctccagcgcctgctcctatcctctccggcgccgattctacgctccccgctctcctctcgctccagggccccgccgtcgctgccgcctctcgtttcgcttggctctagcggcacccttcgtctcgacgccgccgccgacgtggggtacttccacctcgagggacacggcgtcccttcccagctgccgtcctccgcgctcgccgagctctccctcgtcgacgcgtccgcgcgccgcgcgtcgaacctcctcacgctcggattcacggaggaggatcagcaggaagcggacggcgccgaggaccccgccctggtgttcgacgtcgacgacgagggggagatgggcgcgctcccggctgcggcggcggagtacgcgcggcggatgcgggacgtgggcatgcaggtggtggcgatgatgtccgggtgtcccgaggtgggcttcggggaggcgccgttcgcggaagggaggaggaaggcgaggtgcttgatgtgggtctccaaggttgccgctggcgaggcggcgcctccggccgccgggaaggcgaaggcgtacccgtacgtcgtgggcatccattgccagtgggaagcgtccgggaaggaggcggcgccggcgagctgggtgatggacgacggcggcgagtggacggccgtaggcgcgcgcgacggcgcactccttgtcaccatcggcaacattgctcaggtacttgcgtgcaaatgtctcattttgactagtttgcaaacggaaggacattagagcattaatttttgcacagataacacataaatgattgacatgtagacactcatattattgattcagtttgtaatttgcattaaaaaaacaaatggcaaacgtgtaaaattaattacaggttttacagctacgaatttgctggtcgttcaccacagaaaaaagatgtgttgattgttcgtgagtggcagagtctgtctctaagaagcatagacatgtactaaaaagcatccatttttattttgcgaaggcatcaaattctaaagtataggctgtgcgtcaccactcaatttggacccatttaggccccatgtctgcatcaaccggtgcatcactgcctcacagctcggtttggaatccaccaaaggaccttaaaaaagagtcaaagatctcggcttttgaagagaaaccacaaagtgaccatcatgtcatgtctgttgtttcctttactctttgagcagcatcaaagcagtaacaacttgcttgaatttgccttaatgcctcttgttttttatggcacgcgtgctaggtgtggagcaatggaaagctgaagaaagtgagagggatggctcgccccgtttcttctgcacccggagcagggcacggcgccgaggctgaccgcttgtcagtcaccgtgctgatcactctccccttggacagtgtcatctcgccattggtcccggtcacggatgccggagaagagggcggcgacgacgaggtggatggagccggcgatgatggggatgggtggagatttcactcgtttttactcgaggaccttgcgtggagggtgtataatgggcggcttcagttcaaggacccgctggtccggtatcggatataagatttgtccatggtcgtcggcatgttgcatagctttgttttgtttgttggtgtgtgtgtggattggttgtaatcctagtattggagtggtttgagcacgagtgaatcattcatcgtgtgaaaaaaatatacgaactgaaccaggaaatggctcattttcgtgatggtacttcgaataatcctcacattatttctccaatttcgttgcgagctacttcctctgtttcacagtgtaaatcattttaacatttcctatattcatattgatgttaatgaatctagatagatatatgtgtctagattcattaacatcaatatgaatgtggaaaatgctagaatgatttatattgtaaaacggagggagtattatggaccagtgatcactgataaacacaaagaaactaagaatacagtaaagtgataccgaattgcgtattccagacgcggggaaaatgtcacagattagtgcgaaatcctatattccacacccaagaagagcaaaagcagtcatcaactcaatacatagttaaaacattgtttcaaacgctgaaatttcaaataaatcatccatttcctgttggaaatcagaaaacatctcctattttcctcgaaaaaaaaaggaactcttagaattatatagatgggccagggccttgcaagcctggacgatccagcaacagccggactaagttcactttgggtccctctatttgtcacccagtccgattttcgtcccttgaccgcaaaactggatacgaaccgtccccaaacttacgaaaaccaggcaaacgaggttcctcggcggttttgataatagttttggctgacgtggcgcttacgtggctaatttgactcggtcttcatctgacgtggcactgacgtggcgtttatgtggcaattcgatccggaaaaataataaagccatgggacccacatgtcattttcacacataaagtaataaaaaatagtgggacccacatgttatactcaccccctcatcttcttcctccctcaccatctcccctctctctcctctcctctctccagcggcctccaggcgccacggctcacggggtcatggggaggtccagcggtggcggctggcgacgcgacagccggcggcggcaacgagctccacctctcgtgcagccgtgcagccgcgcgcgtttctgaccctgcgcgcgcgtggctgtctgatggcgtaggcggcacggatggattcatggatctaatcctgcgccagcacgtagccccccctcccgcgatccgacggccggcgacgtcgctcttacacctcagctcgctggggttttgagttttgaccaccggaatgaactttgttccgatagatgcagtttttgctaataatgcctttacctactcacctttcgtcagtaactggtaattgctaattgctcacagatcacctactcacctctcggctgcacggctgcgccgagaggtggagctcgccgccgccggcggctgtcacgtcgccggccgccaccgccggacctccccgtcaccccgtgagccgtggcgcctagaggccgctggagagaggaaaggagagagatggaggggagatggagatggagagggaggaagaagatgaggggtgagtataacatgtggggcccatgcgggtcccactattttttattactttatgtgtgaaaatgacatgtaggtcccacatgctttattatttttccggatcgaattgccacgtaagtgcctcagtgtcacgtcaaataaagaccgagtcaaattagccacgtaggcatcacgtcagccaaaaccgctatcaaaaccgccgagagaccttgtttacctggtttttataagttgggggatgggtcgtatccagttttgcggtcaagggacgaaatcggacagggcgacaaataaagggacccaaagtgaacttattccgcaacagccaccgcgggcggccacgcgggctggaccagcccactaaactggcccaggcatagaacggagccacccggccacacccattcctccactcgcatatcccgttacctttgccgccgcggcgccgccgccctcttccgctcgccgccggccgagggcgcccgtcgcgcgccgtggagcgagcctagccgcacgagctgaaagcacctaaaaggtcagcgcgtcccctccccctttcctctcctttcgccgctcccgcagcagccacaggacacctgagacgggtctgggggtgcaggtcgcgcctggaggaatccctaggggctaggggaggtggctggagatggctggtgggagctgcgacgtgtgcaaggaggcgccgtccaagtacaagtgctccgcttgccgcacgccatagtaagtccagccaccggatatctccacccttctgtgcttacagcttccatgggtagcgtcgtcgcataccactgtccttaaaatttgggaaatcgcttcgatcatggtgctcagtaatggcctactagctagcataacaattgaattgaagaacacttgttacggttttagtgcaatgtcctacttgctgtgttcacatcgattacttcactgcttactgcttgaaaagagagtacgggtttgctaggtcaatagagtagattgatgattaatggttggaagcattagcttctttttagaatatgagcctacatcagaattagcttgatatattttgggtttgactcggtagcttgctgctggagtggttttgcatgagtaaaaaaaaaaaaaggcagcagcaaaacaagacatgtaaacctttctcctgatatctggtgtcagtgttggttttggtactaagctgtattgaattagtattcagaggcaaacgtccatcattcaataatctgtaatactttgcttattttttcttgaatacgcaagagaattacatatcatactttatgacttctcttgcacaattgtttcaaggatgtaaccttaggattgccaaatatgattatctaaacaaactgtttttcaagattccctgaaactaaatggactactgaactaacatacctgttcagcgatgcaatcacggttggacatcttctatgtgtcctgtagatttgtttggtaaaattgctcttttgccctaaagttgaatggcattggctcatttgccacagtccggtgtatgacaactggggccagggctacatgttatacacacatatgtggcaaaagagcacatgtcatattgtagaccaattaagagcatggtccgttcaatttctctggcttctttttctctattgtgtaatgcagttgggccttacaaacggtttcattatcccttgcagttgctcggtggcatgctttaaaaatcacaaaggtactcagtgctatcctttggtagtttctaaatatagctctagtgctgcgatctgaaagtagctcaagtagcgcgagggggctgtagcaaactgccgtgttccctctgttgcttcttagttgtgtattttaaatcaacaagcttccctgtactgccttttctctctttggccagcgttctttgccagccgcatttttaaacatagctcaataaaccaaacgtcttaaaaaaatatagcaagtgataaactgcttatcacactccaagtgtccaagtctgcgggggaccttttgttttgaaattttggcaattttactattgtacttggtttgagattagggaaaggctgaacagtactaaacacagcacaaattataactatcatttatgcattgcctttatgcaaacaaaaatggccaccaaatatcttcatctcccttttttagaggaatatatttattatcttgatagccagtatttgtgctaaatatcgttttgccaacagataaattttgccagaagacaatacctctggaagaagttagcaagtcatctcttcaggaggaaatttgtaagtgctctagcttttggtgactcaatacagttgtttgcaacagctatatagtcctgctatatatggaaattgagttgaaaccatgatcattaaaatagaggggtcctacataaaattacatcaatatactgtaaatgagcatttgactgtgtacacctaaaagtcctgcagggcatgtacttgcccatatataagggcctgaattatcttatcatatagtcattcattaaattgtcaattgttctgtcctactaacatgtttctaaaataatctactggaatttacagttgtgccttctattgttttcagcaaggaactctaggtcactggaagaagcaacaaattgtcctaatgacaaggatcaaaccccgtctttatgtaaaaatgcaccatacttatctctgttgttaactctccatttcttctatttggttttcactaataattgattgaactcaaaactttatagatcatgactaccttcagttgtaaacaatgtaaccatatgctatcctcgcaaaaaaagaagaagaagtaaccatatgctatgctttttaatcaataatttaaattagtttctctagaatttattataagggctataatattattcattgtgaatcttgaaggccaagaaaatttatgttaagctcaattttttgtctgtagtatcggacacgacttgtcccacacaatatccaaacacattgcactctgcaaaatctcttgaagttgaggatccaagctggcttgttgacaagaatggattaagatctttaggtattgcctatgtttgactatttcataccatgatttgtgttttttaaaaaggaatcctttgcttttacttgatttctggctttatttgttagctgaaacaaatgtctccatgttagtatagtccagcatttcaacccaagaatatcgacttcaatttcataattatctgaacctaatcccaatcctacagacctacagtataggagtaaaatattggcatgcacatttagtaatggggaatttaactatttgccacttttataaatggctactctccgtttgccattcttacatttctctacggatttgccaccagagagaaggtttcttaatcatttgccactttcacctattaagcatgctagtgaggacagccaatgtggacaagagacacaaaaagtccattttacccatggcccttcccttgtgttcccccctctctccctttccttttcagatttgagctcacctccgccgctgtttctcgtccatcttctgcactgctgtgtagtgacaagccattaggtagcagtaacacttaggtgcgtgcatggatgttctttggctgctattgattgcggatgtaccttctccttgtggctgtcgatgacaaccttcaaccttgcggatgtaccttctccttgtacctcaacgtgctcctcacttgccggccttgccatcaatgaaccgcatgacgacctgcaccggggtgctccgccatcctcccagtgagtttgagggcctcgcggttatctggcctgccgaagaagatgatgcagatgcagtgcacaaccttcttgccgctgacacatgattgacgaggcttgatgagacagcgtggctggtgtggccgcggatggtctcaatgaggaggtgaccccgcaagcaggaagccagaagcatacgtgcaccgctgtggatgatctcaatgagatgaaggggagtggcaggggcaaaaaggacattcacgtcctcagtccatgctggtatgccacatcggtgaaaggggcaaattgttaagaaaatttctctccggtggcaaaaatgtaaggacaatcgtaagtggcatttggagagtggttattcgtaagagttgacaaatagttagtaaggatagtactgtaagcagaatatgggcttcatgctagtcaattttgtatattggttccacatccctccctgtacaaatttcataacctgctagcatttctaccttatttaattaatcatagtaatactcatcgtcttgtctcgcaaaaagaaataaacatcatcaattaactcattgcttgatttttgtatccatgccagcggaatctaatgagatccgagatgctctgaaagattgtaagcttcagcaaatgctacttaagattgatggctctgcagagccagaaaaggtaattctctactcttgtgataactgcaagtttatttaacaagttaactatgtttgcaatttctgtccggctgctcaaataacatgcacataatatgccaatacctattgaggacaatggtttgcagtaatgaacattgtcactgttatagtacaacacttctgtttcttattccaccatcatgacttcattttcctaccagtagttgagaagcttcaaatgggcacgttcgatgaattaattccttttactatagtctgctgaatactgatacgaatataacttttctcacttacatttatttttttcctctctctaccacctttattttatgatgcccactccctcattaattcatcctcaggaattagagaaattgatggaaggacaagtttttcaacagttcaccaataaggtttctctttccgttgcatttgctcttctatccacaagatattccttgttaactctaagttaattaaccagacacttgcacgtttttgtttcctctgtgtttgcagattcttgacattgttagcccacaacaatgaacaccaactttctggtggagctattcagcagaagagtgcacgcatcggggcaaatgacaacatgtagagcaacttacctcagatgctgttttcctaccatgatgagattgcctatacccgtgacatttccttctactactttgagaaagttttgtcgtccaatatggtgctagtattttaccatggcatctctggctcaatcaacaactgttcaatttgtctacatccgtgacatcttctttggctaatggctactgtgagagttttgttgtccattatgttttttttgtggtatactccctccagttttaggttttgttgttcagttttgtggtttaccaaagtcaaactactttaagtttgactaacgttatagacaaatacaataatattcacattaccaaattagtttattaaattaataattaaatatatatttataataaatttatcttaggtcgaaaatattacttttttctataaacttgatcaaatttgaagcggcaagtcaaaatatcttataacctgaaacgaagggagtagcattttaccatggcatctctgtctcaatcaacaaaggtggtgtttagatcgaggggtgtaaagttttggcgtgccacatcggatattatatagggtgtcgtatagggcattcgggcactaataaaaaaactaattacagaatctgccagtaagcagcgggacgaatttattaagcctaattaatccatcattagtaaatgtttactgtagcaacacattgttaaatcatggagcaattaggcttaaaagattcgtctcgtaaattagtcgcaatctgtgcaattagttatttttaagcctatatttaatattttatacatgtgttcaaacattcgatgtgatgcggtgtaaaatttttgtgtgcgaactaaagcgggccaaagtagaaatgatgcattgtttcaggagaacccgatgttacagttcttctgcatggtttgtcttagcaagctttatattggcacgggattgttgttcttaaatgtaaatcatcatcgtgaatttgttttgtttccctcagcgtatgtaatcatgactattaccttttcagcttttttagctgtaaaattgtttgagctgactgctgaaaggcaacagcaacagcacatgacacatgagccactgcaactgggtccacctcatttgcttcttttaggctattaagagagagatgggtttataacgtgcaagataataacacaggtaaaaagtatttctttctacggctaatggctttccaaatcccaaattaacccacgttcacctgacgctagcacgtttcagcaacttgcaagccgcaaacctattcttctctgctgcggtaaccaaacccaataaaaagggcacctctttttggcaccacattgctgctactctctctccccttctcttctccggttctccctctcctcctcccacctcagccgccgcttaccggcggcgccgcctgctaatctgccggcgtgagcaccggcggagatgtgttactgctacccaacctataacgcagctctcccgcgcagtgcctctgtctctagctagggttttcctcttgggggagacgacctactatggtaaggtggggagctgaagccggcgacctggtgctgtccggaggaagctggagctcgtcgccgtcggatggacgccgatgaggccgcggggagtagcaggaggatggatctgaacctctaccttggcctcccacgcgccccgcgcccgcgccgctccgacctcggctccgacctcgccctcagcaccccgatgccctcctccccgtcctcctccgcagcctccgtcgacgcgccgccgccaccgcccgagctgtcgcatcccccgtactccccctctcacgccgacctttcccctccgctgcaggaggtctactccctgtacaaccccgacgacccgcctgcttccgagacgcacctgccgccgtatgcgccgcctccggctccggtggtctcggagctccctgacgacctcgagtttggcctccaccccccgccgccgctggtgcgtgccagcgaactgctaggttgggaggaccggccgtcttcgtcgacggcatcgtcctctttcctccctgacaccgcagcccgttactggcggcttctcgagcagactggaagcagatggctccgtgcgaggcggtttaggtcggaccttccgccactcagttctgaagcttacccagctgggcgtgatgctgccgcagtcccagtgctgcagcatgaaccgatgaatgatactgttgaacataataaggtagctgccgatggcgcggaagtaggcgcctccgaggaatcggaggagcagggcaggagcgctgccacatttgagtgtaatatatgcttcgatatggccagcgagccggtggtcacctcttgtggccatctcttctgctggccttgcttgtaccaatggctcaatgtttattccaatcacaaggaatgcccagtctgcaaaggcgaggtgactgaggcgaatattactccgatctatgggagagggaattcatgtttggatgccgagaaggctgtggaaggtgggaaacaaacaggtcctactatcccaccaagaccacatggaaatcggctcgaaagcttcaggcagcagtttcaccatttgcgaccgatctcaagaaggcttggtgaggctcatgggttattgtcatcatggaggcgccttctggaccaacagattatgaatactgcgagtaggtttgaaggtccgcctgaatcagctgtgcaggaaatggttgacactgctcacgctcagcacaccagtcgcctaagtagattggcgtcaaggatgagagcaagacggttgctgagagaagcagacaaccctaaccctcccgatggcggatccacttcccctgacagtggtttgatcagaaacaatgcatcggatccatccagaaatggtccgagctcattattaccagatggaattgactggttgcgtggacttacccttcttgggtatgaagacacggaaagatttgcatctgccatgagtgattttagaaggataactggaccaagccaatatggtgcatcggcttcatcatcgaatcctccaaatctcgagtcaacatttgacagaactcatgttgttgcagcaccttctgcagaccaagcatctaactcaagcactgctgcagtgatacagggggatgctggtatctctgagagtgcaggagaaccaagtaacgcggggtcatcaagatccctgaggaggagagggaggagcagtgccctgggttctttggatgctgatggcgggggcctccaacggaacaagaggcgaaggataaactgaacattctgtgttgtggtgttgatctaaactctgcatgccatgctcgctgattttcaactattgcatttcatttcttcgggtgatgtctcctgtgttgtagtgtaacattttttcttctcttttcattttcccccgtaggttgcactgaaatgtttatctgtttagttctcatgtagcctgtacctgtttaatttatggaaagttattgatcaagacatttttgcattcgaaaggtaatgaatggttcaactgcatttccatgacaataaattggatgctgaaatgtgcatccaacacaatggtattcttgtgcatcaaataataggcataaacattgtgtttttatttgtgtcaataagctccttcagacatatagaaaactaacaggtcaataatgtagtatattgaagttggaaggaatacccagagaatggatccatggacacaattgtcttttgttgcttgggagaaggtacatagcctgatctttagtccttgtttatcctccaatgaaaatactcacgcattgattgtttcaatagacaaggtaaactttgccatcgccgtgaattttatgatccatggaagctgtttcattgagcagtggtgggtgtaactgtgataacctttatattacttgcttgcttttaaggaatagcacactttttgtggggatgggattactcccctttttggaactacatattgaggaacggatttaacatagaaagagcttaatacatttaagtactgattgtgtgcatagaaaggggtttattatttggaacaaaattgcttagctcgtagtaataaggaagttcatagtattgaactttatatgacatgtgagttatatatatcatgtttgtctttggtcacttctattttatgaccatgtaacatttatttcatgtggaacttggcagaagagaatttgaagagatttcttctgattgatttccatttcggacaaaatacaaagctcccagaccagctgtcacaaagaggtctggttgattttccagatttgtatgcctgtctctagccgagagtaacaggtatttttctgcatctatgactggcatggatagtagattggcatatggaaacaaactcggaagggtttgggtggtgcttaggtgctcttggcagggaagggagacaactctgtgtttttgggttttcagtacatctatcctacatatcttccaaaagctcacacataagccagttaattgtttttttttttggcttgcagaattacctcaataacttccatgtaaatattttactcttttgcagtattacatgaacagattcaatgctatttttctgcagaactgccccaagatgtaaaatgaaaatgcattgagtctgttcaattagaaaacacaagatcactgtgtatactgttcaaagaatgtgctaaacatattatagaaccaaacacagttcatctcaacattgttgctttttgtcttagttgtcacaactatttaaacggatgaaacagtggaatctctaagcaaagctgtgaagagcttcagggctacctcctggcgcgaaatgaaggtgctattgcaagctgctgcagctctactgggtgaacaattactcacatgtcaccagaactctagcaatgaagcagcatattggaacctgaaaagatttggatctcaccaatgtggacaacgaggctcatgagttatgactgctatgatgatgatgatgaagatctgcttcagcaagctcatgttatggatgtactactttagtatgctttgctttgttgattgggagctgcatcagatcctgtttgactgctcaatcaattgcaccatcttactctcacctactgttggatgagggtggggctttgctgtatgctcaatgttcttgaactcttgcatatgacagtaatgatgttccgtccttaagaaattgtacttatgtagtgcagcagttgatcatccaggatttaacccaagttctaggtgatacaatataggttgtacatgacctaataaatttctaaatagaaggtaaatccatgttgattttcaggcgccgtttgtagtccgtacattatgttttctatgtgtagatgtgtacccagtacagtattaattttgaagtttaaatatgaagatagagtgatcatacatcaaattttgcttggattctgtttttgaggtttaactacttcaagatgtcataattttattattgtaaaggtttataaggattttataaattatatgaaacaagtaaccatattgttcacatgcggtcttcacagatagtaatcactctagttattgttttctgtacttcttaagtcagctctgggtaaaaatgaagcctgaacaagtggacagtgcacaaaatcgcgatggaggccagaacccacggattttaaaagatggtgataagttgcacggacgttccatgattcttagacttctccagatagcgatactaatcatcagtatttaaagtttgaactcgcttccttggtttgttttgatagtgttatttaagaaaaaaattctgtggaaattacacatatctgacaaaaaaaaagaagtgggaaaggatgcactgtactgttcatcgttcagatatctacaaacaggcacctaaatacggctaatgtcacggccaaataacagtgtggtcagccagttgatagccacataaaacctgttcctccagctaacaacacgagtcaggtatgctgagcgccagatgaaccagctcacaaatcctgcaagagatatccctttcgattcctgacaataaagggacaatttcagttaactcgtcagaagtttagaacaatgcaagttttttttacagacagaaacagtaaccagccttgctttgcctcagatcgactagagctttgtatcttccgacagttgccatgctccccagatgcttatacacaaaggcaggacctagatcaacgtcgatctcacagttcgcatgccctcctccagctttcatgacatggttaagcaggtgagctagatacttgccttgtcgttctgcaacctgttccagagtacaagtgcagtagaatgtataaatatctaatacgagaagatgcccatttctttctaaccgatatcaataatccaagatagtgaaaggattgggaattgtttcaccgaaagatcttgtttcggtttatgttaaaccctttagccttttaagttactacttagcctggcctaagtaaagcgttttctgaacttaaagagggtcttataccacaccctgcatgttttcctttacctcaaacctgcggaactacttggttttctttaaacaaaatgagggatgatactgttttggaagtttcttctaaagaaaataattgaattaagtaatcatatgagagagtgcatctacttcaaacaacagaaagtatttgtatgagaaagaacagaaattagggcctgttcactttgatgccattttcaaccttaccaaattttggtaaagttgccaaaaaagtggctacatttagtttgctgccaaattttggtaactatataagaaatcatgccaaaatttggtaagattttttttggcatcaaagtgaacaggcccttatacaatagatgaggtttgtcatggccaagaatctgtttaatgttgatgtaaggcccttttgtcttttttttttctggttcctattcctcccagtgttcttggtactccagaaaagattaaggaagcccaaatattagtttgccaaatactttgtgattgactcggactgtaggaagatgttcagataagtacctgagctaaagctgggagaacatccttgcctgtgctttcaagaaatccactgcaatccccaatagcgaacacatcccgggcagaaggaacacgtaaccactcatcaaccccaatcctgtgaccaggcaaccagtaaatctatcacaggtaccaaagatgtagatagccatgttacaccagtaattgggtggataccaaaagcctatagatagtagaagcttcttatagtgcatggtgaaacctgattcacaaatgaactacatgtagaagatatatatatatatccctattcctcaaagtacagaaggtgcgcaggtgcatataatcaaatcccattcagtatatgatgcatatacatgaaactccatacggtcaagccaatttacaataccttccacctggtgactttggaaatggcaacgacttaacgaatgatgaaggaccaactccagtagaccataccagcaaaccataaggaacctcttctccattgtccaggattaatttgttgggttgtacatccttcacaatgcctctcacaagcctaacacctgactgttggatgatcacaagttatttttagtatttcactgccagctttcttatacgatccacacatatttttaggtcttggagtcttggtacatgatggcttaaaatggcacaacagtacaacactagattagacagagattacataccttagttagttgatttgtagcatattgcctgaggcgaacatcaaaagatgacaatatctcatttgcctgaaataataaaatgaaacaaaatttgttaagtgtggtcaaagtttagagagagggagagatgccaacagctctaacctcaatcaaggtaacatggatataatctttaacatgtgaataacgctgtttaacatctctgatgataaaatcactaagttcaccactaaattcgacacctgttggaccacctccaacaacaacgcaatgcaaaagtctgcgcttttcttcctccgatattcctgttttaacaaataacattggccaattggttataataaggaggatataaacaaaattagatttcagcacacaaggtattttgtaaaaaacaagtatacctaaaatgtaatagttctattctaaattctgctcaatcaaacagagaaaaacaagaaacagcaataagagcccaggttaatgtagttgcaaatttcatcaagagacaaacaaaatgtaaaagtaacgagtaattactgattcctttgtgccagtgaagtgtgagtgtgtgatagttgtcaatgtgacaaattacctaagtaacacaaatatcttgatttgagttgttttgtgtttctgtggcataccaggtacatcagatagcatcaggttcagaaggagctttctgcgaatttcttgagcatggtgaacttcccggagaaatattgcatggtcagtaacaccacgtatcccaaaagttgaggcctcagctccacacgcaaagaccagcttatcatacgctaccttgaatttccaaggtttcaaggtatctttctcaccttcagtaactgtctcgcaatcaatctaaaggtcaaaggacgatgaataaataggtgaaacaacttttcagagaaaaattggtataggaaattcatgtattaaccatccagtgggtttgtaaagtttaaatgaaaactgcaccctaaatatgcactagatggtgaatattcacgaagtaccatgcctcttttccaggcaaaagctatttcgtcctaaaatatagcaacctagtactctactagataggttgctacattttgggccggatggagtactaaacaataaatacagtatcacatagaatctgacgaaccatagatgaattcgtgaatatacgcaagttcagcagcgttctctagctattttccccattattattggtctaactttcttctccttcgatgtgaccaaaaggcagctcaccaactactcaatcaactacttaagagacacgcagcacatgctgtggatggatcacgatgcagatgagtaaagtcaagattcctccagcaaagcccagaaatccgattcactcctctcccctattcaaaaaggtcaaaagtatcgattctgcacgaggaaaaatagaaaggatcgagcttcgatcattcccacattttgatcactcctccaagaatgttggaaacaggcattccccacgcaggcacgtctgtaaaaccagtggccatttggccgcacacaccaacccagagctgctatgggggtctcaccgtgtgagcgtcggggtcgacggcggtgcagcgggcgaggaggaagtaggagccgggggacttggacacggcgggctggatgcgcgcgagaggctcggcgacggagcggaactcgagcgtgccgacgcaggtggaggcgaggagcggcgtgaacaccatgtggttgcgcggggagacgcacaccacctcgtacccggtcgtgtcgatgtccttcatcagccgcgaccccgcccacccggtccccagcaccaccacccgcgccttctcccccttcgccgtcggccccagccccgcgaaccccctcctctccaccgcatccgccgccgcggtggagaacggcgagtacgggaggcggctgtggtggaacgggctcggccccgcgcctcccacgcagccgcggcgcgagatgcgggagagcgaccggagcaaggacgacgccgccatggccggcgacgatgagacgagattgcgattgctgaacctgaacgagaagtgagccgac

SEQ ID NO: 39280 - DNA, 8096 bp, Oryza sativa
tccgagaggctgagatctggacggcgaggggctcccccaccgtcggatcgcgggtgaacgggcaccgttgaaggtctaaagcccccagccagaggcggtttcgtcgtcgcgtgtgcggtggaattttttgcggtggcggagtggcgaggccaagaaacggggagaaatcgcacaaaaccacggcgttttccgcatggcccgccacgcggcgcgaaccacatccactgccgcgccacgcctctcggccgccacacgaccgtgcccccatcgcgccgggcttcccgtggaccgcgcccacccgcgccggcctcacgcgcggctgaggctcacgtagcacgggtccacaccaccgaacaacaacccacccctcctgcgctctccatcccatccgcatccctaatttcgcctcggcctcgccacgccgccgcaccatggccgcagccgccgcgtcgtccacgcccctcttctcgccctgctgcgccgccgcgaccgccaagctcggggcggcgtgcccgtcgtcgtacggatcccggcggaggccgtgcacgcgccgtggacgcctctcggtggtggccgtgcagacgggcccgcagaagccatcgccgtcgtcgtcgtcccaggcggggacggaatcggagacgctgcagaacctgctgaagagggagtacaagtatgggttcgtgtctgatttcgagtccttctccatccccaaggggctctccgaggccacggtccgccgcatctcggagctcaaggcggagccggcgtggatgctcgacttccgcctcgccgcctaccgccggttcctgaccatggtgcagcccacctggagcgacaacgtgtacgagccggtggatctccagtccatctgctactactccgcgcccaagaccaagcccaagctcaacagcctcgacgaggtcgacccggagcttctcaacaccttcgatcgcctcgggatcccgctcagcgagcagaagcgcctcgccaacgtcgccgtcgatgccgtcatcgactccacctccatcgccaccacccaccgggaggagctcatgaagaagggcgtcatcttttgctccatttccgaggccatccgcgagtacccggaccttgtcaagcgctaccttggcagcgtcgtgccgccggcagataactactatgctgccctcaattcggccgtgttcagcgatgggtcgttctgctatgtgcccaaggatacggtttgcccaatggagatatcgacatactttaggatcaacgacaaggagaccgggcaatttgagaggactctaattgtggctgatgagaggagcacggttagctatctggaagggtgtactgctccagcttatgactccaaccagctccatgcggcggttgtggagcttgtgtgtgaggagcaggcagagatcaagtactctacggtgcagaattggtactctggtgatgaggaggggaaggggggcatttacaactttgttactaagagaggacggtgcaaagggcggggctctaagatctcatggacacaggttgagacaggttcagcaattacatggaagtacccaagtgtggagcttcttggggatgatactgttggagagttctactcagttgcactgacgaaggattaccagcaggcagacacagggacaaaaatgatccacaagggaaagaattcgcggagtcggattatatccaaaggtatctcagctgggaagtcacggaattgctaccgtgggttggtccagataaactcaggcgcagaaaatgcttataattcttcacagtgtgattctttgctgattggggataacgctgctgccaacacctatccgactattcaggtaactgctctgctgttcttgatttgcctggcatgaagggccaattgcatttttataatgcaaactattaagagtaggttgttaatcctttgttctgtatgtcatttttcagtttctgttttacaaaagcaatagagcatgtataaattaataggggctttgataattttgcaagttggagggtttcatattaatcttcgtagtccttggttacaatcagtcttctccatttaagtttcaatatattgacatgcaaagtaaatggtaatgacaccctttttgggaatacacactgttccatatattagaagaaatatggtcgccgttgattccatattactgaatttaacttttatgctggctaaaaactataagagtcaaactattggtttagtccaatttatcttatggttagaaaatctcctgccatgcacgttttcatgttcaaaagcaggaaaaatctcatacttattcatctggaacatttatatgacactgatggcgtatagccagcacaactttagtaccgcttcaggtttcatcatgctcccattcaaatacacctttagatgaccttttagctttccgcccttcagcaccctagccgccttcggccttcctaacaagcgctcgggcctcctttgcgctgccttcctcatagaagccgctgggttgacctcgtttgtctaatagtgtcatgcattctttctgcaatatcactgtacctttaagttgcttaccatcacctctaggctactcgcttagttccagcagttaatgtttctcatggtattcttgatggcccattgtgatcttgagctagacatgagttatctctgtgcacgcatgtcctatgcacaagcacttccataatctgcaattacatgtatttgcagttttgaatacagatgtgtaactaatgagcctccagtactatacttatgcctaaaatgcgtatcatctatttctttatctaatatggctgaaattacatttacactaacattctgttccaacttgcgtgataacaggtgggttgcatttctagtcgtgttgagcatgaggcaagcacttcaaaaataggggaggaccagctattttatttccaacaaagggggatagaccatgaaaaggctgttgcagcgatgattggtggattctgcagggctgttttcgagaatcttccttacgagtttgcacatgagatggatgcacttatgaacctgaagcttgagggatcagttggttaattagatggagcaaaatgtctttgcagtacaacacaacaattatttagatgtcctttgtacagaagtatgagaagaataaattgcatgagcaatggacgttttcctagccttgtctaccactagggatgtccttggcaacaaagaaaattctgttacttatctactgttttatccctttttgtttctgtttcttctgttgtaaacaaacccttattagaatgcgtagccacactagaaatgtctccaaaaaagctacacaagaaatggaatctgcttttttagacttatttgcattgtatctgtgtgagcgccacctgagcatgcatgattgcttatagaaacattttgttttaatgtctagagttgtttggtctgaggatccatgaaagtcacaatagttacgattcccttttcctgagtaccattcctcaaaacaaccaagatgacgacgattcactgatttttgggactatcatccctcgcattgcaccgctggtaattgaactacttatttgcatggcaagaacgttgcgctgttggtatttgagtaacttctagccaagggtcacgatctccacgaatttcgaccatctcgagccatcatttcgaatggtctgttcaactgttgaacttcgttcgaaatttatcaaaaattgattgaaatcagcgaaaaaatgattggagctcgaattttaccggctaatcgagattctgcttctggcttcatgcatggcaagagccaagagggtgcgaaggagcagtgacacctccaaatctaacatttcgcggttgcattaccatctcttgcctcttgggctctgccaagaatagccaaagcatatgtagccttcctgcctctcgtgttcactcgttcggtcctcttcctccgttctcctcttccccttgccctcctccagatcgaccatcacttgcatgcatgcgcaggcacgatcgaacgcagtagatgcattggctgccagctcgatccgcaccgacgatactccggcgaggcaaagcgcggcgtaaggaggaggaggaaaagtggccgggatggagtcggtcggcgacccgcgggatgggccgtcgacggagcgcgcgttcgaggggcagcccgtcccgccgtggacggagcaggtgacgctgcgcgccgtggtggcgagcgtggcgctgggcgtggccctgagcagcgtgatgatgaacctggtgttcacgtcggggatcatcccgtcgctcaacatctccgccggcctcctcggcttcttcctcctcaaggcctggacgcgcctgctcgaccagctcggctcgccgggccgccccttcacccgccaggagaacgccgtcgtccagacctgcgtcgtcgcctgcgccagcatgacatacagcggtacgccaccgcgcgcgacacgacgccgcgctcttgcctcttcctgcattgcctcttccattgatctcgccgtcgtaacgccgacgtcgctggcggctggcctgttcttaggtgggtttggatcgtatctgctggccatggatcggaagacggcggagaagacgagcaccggggacgactccagcgcgagcgtcagtgagccggagttcggtcggatgatggccttcttcttcctcgttagcttcgtcggtctcctcgccattgtccccatgaggaaggtacgatccacgaacgcacctaaaaatacaaaaaaaaaaagaagaagaagagatcatagctccctgattcttcgccgatttactggttcatccgtccgtagacaatgatcatccgccaccggctgacgttcccaagcggctcggcgacggctcacctcatcaacagcttccatacccctcacggcgctagacaagcgaagtgagcagattatcactagcttggtgagttatagccatgttgtcacatgatttacggtaatatctacgtctacttgtgatcacaggaggcaagtctcgctcgttctccggtcgtcgttggcgagcttgttctggtccatcttccagtggttctacaccggaggtccaaactgcggcttcacttccttcccaacgtttgggctcagcgccttcaatcgcgggtaagctgagccgagcctgagctaggcaacgaaccgaggaaaccgacgaattcgaacactgaattcatgcaaagtttttattcgggctggagaaattaatcgatcatcggcttgagtgacttgtgtttcgttgtttgttgcgttgcagtttctacatcagtttgaacggaacttatgtgggaatcgggatgatcagtcctcacctgataaacgtctcgatgctcttcgggtccatcatctcctgggggatcatgcggccgtacatccggagcaaaagaggaatctggtacgacgccgatctccaggagacgaacttgaagagcttcagtggatacaaggtactaccaatgatcgaatatttgttgttagacaaaaaaaaaaaaaagacgacgtcgatgatgtgcatcaagaatcagtcagacttcactttgttgtgatcgagaaggtgttttgcgccatagcaatgatcctcggcgacggcatcttccagctcgtcgcgatctcgctgaggacgatacacacggtgcgccaccaccaggtagcggcggagacgctcaggtccttctccgacgtcgacgccatgccgcggccggtgatgagcttcgacgaccgccgcaggacgcaggtgttcctcagggagcacatcccgagcaccttcgccatcagcgggtacgtcgtcctggccaccgtctccaccgtcgtcatcccgctcatgtacggccaggtgaggtactaccacgtcgccgccgcgtacgcgttcgcgcccgtcctggccttctgcaacgcctacggcacgggcgtcgcggagaccaacttctcggcgcagtacaacaagctggtgatcctcatgttcgcgtcgtggatcgggatcaagaacggcgggatcgtcgggagcctcgtcatctgcggcatcgtgtcgtccatcgtctccaccgcctccgacttcatgtcggacttcaagacgagctacctgacgctcacctcgccgcgggccacgctggtgagccaggtgatcggcacggcgatggggtgcgtcgtcaacccggccgtgttcaccgtcttccaccacttctacgagatgaaccccaacaagacgtaccaggcgccgctggccaagatctaccggggcatcgccgtgctcggcgccggcggcctcgagctgcccaagtactgcctcgccatcagcgccaccttcttcgtgctggcgctggccgtctgcgcgatgcgggaggtggccgcgcacggcaagtggcgcgccgagccgtacatcccgagcgtcaccggcatggccgtgtcgttcctgctggtgccggcggtgtccatcgacatgtgcatcggcagcctgatcgtgttcctgtggaaccgcaacgacaagctgggatcgcaggtgttcgggccggtgctggcgtccgggctcatctgcggcgacggcctcttctccataccgtacgcgctgctcgcgaggtacgacgtcacgccgcccatctgcatcaggttcctcggccgggtgcagaacgacaagctggacgctttcttggcgagtaaggctaaagctggatgatcctgaattcttgatcgaggaagaagtgggcacaattgtttattccgttctttttcttccaacacctgtagattatttagtgatagaactgatcttttcatgtagagcgaaatggactttttgtgcttttcaaacagttgagatttcaatccaacgaacatactatggcagccgaaataaattcaacatggtttgccttgttttcttaccagagttgtaggcttgtagcggattcagtagaaacagacgtgccatggcattgcagcagcagctcctcgccctagctgttcagaaaattttggcatgaaattggtaagtagtgacacagtgagagatgatatcaatgaggttgctattttgccaaaggcaatggcgcaatgccatgttgcactacccagaaggtatatataataacataaatcaggcaacaatcaaaaactactttattccttagtttgtgtatctcatcaagatgcaggcacaagggtcaaatagctcatgaaaacaggcaacagtttgggcatccacgccctcatgtgatcagaagagactaaacaagcaacaactagacacgaaaaattccgccttcaaaactaaaagctattgagaaccatttctgcatttattatcttctctcatgccgatagtcattctccacacttcaagaagtagcggcagcctgctgtttgtggacgaactcgatgcccttctcaatgctggccttcaactcaggcttcaatgactcaagggccttggcctcatattcagtcactccctcaaggtcggaagaaatgatggactcaacaccattcttaccaagcttaaccctagatgcaaagaacagcagctcagttaattcagattgaacaaatgtgcactcgtaaacatctggatcaccagccaatgcacggagggatgactcaacaaatctggcagctgcataggccatcgacagggtagcagatccagcaccagctttcgcctccaccacctctgtcccagcattctgtatcctccttgtcagctcttcagtttcctcatttgtgaaggtgacagatggtctggtttttgacagcaatggtaggatagtaatcccagcatgaccaccaacaactgggacatcaacatcaatgagcttcaggttcttcttctgagctataaatgtgttagctctgacaacatctagggtggtaactccgaaaagcttcttggggttatagacacccttctgtttcagaacctcagcagcaatgggcactgttgagtttactgggttgctaatgatatggataaaggcttctggacaattgtctgcaacagcctcaacaagtgtcttgacaatgctcgcattgatgtt

SEQ ID NO: 39281 - DNA, 1362 bp, Oryza sativa
  unsure (1)..(1362): unsure at all n locations
ttgatgttaaaaagatcatcacgagtcattcctggcttccttgggactccagcagggatgacaacaacatccacacctttcaagcagttggctaattccgagggcccagtaaagtccagaacctgagaaggtgtgttgcagtggctcagatcagcagcaactcctttgacatttgcaatatcatacagatgtagtgcagagaccagaggagacatcttaattaacaagcccaacggttgaccaatgccaccagcagcaccgagaactgccactttgtaagatgcctcaggagaaatgtgagatccagagtttgcctttggtacaatccttggagagatagatgatcgaagagatgcattctgacccaggaatgatgaccttgactcaaaactaatagatgatcttgcctttaagccactgtagcttgtgatgtcgcaattccttaactttgagataatgccagcctgagcaccaatcaaattgatggcaacagttgatgccatgcctaactgcaggaacagttccattagatttatattgaggagatgccgaatagaaaatagacaggtcgtgacatgaatcatttgtatatcattagggaagtgcatctaaaacactgacaagtaatggtaatacatattaaagcgattctttatcttttggactacatgatgaaatgtcttcttgcaaatagcagtgaaacaactgatgacatgacacaaaagctggatccttcagaacttcaataaattactagcttgtgaatttcttagaaattttctaaaaacttttagtatgaaaattatctacaagctgatgattatcatttaaatattggtcataacaaacaaaaggttcagaagaaatgagcccacgagaagcatgagatgatataatctgaagctaaattctagcattatcatcacctgacatccaagttacaaaacttatgagcaagatgagaaaattgggggtgctaaagtatcttccataccgtttccccacaaggtatctatatccatcctaaagtaactaaggtgttgatgcctttctacatcaaaaaaaaaaaaaatactacgatcgtcttcctccaatccatcagcatccagagaataccagtataccagaatctttagttgtcccggttcctcttttctctagtacgccgttgcagcccgctcaattctgctcggtcacaatctactgatccagcacagccggcgccaatcctttgtaaatctcacaaatctacagacaacaccaatccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 39282 - DNA, 10892 bp, Oryza sativa
tagaattctacatggggtttcctggattaatatttcatggatgacaatttaagcctgcatcacaattgacaaacaacaatatgcagatttccccaggatatttaactatttgctacttttaagatgtggcaactaagaatttgtcactcgcagtctataatatgtgagtccaataaaatatccttaattgtcacttgcaatagtggtaaatagttaaaatatccttaactgtcacttgcaatagtggtaaatagttaaatatctcgatttttttctctatctatatctatatggacctttcttaggttctatttaggggagcttctaactgctgtagcttcttcgagaatcagaagctcccccaaataatctatcttttgctacaaatcctaagaagctataggaaaataaattagaagccagaagctgggaaactcagcttttctaaatgttgactaccaattagctgcttctcggaattttaagctcctccaaacatgctattagttgacctctttctttcatatcctagttgaaggaatatgcggttttaatctaagcttcagtatactccctctaacttaaaatggagtaatctggtatgaaatatgatatattttaatactacgaatcctaatattattaggttgctatattttaagatgaaatgacgagggagtatctgctagcattaacatcatgatcagtagccagttatccacaacagagcgagataagatatccatgaaggaagctcctgctcatatgcatagcttttattagcacccacaccttaattaattgcacttaggcatatcatctcacaattttcactgcatataacacagtgaacacacacatgcatgcaagaacacagaagagacaacactggtagtattctctctgggataaaaagggcatgtcattgatgccatattgctgcaaatctagttcgattttgtgagagtatattcagatttagccctggcctttgcagcctcgagggagtgcttcctggacagctccaccaccttcttctccccggcgatgaagtaggccatgccagcagctgcatcattaaccaaatcaaccatgaattaatttcccagagctcttaattatcagttgctgatctttttcaagcactattatctgttgtagtaattagctagcatcaaacatttttaccgtaggtgatgatgactgtcttggcgactgggttgcccagattggcctttgcccacttggacatacgaacactggcaaactgcaagggatcatatcaaaagttgcattggttcagaataattcagatgttgttcgcatccatgataaatgtgcattgctctgacaagaacgagcacattgtgttttttgtcacaagagtagttaattatgatcctgctaattaaattaattaattaatctgcttgcactcacggtggggatcgcggtgcagacagcagtgacggccgctgctttcagcccggcaatggccgcctctgaagtcaaaacaaaaaccatccatatacaacatcaaacaacatcacattgttagaatctaacatgcaacgatcaaacatacaatcttagcaataataatcagatatcgtgttaatagctagctaagctaggcagcaggagaagaaatcaccatgggagctctgcttggccatggcgaacttctgctcgatgagctgggaagaatccgtagccttgttcgacatctcgatcaaaacacaccagatcgacacacactatcacactaaccaactagctaattcaagctaatgaatgcgagatcgatcgatggatggatgatttgtgtgtaaagcagccatcaaatcctccaatttataggcttttcagacagcagcagaagcaggaggaggaggagtgcaccacctgacgacacatttcgtcaggcaaagaaagaacagcgaacccccggttttgccatggcggccgcgacgaagccgcgggctcctggagcccggacacgccggtttcgcaggatcacgccggcggcggaggcgcaaaccacgtcctcgggcgccgggtgcaacaagaactcggtgtgtttgcttgctgaacttttggctgcgtgcagtggcgtttcttgcccttttggttgtgtgcacacttctgttgatctctttgagtgtgagaatgggatggattaatatccattactaatgagacatatttggaactgaattctttggataaagattttggaaatgatggctttgtaattttggattaacagcttttttctggtagctatttatgccggccaagaaacctacattgtcctgtgggcttaattaaggggttcacatatttatgtatagtaaggagaacaatgtgctactggtaagtataaacaaaaatgaaatgtggagatttttttttaatttacctcacacaatttaatcgcgccaatactgcacttgttatttgtccactcgtttaaaaggaaaatagcaccagccaggaggatttacatgctcaaaatgtacttagattacttgcttgcagaagcacaaatatctatatgtgtcatcaccagcctaattaattggtagcaaaattgtgacgaatctggaaaaaataattactagtgtcccatatggtgctaccaatagtccaatacatgtgtgacgaactaacgctacaagtatcaactagaaacattgagattgcaaattttgcatgctattcctgggtaccccccccccccaaaaaaacaaaaaaaaaacagcatcccccgccataccctgccctccaaaaaaaatcaaaaggaaaaactcacctctaatagtagtatcaaaggcaaatgaaagaaagaagatgtagctagaggggaaacaaattgatcatgcaagtgatttgaacttcaattgagtaatcatgttaccggatatagatcgcctcaaccttagagtccaacaaatcagtatggcgatgccgcaatatttggtggcacccgctggagatggatttgattctatggcctaatggatggggcaaaatacaactagaaaaccaaggcaacgaaaaattgaagtcaggaacattgatggtggataagtggagaagacgaggtaccatggaggaaagacgaggtagcaagctggaggagaaagataagggtaaaggaggatcaccgacaaggacgaaggaggctaggaaagcatgctcggggctagtcttgtatagcgtgtacacgtgcagacgtatgtatgcacatgcggcacgaggggcgtgaggtgcacccgtgttggcggtctcaaataaagcggttgtgggaacaaaaataatcccaatagcaattattactaggtgtggaagaaaatcaatattacagccagatttaggtaaaaaaaaagatgccaacattcataaatagtttatctctaagaaaaaaatttaagaaacatgatgaaagcaacatggtttgctgtcctactgattttatttttcaaacacgtgtgtctttcttttttgtttgaaaaatatagaagcaaaaataaagaatacatcagtatttttatatacaatttacatctatgaatgtctatgttgtaactacaaaataaaattgaactactttttattcaactagtgttaatacatgttagtagaaaaaataatgtagcaccacatcatacatgcgtattattttggctttacaaccgttgttcaatttacttatagtttatttataagtaccaaacaaactatcatgtaagttaaagcgaccaacaaaactattaacttgaagaaaaattaggtaatttaatttttaaacaacaaggctatatggatatcagctgcctaattatttttttctcttatattttttttctttgggacataggaaggttgggagagaaggttcatttactgttttattacaaattacaatttacaaggtgagttccaccctcatgacccgttagaacactgaaccggttacgttggcgccttttccgtcgcggcttgctgagcccaagctaaccagccataagtgggcctacaaccgattttttttattttaaattttatttattaaaatatttacagaaataattttcgatttaaaaattttacaaatagtcgcccatcgtcatctgggagggtccaaagggcattttttccgacgtggcagacggctgtttgctctgtcataacggccgccaccgagggcgctgaaattttgtaggcgatttttaggacatagcaaaggcgatttttggctctagggggccacctgcaaaagggctgggagggctgcctggtagccccctttagtcctctaggagtgctattttctactgtatgcgaggggtagcatttttataggcagccccctgcacagtaaaaaatacaagggtattaggatgtccagattcattatccagtactatattgaattttttttagtaaatttcataaaactacatatactttgcataatctatcacaaaactatatattcaatgtattcatttatcacaaaactacaggtattttgaatagtatatcacaaaactacagatgtaagaacttgtttcacaaaactataggtttaatatcttcatttatcacaaaactacagatttagtgtctccattctcacaaaattagacaataaatatgtagttttgtgataaatgaagacactaaatgtgtagcattgtgattcgttatacactaaatctatatttttgttaaacaagttcttaaatctataattttgtgatagattgtacaaagtacatatagttttgtgataaacgaagacactaaatctgtagttttgtgaaacaagcttttaaatctatagttttatgataatttaatataaaatacctatagttttgtgaaatttactctcttttttttaaggagggactacctagtagttcatcgtaatattaatctttgaattcctctatatatatatactgcacgtacgtatacatacgcgagaagtagggcgcaacttcttgcgtgcgtgcatgcacagttggagttaaggacacatcagttgctttcatgcatgattggtggaatgagtattaaacaaaaacatatgcacagtattcaattgttcggctcttttgaagcaagcaacttagcaacagagtataaataaatctcctctgtcaaaaccgtcagcaaatgcagactaaaccgccacctttttttcatcacgttaatttcttcagtttgagactttgggaccggtccatctaacagagtaaacaattactgatatgttctcaccttatatatatatatatatatatatatatatatatatatatatatatatatatatatatatactctatatatactgtttatatcctacttccctatcctaaaatatagcagcaacttagaatcgaattttacaaatctgaagaatttctatcaaatttaaagtgtccaatccaatacttagtttgctatattttaggaggaagagtacttaaataaaaatggcacacagtgctcttaatgctaatcttataatccttaattatacatgacccattttatctcttaccatttgtccattgcagtaatttgattatttcgcacgaattttctgtttatacgagcaaacaatacactgaacaggaagagtacaataacaatactagttgtgttgtgatttctgaacattattactgcagcagtgttacatgaagttattagtacaagataggagtacatgcatgtattcatattcaggtgtggctagataatgcctaatggcaagaggccaggatgagcagctagctgttgtaaacggttcgatctctgcaggggcgtagtacttgtattgtattactactactactactactacatgatacagatactactctgatcatatgcagctagctagccaggtagctagaagtatatataatatagcatatgttgtgttcttgtaattattgatcagggcctgaagaaggcagggtgggggcggccggtgccctggaaggaggtgttcttgaggtgttcaggtgcgttctcgaaggagtgcctcctggccagcgagaggatcttcttgtcggcggcgacgaagtatgccatcccggccgccgtgcagatgatcagcgcctgtcccgtcgggttgatgttggccttcgcccatggcaccatcctcacgctcgccagctgaaataaacagcacacacaagcatatgcagctaagttagaaaacctactcttctgataaagaattaattgacacaagaaagaagaagcatttgagaaagaagagagactactgacggttggaacggcagaggcgatggtcgcgacagcagccgccttaacccctgcaaggttcgcctctgcagatcgacgaagcatacatcagtttgtatatattcagttattagcgccatggaatgcaagaagatttgacgcaaaaagaacatgaatgttattacagtagtactagctagttttcttttgtaaaacacacgtaattaacgtacgtacccctggagcagcgcttggcgagggcaagcctctggtccaggtgtgcacgagtcaccgtcgttgccatcctaattcaatccctaactatgatccaaatcaaatttcagttaaccgctctgcacgcgatgagcagcagtgaatgtgtgagcagatagatgatggagtgatggatgggttttggaggtagctaggcctgcgaatttataggcgagacgaagcggaatgaaatcggtggacgatcgaactaggtagatagcaccggagaagcggcgggacgtggtttttgggcgaaaccatgtgtgcacgtgtggccgttgcctgcctcgatgatctgctgaatggattccattccatatgcctcgctcgatgtattcctatccgtccacgcgtccagggatggtttttagggctccgcaaaaagaaaattttttgaatgttatatcggatgttaatttgacctgttgtcggaagagcctttcggacacgaatgaaaaaactaatttcagaactcgcctggaaaccgcgagatggatcttttgagcctaattaacccctcattagcacatatgggttactttagcacttatggctaatcatggattaattaaactcaaaagattcgtcttgcgattttctccataactgtgcaatttttttcatttatctatatttgatgtttcatgtatgtatccaaatattcaatgtgatgtttttgggaaaaaattttatgaactaaacagggccttactaatgcaactacaggtcggtgcatggggctaagttaaattaatctatctattgctgctactcaaaacacaacattgatagatggaatccatagcatctcgatcgataactactactaccagctagcgaaagagtagatatgaaatttcaaaatcgatgtaaatttttgagctatcttgggcttaaccatgcatatgcatccatgcacgcatgtaggttcctggcaaatgcagtagtaggggtggtgaggaaagtgctactacctcaatttctaataaatgacgatgttgtttgatcattcgtattattaaaaaaatatatataattaatatttgttttgtggtgagttattttataatcactaatagtattttaaacacaatttatatttcatgtatttgtataaaatttctttaataaaatgaatgttaaacgtgtgtctaagagtcaaagtcaacagcggacatctatttaaaaaaagaaagtagttaattaggagtaagcaccacattagtagttaatctactgctccgtttactggatggtcaattgctaatcatgtgggcggtcaggttcaacgtttcctgtggtaagatgctgctaccaaatagccacagagacacatgtcaacaaaatcaagcctagctactctcagtactcactgtgttgcggcatctttcaatttattatttttattttttttaaggagcctcactgttgcagcagcaatgcatgtgcaacagacacacaagtcatgcatcttcttcaactctaattaaacatttgcaaatgactattgtaaataaatactggagtactatcatttttctgcttgctagtgttaatcacttaattaataatttagcaattaacccatgtggagatgaagggcaattagcaattgctagtaggttttttttttcttttctgaaactgacggtgcatgggctagattggtgcctttgccgtcagttttgggcatttttcggccggcggaaaactgtgtggcgctcccagttttcggctggggtgtttagagcaagtttaatagtataccccactactatcttcaattcatatattgtcaatctaatagtcaattcatacaatagttgcttaccatactattaatatctggtcccacctgtcatacacatattacgtcttggaatccgtgctgcagctggctacagatctgtagcccgctgctcttctctctcatcctttatcttattaaaaatatatttacagctggctaatagctagctgctcttaggcgttggccgacgtcattcaggccagcttcgctctctgtggcccgggctaccaccctcttgtctgcatgcctgccgcagcccattgctctagggatcgcctatccccatttctgatgctatctatttccgtcccaatatataatattttagaatcatattagattcattttagatttgtagtttcaggataggtctaatctcattctaaattgctacatattaagattaaaattaagattaaaattaagattaagtaaagtcgtataaagcaagaaagttattagtacataattaattgagttttaattattataaacttaaaaaatagatttattcgatagtttagaacaacttttgtaaagaaaattttcgcataaaatatattatttttagtagtttgaaaaacgtgctaaaaatcagtatcttaattagaaaagaacgagcccaggatacaaccaactttgctttactgataatttactgaaaactcctctttttttgtgtgttcttaattaataacaaccaacggggttcacaaaaccgatcagttttcgtgaaactgctatatcttgatttgtgaaaaccgatctgcattagctagtttccataagtcgttgatagaaagtcatcggttttttatatctgttttcgataaatcggtgtggagcggttttcacctcgaaaacaaataagtaggagaaaactgtacagtagttgtcgatccagttcggttagtagggattagcaaagggtagcaagaaactagctacatgattagatcaatcaatcactggctgcccatggtatagatcaccatcctcctccctgtttttcactctatccatggctgctgctgctatacagtcgatgcattgactctttcctctatctgtcactcagcatcgatgtacatagacggatgaaacgctggctaaaattaagctatagatgtctcatgagaaaccaaaccagcagcagttagcagcttgatttgggaaaacagaacttccattcgtacatcaatgatcaatcaatttgttctcttttggccgtattgagctgcgatgataaggcaataagctgtaccgtcgaggtgatgtgacgcgtatcatattgttataccgtttttctgtacgtagatactactaccagcactacattttctgaaggttcacatcacctttgctctgcattagtgcacaattgcacataatgcataagtatgtgctgtatttacaaatctttatagctttggccttcaaagttcacaccaactagctaggggatgcatcatgcatgcatacagtcattagtaatttgtaatgcgctaacacatgttgtcagcgttcatacatagcattatgctgtttttatctttttcacttttttccctttgtcccggcaagaaaatgttctgaataaagggcagacaagacagcaaggaaatttcagaggaagttcagaacggagtgaaaaaaaaaacaaggtactagttctcactgatttcatcatcatcatcttcatcatcaaaactaattaattacattacaacttatagaaccattacacagcaagcacagccatattgtagtagtagcggtttatccaggcttccatcagtcactgtgaagttcagtgttcctcatggcctgaagaaggcagggtgagggtggccggtgccctggaaggaggtgttcttgaggtgttcaggtgcgttctcgaaggagtgcctcctcgccagcgagaggatcttcttgtcggcggcgacgaagtatgccatcccggccgccgtgcagatgatcagcgcctgtcccgtcgggttgatgttggccttcgcccacggcagcatcctcacgctcgccagctgatcgatgaaacaacacacagttcatcgcaagatcagtttggtgagatgcaatgtcaggcgaaactgcgaatgtttcgttgtcggtttaattagctcaccgtcgggacggcggatgccaccgtcgccaccgccgccgccttggctccggcgagcgtcgcctctgcaacaatttcaaccaccaatgtatgagaaccaagatacactatacattgatcaaactgacagttaattagcatacttagctcgcaacaaggagcaggaattctcacctctggagcagcgttttgcgagggcgagcttctggtcgaggtaggcacgagtcaccgtcgacatcagcttcttcttctacaacaacaacgacaagcagagagaggatctagctaccaacacttgcagtagcagtctagcagaaacaccagtctgaatctgtatctgttcttgagagtgggttcagttggcttgcatcg

SEQ ID NO: 39283 - DNA, 7781 bp, Oryza sativa
tttaattcataccaaaatttaaagtttggttgaaattggaacgatgtgatgaaaaagttaaaagtttatgtttaagaaagttttgatgtgatagaaaaagtaaaagtttgaagaaaaatttttgaatctaaactcgacctttacttcttttggaagttggtggccaacctgcgcccgcttcacactccactcattcagatggtagcactggagtacgcttttacgggaccaacgggtttgagagcctgaaactgtggtgccacccactgacccatatgccatgtcctgtttggctaatgggatatgaaaatgatctccaacccaccaaaagacatctttaaattctaatcattcattcttcctctctcatttaatcttaatctttcatttatttctcaatcataatcccatccctcatttcccattatccaaacacacccacacaggatttggggattcgatttaactgaatattttggttggttccttttctacccaaatcccatcttctttatcaggatgggagatctggttaggtagaataagtctatttaactgatcatccactataatgtactgaaagaaaaatgctactagttagtactaaatttttcgttgttacgtagcaacagtattatgagagggatgaataactaatactcggtcatatggttgccggcagtagtaactaattcttttctcgtaggaagaagacacggtagttgaggattggtgagtaattttttagtggccccacgttataccctactctttctatttcatattataaatcgtttgatttttcttttacttaaactttattatgtttattatgtttgattaagtttataggaaaggaaaaagtatgaattacccgataccatcgatgcccgcatgactacttgcaaaaaaaaccttacctgctacttcctccgtttcaaaatataagtcattctagcattttccatattcatattgatgttaatgaatctagacatatatatctatttagatttattaacatcactatgaatgtgagaaatactaaaatgacttatattatgaaacggagaaagtaatagctagtttcttctggtgtggagtttaactgtttatagagtgtcctcgacgtattctgatagctccacctgtcggcttgaaatttcttgaggaaactagcttaggtgtcacctgttgctgcttcctgctaacatgaagtctctagaccaaaagaaaaaacaaggaaaaagagtggagtactatactagtcaatttgctctatcaattctactagttacgtgatcacgtaggctctccacataaactagcacggtgatccgtataattacgcggctagtactgaactaaagttatattacgatatagaattatctacatttattcaatttgaaatcttttttaagaaacagaataatcgacccgctagattttacaacttttacagggtggcccgcgcaattgcacggctagcattgaaataaaattatattacgatgtagaattatctatatttgtttaacttgaaatcttttttaagaaacagaataattgatctgctagattttatagctttcttcactttgttacaaactcttttgtgcgcgcgagtgtgttttggctgtgtgcatcctagttatgcagaggacgggagcattattttatagctttcttcactttgttacaaactcttttgcgtacgtgtgtgtgttttagctgtgtacatcgtagttatgtagcagccaggagtattcttagtatggttgtatcaatttgatgtaattgtctgagattaataaaagctttctttatttaaagaattgcacatatataggcatatctatatgagagagatattatattgctttaaccatatactctctaagggaactaattaataaagtgacaataacaattttcctgcttcaagttcaaaatatgattgagcatctccgatgtactccctatcacgcgccattaaattatatttttataaaaaaaatgttccttcatttttatagtttttagaccataccaattttccctctttgacttcaaaatattatcatgtatctccgataaactccctatactacaccattaaatctatgatttataaacaaatgtttctctgctaccatccctctgctcgtctacattatgtcccttcttttcatttctattgcttgttgctcttcatattgtcttttagcacccgctgccacttcgctactccgttgttgtccctccaatcgactctttgccactacttttcttaatcaggcacaatacaaaattgaacctcaccattttttatagtttttaattagaagctgtcaccaccaacttactcctccgcagcttctcaaattgctccccttggcaagtgatgcctccatactcctttacgcccctccgcacctctctacattaagcaccttacaaatcacgctgaggttctgtttttatagtttgtagaagtcaccgccgacgccaccctcttcatttaccaccctctcagcttgctctccatggcaaccgccatctcgttgcttattttgccgcacactcacttgtatgcctattctgtcatctttcatctttgttatcatcgatactttgtaaaatcgaacatcattatcattagggtttatttttagaagccgtcacttccactttactaatttattgcctcttggctcgctcttcattggcaaccaccatctccctgctcttttgtcgcctatccactcattagcccacgtagtctcgcttccgttttgtcatcaatgcctagcgaaatcgaaatttattcgccgcgattatgttataagtttttattatatttgtgattgtaattttaatgatttcatctttatctggaattcatatgtaaatccagttttgaacttattttatttttatttcaaaagttagttaatcctgtgttgtgtactatatggactgttctttgatatttcttattttaatcgcaaattttagtaatttcaaaattattttcctactttattcagaattttcatgatcttttaaagtttatttggaattagtgttgaaaagcaatttcagaaatattttttttctgagtttcaattactcttacttttgtatatttatagaatgtgctttgctaggttgttcaacttttattattattttgaattttaatgacctttttatggaattcgtattaaaaattcaattttaaaatttattttatcttttacccaaattttaaacaaaatccggcggcttggctctgttattttgtgattgccagcccttgtgtgcagtagtacgttgattgcaagtggcttgatttattgtttgattgcccgtgctattggtttgcttggtatttatttggatgtactgaatcgtgaccagcataggaatcggtgaaagcctaagtggatagggctataggagcatgcaaaagcttctacactagaaaagctatagaaatctaaaggcatctctctacccccatccccatgggctattccttgcctaaccgacacataaaggcatgaacgaatggtggcgacaggtgatggtggcggcaacggtacctctcgccaccacctcgtccccatcccccgccactgccaccttcctaccaacaccttcaaccaccgccaccgccattactgtccctgttggctgcttggctctgtcgatctagagaagggaaggggtgaggtgaggagagggagcggcagcatggtggagatgaagagtacgacgccggccagcgtcctcatagatggtggtgcggccaatggcaatgacggctagggaaggacgaagaggtggtggcagcacatgaagagcagcagcaaaggcgaaggcggaagaggatagagcagtggaagatacgaggctcggggatctctccgacgaaggaatccactccaccggcagccgcgccgatgaaatcgccatccgaccaaatcgcctcctctctcgtgcatcagtggaaatcacatgtatgaccgaggagcgcgcgcaacctgagcctagcgccgggatagccggaacgatgaccacagacagatggagctcgtcgccggcgagctcctccttcacgcgcagcgcgctggtgaacgccacaatcaagagggtggtcgtcgtggtgccgtacaacatctctgtgctccagatcagcaactttgtcgtgccatcgggcgtccttacgaggccacaaccgctgctcccgaccgccgtcgctgccgctccccaaccgccaccgccgccaccgttcccctccgcctcgtccccaccgccaccgccaccgttcctgagagagagagataagggagagagggggaggaagaagggagagggaggatgacatgtgggtcccacaatactttttttatgaatgacatatgggtcccacatatttgttttatttttgtttttatcctaatgccatgtatctacatcagagattagcctagacaaacccaatccggtacctacggaggccggcaagagagatctagtgctatctctgatctcatcgagttcatattcgaggagaaaggctacctcgtcgtcgagtacgagttagtgttcatgccgccaagtcgacgatggctagataggttatcccaatcgtctcaattgttgtattctgtgattttctatatcaattccatataaacaggatgtagggttattgcctgtcagataaggggcctgaacctatataaaagtccttgtcttcatatcttttacctcaatcttgcatatacccttgtcggtaatatgggcccgggggtacccacactaagagagaagggtcctttcctctagccacgtggccgcgtagcttgtcccccccatcgggggggggggggggggggtcgggcgcacgggtaatgagcagccaagaggcgcccatagctgcataggggcctcggggtatcctgtcgcgcccctcgggcctgaggggctgcgtcgccccgaggccctcactcggctgccacgttgctgctgagtgggcagagaaagaggcgctgccaggcgcattgatgggcgacgccccaaccaccaccgccgcatttaatgtggcatggctagtcgtgcgacgttcgattgattgatgtgcgtcaatcgcccttgaccaggctgagactagtcgcaggcggatgagacgggtggcagcgcacccatgctagggctatcaacgagccgagctcgagcgagctcgtctgcctaggctcgagctcgatataagctcgagccgagcctataaaatgttcgagctttttgacaggctcggctcaagctcgatccagctcgagcttgatttttaagtaacacaatatatatttcaaagataatcttataattaatttctagttcatcgtattaatagaagaggaaaaaagaacaaaataaatatatgatgtcaatataagacatacaaataacatatttgatctcctaatttattaaataacaacaaaaatcatatattactagactcgttagaagctcgagctcggctcgacaaagctcgcgagcttagggataggctcgggctcggctcgtctggagctcgagccgaactcgaatcgagcctaggacgagccgagctcgagtagttcgcgagcctcaagcttttttgacaaccctaacccatgccccaccctgtgtcaggtggcgtgggggcaggtatgccccgtctcatcgacgcccggagaccgatgtccgaccggtgcatcccctatgcatgaacccacaaagtctctaagaatttatgagggaatgacaggggatgtccccccgtgtcagacaaaagactgcgctggggatcacctgaggacgggtggccaccttacttccgatctaaggcatgggtggcggctcgaccagagttgatgtgggcccccctccaatgacaagatgtgtagaggcggtgcatgtggtaaccccttaaactataaaaggaggaccttgcctaccgagtaagggggattcggaagatcttgaactctgggggaacgcttgcagattgcactcccggattcaagatcccttgtaacaacctaaacataaacccacacacaggagtagggtattacgcttccaagcggcccgaacctagataatctctggtctcactccccgttcaccatccacctcgctagccgagtccacggcgatgacacactcttgatcatcgcgccctatcccctagccgaactcacaaagggggggggggggtctcacgtcctcccgctagagaggtttacacttcgataaccctggtaccgacgatacccatacaatctaaatatcctagttgtgactatcaaacgtcgacacttcttctctccacagaatcaccatgtttgcatcgaccatcgttgaaggatcgacgcctcagagtagaattccaagtggttctttatagcattgtcggttctcccatccaaaagctttgcaatacatgcccgcttgttcccatggatagcatgagcggcgattataatccggtcctcctcttctgcaccaaagatcacatgtttaacacgcaatgtaaaatattcttgctagactgacacgttggtcccacttgccaatcttctctccctcatgcataatctctccgtccctaaatatttgacaccgttaattttttgacacacgtttaaccgttcgtctattcaaaagcttttttgaaatatgtaaaactctacgaatgcataaaagtatatttaacaatgaatcaaatgatagaaaaataattaacataaattttttttaataggtcaaacatgtgtaaaaaaaaatcaatagtacggagggacgcggccgcaaataagcacgtgtatgggctatttctttggtaagccgtacctgtctcgtgggcttcaaaatcgatggggggcgatttggcccgcgtagccgatttccacgcgggcttcctgcacagatcctgtccgtccatccagtactgatccggtggccgtgatttgctcatagcatggtaggattcctgccctgcatcaccctcccccatcccttcccggagtccctctcgtggcatgccttgtaaagattcttgcggtactggtgtttttttttttttttaatctcttcccatcgccatcgttgttccagtccgtccgaggcagcggagcggctaccctccggtgcgggctccggcgagcacgctcctcctccctcggtaacaggttagctcttttctccaccgccaccgtgccggcgccgaaaggcgtcaacgtgccggcgcggccccaccccgccggcctcctccccctcccctttgcctcgctttgcccccgccaccatcaccggcccaccgcccgccctcccagcgccaccttcccccaccccacccggcaaccctaaccctaaccctagttgtcgtgacgcggtcggaaaacgcgcgtgacttcttttgctagcgcgtgcccgctaattagtattcctggttttttcttggtccgattacatgcgtcatcttattggaactttacttcagcgggtcgacttctttcaacgagatcgcttgattgggtggtacaatattgctgttatatatatatatataattcaaaagatcaatatcttcaagcatacagtgtttctttagaaacccccttaatgaatctagtaccagagtaacagcagcacatggaattctgaaaaaaaatatcaccaacttatcttacatggaatattgtgcagtttcagattagttc

SEQ ID NO: 39284 - DNA, 2388 bp, Oryza sativa
cccgaaaaaaatacggagggtttaagtgagctcttttctttctgttgtgtttgtgggaacagcctttgctccaagatgataccataaatgtatgtttggggaacatacttggcactcgaaatacagttggacacaacctaaggaataggcttgtacatcaggtgtgacgttgcactgtccttgtcacgtcagcactccatgctatagctgatagttgaactaacagtggcagaacttcatgtcacgcatggtttttgcaaactccgtaagacatgtacaataacaactagctaatatttacgaacaatcaatatatctacttgttggccatgcacaatttagatgcaagctctgcgactgccaagaaattatgctttttggctaccttcttggtgtttcaggcaaccaaggaaggatcagcaaccctgacataatttacatacttcgcattcctgattagttgctcggttatagttttatattgtcgcttcactgcttatgaccccacattttgcccctttgtttttatttctaaaagaaagttctgcttcagtcttgaaaaatatgtggaaagctaagaggggcggtggtgatctccctagaagctttcataagaatagtagagccttcaagaatgagtggatctcaggtctgctagatcttttcctcttttctgctacacccctggcgttttcacagtttatgtgattattcacagctgctttatgttttattttcttcaactaggtgacctccttcggaactctaagcaagatgtttggactggtctcagtgatgggcttaaatcatatttgtctaaaagtgtcgcttctattattttgttcaatggtgattatatacgcttagtcttctcagttttctaacaagtatatattgaaatgccaccagttataaatgattcaacttgcgatcttctgtaggagacaaaatcttattttcatgctcaggcatagctatagaacaccagttttttacaaagtttttgactactgcaactctggttagagctcttaatgctacgaccaaacaccatgatgacttaaaggttggtgctgacagtcatcctttactaatctgtttacttctgatcattgtgtgctcatttctcgctttttcattttttagattcaagtgcgccttgacggcaccagactgtatgatgggtatatggctgaatatgatttggataatgacttttctgttgtcgaagtctatagtgtccgtgatgttcaggttggacctttccaaagtgcacttgaaagtctgccccatggtgaggtattagctgtagggcatgacacctccggcgaaataatggtcgagactgtggagttgaatggcgattcaaaggtatccgaggatgatagagatcttcattgtaaaatctcaaaggtacacttgcatgatgatatgagcatttcatttttatttctgttaggcatggaggcaacagaaatatttgatttcttgtttgtatttaactcttgttctgtacaactttattttgttcaaatgtaacccgtgttgcttgttttatttcttagccttgggaaggtgggccgcttctttctgttgatggggatatggttggcatgaaccttttttttaccaatagaagagccatttttctaccatggggcacaactctcaatcattacttgacattcgtgcaaaagaagactggccttgtacaataaaaaaaaatgaaggttcacaggtatgtctatttaatcctcgcttctctgtcttgttccttgcctatgattctacccacatagtgtttggcaccatttttcgtataagtgcactggtttgatccattttactttttgattagtagtcaactagtcattttttatgatctgcaggcctgaagcatccataggtgagaaatctaacagccatccagaaggtgagcacacaggcactcctcacaagtgcttaacatcatattgttatgcaaattattgagttcgtaatggtacctatttagaagctgtgcaagcgtttacatttgtacatcaattattccggccctttcagtagtactcttgtattgttggatcttattagttaacatatgtacaataggtatgttcatgcacgctgacttctaatgctaattgttgctcaggctgttataatgatataactcatgttacatgctatgtatgcgcagagtttatgtgaatttactttttgtgtatagtattagtatatgtcagtgctgatcacttcaccttgttgcaccagtacatggagattttctcaaccaggaacagttagatcttgactccatgggttatactaagttaccatcctccatgttaggaggtgagtcagtgcttctaaaatttgctgatcttt

SEQ ID NO: 39285 - DNA, 9097 bp, Oryza sativa
aactctcttttttctattaggtgtaatttgactgtctaaaagagagctttgactgtaaattcctgtcattaatttgcttacagttaaaatatggtcatggtaaagtactttggaatatgaatcgaacggtatcttttgatgaaacctagataatattacaattgtgaaagcttgacattggacagactctgctttgtgtttctgacaaagtatatagttgcattggaatgaattagctagcaatgttttcaatagaaaacagtaaatcacaacttatttatgttaacttgctaggctgggattggaagccctcttgttaatcttgatggcaatgttattggcatgaacttctatgacacaagaattggaactcctttcttattatgggaagagatctgcaagattctagcatcgtttgagacaaaaaggtattagcattgttcatgtcagtattctagcattgttcttttttggagcattttaagaagcttgctgaagcataatctgacagtgaatctagtggtgatattggcaatgcctctggtgcgtgtttctggaaaatgccaagagatgtcaaaaataaggttaacaggttggtattccgatccatgttgctatttattaggttgaagttaagttttggatatataagttatttcgttgaaatgaacaggtggtctgtgcccaagccacgctggtgccgtcctgaagatgctgaatctgatgatgatgataagttagcttttgatgatactggccagcttcaatacagttatattttgggacggaaagtcaagctccttcgtctcacaatccccatatcggttccgattgttgaagctaaatccactgatggttagtaatttgtcttcatgaaccttttgccaacaatcctgttgactgttgtgctgactggtctctctccctgatacagtattgcagctctcatattcatctgcttttgttagtcgactccgtccagcaaattttccagcatttttcatatgcagtgctttacccccatttatttttttatatgcagtcatttcatagtttaggacctaaatctgacaaacattttcttactattaatgattctttttctagatgtgcatgtatcctaaacctggttggtcaacctgatatacccttttaatcgacaatttcatttgttacagagcctggagttgatcctttcgcacaaaggaagcaaaagaagaagcgggtagaaaagcaaggaaaaaacagactagagaacttaaagaaagctgcaaaagttggtgctttgccaaggttgtaatcctttactcacctactgcttacccctccctcctatgaattccttttcgtaccagtaaggaacattgagaattatgcagtatagtcatctaacagctctccaatatattttgtgtgcagtcatatacaacttgctgcaacgtccttgcccatcacaggaactaaagctgatcttccgaaaaaatctagaaaagaggatcttgagaatgttgctggcatgggatctgcaacagcaagtggtgggaagtttgatgagaagttgcctggcgagaaacctccaaagcatcctggcaaacataaaaaggtttttatatcttaatggctttgatttatgagtctgcctttgtaggctgaatttgtgaactatagctgaatcatgttgtttctgcagtttatcccagttgctgaaggggagggaatgggcaacctggggaaacagcagaatgacaaaattctgatgtctctacttgccagaaactctgaacagcttgatgtttgcaaggcaagttccaggattcaatggagtatattaaattgtgttttgcccaccatcattggcactgcttgttctgtttgaatgaactaaccgcatctgtaaacatttttgtaagcaggcaaacacaatgtacaaggtgaagaaggaaaagcgaagaaggaaagacagagagatgtcctcgagatctgataagctcaagccccagaagaaacctttcaagaaatcatctaagaaaaaagcttaggtcaacatctttcttgtgacttgtttttggaggtgaccatagttttgaatgctcaaggagacctgttgcatcttcctatgtttgaatctatgggagaattactgttgttcctttataactggttaagagttatgacataggcctgaatgatgatataacaagatcacaaatctctgttatgccctgctatgtgcgtattatattttcaaattttgtttgatgtggtttgcaagtcatctgtattgattcctgaaacccattccaaaggatgtcctgacaaactggtttgtgtgattggttatccagtgacaatctgatgcttggttctcaagtgccaatctgaatcattggataacctgatatccatgcatgtgtcatcgtttgcagttgtattgatatggtttgcttacccagcagcattagtgttgttgaaattcgaatgccttggcaaatggcaaccatatatatcagcctctacgtgaactgtctgaagtggatcaatctatgatctctaattttggtagcctggcttggatctaaccgaccaggctaggccaatcttagcttatatggtgtgatgatgttgtcattgctccggtgcgctctttgtgtgtgatctctttggtcgccggcggtccagaaaaccgcatgccgtcgacgaccactgccggtgtagatgtggatgcctcggacgcgtcgcttgcaatgtcttctctttccttcctaaaaggaaaatctctcgtttaatttgcctctccaatccccctaatttcagtgcgattctctcaccacagtggccatcgccggagagagatcccctgagacagataggagtcatccaccaccatctccatggggatgctgaatctgatgcgcctcatgtccgtcaagcgccgccgccgccaagtccaagttccccatggtaaaagaacaccatctccttccttattttttcgattatttgaatctgtatatatctatagtatgtacacaaacaaacagaaccaaaaaacaaaagattttactgttgttaagtggtaccaatttttttttaactaccttcatcccaaaaatataaaaaattagtaatggatgagacacatttttttttccagattaatacgtttttatattttgggacagatagaatagtacaaattttcatacctcagagtatcagatataccatcttattaaaaacttgagcatcataaaaagacatgtttttattgagtgcaaggtaggagatcaaaagaggtggtttatctatgatcacaatggctggtggcctccaccttcttgttccttttgctatttaactagattgacccgacgtacatgggtagagaccatactatttattatgctatgtaaaatatgaaaaaaaaaactatatacatgctgaacttcaggttttccccttaagttgataacaagttggtttcttttacaaaactgttagtattgttgcacaaaaggggacaacagaagaaaacaaagataacggattgccatgtgtgcgatggtgtgcttgcttgagttttctgttttattactcaaatgtatgtaaaccaatgttttcaaaatcgctaatgtggcataatcagatgcttatatggtataatcggccacttatatgacttgagtagtataaggttggcgcatccgttccttgtacacggccttgtaaagcttttttaaaacactgatgtaaaccatgcatcttgtgctgcagatggattgattgccttacgggctaaaagaaagtgttcaccctgccaacaagatggcgattctcagggcgctgctgacatagagataccagaccttccagaggtacaccataaataaaatgttgatgatgaaacatcttactagtagtagtgtagtgcaagtaaattatgacgattactgcttcaattgcacaaattggtccaccaacgctattaaagtttatgaacggagcactttgatgctgtaacctcctacagccctgctgcattggaatcttctttgttttgctgccattgaatagcaacatgctattagacaattaaacatcattccatccattctttctggcacaaatgcaaagaaacaaatatgtgctgagcacttaacacctcatttgggtaaagaccatatttgcctagaagaattcaactatacaattcatagtacaatagtacataatcaggcaggtagcattggaccggttaaggtgttactccataagttatcctttctttcttccatctaattcaaccatttgtcttcacaattagtacaatgtttaacttctctcccatatgcttgtgcaagcaggacatctggcgtcttatacattccttgatgccaatgcgagctgctgcccgagctgcctgtgtgtctcgttcctttctaagttcctggagatgccatcccaacctcaatttcagtagtgaagcatttgggttgaatagaaatgcatgtggaaaggaagaattggctggacttttctacagcaaagtcgaccacattctcaaaaggcactcaggcatcggcgtgaaaaaacttacgattaaggtatattcagattatagtgggaagggctcttcatatctcaacaattggcttcagattggtgttaaaccagggattgaagaactcataatttcactgacccagttccaggcaaagtacaatttcccatgctctcttctgtcgaatgggagtggagactcaatccaatatcttcacctttctaactgttccttccacccaacagtcacacttggtggcttaagaagtctgacgagattgtatctctgttgtgtgcgtattacggagaacgagttaagctgctttctttcccattctcttgcattggagcagttggaaatcaggtactgcgataggattgtttgcctgaaggtaccttgcctactgcagcggctcatctccctgaaggtgtttgggtgcgacaatctgaaactgatagaaaatgaagctcctaatgtctccatttttgcatttcaaggggacaaaacgcaactgaaacttggagaaactttgcaaatgaagagcctatgcatggttcgctctggttatgtttatcatgctcgtgctgaacttccatccatcatgccaaatcttgaatctcttgccatgaagtcattcaaagaggtatgagaaattttgcctgacacatgaatgagactagattctgtcttatgggttgtagcataattaatttgacctctttatgcagacggcctttgcaccgaagctgtgtagcaaattcctctgcctcaggcacttgagcattgcccttattggatatttcccagcctatgactatttgtccctggcttcttatattcatgctgcaccttctctggagactttctacctgactgtgagttgccattcatatattattactgctatgaatgaaaattagtagttgtgtggtggaaatgtcacttaaaatttctccctttcacatcctaggtaatgcagcggtacgtgcagaatgtttcaatttttgcacatcctgcagatctgagatcaatacgagaagagcagcatcacagccttaagagtgtgagggtcacatcattcatctctgtaaagagcttggttgagctgacatgccatatccttgagagtacaacttcccttgagtgcttgacattggatgcttctcagactggttttaggtgtgatactcctggcagcaaaattggcaaatgccccccactagatagggacattatcatggaaggtcacagaggggtcttggctatcagaagatacatccagcctagggtaccttccacagtgaagctgaatgttttggagccctgcagctgccattgtactgaactttagatgtcatgtaaaattacccttatcttaattattcgatgtttaatcgtgctgctgttgatgatgattcagctgaatgtttagatgggtcatggtttctatagtttgctattaatgagtaattgatatcatcaccaaatgcacacgatatccaccagtaactccagtttccacctagcagcagtggtgtatgcacattaaaaagttcttactagcaaatgttctcgaacgtctgatttacctagttcagggtggttataaaaagctaaacaactagagtttgtaacaaattttagtgtgtagactttaatttgaaaatttcacctatatatgcatggttttcttaatcttttaattcatctatgtacgtatacataacatcagggctaaacctttcggtttagctaccaaaatttacgaaaaagtttaaaatttttggccgaaataatatcgtatcggagggggtccgaaataaccgaaatttcgttccggaatttccaaccctgcataacatacgtacgcgaatggtagggcaactttttgcatgcatgaatgccacagttggaattaagaatgcccgtaatcgttttcatgcatgattgatggaataagaatcaaacaaaaacatacagtattcaattgttcatctgttgaagaaaaagcaacagacaatatacatataaaactatagcctgtcaaaaccgtcagcaagtgcagactaaaccgccaccttttttttaatcttgattgttcagtttgagacttttttagagacctgtccatataggaggatcgatatatttgaaccaagttaaaaaaaaatgacccatcatctgcagaaaggtggtacacagaacacagtgctcatgttgctgaagctacaagcctcatatatataaacccattttatctccagttatttaaccactgcagtaatcaacttgattagtatttcgcacaaacctctctgtttaccgacaatcaatacatagtggtcggaatatatagtagtaccacttgtgatttctgaacattatgaggagtgcatgcactctgcagtagtgttacatgcagtgagccccagtgcaagatagcagtacatgtatttaattaggtggctaatggcagatacgacagagatgagtactaacaccactgctctacagaagcagctctaaatggttctgcaggggcgtacatcgattattatatgacacagggatcgatcgagagctagatactgtgatcaagtttcagattcatgccttgcttatcttggtctaatggttcagggcctgaagaaggcagggtgagggcggccggtgccctgaaggaggtgttcttgaggtgttcaggtgcgttctcgaaggagtgcctcctcgccagcgagaggatcttcttgtcggcggcgacgaagtatgccatcccggccgccgtgcagatgatcagcgcctgccccgtcgggttgatgttggccttcgcccatggcagcatcctcacgctcgccagctgaaataaaccacacacatatgcagataataagttagtacatgtacctgatgagctctgctgatgaatgaagactgaagaaatcacacaaaagctagcagcaagaactgaagaagacgcatttgtgtgtgtgtgtgagagagagatatatatatataaagagagtttactcacggtgggaactgcagaagcgatggtcgcaacggcagccgccttaacccctgcaatgtttgcctctgcagattcacaaagcacgcacgtatatatgcatcagtcgatatatattcagttaataagtgccatggaattcaattaacgcaaagacgaagaacattgtagttcatgactactacacgtaccacgcgagcagcgcttggcgagggcgagcctctgctccaggtgtgcacgggtcaccgttgccatgtaaattagtttcagtcacttagtttttgctgaactgcactagagcagtttgagagagctaggcaagccaatcgactagcgagagagagagagagagatcagaggagtgtgtgagagagtagatcgagtgtagcggcaagcaagggagatggatggattggattggggagaggcatgggggcctgcgaatttataggcaggcaagccaagacccaagagatcgatgtagcggaatgaagaaggaatcagtggacgatggaggcagatagcggcgggcgggggacgtggttttggggcgaaaccatgtgtgcgcgtgtggccgttgccggcaaccgcctccggcctcgatctgcttcacgatgataccatatattccgccacgcacgtacactacctcgcctcgcctcgctcgatctgttcctatccgtccacgcgtccagccatggtttgctgatgcaactacaggtcggtgcctggggctctgccaaagctggattagttttttctttttcttttttgaagcccccaaagctggattacttaagagtatggaccctctgaattgtaggtttgcaaaaaaaaaaagaagataaatacgagaaaaacatgtttctgacatgaatacgagcgtaaaataatgattgcaaaacacatgaatggctgattgattatactgcatgaaaaaagcagaaattagagataggctttaaagaaaatttttcgataggttggagctcttactaagttcattccaaaatctacatgcaatgagtcattatatagaaatttcataggattcggaaacttcatccctttgaatcaaatgatcatagaaaaaattcctataggatttgaatcctatacgagctccttcgacttgtaggaaaataattaaattttgaaggatttcagttctatgagaaaatattttctaaagatttttaaaataaaatattgaataatatcctatcttttaaaattcctatggaatgataaatccagtagagattttgaagataatttagcaagagctctaaccgcctcttggaaaattttcctttgagtttatctttcttatttaattcctacgtttttcctacgatccaatcaaacgatcattcctgtgttttttttacgttttatagttctctgttttgcacttatattcttatcaaaattctacatgttttttttttcatttttctccgtttttccattcatgctattcaaagcggtcctaaaattcataaatgaat

SEQ ID NO: 39286 - DNA, 27536 bp, Oryza sativa
tatatatatatatatatatatatatatatatatatatatatatatatatatatatatatatatatatatatatatatatatatatatatgacactcatatggggcaccatggtgcccgggcaccatggtatctaatgcacaaaattactcaaatttttcaaaattttcaaattgtgagtatatacctagttataataatttgattcatacctatacttatcaacaaaacaactcaaatttaactttatttcacaatccatgattacatacctaactaattatatgtatggatgctatatacctagaatcaaaatctaacaaaaataagttcaaattcagttcaaacttgctttaaactagttagtaaagtttgtgatatatatatatatatcacaccattaatatctggtctcacctctcatacatagcgtctaaaagttcgtgctagagctacttgaaaaatctgcacttcactttttttactttatagttggtttatagtctattattgcaattgctcttgggccatccccaacccagaaactatgcagtagtttccatacttaccatgtcatatagacatcatgtgtaaaaaccatatatccaatatggttggtgtctttaaattaaattctcatgcaataatctcttctctctctccttttatctatctatcccattgtttttattcatggtacttgtgtagatatggtttcttgcatgagaaatagcttcttcatctttttatccatctcctcattaactctcttgccacatcatatttgccacattatatttttgtttatgtgacaatatatttaatgctatgtacactagatacatggagtgatggagggttggggatggccttattttaatccactgctactaatattcactattgattcatggaatccataacatctcactagatgtagacatgaaccaagatcgatgtaattttgagctctctttggggactaattaatcctataactactgcgtgcacatagattcccgactaatgcagttagtgggggcgtgtggtgagcagttaattaattaggagtgagcattttgttaatactacctctcctatctacgaactgccctgtttactggttagtcaaactggctgaacctaatcatgtgggcggtcaggttcaacgttcctgtggtagatgctgctaccaaatggccacagagacgcatgtcaacaagtcaagcctcactctgttgccgcttcttccagaatgcatgtgcaacggacacacaagtcatcttcttcaactcttaaacacttgcaaatgacatatagtaagtactgtaaatactagtgctgttaatgactagcatcaattaataatttagcagttaacccatgtggagatcgagggcaattagcaactagccttttttttttacttttttcctctgatgaaactgaaatgcaccgtgatctgtgatgatcgatccatggttggtggccggccatggcgaatctgccgtcagttttgggcattttttgtggggcggcggaaaactgtgtggcgctcccagttttcggctggtttttagcctcgccgacgtcactcatgctcatgcctgtcttgcactctcactctgtgggctaccacccggccttgtctgctcactagcaatgcattgctgccccactcaaagtacggatcgcttatccatttctgatgcgatctgctccatttcagtctctcccatctcaccttatcatctcctgctagatccaaccaactttgctttactgctattctactgaaaaatactccatccgctctatttataagtgcaattgttataacgcagttgtggttgtttgtgtctaatgttttaccgtttatcttatttttaaaaaatataaaaaataatcgcataaagtactatttattttttatgtaataacaataaaaatactaatcataaaacatttaaataagatggacaatcaaattttgagcacagaaacctacaactttaattaaatgtttagaatcgttatattagaatgtgtcatttaatttaatttggttttttttaacggaaagtgagtagtatgaagggttcggtactgtgcgttagttgtccatccagttgggtttgtggtgatcatcagcaggcaactggttgattagatcaatcaatcactgcccacggtatagatcagatcaccatcctcctccatgtttttcactgtatccgtggccgctgccgttaaactttttcgaacggtcgctgccgttaaacttgaacagttgatatgcatttactctctcctctctctctctctctctgcatatatttatagacggcaaaatgaaaggggactaaggccgtctttagttcttccaaaaaaattttatgtatacagacgcatatttaaaatattaaacatagattaataacaaaacaaattacagattccgcctgtaaatcgtaagacgaatttattaagtctaattaatccatcattagcaaatgtttactgtagctccacattatcatatcaaggcgtaattaggctcaagagatccgtctcgcaatttacatgcaaactgtgtaattgatttttttcgtccacatttaatgctccatgcatatgtgtcagggttatagataccacatatttaatagtagttgactaaatctcggcaggacccaccacatactatgtcttatatggaaatatccttcagatataagaggagttccgcgtaaggaaggaagaatagagttttatatggaaacgacaaaaactactcgaattgtatccatattggtttccctagttctacatgaaaaatggaacacctatggatataaatacaagacaccttaggaggagaggggagagggaacaacagatcaagatacatatcaacatacaagccaatatacgccaagacgtgccgccggatatcgacatcagagatatgcctggactgaccctatccggtacctacagaggccggttgtagagatctagcgatgcctctgatctcgccgagcacggattcgaggagaaaaactaccctgttgtcgatacttcaatccactatgtcgacaacagttagataagttaccccaaatattgtactggtgtgatcatagtgaataagagcaacgaccggcttcagccaacaggagtagggttattatctgataattcaggggcccgaaactgtataaaaatcctcctctccgtctcttttacctaagtctcgcatatatcctagtaccaacgatccccatactatgcaaataccggaatcgcgacatcaaacgttgacaatatgtccaaatattttatgtgacgaaatttttaaaagtttgaatggaactaaacacaaacacagcctaacttttaggaaatgcacttggtagcgttaattgtaagggatatgccaatttaatttcaactctaagatactattttcaattcctaaacaatttttttaagaaaagcatctggagaaacatttctttctacaaatctcttttttttcgaagttaagctataaaagaattcattctctataaaaccagcagcagtttagctggttgatttgggaaaacagaacttcgttcgtacatcaatcttggttactttggccatatattgagctggcgatatgctataccggcgaggtgacgtggcgtcgtcatgtatccgtaccagtctaccagatcactgtaccgttgctctgttactgtatatactagcagtactacattttctgaaggttcacatcacctttgctttgcattagtgcactctgaaaaacttgacactgcttatccaatatccactacattattcaatactagtataaaagtactcccttgtgaaaaagaaaagattcatgtatgaaagttgtctcttttttttttgactatcggagagtatgtgctatctgaaaatctttttaattatagcttttggcttcaaatttcacaccaactaactagctaggggataagtgttcatcaactgttttgaagaaggtgaagacatcaacgagttttcagatgaagttcagaacagggtaaaaaaacaaagtactagttctcattgatttcattttcatcatcaacaacaacaaaactaattacatcacaacttatagaaccattacgcatgaactcagcagcagtagcagtttatccaggcttccatcagtcactgtgaaagttcagtgttcctcatggcctgaagaaggctgggtgagggcggccggtgccctggaaggaggtgttcttgaggtgctccggtgcgccctcgaacgagtgcttcctcgccagcgagaggatcttcttgtcggcggcgacgaagtatgccatcccagccgccgtgcagatgatcagcgcctgacccgtcgggttgatgttggccttcgcccatggcagcatcctcacgctcgccaactgaatttttttacagcagcagatttcatcgcaagatcagtacacaaggaaaaaactctgaaaatctgaatgtttcgttgtcagtttagctcaccgttgggacggcggatgccaccgtcgccaccgccgcagccttggctccggcgagcgtcgcctctgcaacaattcaaccaccaatgtaagaaccaagctacagtgactgaccgtcaggtaaatcacttataagcagcataaatgttcacctctggagcagcgcttggcgagtgcgagcttctgatccaagtaggcacgagtcaccgtcgacatcttcttcttcttcttcttctacaacaacaaccaaccaagaacaacgagaagcagagaggaatcagctacaattgtttgaatctgttcttgagttcgttcagttggcttgcattgccaagagagcaagaagccgtatgattttataggcgtacgaggagatcgaggagtggatgggatgaacttggtggcgcgcggccacggttttgtgcagaaacccacgagccgggtaggttcaatggacctctgcttccggagttttactcgtttggaagttggtggccaacctgcacactgcatagtgcactccactcattcagaaagcagcagctagcactgtacatttgtacaacgctttacagggaccaacggatttgagcctgaaactgtggtgcacccacagggtttggggattcgatttaactaaatattttggttgcttggttccttttctacccaaaatcttgaatttttcttcaggatgatatggtctgagagatctggttaggtagaagaataactctagttaattagctactcctacttgtagtagtctaggtagaacgtagctagcatggatgcatgatattctggagagaaattataatgttctcaagctttgcctaatggagtgcaagaaacacaatttgcaggattcaaagcgctgaaaaaattattcgattgtgctgagatactagtgatggagtcaaaacggtgaccgaattgggagaatcgattcaacacgcgaatacggatgcattaggtttggagtttttgacaaaacgaatttttttgcttgtgtttactctatctggttcatagattctaaggagatttggagaaaccggcacgtttgttctctgaagaagaacaaggtaggtgaagccagccagccacagtaaacagctgaatatttttagcatttgaacccatccgtgaacaaccatgatttgcatacgaatgcgacgaccagagtgacgcgttgtgttgtgattttgccatcagttttgctctgaatccgtggatgtgttgccggcagtttttgctctgacggatgacgctcctagttttcgggcgaaaccggctcagtcagcagcagtagcaacgtctctctctctcaaagttgcaaaggcataattctgtgagctgaaacgcgtgtgtgcataggctgtttggtaatgcttccaatgaacttctagactttttgcaggtttgctctgggcccacctgtcaggccggcaccgtacgtacgcaggaatactccatccactgtagtatacgtttttcgaaccgttaaatgatatttttaagaaaaaaagttatatgtgaaaattgttttattttaattcattttcttaaaaaaactaataattaattaattatgtgctaatgaattgttctgttttacatgcgcacaaaggattaatttccaacaaagacatccgaatatagcctatatgtagctctactagtgaaaattacagttagtcactgtagacttcaaaactgacggaaaattgatactagcactaaatctgcttgatcagaaaaaaattactgtaattctggagtcactaaacaacgaacatgagatttggcctctgcattttctgaaagagcaagatcgatcgccggccggtctgaaaaaccgtaggccgccggtcggctgaacgtcatcgatggccgctcctgttttgtgggcgtcgccatcggcacccaccagcagcaccccttcctgtccatttcttaccatgtctgcagatgatctccatctgtgtgggctctctctgcatctctgtcgttttctatagcacacaaaattaaagcaggataagaaaaagctgttcgctcttttgcgttgcctgatggggccgacgtcgcatgattgcagtatggcgccgtcgtgcgccgcaattcgattttctgatccgcagctgatattaatcggttgtttttctgcttcgatcgaccaagcgtcgtcatcttcatctgatagctttctgtacgttttgggactgaatgctactgctgctagctactccaggtgggtgagaattgtctgtaacttgctcgaatgtgctagctaatttactctcaagtgcagatatctgaaaggagattcagatcagtggatttgtctttcttcagtctagatactcgtgtgacattttctctgaagatctggagcttccatttcgctttcttgtgcagatacaaatgagagttctttttacttttagacgtcttatatacgagtgttctaggggacgtttacaaaatgtataggcagttcaaattcgttcgagttcaaggaacaagaaacatgtactacagtgcacatgaaccaccgcatccattcttgagttcatcaaattaagattgtttattaatacaagctggagcatacagtatattacatccaagtacacaacactagctactttctgcagcagattgcaagcagcactagcttgctgatcatggcctgaagaaggcagggtgagggcggccggtgccctggaaggaggtgttcttgaggtgttcaggtgcgttctcgaaggagtgcctcctggccagcgagaggatcttcttgtcggcggcgacgaagtatgccatcccggccgccgtgcagatgatcagcgcctgccccgtcgggttgatgttggccttcgcccatggcagcatcctcacgctcgccagctgatcgatgaaacaacacacatatgcagctaataagttagtacacctactctctgctgaagaatcaacacaaggaggaattagaagaagctagtagcatctgagcacactcacggttggaacggcagaggcgatggtcgcgacagcagccgccttaacccctgcaaggttcgcctctgcagatcgacgaagcatacatcagtttgtatatattcagttattagcgccatggaatgcaagacaaagcgagattaaacatggtggtttagtgtgcgtgcgtacgtaccccgggagcagcgcttggcgagggcgagcctctgctccaggtgagcacgggtcaccgtcgtcgacattgtcgagcaagatcgatggagctgagaagaaactagtcctgaagtgaagtagctgggaggtggagagaatcgcctactggttggatcagtagtgctgagcgagatgagatgagatgagattgaagaggagggggtctggatttataggcgagagaatgcgatcatcggatgatgcgaaggcagcaaggtgggggagcacgcacgcaccaaggagaggagacgaccatggttttgaggtgaaaaccacgagtggttgcatatgctggagtggtcggtggcactgtgctcgatctgccccctgttgaggatggattctaatctaatctctcgggtggacgttcacccgtttcttacatgtcacctaaataattatgaaaaaattctaaaaaaattcacaagataggttaatatgtaatatatctcttcacaaacatgcaagttcaaattcgacttctacaagttgtaacaaaaataacaaatcaaactctaactagtatacgtatattcacagtcaaatttgttatttttgttataatttttagaagtcttgttatttttgttataatttttagaagtcgaatttgaacttacatatttgtgaagtgatatattatatattaacctatcatgtcaattttttttaaaatttttcataactatttaaatgacatgcaagaaacggatgtacgttcacccaagtatttaaaagagtttcccgcaccctgttttctctgacgtacttctccactccacgtacgtatgtatgtgctccgtacatgccttcttttcagtagatcctgaacattttcagagttaaaaagaaaagagtattatcggttttactgccaaaagaaaaacttttcagagtcgaaatgaatctgagcggcacgtggcaggtgacattggccggtttgtcagcctgcctgattatctttaagagcaaatttaatggtatagctaacttattatttattagcttatactacttgagctaatatgtataataagttaaccatgtctaactaacttatttgacaatgcagtgctaaaataaatattaaattaaatatgtgttaattatagattaattaggattaatagatttatctcataaattagcctctatctgtgtaattagtctatatttaatactttaaattagtgtctaaacatccgatgtgatagagactaaagtttagtctttgtattcaaacaccccctcaagatgatgcatgcgtgtgcactatgctagcgtgccctcggttttgggtcgatcgatgagctgcattttccttaaaaaaaaaagctatcctataaatatatctaaaaaaattattattcttttcgtggcgctaacataattgacatcatgatccaacatgacggtggtcacggcgctaacaacattggcactatctcccttcacattagtgatttagatttcactgaggggctatggggatagcgtcaacgtcattaacgtcttcacgttggaccacggcgccaataacattggcgccacaaaaacaaccatttttaaaataagttttcttaggggtatatttgtagaataagttttctaaatggtaggaaggtttgataatcagctttcgagaatttacagaaattgggtttcccagcttctatttctagtttattttctgaattttttaactacagcttttgagaatatggatgaaaagctaactatatatatgagggagtttttgattttagcagaagctggactgtttgtgctgatatgctagtgataggaattggtgacggaattagtcaaatcgattcaacactcgcatacgcatgcattagggttcgagttggacaccgccgaatttttactcatgttttacttgatccgattcatagatttttcggagatatggagacccggccgtcatgtgtacgtactgaaccggcactttttgttctctgaagaagaacaaggtagggtgaagccagccagccacagtaaacagctgaattttgtatagtagcatttgaacggcacccgtgaacaaccatgcatgattcatgcacacgaatgcgacgaccatcgtgacgcgttgtgttgtgattttgccgtcagttttggtctgaatccgtggatgtgtgccgctcggttgccggcagttttcgctctgacgaacgcgacgcgaccgcgaaaacgctcctagttttcgggcgaaaccggttcagtcagcagcagcagcagcagcaacgtcgattctgtgagctgcgtgtatggccaccagcatattttataggctgtcaggttgccgtgggcccacctgtcaggccggcactgtatgtatatacgtacattgtgcaagtactatacgtagctctagtacacgtattgccagtagagaaaactacagttatactctcaccttgcctcaaaactgactgtaaaatttcttaacttttctcccccaaaaagataaccgtaaattaaatctgaagggcaactaaacatcttggcccttgtgttttctgaaacaggatagatcgatcagtcgatggcatgagcgccgccggtttgtgggcgatcggcaccatcacaccagcagctagcattaccgtcctgtccacttcttgtatcatgtctgaagataatctctccatctgtgtgggggctctctgcatctatctgtgtctttttttagcgcacaaaagtcgaaagcaggataagaaaagctgttcgctctctgcgttgcttgatggggccgacgtcgcatgattgcagtatggcgttgtgcgccgcaatctaaatttctccgcagctgatattaatcacctgtttgtgcttcgaccaagagtcatcttcatctaatagctttctgttcggtagatgggtgaagattgtctgtaattaacttgctcaaatgtgctggctagctaattactctgaaatgcccatgtagggctaattcctatgatattctctctgtaacaagtatctgcaacttccatatcatttttcttgtatagatacatatgagagttagtagtagttcttttttttttacacagttacttcttatacttgagagtagttcacaggctgacagacagtttctaatttgttggcgtcgttggaagagcaagaaacttgtagaatgcacatgaaccacaaaaccaccacatcaatgtaattcgttctcaagttcaaaagatttgtttattagtactacaaactggagatacagacatacagtatactacatcgatccaagtacacagcaaacactttctgaagcagcagctagcctagcaatgcaagcagcattttttttttctatagctagttgattaggagaaattcatggcctgaagaaggcagggtgagggcggccggcgccctggaaggaggtgttcttgaggtgctccggtgcgttctcgaaggagtgcctcctcgccagcgagaggatcttcttgtcggcggccacgaagtatgccatcccggccgccgtgcagatgatcagcgcctgccccgtcgggttgatgttcgccttcgcccatggcagcatcctcacgctcgccagctgatcgatgaaacaacacataaaatgtgctctaagttagtactcctactctgctaatgaagaactgacacgagaaaaagggctaattaatcctagcgtagcatgatctgagatagtagacacttacggttggaacggcggaggcgatggtcgcaacggcagccgccttaacccctgcaatgttcgcctctgcaggtattatgcatcagtttatattcagttaggtgccatggaattcaattaacgcaaagacgaagaacattgtaggagtagttgatgacttcgtatacgtaccacgcgagcagcgcttggccagggcgagcctctgctccaggtgagcacgggtcaccgttgccatcgcgatcaagacgatgatgggatgggagctgaagagaaagtctgaagcgaaggaggtgattaacccaaggagatcgaggagtactggctactagtttgatcgagagtgagttgagatggtgcttgaaggggagctctggatttataggcagcagcaagcaacgcaatgcaagggaggaggatgcgaaggcagcaaggcgggaagcatgaaggagaccatggttttgaggtgaaaccacgagtgggagtgggagggacgaatcgggaggcggttgcatgctggattggtcggtggcactatgctctctctgaaaccgggggcatttaactgttctctctctgaaaccgggggcttttaactgtttgccacttgaaataactatttgccatcaatgacatgtggcgcttattatactcccttcgttttaaaatgtttgacaccattcgtcttattaaaaaaatttatgaaatatgtaaaactatatgtgtatatgaaagtatatttaacaatgaatcaaataatatgaaaataataaataattacttaaatttgttgaataagataaatagtcaaatacgtactaaaaagtcaacggtgtcaaacattttgaaacggatggagcatgttgtacccgactcttttcagtacatctagtcaattttcagagttaaaaggtactgcgaaaaagaattttgagttttcagaggcgagatgaatctgaccgtccagaacagaacggcgacacgtgggaggtgacacgtactggccggtttgtcagtctgcctggctaatttttttttttacatctgattagtataagcaattaagcatacgcggaagtgagaaaaaacgagttataaacttgttctaccagctgtgctccaagatatgatgggccaaatataatgatgtagtgtatatttacatgaaaaatattttttatacgctagtaaattggctatggatgatatgacgatgttttaatttttagaactagcatatgcttacgctattaaatttgctctgatgactttaagtaatccatagtactctatccgtactcgcaaaggaagtcgtttaggatcaaacccttgggaatataaatcatgaataactcttaatttgttgagtttgaaaatataaaaattatatgaatagatttgttttaaaaatacttttataaaagtatacatatatcacttttcaataaatatttttatagaaacaataagtcaaagttgtgttttggagaccgtttcgctgtccaaaacatctttctttacgagtacgagaagagaatataatcgaatgcatgaatgagcagtggataagattgtctactactgcaatggacggaagctgcatggatagctggagaagatgaagcatatgtgtgtgcactgtgaagcgtgccctccagccctcggttttgggggcagccgtcgtctcgtctcgtctcccacgaaacaaggaaatccgccgcggtttcagcttggccgttgcagactggcggtttgccgacccaaccgaccatctgtgactgacacgtgggccccacatgtcagctgccgtactgctgaacagtcagataatactgtacgatggagaaactgtagtacggtttgttgggccaaaactacggccagtgttccttcccgtatatcgtggtgaacatacggcccaaacaaagttgggccgtaaagattccgaggtttaacgtgggccgtcgttgttgggccaatttactgcgggcctaatggaagcccatatatcagttgggcctagaacggggatcgctgttagacgtgtggcccatgctattactgtcagatgtctatttccttgagccgttcaaaggccgatagacagacagcgatagaagctactccgacaatcggccggctatcgggcaggctggcaaagatgccggccgtacttgagccttcagcttcagctccaactcgtggttgcaattcaaggcgtgtaaataatccgtggtaataattcgaccagtcagtcacaaatatctagattttacctcgttttcccgttaatacgttttttaaactaataaacggtgcgttccgtcgtctgtgcgaaaacattctatataaaagttgctttaaaatatcacatatatccatttgtcaagtttgtaataattataatttatttaatcatacatatgctaatagctttcttatttcacatactctaacttaatctttattttcatcagtttcagacaccacctacttagtgctctctctattctaaaataagtgcagcctttagtttaaatttgaatatctgtatttattttgaaaagaatgtacgactataaagcgatgtttttgttcagactaattattactccagttcgatacaaagacgatgacccgcactagtcaagtcttttctgatgcagaaactttcaggacgatattgttgttgcttggtgcaaacgaataaaaaggcagcttatcagcatgttcgatgtctctatgtataggaggtattcatcgtatggtcacaggagtatctgagggacagggaaagtacgtagcataatacatggcttgctctttactttcaggtcagaagctctcataccttactatacaggctcatagttaattcttgcatgctcaagtattttgtaaagttgagatgtttagaggttcaaatatataggaatgttacgtgcatatggtagaagaattaactcaaaaagtcttttttttggacgttgtatccgttcctttgacatgcaaatttactttgcgaggatagtatatactccctctgaccataaatatttgacgccgttgactttttaaaacatgtttgactgttcatcttattcaaaaaatttaaataattattaattttttttctatcatttgattcattgttgaatatacttatatatatatatatatatatatatatagttttatatatttcacaaaagtttttgaataaaacgaacggtcaaacatgttttaaaaagtcaacgacgttaaatatttagggacggaggtagtatgtttttggtgtttaacgaagaacaaagagaatccataaaattgaaggtccggccctggtgtatgataatttgccgttattttggattggtgttgttttatcttgtctgtcaacgaaatgaggcaaatcttttgccttggaacgatttcaagcattatcgatagaatattggtaatgaagggttttccttaaagttctggtaggagtttatcgctacccggcgataaccacacggttaccaagaaaaacacgaggtttcagaaactaatattgacggagcgtggggctcctcaccgggagaccgcgcaggcccccctttaccggttcggccggggactcagggagagattctaagctctctgtatgtggaaggctcgcgagacaggaaacacacaagacacgggcgatgtatacaggttcgggccgctgagaagcgtaataccctactcctgtgttttgggagatctgtgtatgaaggagctacaaagtatcagccagcctctcccttgttctgggtttctaatctggaaaagtccagtcccccctctcagtgggcaaggtcctccttttatatcttaaggggataccacatgcaccatttctctcttttttgtggggacttaccccccccccctttttcataaatggacggagatttgtataattgccgtccgagtcaccttctgatgagacggcccacaactacctccactttcgccgggagcaggtgcgacgtggaatcgtggctgtctactgacgacatgaccggtatcagaccagtcacgtcggtcattcttgtccaccacgtgtcagcttagcaatctacatgctcgcccttcttcacacaacatcttgcctgtaatggttaggatgaagcctggcatatatctgaccaggactaacgtgccatctctgggaggtaacacgctagctccagctggggatgagcgcctagaagccctcgtcctgacgggatggggcgatgcgtgcgtcagatcgcctgtcgccacctaacccgcgatctgaccggtctgtgactggtcacagaccggataaacgagtgcactgcactgcgttacatgcggcgtgacacgctcagccaaaccgcaataaatgtggttaggtgagtcccactgtgctcacctaacccatacacgcggagcaaaaacccacgaggggtcggggcgcctcggccctcggggccgaggggggtgcggcccgaccccctcggggggactaagaggagggcgaacgcatcaccctcgggcccgacgtccctcgggggtaccaggccacgtgtgcgattgtgtctgcctcaaacctctagtcatgatactcctgatcccatgtcaccgacagtagccctcggcgttatgccagggcgatcgccctctttaagggaaacggtcgggcgtgacgccactcctaagacctggtgacaggtgggaccggtctccacaattgggcagaaacccaacggtcacaaaccacgcacatcggcaatggtaactcggctgtcaacaatgagcggtctcttcaagactgccacattacttgagtagcacacgaatctggacatggcgattcgtttcgtctgaagatatggtaacgtcgcttcggtcggcgagcgtaattaacgcgcacacgatatgatctacgcacgatatgatctatctcgactgccacaaccgcatacccacctcatgcgccgcaagcgggcgaatgggattagtggaagcgtgggcgcgagaaacgagggggcgaaatagtgggcgcgagaagcgaggagccgggcacagcgttggcaagagtataaaggcactgaggaagggatctgtttccttcctttcgccattattccccttgtcttcgccgcttgcgccctaactccttctttcatgtgccctaccttcgccacacacgctcgctcttaatcttctcttcctccggcgccatggcacggggttccgctctgctcgatggtagcgtgctgccgccttcccggatcgtgagcgagaggcaggctgggctgtcgcgccgcttcatgccggaatctgccaccggccgggagatagtcacgctgggcgagggacgcccggcgccagactacccggggcggtccgtcttctttctcccctatgcaatggcagggctggttccaccattttcttctttcttcatggatgttctggagttctacgatctccagatggcgcacctcacccccaacgcggtgatgacattggccatcttcgcgcatctgtgcgagatgttcattggggtgcgcccatctcttcggctgttccggtggttcttcaccgtgcagtcggtgtcgccgccatcggtagtcggtggctgctacttccagccatgggggccggtgctgaaccgctacatcccctgcgccctccgcaagaagtgggacgactggaagagcgactggttctacactcccctcgccgacgaagcgcgcctccgacttccgagccagcccccggcgcaggcctccagctggcgggcgccggtagatctgggggatggctatgacgccgtcctcgaccgcctggcgggcctacgatcccaggggctcacaggggccatggtgtacggcgactacctccgttgtcggattgcgccgctccagcgacgcgctcggggcgcttgggagtacaccgggtccgaagacttcacgaggacccaccagggagtgagatgggactgggctcctgaggacttcaagatattggtccaacgggtgctgaatctcaactccgtagaggcggccctcattccccaaggaatcctccccctctgcagcgatccagaccgtgcctccatcctgaccattatgatggcggtcggggcctcagaggagcgagctccaaagggccacgacggcgcaggcgggagccgcaggggggaacaatctaccccgagagggggtcgtgcttctgggtcccgcgacaggggcccggggagcagccgccctgccgacgcccgggggaagaggaagcagggaggaacacctcccccatctcctccccgagggggcggggcggcgcgtgccagtaacaggcgcccggagggggccgcgccaacatcgcagcccgagggggagcgcaagaagaagcggccccgtaagatgggggagacagaaccatctcggggaaacctcatttcccctccaaagtggtcgtttaaccgaccccctcgcaggttcgtctctcacccatcgtggctgtattcattctctcaacgcgagttttcactcacccatcttgttcgtcttctggttttttcttttgtttcagcgagatcccgtcgcgtccctcccgccattccaagtccggccagtctgaggccgaggatccggcggccgcagaggccctcaggcgggaatctgaccggcgagaggccgcggatcgcctacgggaagccgaggagaccgcccaggaggccgcccgggctcgccaggccgaggaaaccgctcgggaggaggccgcccgggcccgccaggccggggaagccgctcgggaggaggccggatttcgccaggacgaggcgatggcgacttccgaggcagctcgcgacgaggccgcgggcgcgtcgcttgggcccactccctcaggcgacactcaggcgacaacttccggggcagctggcgaagaggccgcgggcgcgtcgcttgggcctactccctcgggcgacgctcaggaccaaccgggtccgggggacatccccgagtccggcacttccatcggcggcccgagccgcgtggcatcctctccaaggcggctcttccccacgccttctatcgccctactgaacgcagagccccttctgcaggccttggccgccgcaaacaccacggtgttggatgggttaagtgcccaggtggaggtcctgcaggcagagcgggcggagctcgacgccgcgtgggcgcgtgtcgaagaggggcgacgctcggtggaggccatggtggaggtgggccgtaaggctcaccgccggcatgtctcggagcttgaaactcgtaagaaggtgctggcggagatcgccaaggaagtggaggaggagcggggggctgccctcattgccaccaccgtgatgaacgaggcgcaggacaccctccgccttcaatacgggagctgggaggcggagctagggaagaagctcgacgccacccagggggtgcttgacgctgccgctgcccgagaacagcgggcggcggagaccgaagcggcgtcccggcggcgcgaagaggcccttgaggcgcgcgccatggcgctggaagagcgcgcctgcgtcgtggagagggatctggcggaccgcaaggccgccgtcaccatccgggaagcaacgctggcggcgcacgaggctgcctgcgccgaagaagagttcacgctccgcctccgcgaggacgcgctcaccgaacgggagcgagctctcgagggggccgaggccgcggcgcaacagctggcggtcaacctgtccctccgcgaggcagcgcaggaggagcaggcgcgccgcaatctggaaggtgcccgcgccgagagggccgtactgaaccaacgggccgctgagctcgaggcgcgggcgaaggagctggacgcgagggcgcgcagcggcggggcggccacgggcgaaagcgacttagccgcccgcctcgcagctgccgaacgcaccatcgccgatctgcagggcgtgctggactcgtccgccggggaggtcgaaaccctccgcttggcaggcgaggtagggcccggcatgctttgggacgccgtctcccgcctagattgcgccggtcggcaagtgggcctctggagagggcggaccgtaaagtacgccgccaaccagggaggcctcgcccagcgcctctcgaagatggccggggctctccaacggctccccgaggagctcgagaagacaattaagtcatcctcgagggacctcgcccaaggagcggtggagctcgtcctggcgagttaccaggccagggaccccaatttctctccatggatggcgctggatgagttccctcctgggaccgaggaccgcgcgcgcgcgcaggtccgggatgccgccgaccatatcgtcgacagcttcgagggctcggcccctcggcttgcgttcgcccccaactccgacgaggagggcaatgccggtggtgcagacgacagtgacgtcgaggccggcgatccgggcgcatcggattgagtccccagacccccgccattcttcagttttttcttcttttctttcttctaaggccttcgggcctcttttttgtatagatcaacttaatctgtaatcaaaaatgaagaaatttttgtgttaatttcatcttgctgtgagtatgagatgaggatgatctgtgccgtggtccttttgtgtcttagcttgaataagggcttgtgcccaggttctggtcctcaaaaggcgcgggtcggggctagtgcctggggagatccacatgtcgagactggccaggccgggaacgtggtgaccgagggttatgggtgacccgattgtgggtttttgccgattcccccccggagttcaccacgcctcggggcacggctcggttctgggccccgtttggcgattttagccgacccgagcccccgagggcaggattgagcacgagtgacctatttcaagtcaagattcttcaaaaggaaaaaacagcacagatacagcctttaggaaattgaaactgcttttatagaaattcagatataagagaaataagaatatgcatatgttgtagcccccggccaaccctgcacgcccgaggggggtgcggggttggcccgagcccgaaacctgacacccgacccccccctcaggggtagaagcgacgaaggtgttcgatgttccacgggttaggcagctcagtgccgtcgcccgtggctagccgtatggagcccggccgggggacgccgaccactcgatacggaccctcccacattggtgaaagcttgctcaatccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcatctctgcgaagctgattttgatcagcctcgcaatacatggtagcccgaggagacctcagggtgagctcggatgggagaaccgcttccgcgccgtagacgaggaagaaaggcgtttccccggttgctcggcttggtgtagttcggtttgcccagagcaccgctggcaactcctcgatccatgaatcgccgtgcttcttgagtatgttgaaggtcttggttttaaggcctttgaggatttccgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaccgggccgtgatgcccttaatgaatttaagtgcggagtgcttatcgatcttgacgaccggataagcctcgggccacttagtgaacctgtcgatcgcgacatacagatactcaaacccgcccggggcccgcctaaacagtcccaggatatcgagtccccagacagcaaatggccacgaaagtggtatggtctgcagggcctgggccggctgatggatttgcttggcgtggaattgacacgctctacatcgccggaccaggtcgaccgcatcattaagagctgtcggccaatagaaaccctggcgaaaagctttaccaaccaaggtgcgcgaggcggagtgggctccgcattcgccttcatggatatcggcaagaagcacaacgccttgttcccgaggaatgcacttcaggaggattccattagccgcgcgccgatagagggtcccttctaccagcacgtagcgtttggagatgcgatggacgcgttcactcccttcgcggtcctcgggtagagtcttatctgtgaggtatgcttggatctcggcgatccaagcaatcaatctaagggagttgggagcactcccctcgggtcccgaggcctggactccgacaggcctcgggggccggtcaggcgcatccgtctcccctaaggggtcgggtcgcgccgacggctgggcaagcctttcttcaaaggcgcccggtggggtctgggctcgcgaggacgcgagccgtgagagttcgtcggcaatcatgttatcccgtctgggcacatgccgaagctcaatcccgccaaaatggcgctccatacgccgtacttggcgcacgtaggcgtccatctgcgggtcagagcaccggtactccttacagacttggttaacgaccagctgagagtcgcctaacaccaggaggcggcggatccccagtccagctgccactcttagtccggcaaggagtccctcgtattctgccatattattggtcgctcgaaagtcgaggcggaccaagtatctgaggacgtctccgctcggagaggtcaacgtgacccccgcaccggcgccctgaagagacagggagccgtcgaactgcatcacccagtgggcggtgtgaggcagctgcgaggggtccgtgctggcctcggggatcgagacgggctcgggagccggggtccactctgccacaaaatcggcgagggcctggctcttgatagcgtggcgtggttcaaagtgcaaatcgaactcagaaagttcgattgcccatttcaccacccgtcctgtaccctctcgattatgcaagatttgaccgagggggtaagacgtaactactgtgacccgatacgcctggaaataatggcgcagtttcctcgaggccatcagaatagcgtaaagcatcttctgggcctgagggtatcgggttttggcgtcccggagggcctcactaacaaagtagacgggccgctgcacctttcggtggggccgatcctcttcgctaggggccgcatccctggggcactcttcgtccaagcagccttgcggggcgcacttatcttctgtgctgatgacctcagggtcggaggataacaggggcggccttcccacagtggcttcggggccgtcctgggggtcgggggctcctggcgtcgtcggaaaagcgggcaaagggccaactccggtcgtcaggggccttaggcctccgttcggctcgggggcctcttctccctgctctttcccgggtcgggtcagcacagggttagcctcggggtcgaagggcgataggtgcggccttcccacagtggcctcagggccttcctgggggtcgggggctcctagcaccgtctgacaagcgggcagagggccaactccggtcgtcgggggccttgggccaccgttcggctcgggagcctctcctccccgctctctcccgggccaagtcggcacagggtggggaagcgtgaaatgagaattgttctcatcgcgctccacaaccaatgccgcactaactacttgcggggtcgccgctaagtagagtaacaagggctcgtctggctccggggcgaccagaactgggggagagcttagatacgccttcaactgggtgagggcattttcggcttcctccgtccaggtaaacggtccggagcgtttgagaagcttaaataagggtaacgccttctctcccagcctcgatatgaaccgacttagggcggccatgcaaccggtgacgcattgcacatccctaagtttgctggggggcgcatccgctctatagcccgtatcttctcagggttggcctcaatgcctcgggcagagaccaagaaccctagaagcttgcccgcaggtacaccgaacacacacttatcggggtttagttttatgcgggcggagcggagactctcaaaagtttccgctagatctgagagtaacatttcctggttgcgcgtctttacaaccaagtcatcgacataagcctcaacattacgtcctaattggttacccaaagaaattcgagtagtacgttgaaaagtaggacctgcattctttaacccgaagggcattgtcgtataacaataggttcctatgggggtaatgaacgcagttttttcctcatcctccctagccatgcgaatctgatggtaaccagagtatgcatctagaaaacacaaaaggtcgcaccccgcagtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccggatggatgacctcacggatgaatccggcttccagaagtcgcgccacctcctcgcggatgaaggcttgacgtttcggggcctgccgccgcactttctgccggaccggccttgcgcccggccgcacggcgagacggtgctcaatcacctccctagggaccccgggcatatccgccggtctccatgcgaagacgtcagcgtttgcccgcaggaaggagacgagcgcgtcttcctatttgccatccagaagaccaccgatccgtgtggtcttggacgggccgtcgcccagggcaacctccttgaccgggacctcatcgcctgtgatcatccgttgcctcggggtggcgggggcggaagcgccaagcctctcgtcgccaccctcgggcttggatgcagcggcgaggtggtccgcgcgctgctccagacaagcgagcgtgactttgaggtcgccatggacagagatggggccaccggggcccggcatcttcatctgtaggtaggcgtagtggaccgccgccatgaacttcaccaacgcgggcctccccaggaccgcgttgtagggcagactgaggtccgccacatcgaagttcacccgctccgtgcggaagttggcggatccaccgaaggtgaccggtaggtcgatgtgacctaacggtcacgtgtgccccggcgtcacaccgataattggctgggacggccggagcaccatccccggggccttgatggcgtcaaaggccgcaggggaaaggatgttgagggccgctcccccatcaatgaggacacgccccaacttcacgttgcaaacggtgggagaaaccaccatcgcaatctgccctccccgggcaacgcacggtgggtggtcggtctggtcgaaggtgagggcaacctccgaccaccgcgcccgacacgtcgcctcatgagtaggggccgcggccagaagctctcgcttcatggccttgaagctccggcgagaaacgtgagcacacgctcccccatcgacggtggcaatggtggccccaggctcttggaaacctaggtcatcatcgccgtcatcgatgtcctcggcggaggccttctgcttggcctcacttcgccgattaccggaaggaaccgccggggatttgccctctcggcgctcctgcctcctctcctcctcccacttcctcgtccgttcagccaaacttttgactgcacggcagtccgcgagatcgtgaagggaagtgttgtggacggtgcaccacttgccggttgggcgctccctgttgggagcgccggcctcgttctttttgcctcccgcaggcctcccctttcgggtggcccgcgaagcgccctcgacggcgaggacatgaccctcgtcatcggtatgggctgacctcttcttcctcctcctgtcacgccgccctatctgagcggcggatccgggggcggccgaagctgccacaccggaaccggaggggttctaagtccatgcctcctccttatgagccactcggtccgcgagctgaaaaagctccgcggtagtctggggctccttggaggcgatcttttcaagcatgcggttgtgccgcacaccccccctgaacgcgtaaatcaccgcgtgcgcagggatgcatggtatggtgttgcggacttgacagaaccgctgaatgtacgagcgaagtgactcatcatcccttcgctgtactgcgtgcaagtccgcttcctcacctgggcgcggatatgtgccttggaagttcatggtgaactgttggcacaaatcctcccaagagtggacagacgcgggtggcaagttcattagccaaccccgcgcttgtcctttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacattccgaaggctcgccacaaaggctctacagccgacaccaccaaccgggggcacggagggctgatccccgcgtccgtggtgaggtgacactccggacgaggaggcgccctccgttgcgtggggagcacgtcggccattacgccggcgctcgatactgatgcgagcatccggttccccacgcagatcttcctgggtcggaggcgttgacgaaggagtggcggccgaatggcgaacagcggctgccgctcgccgcgccctccgtcttgacgatgcggagccggtggtagcagcaccagaggccttggtggcggaggaccgcccaccagcatctaggcgctgccgtgcagtcatgaccaatttggccacatcgtccagccaacgttgggctggagactccgggtcatgggcgacgggcgggtgacgtaggagcgcgcccgcagcttggagcgcgccctggggcgtgctgccgtcgccgtagacgaggaggcgacgctccccatctcgccgcccttctccacctcctgtgggtgtcgaagtcgcggatccttcggccctctcgagcgccttctcccgcctaggactttggcgtggagggggcggtggagtacgagctcgacggcgtgggtttggctccccgtcgtcaccgctcatactcggggagaggtcgtgcgcctttgctggctcggccattgggctgaacaggaaaagcttggcgcacacgaaagagtgcgagagctcaaaaaatccctcgcagagccccctacctggcgcgccagatgacggagcgtggggctcctcaccgggagaccgcgcaggcccccctttgccggttcggccggggactcagggagagattctaagctctctatatgtggaaggctcgcgagacaggaaacacacaagacacgggtgatgtatacaggttcgggccgctgagaagcgtaataccctactcctgtgttttgggagatctgtgtatgaaggagctacaaagtatcagccagcctctcccttgttctgggtttctaatctggaaaagtctagtcccccctctcagtggacaaggtcctccttttatatcttaaggggataccacatgcaccatttctctctttttttgtggggacttacccccccccctttttcataaatggacggagatttgtatagttgccgtccgagtcaccttctgatgagacggcccacaactacctccactttcgccgggagcaggtgcgacgtggaatcgtggctgtctactaacgacatgaccggtatcagaccagtcacgtcggtcattcttgtccaccacgtgtcagcttagcaatctacatgctcgcccttcttcacacaacatcttgcctgtaatggttaggatgaagcctggcatatatctgaccaggactaacgtgccatctctaggaggtaacacgctagctccag

SEQ ID NO: 39287 - DNA, 6255 bp, Oryza sativa
  unsure (1)..(6255): unsure at all n locations
accccctcggggggactaagaggaggcgaacgcatcaccctcgggcccgacgtccctcgggggtaccaggctacgtgtgcgattgtgtctgcctcaaacctctagtcatgatactcctgatcccatgtcaccgacaaatatggttacgacggtattgtaagagcaggcacaatagcatactataaaccaactataaacacacatcgagaagaacaaatttgtagccagctgcagcacaaatacaagacacaatgtttgtctgataagtgggaccaggtattactagtgtggtacatatttataaacaactattgtataaattgactgttaaattaactatagatgatttgaatctagtactattaaacttgctctaaacctctttgctcattacctgggtaagaagttaggtccccatcgtttggttttttatggaataaaaataaatttataggtaaaacttttatatagatgttcttggtggcttaaaaatcaatgttgaaaaagaaactatattgaaaatatcacaaaatcaaaaatttaaattttggctttttcttttactgattaggccatccgatgggagccttagtacttgtggcaaccagcctgatgctgctgatactacagcatagtggtgcatctgacggggctagggctgggtctggaagtatctggcagccccagcccgattgtccagctccagcgaagtgcggcaacgtcaacattccctacccgtttggcataagagaaggttgcttccgaccgaagggcggctttaatatctcatgcaagcaagaacaagcttatattgggtcagattttctgattaaaataaatattttatcttgatttctgttagcacgttctttcaaattgttaaacggtgaatttcatgcggaaactaaaaattactttaaaatatcagataaattcattttcaagtttaaaataattaactactcctgtactaacggttttcctgtactatacctttatcagaccggacattagggtcacgaattttgatgtagtccagagtgaggctcgcatcctgaccgatataccatcagggacggtagcatggaagtacaacaatgaatttgatccaattgcatggacgtccagaggaggattacgacttggtaatcaccatatggtttccagcgccaagaacagattcacagcaatcgggtgttcaactgttgcattcatctacggcagagacaaaaatggtagcaatggacagtttgatcagttcaccagcttatgtggatcgttctgcttcgacgagggtagcatcgaagacggcccagagtgctccggcatgggttgttgccaagtccccatttcaaccaaccttaggaggttcagtttaggattctataattataacacaaccaaaaaagttcttaattttagttcacgcagctatgcgttcgtggtcgagaaggatcaattcaagttcaagagttcctatgccaaagcagacaatttcatggaggagctcgctcgtgggattcctataattctccagtggattgctggtaatgaaacctgcaaggaagcagccctgaaggagtcgtatgcttgcgttgccaataacagcaaatgcatcgatgtgatagaggcgcccgggtacagatgcaactgcacccaaggttacgagggaaatccctacctcaaagacggctgccgaggtcagaattaattcatacgcatgtgttcaggttcatggttagaattgggtctttttatgagatggaggggataaatttgttcaaaaggactccaacaaataaatttgatcactctctctcaaacacacacagagcaagctaaattaattatatatgcaccctatatatgcgagttgctgttctccatggattcatatgaagttattattattgattcctcactttgttcagttgttaatattgcagacatcaatgagtgcaacgccacaagattcccgaattcttgcaagggcatctgcactaacaccgatgggagctacgactgtaagtgcccactaggaactcacagcgatgatccaaagaacaaggaatgcgtcccacaagtgaagctggtcattggtaatatgtttttcacgctacatttttcagctgccaaaactttttctctaactgttcatatttacagcgaattgagatgcaaaccatacagtttttttttcgactatatatgttgttttcttagcaaaaaataacaggttgttttgtttctgaaattttctacttatccgtttctattcaacctaaccaattccattccaacaaacggaaacaacaagtctgtcataatggggctagtcgagcttatgataggtaatcatccatttccaggtatttgcatcagcatcatcttcctcatcatctgtatctccactctgctgatcaagattcagagaatgaagctggaaaaagagaagcagaggttctacgatcagaacggtggccacatattataccagaaaattatctcagggcaagtcaatacagtggaaatattcacagaagaggtactaaagaatgcgaccaacaacttcgacagcggacaaaagcttggcgccggtggtcatggcattgtctacaagggcattctcagggacaacaatgtcgtcgccgtgaagcgctccaacttcctccacgtgacagacgccgaggaattcgtgcaggagatcatcatgctctcgcagatcaaccaccggaacgtggtcaggctcatcggctgctgcctggaagttgaagtgcccatactggtctacgagttcatctccaatggcactctctcctacctgatccatggcgatagcaggcggtatgcttcactgaaacttcgtcttaggattgctcaagaatcagctgaagcattggcatacctgcacctgtcgacgaaccggcctatcatccatggcgacgtggagtctctgaacattatgctcgatgatagctacacggtgaaggtgaccgacttcggggcatcacggtggctgtccaatgaagctgtcgagcaaattgcgatggtgcagggaacccgagggtacctggatccggagtacctgcaggagaggaagctgacggagaagagcgacgtgtacagcttcggcgtcgtgctgctggagctgatcactgggaagaaggatctaccgccacgatggcgatggcgacttcgagagcctcgcaggatcgttcctgcgggcgatggaggagagggtggagaacatcttggacacaagcttggctggtgccagcatggaggcgctgcccctgcccaggaggtcgccaaggtggggagtatgtgtctgagcgccaaggggaaggagaggccatccatggcggaggtgaccgacatgttgaaagctgtaagaattgcgtggagggatcttctggtttcatcggagtacaacgtgacggaggttttcgtcgacagttcagaagctcctccatctggcaacccatcttccgctgtgttctggacgccggacatgcagtctctagaagttgaaactttgaggtgatgtttacagtctagactgtttgcagatattcagagttgcattgtctgcagacgagttgcaaaggtgtttgttcttgttataaactattcctatgtggttttcgtgactgttctagctgtcaattctcaggtttgctatctcaaaatggctattacttagctttgccagcaatgattttagtagtctcaagtgtaacagtagagtaaagcatacattgatatctttcaaacaggtttcagatggcataaagtattcagaatatgatatagtaattaagttgcctgggggggtctatagtcttgttgtaaattattccgttttgacaactctaatttttttttctctgtaaattctcaattctaaactctattatcttctgtgtcgcccttcatcctagaacttgcgcgtcatatcatagatcgctgcagcggaatcgacatcgcgcacgccaaatttggaggccaaaatccttggggtctcgtggggggggggggatttggcggcccggcggcggcgtcgtgactcgtgtgagcaaagagtagagttcgaggagaggccggcggaggtggacgtacctggatgcggcggtggaggcggggccagatctggcggcgcagaggtcgtgggggcgcggagggaggcgcttcgccgccggtcgccgcccctcgcgcgcgccggcgccggcgccgcctaccctaattggctacggaatcagaagataatcaaatcataagtacacccatcgagctccagtattcgatttcttgaccgcacgatctccatccgacggttcacatgaacctaaatggggttcggggaatttttctccgaccccccacgcgaccaccattcgcatcgatcgccttcaaccactcctcgtacatctcgtccgcacgtgcttcatccaacggttcacgtgaaccaacaggggttcggactatttttcaaatttgggcggttcgaatttttttgcatttgccgctcgatcatatatagattatctccatctgtaaagaaattttctcctatagatctcacacaaatccttacggcatgttcagaactcaactcacaactgaaaacgtgctactccatttcagggtcaattcattcatagatggtttcatcagtaaaatactggcacacattacatatatccaaaaatcatatatctccattctgtttgcaatatagatcacacacttataagagcaaatccccacaaatggcgcggggccttaactcgtaatcagggttcacaaaagaaagagataaaaagagcggggtcttttccccagctcattagctttagtattattctgcttaactgaccagcaatggctttacatagcgttaaagttaaacagatactgtcctgtcctactgtacaaaatacattacaaattgacgaaggggcgacatcaccctgacggagcccgcccttgagaatatacagtatcatcantgtctataaacggtcaggataaatataggggtcaccataatctggcaaacctcttctctacatttaccaagtcatcaaatgcatccagcataaaattgccagttctcatggctatcaatcatctcgttgccgttccatttgtattgaccggaaaatccgtgctgctgactctgaagcagttcgtgaattatgtggaacaaccttgataacattggtctggttgtcccggctgctatatgagggctgaggctggttgttctgagctgatactgtggggaaggcggatacaggaccacttccactgcattggaacctgtcaaaaggactgctagcgctgctggcctgtgcctcgctatctcttgaggcatgaaatctccaaatgccacttggatgtgacatgttacatgagatccacgactgctgctcaaagttcccataaggctgtggcatcgaaggatgtctcccttgttcgactacaggtgccggtgcagttgggttcatcactggtatgctgaaaggcgggaagtagttcataggcatggaaggagggccaggagcacccatatgttgtggctgatgaggcataggaacaccgtatgccgagttcatgaaatctccagctgttgatggaagactcaaaggagtacagttggcataaaacggggccaatatgctaccagctggagggcacggaccagaataaggcttatagacaaggccttccaaaggagacatgacagggacaagccattgattttgaggtggttgaagttgaacgccccagttattttgtttgttatcagaagcaacaggtgtagctcgacgattgcttttagagacgccatttgttgcagcttgatcacgttgaccactgccaagcccagtatcatgaggggagggtgggctgtcttcagtgttttcttttgatacctccggttgctgtagacttggctccacgtcatcgatggttgcgactaaaagaggttgtgctttcaggttttcttccaccagcttgttcttgctacccaacaaggcattgccaaggcaaggatcactttcaataagtacatgtggcgatgctgcaatcaacttctgcacctgattgtaagtcaaatacaagtgtgggttataaacagattatggacaaaatcctatccacgaattaacctgcttaagagtggctagaaggaagagaaatttgctagactcacttttaccaacttatgcagctcaaaaacctggacag

SEQ ID NO: 39288 - DNA, 6587 bp, Oryza sativa
tccaattacaaatcagcaaatgttgaactagatatatattaattctgccaaagaaatttgtagacatgctgacttgtaagcccaaaatttggcataagtatgcacagtttccatgcatgaggtatttgaaatatcatctggagctgacatctattggcattcaaatatgaaataaaccaaaaacaaacgagatagtcatcatgtttttctgtctaagatgattaagatcaaccgcaaattaagagcaaataacagtaaagcaagggaaacaaaacaaattttattcatcaaagctacctatacgtaattagagctgcaaacaagtctagtttgagtgggccaaactaagctcaaaaggatagttttacttacttcataatagcacgtcttgctttccagaaatgctttgtaccaatggctccaacaattttatctggagaaatctcccaaccagttatacactccaccgaggaatcagacacatcatcaatgttctctgcatcgtgttgttctagcaaccttgacacatcatcacttttctctgcatcgtgttgttctagcaacctttttctctttgtacctgtttcctctatgcctccttgcggtaaattataatgcctatcagtattttcagaagatggattagaggaaatttcatttcttctcattggagggttctgaaatttcatggaacctccatttctgcttgtcgcttgatgcccactatttccaccatgtggctcatcagaatcatttataatgcccgtcttatccatcttaggatatactttagcatgcctgctttcaaacatatctttggaagcatgaaaggatgaacttttttcaacttccacgtttttggatgtctgtgctgcttccatctccttgtctttcaaaggggtccttgatttcacatcagaaacatggattctctccaatttcttgctaacagtgttataacactttgtggatgatttggacactgttgaagggcttttgtgtggatttgcagcaacaaggggtgttgattggtcttgaacccctgcattctcttgagtactatattgaggaaatctggaattgaagacagaaggaaccataaattcatcatcatcggccaatctctttcccgaagaactctttattgtattttctgctcttctttgtggtgcctcagcagttgatcttgaagcataaatatccatgcccttagtctgagaggataacatccccagttcttttcttgaaccactaatcttcttgttgatcttatctgaattgatcttttcagtagaatggccaggtcgattggaaggcacattgaacggctggaacagagaactgtcacgtccataaacctggaagaaaataaaatccatttcagtactactagatttagtgaaaaattgcgaggattccacgctaattggtaggaagcgtatttaaactatccaagaacttccatgttgaattagaaaaagtggtgggagattaagtatctcatggtaagatctcgattttttattttattttcgacccaaagaagggcaaaagagacataatactgcaaatggacttctttctttcttattttgttcacatttcttcatttggaaatctatgacttggacttttgccattcgcacttcatgtctataactatcccattatcaaaaggtagttggatgtgttgtgggaggctattgcagatttgttctaaagaatattttccactcctaaatccttgctgaaaacagtattagaaaaccgttgatatttatcacatacaggttgaacgtgtgcctgacaatcaaagcatatcaaccaccatttttatcattccctttcacgtggacctttttttttcggcaggcaaaaatgcaagacactaaggaggaacctagtgtcaatgatttaaggaaggtgagcacgtcagggagaatagaacacagtacgttgagcagcactacggctactctttgccacctgcgctacatgcagtttcacatgtggacctttttgtttgtatattacaaacaccagacctcagcaaacacaatcatagcatatctggccatatacaatttgcaataagctataatatccgatattgtttgcaaggaacttatgccccgtctccaaaactttaccggaagagctgatgtaaactgcatataatggttttgttctgctctttcgccttcaacacaagtgagttatcagcacggagaaagatcaataatgacactatgacaacgtgcaagcatgttactcctaccacaattgtatgactatatttgcaagtaattgaatcacatgtcgacggcatgatagattaatcagcacaaaaggaacatggcatttgtgcctcaaactgggcttctcggccttaatcttatccaatttttccatgtgtttagctccgttgcactaaattcgcccatcaattcatctatcccaaccgagataactacaaagggtaaggcgtgaaacgccccctctgacctagctcgtcgacgtcgagggcaccatttgtgcctcgaaattatcttcccagcttttagttctattcgatttgcaaggaagtttagctccattgcacagaattattgcctaccaatttaggcttctaattcgattcgatttgcaaggcgtttagctccatttgcacagaattgtcgcctactagtaccaatttagcagtcgcacacactacccccaatcgaatcgatcatacgggcaggacgtcgagtcacctggctctggctctggctctggctcgccgccgacgtcgagtgcgcggggctgcctcctactccgccgccgcctcctccgccgctgaagcgatgcgagggcacggtgaactgctcgtagagcgccatcttgttccggggcggcgcccgcgggcctccgcccttggccgcgtcgttgacgtggagccgcgggaacagcgggcccatcaccttccccttcgcctccttccctcctcctcctccgcctcctcccctcgtcgccatcgcctcccgccgcagcagcttctcgggggcgtcaggccatggcggggtggaggaggtcgccggtttttgtggccatggaaatggaagctacgggattgttttgctttttttttttttctcttggatctggatgccatgctcatccatacgcccattggaggagtgaaaggtgggcccaccgtgagtgagacattgggaaaaaagaaccggtcactgagccggtttataggctttatgatcaccgattcagtagtgtgacaaccggtttaaaccgtgatcatgaagcacatttttctgactgagcatgtataatcagtggcaggtctagaaaatcaattcattggtgtcataacatatatatcggtgtcatagtatgctagttatgcttagatcatgatgttataatatatggataagcagttttgctatagcttttgtcaaaagtcgtcggtgtcgtctggcaccggcccatatactgtagatccgcccctgtgtataatagtatgctataaaccagctataactttataagaatatgtgaaaaaggtaagagaagagagtgaagaaaagtgagatttctagccagctatagcatggattttaagatgttgtctgtgtatgagagggtaggatcagtcattaatggtataatatatatttatagataactattgtatgaataaattattagattggatataaatgatttggagctagtagttagctatgctattaaacttgctcttaggcttcattagatttgtctcttttggattagctacttcttttatcgctctccatgagcatactattttgaattgttgaatggtatctttttttaaaatatatattatatggaaatttgtaccgcaccataatcaactgttcccgctatcgacacccaacccctattttaccggatcaaggagacagagtgcgacggtgatggaactgctcctggcggcaggaagagaaggtattggtctccttctactcatgcatccggttgatgggagagataggcgatgcccaagatgccaacaacatgatgagagagaggtctcgctcagatcctgatcctaccaaatcgcttccagcgacactattgtcccctgggatgggaggtgctcatgacgacggttggacgggcgtagatgaggtcaaagagaaggccatcatcttcattgtagaaagagcccaacgttgttgcccgtgccaaatcgaacaccatgaaaacctgttccacgcactcattgccgtggacgccagcctagagcggtaaaggaactgtggtggtggtcgacatggctgaaatgtgaccaggcttcaaatcagtcaaggggggagctgtcgtcgtcatcggtaagccgaaggggtttgtttcctcctttgttacacggagtctaagccccaccgtcagcgactgcgatgggttgagtaagtgaatctagggctgctactgttaccttcatcattttttaatccactcgaaaatataagacaattttgaaatgactaccttcacccaaaaatataaaagtttattttaggacgaaggtttttcaatagtcgcaggtctgacagaagagtacaaacatacagaggtttcaaagagatttcgaattacaaaaagaaaaaaaaatgaagttcagaatatgaaaacaatgtttagatgaggaagctgacaatgagctctgatcaaattaaatgcgaggaaatgagtactccctctgtcccacaatataagggattttgacattttacctacactgtttgaccactcatcttattaaaaaaattgtgcaaatatagaaaacgaaaagttatgcttaaagtactttggataataaaataagtcacagataaaataaataataattttaatttttttaataagacgaataatcaaacagtgcaataccttataattggggaagtagggagtataatttttccgggccttcaaccaagcatgctctctatcagagtatcagttcgatctatgcttggaccattgagggtgtgtttgaggagtaggagattagagagattggaaagatacgtaaaacgaggtgagccattagctcatgattaattgagtattaactattttaaattttaaaaatggattaatatgattttttaaagcaactttcctatagaatttttttacaaaaaatacatcgtttagtagtttgaaaagcgtgcgcgcgaaaaacgagactcaatctcccctgtctcgcgaacgaacatagcatgaatgaacaaattgaacaatgtcaccacaaagcaaaacaatccttaaacacacaaattgtgttttgcaaaaaaaaacaaataatccttcagtttgtacctctatttcgaaagaaataaactttgaatcagacgatcatcaaatcgccatcgatctaaaccctaattagctgtggaaccagaagataatcaatcaaatcccaagtatagtgttgctggactcacgtccgtttgattattgaccgcacgatctccatccgacggttcacgtgaacccaacacgggttcggagaatttttctccgaaccccacacgaccaccatctcgtccgcacgtgcttcatccaacggttcacgtgaacccaactggggctcggagaaacctcgtcgccggagtgacgtcactcctccggcgagccaccgtgcggagagcgtgaggtcatcgtcccgacaggtaggagagcgcgaacgagttgctgatccccgacgacgtcacctgcatcccgccgtcgctggccgccgccggcggcggcaggccgaacgggccggggccgcgcgccgccgggtcgagcgcgaggaggtcgacgacgatcatgtccgacggcggcggcgcctccacggcctccgcggcggcgccacgcccctcgagcatctccaccacgcgcgccatggtggggcgcgcccccgccttctcctgcgcgcaccacagcgccacgtggaccagcctccgcaccgccgcctcctccaccgcctcgccggactccaccacccgcctgtccagcacctccatcaccctcccttccctcgccatgtctccggcgatcttcgggaagtacgtccaccgcggcgacgccgacgacccgtcgtcgccattctccgcctgcatcaggttgcggcggccgccgaccatctcgagcagaacgagaccgtagctgtacacgtcggacttctcggtgatgccgacgccgagcagccactccggcgcgaggtaccccgtcgtgccgcgcaccgtggtgacgacgcggctctgctccttccccaccagcttggacagcccgaagtcggagaggacgccgcggaagccgtcgtcgaggaggatgttctccggcttgacgtcgaggtggagcaccttgctgcggcagtcatggtgcaggtaggcgagcgccctcgccacgtcgacggcgacctggtaccgcgccgcccacggcaggtacctccggcggcggcgatcgccggagtgcggggagaagatccacctgtcaagggagccgtgctccatgtactcgtagacgaggaagcgcggcccgcgcgggac

SEQ ID NO: 39289 - DNA, 10008 bp, Oryza sativa
ccgccgtcgatccgcttcaccgccaccgccgtgccgtcgtcgaggatgcccttgtacaccgtccccgacgagccccgcccgacggcgtactggaacccgtccgtcgccgccgccagcgactcgagcgtgagcttgcgcggcagcccggcgaccttgcggaagtagctgtactccacgcggatccgctcgtcctccatcgacggcagccgcctcgccatgcgcgccgcccgcctccgctcgcccgccgcgtggtgcagcagcgccgcggcggccgccgacagcgcggcggagacgatgacggcggtggagaggaagaacggccgcgacagccggaagcggaggtagagagcgagctcgaggaccagcagcacggcggcggccgcgccggcgacgatcttggccgtcttgctctccatatctcggccacgtgacgtcacgccgtcaccggctcgccgtcgccggcgacgccgcccgccatggtcagttctttgctcactttggacgcgagttaatttcggattttgacatgatgggttagcaattaatacatgtgagaaaacacactgaaatcttaagagtgatagctacatttcaactaatgtttgtgcctagtgcatcactattggatttatctaattatcttgcagtagtaaggagctgacctgatcaaaaaaaaatgaagggaaaagatatgtaggtgtggagatcaggaatggttcaaatcaataaagtggattaaatgcagtgcaaattggaattctgtcacgccgaatccgtccaaaattttcggtattttgtgtggtaaagttaacactttggttgaatgcatcctcacgtgaatgacatcagtgagtggtgaagtgtgtggtgctggtttggccaaatccaagtttgaatgcatcactgtctcactcatcaaagcaacaaattgaccacgtaagcagtaggaaattaaggatcatataaagaaattacaaaagcaattgactgtttcatccaactgcttggttataatcaaagataactgaactggataggagggagaaggatcatcagaatgctgacttcatttgtttaaactgaattgaacaggaccaaggtttgtgaaatgttcagataacagatcatacaccaaaataaatggtccaggtggccattgaacatggaatcatccatcaagacaaacaaacaaacatacctattttgaattcgactaaggtgtgctgaaaaagagaattgcatatcattgtttactgaatcctgttatttgcatgaacaaatctctaaaaagacaaactttgtttttccaaaatccactgctgctccaagtcatctgaattgagagttgacatggatatggccatatccagtgtttttattgctagaggtgacttctgcaaccttaatgatggtggtgatcgtcgtcatcgtcatgcccatcaggatctcctccttctcctatcacctcaagctgtgaacataaagttgcaagttgatagctcagcgaacatcaggacaacataccaacatatgcgcgatttagtggctcatgcagaaattgctctcacaaggcaagcgattttgtcaacagaaagtaccaacataccgagaaatactgagtgcagacagggcattcatgtggcttgcctttctccaaccaaaaccacacgacatcatgctcgtcctctgaaaatatcaatcattgcaatttgcagtttaagttaattccattggtggttagtcgatgaatatttatagagaagatgcaggagaagatttcatcctagaagcttctttataggtcaaaaacaaggaaattagcatgcacaggtactatacctccttcaccaccgggacaaccaacaatccttttgttgtagtatgactgaataacagctggagcttcctatacaacatggaaaaaatattagtccagttcgatcacgcaggagtggaatgaactaaactgaacagtgacacaaaaggtacaaagggaccaaatcaaggttagatgcaacacgctaaagagtagtaccattcatcaacaggccaaaacagaatgaaaatgatgcccattaatgtgctgataaccttatcagatcacacctaatgcaagtctgaggggaaatgtcatgagaaaaacaatttgtaggaaaataggggtgataaaacaaaagaaaccactgaataaataaataaattgtataacatccgtacatgtatcgatcaccacaactagggggcaatctgccttagagactagagatatatgggaaagcgaagaattttcaaaacactgcacttattttatttcctggagatagacaacatagaaattgcaaattcaacttcatgatcaaatgtactattattgagcaaccaataactaaaaggtccaacattgctggttcaactagaaacctccatattagccggatccacatggacagaatcagagaataaactcacaagatatagtagcagggttttccaagtgaaaatatatttctatgagcatgtaaaggaaagtcttaacatgaaattgctaatcaacaattctctaaagaaaagcaaaatcaagatgcctccaagtactagatataagacaggcccccataattatgcatggaaattcagaatgttatagcctacaaaatccccaaaattattttaacatgctgaaaaaaaatgctctactaaagttataatgaaaacaaagacaaacaaaatcctctttgttaacacaacaggagtcaggcaacacagcccaacctttcttaagcaagcacatctgacaagtgaacaaaacagctatttatgcaagtttttcctatcaacaggactatacgaaaagtcaacacataagatgtacagaatagcaaaagatgtgaccatacgaaaagccaacacatagcaaataacataagctggaatgcacacaccatacagcaaggcaaaaacttcggttgccaatgaccagcccacaaaaatacaaatcacagatcagtgtaaacataaacagaattacctatgttgtaatgactttattaaacgtatgtgtgttgaacttttgcctaatgtttgtgcataaaaatctttcctatgtagggaaaagaactggtagctgaaccaatgctacaatctcacatattcatattcagtgaacaaaatccctgccgtgacccagctgctgcatctgcaacatcagaaactaacacctatctcttcgccgattccgttgagccaaagaagcttatcacctaatatcagaggggaacatgtcaagctattaagagagcgttgcatccatggccacaagtcttaagcactacacatcagcattaattcagtcagcaatcacacactccatctaaccaatcaattcaatagctctcaaatacacgggtcaaaacatccatggaattgatgtgaaatggaaagctctcagcctctcatctcaccttggtaccaaagggcccgacgggcgcgtccatatcaaacctcttcttcccctgaaatgaaaaaaaaattcagaccttccatctagtaaaaaaaaaaaaacttccactaataaatcaatatcaagaggagaggtggttgacctggagctcggcggcgatctcctcgcgctcgagcccggtggcgatcggcatcacgtcctccaccctcgtcctcgcctgcgccgcatctgcgcgggacagagacagacagacagacagaccgccccgtcaaatcgccgcctcaccacctgccgggatcgggccggagttcgggagggaatgttaccgagcgtggagaagaagagagcacggggaaggacgccgccgccgatcgccggggagcggcgggtgagggcggagcggtggtggaggaggacggaggtcgcgcgcttccacatggcgggcggcggcggcgacggcgagcggcgggagatggagaggccggagcggtggttaggaggaggaaaaaggaggcagctttcgggccaatttggggtggttttgtcggcccacggaaatcagaacaatccacttgggtgtaaaaatttaacaaattttgcaacgaaattcgtaaacaaagtgtgttagaacagtgagatgattgtttaaatgcaaccacggtttggttagtttgacttgtttattttaaagttattattaccaaatgatagtggtttcgatggatagatcgttattagtatggtttggtgaaccaaacaaaattgattgtgcatatatctcgtttttatttatttattttagataccacaatgattgggtcttaagattttctttaattattcgacgataggcatgtactattgatatgaaaaataattccagttacacgtgactaagtgacttatattcatatagtgatatagatatactagcttgtttctaaaagaaaaaaaataaaataagataattgcaaaagaaaaaaacaaaaaggatcgacaattacgtgtagagtaacttaaagttgaacaaattgtgttcatttgtttaacttttttttaagtatgattggttatttatgtatataaataacacttcttttacctaggatcttcactgcatatctacgtggcatccggctcgtaatatttcacgccatatcggcctctgttgtcccccggtgaagaacgcgaagccaaaataggacactcgttctcccgtggcgaaacgatggcgtgtgacatgcaggaagagaattgtgagggtgcattgtggaggtcatatccttatcacatcatgccttcacggtcgtggtcgcccccgctcctaaatcacatggctatgtgaaaactcatgtccttatagagttttaggcctagctagcaagtgagacccgagaagtgcgtgtcttgcattgctactgtcctttactatctcacataatttaaagaatacgtctctgtccaaatttaatatatataaagttatcgacaacaatctaaaatttacaaattttctcaggttttactgtctgcagtatctatcttcaaaagttcaaatggtaacaccaccaccatcaacttggagcacgaaattcaaagcacaatccaacggcggaaacacacgatagccaccctttaaaaatcccacccccataaaccctagcaacccaaccccgtcctcctcttccccaccaaaaacctcgtctttctcctcctctcctcccatggcgtccctccccaacggcgccgcctccgcctccgcctccgccgccggcggaggcccggcggtggtcgacaaggaggtggacttcgccaactacttctgcacctactcctacctctaccaccagaaggagatgctctgcgaccgcgtccggatggacgcctaccactccgccgtcttccgcaacgcccaccacttccgcggcaaggtcggttgggtttgatatcttcggtgcgattttggggctctgtgttgatggattttggtggatctgtctttgtcaggtggttcttgatgtgggtaccgggagtggcatcctcgccatctggagcgcgcaggctggcgccaggaaggtgtacgccgtggaggccaccaatatggcggagcacgcgcgcgagctcgcgcgggctaacgacgtcgccgacatcgtcgaggtgatacaggggtccatggaggacgttgtgttgccagagaaaggtgattctctctttttttttattcctcgattggttgttattagtctctgaaaataagggggaattgatgtggctggtggtaattatattcgatctcttgcgaacgaaacatagcttaagaatttgtttcctaaggagaggaaaagttataaagaatttaatggaaacaagaggttaccataatgtgtgttgagtattgattgctttgtttctgtatatctttggaacggcagttgatgtcattatatcggagtggatgggctactttctattgagggaatcgatgtttgattctgtcatttgtgcgcgtgatcgttggttgaagccagacggtgtaatgtaagtctatttatacttctattcatgctaatatagacagaatttttgaatgttgcacacactcttcattctctggaaagcaaaccgtggtagttagttagttagttatccaatatctttgattacattagcaaatacggtcttgtcatttttctggaagatggcaataacctctcaattctgttgttggttcaatgaaatatctgtttcactttcagccaatgtaaaatcaattttggttgcaggtatcccagtcatgctcggatgtggctagcaccaataaggagtgatctggctgaaaataagatggaagatcttgagattgctatgcatgactggaatctatttgttgaggataccgagtcttattatggggtcaacatgaatgttttgacaaaggcataccgtgcagaacatgaaaaatactatcttaaggtatgcctgaatctgtacaaagactggcatgtttgatttaatcttttgtattgcatgtgctgtctgcaagaaaaatgcaatttaaacaatcttataaatatacttgttaagcaagaatccattcatgataagataaataccaaggtgcttgcagcacatatttgattagtatagttcattacttattttattctgtatgtaatataggatccattagtatctctggattacttgttctggttgttcctaaggtctcagcaaaaatagtagtgaatgcacattttcctgcaagctcagtgtacatttggttgtattcttctgcagtctgccatatggaataatcttcatccaaaccaagttatagggcaagctgctgttattaaggaaattgattgcttgacagcaacggttgatgagattcgagaagttcgagcacaggttacaatgccaatcaagctggatatgacaagattagcagctcttgctggatggtttgatgttcattttcgagtatgtcaaactgaactggcacttaatttatctcatgattcagtgagatatgctcactattttctctttaactctttctagggtagtaagcaaaaccctgcaactcaagaagttgagttaagcacagctcctgatgtgaatggtggcactcactggggccagcaggttggtttcctggaattaagctattgtattttataactgcagaaatttgttaccagctagtccataatttgaaatgtatgtattgttctttttaatgtgtgagtgttgatatgtaaagaagaaatcatgtaaagagggaagctccagtctctcttttatttacaattaattgtaaggacaaacagatttcaaaacctttcatgcaaaactgatacttagataaagagcaatatctttatttgaatggcacatgtttatgtataagggcttttattcaaaacaataatttctttcaattgattgtcattatggaaatgcatatcatagaccatagttatctggcacaattcacacatatttactattgctctgattcttttcaaggtattcttgctgactccgcctctgaaagtaaacgaaggggacaatgttaaagtttctttcacaatggttcgctcaaaagagaatcatcggctcatggatatggagttcacatatgaattgcatgagtcatctggcaagcagcttcccgcaatcacaaccaagatttacttagaatagagcaaggtttggttcctaagactacaatgtgtttatgcatttttctttctttattttcaaagtcagataatatgccaacatataaactgtagtgggcactaatagtcatcttaatacccgccacgcaatgctttatttcagtgctttctgtaacaataagaattcaacctaacctggtccttttttttgttgctgtcattacagaacgctgactggatctgattcaattgatgaaaagattgtgtactggctaccatgtctgaaccttgcttgatagttggagccaagctgaactcctccctggtgtatttggtttttaatagagggcctaatggccacattgtgtaatactacccagaatatgtacaccgaggctgtgttgtgtgaggcatgataaaagtgccagagattttgttgtatcagtaattcatcgctcgattggttaattggcttcatgattgctgtcatatgcccatgtgtgctcagtctcaaagtcaaacacctttctcaacattttacaggagtagttgatgctcccagtttgagagggctcagtaatgataaatttgctgttttctgaagaagtcaacagcctgaaggatttgatttagccgttcattcacagttcacacccaatttcaacattttatgatctcattcagagaggattcactgcatccaaagttctgaagggttactcgattacaatttagacacagctctctcttcacttggagtcatacacacacacacacagcacatttattcctcgagtatttacatcagcaagatgattatccccttcctgttacaagcacttgatagggtttaacataatcatcatcaaaacagggtttatagtatgtacagcccccatgaacagattacagtaagcatctggagcacagataaaaacttgcaagctctttcagtggtgcacacaggctgtatctgccatggcaatctcagtttcctctgaaagactgaagaatatccatgaaacagcaatttggctgtcttctaccagctcaaacttgctgcacaacttttcattcttttctagctcatttttccttcttacttcatcaacaaaagtgcgtctcggtgtcgccctaaaagggtcagtgcggttgctgcgatgtgatgagcagtcaacccagccatgtcgagctgctctgtgagcgaagcgtgttcgatgtacctgtctggtagtacaatgggtcgccactgcaagttaacagaaagtcactgtttgaaattatcatttatacaaaacatgaatggagcacaaggcaagtggcatattgcaatacaaaagggtgaagctccattgcaacttgcaagaatattggatggatttatactagataacaggagttaaaatccgtgtaagagtttaaattcttacctttattttgccatcaagcaacccatcgagtgaaataaattgcgagacgtgtgagccaaaaccaccaaccgttccttcttccacggtgattaggaaatcgtgttgctggcacaacattcttatcagatcaatgtcaagtggcttgcaaaatctcgcattagcaacagttgcctggatgccaaagttgaacagaagagatcgagctatcaagcatctttggaccacatcaccataaccaagaaaagctatctctttcccctcagcaagaatctctcctttaccaatctgaaagagagtccccaaaactaataagaacagcatgcaaaatgtttaagcgcacaaaggtattgccagcttgtttttttcagttcaccaaagaacaccagcttttaggtgggcatgaatcccagcattagcgtaactgatagctttcaagctgtactattttccaagtgacttctgcttagaatcaaaaaaagaaattgaagtagagctacctcaagtggattcccatatgctaaagtgccactagtcccaacgatggcacccttgggataccggaagcaaatgggtctgtcctcaaccattgcagctgttgccaccatgtcaataagttcatcctcattagatggtgacatgacgatcatgtttggcaggcatgacatgaatgtaatatcaaatggtcctgagttagtcgggccttcagatcccaccagacctgcacttgtgattgcaaagcgaactggtatcttttgcatgtccacatcttcgactatctggcatatatgtgagctttatcaaatgcgaagtacttgcagtaaagcagccatacagattaagtggagctttagtctatagcccactattacagaaactatgcttgtttcaactattttattgtagtacatgaaaatttggaacatggcttaca

SEQ ID NO: 39290 - DNA, 7782 bp, Oryza sativa
tcattatatgtctagaaagaccattttctaaaaactttagaatgtcttggcttgagtctggaggccctgttagcagagaaaaaagttaataaattatagattcattttagtatcctatatgatttgattgtgcaaagacatgtaggaaggatctcaaaggatagttgacttatacatgtaatatttaacataactgatatgtgaaaccttaaagttcctgaatgttgtgaattgtgaatgattctacaggtgagaaccgattcacatatttcatttgaaatttcagtagtgtgttctatcatttttcaaacaaatacaacattcacatgcatattgccactcaaacaaatccttatcgcgctgtttccttcctcaaattcatgctgtggtgcttcacttatctctctgtattaatatcaaagcaagacatccagaatgtaaaatgagaaaacagagaaagcagaatgtacgctatcatattcataggattgcagaaaatttcgttgacaatttgtaattgcacaccttcctcgtcgggagtaatctcactattaaattctccacctgagtctttttcattctcagtgattacatgcacaagtactgggccggtagaatctagagtagaaacctccttgagtacacaaatgagatcatcaatgttattcccatcaataggcccaatataatataatccaagttcttcaaaaagagttgctccatgaggacctatcataccacgggcatactcatcaattttggcagcaaattcatgcatccctttaccaaaccatttggaaagtccctagaaaggaaacaaaattcgtatcaaagcaggaaactcaaggcagtgcaagactgttgttattaagaaagtagaaagacaacccatgccaaaacttcctggaaatttttcatcataatatgtacagcagcaagtcaattagcaggcttttataacaataagttgaaagtaacaagtacatttgtcactaccagataaaaaagagaactgaaaagaaacaatcaactagaaactatatgtctatactataatcataatcaggaaataacaggacagttaaaaaaaactatgttttattagcaagttcaaatctagtacattatgtcatacagaagcataaagttttacctttgcagcctccctaaactttctaaatcctttgctggattgaaccttgctcagagcactagagagggcattaatagacatctttgattggctatctgctttaggaagcaaggtgtgccggctgtcatttaaaatcactaccatgttagaatcaaggaaaccggcatgacccattgcctcatacacctgaccagccatagttgtccagttacttataactgttactattcggtttttcctcccacctagatcccttgcgactgccatccctgacaagagatcattttcaagctataaacgaataaaaggaaatcatttgacataaaagaataaaacatcaggagattcatgattaaatgtagaaacatacttaggattctaatagactatgcaaacttctataatgattattaactccattagcaaaataagatagtttaagaatttcatatcatgactgctgataccacaccagaaggatatgaacttgaatacatcagaacttatattatatttcttgaattatattttgagtcgtacatcccggcactgtataccttggtttaaaaagcaagaagcactgtttttctctgtttcaggtagctgaactattgataaaatgcatggaagctaatcggagtcgaagatgaaaaaaactatggaatattgtacggattccaaacacaatgaaatcaatatcttaaggaaatccatttaaatagaaggagaggtctaacaacaaagcaagcagttcttgaagtgcaaggcatgaattaatgtattaacatttaacagaggcaacactatatataccaaggcctgcggagagactattgcatccatgtcctgcaccaaagggatcatattcgctctcgaaacgggatgtgaaacctgaaagcccctttctttgcttaatagtatgaaagagtgagcgccttcctgtgagaatcttgtgtgcatatgtctgcagatgagaaaaaatattgaacacaaaaggtaaaacatttccgattatatgaaatggtatatgatagcttactggaggcaaaatcttagcacaaaacaaaaagatagagggatcatacatgctgaccagcatcccataatatcttatccattggggcattgaagacataatgtatagcaatagcgagctccacaacagaatgtccagtgttacatggttggcatttcctcgacattatgaaagatatctccgatcgaacttcaccagctagttgctttaactcctgtctttcaatgggaattgtcaaaaattcctcagccataacatagttagagagtatgctactatgcttaagatagtatgactgacgaccttactagatagatttttcaaatggatgggtgcatcgatcgttccaggattggagttggatccttctcccaaaagaaatcatcgacatctggcagcgcagccactcttctattgaagcgctgtacaaaaagagagaacattcaccatctgtgagtatgagactacaaagttcagagtccttctccggccacaaatgtatccctagtgaaatagttatcaaattctggcaggctgcgactaaagctcacacaatgtacttcattcttttattctttgtgggactaaatatctaccctgaagctaaaatgttagccttgtctgcacagtgtactgcagatatggagaaagaacatacccttgatggcatattgaacaccagtgttcgacatggcttcaaattcgatgttttgcatctcaaacacagacaagagtggagacagcaacttgttgagcgcacaaaagttgattcctcacagattaaattaacagcaggtggagaatgcagatatctcccacccatcctgcgcaaggagtgacgaccaaaagcctgaaatttacagtattctttagcctgtgagaaacttattttttttctaaaaataaacatggagagatcactggatcctaaattcatcataaacaattatccacatatgttttcagtgttctagatgaagatgagcacacaatcaagtatcagtccttggaatgacaccacaccaagaatcagctacaaacagcaaactcatctatccatccagggacagctaaaatggagaatcagacggccaaaatccgtaatccccaatttacaccacaggcaaccagcttccactagaaaccgaaatagccgcggggggcaaaagaaaaccaagaacccatctaccgttacctcctctcctccttcaaaccggccacccgccgccgccgcacgcgcaggatcggcggcgagggagccggaggcggctcagcgtgagggggcgctgctgctcgcgagtggcagcagcagcaaccctagctccggtttgggatttgggacgcggagtgctcctctgcgctcttgacatgacagattagttaggcattaatccgagcagaaaaggggacgatgattaatttgacagaggattagctactaaactaatcacgtctctcctaatcattcattattcggttaacttgttcgtccgtactcgcggggcccaactgccagtggcactggagtggtttgctcgggtaaatttacgagattgcccctgggatgagatagagacgaagtgaaaaagaaaaaagcttcgattttttcttttgcagaggtggtggatagatagcgcggcagaggaaagaggagaagaaaagatggcggctttcgcctccgctctccgcgttctcccctcgccgccggctgcggtgcctcgtcggcttcgctcggtgagctcctcgtcgcgaaacccatggataccttcttcttctttctgccccttgctcgtgcgctcgctggaagctttctcatttggcgagctgccttgttcttcgatttgtgacttgagatttgataaaagggataggaaggggaagggagacactggcatttcaaagagttagacgtttggaattcgagggcattgcaggttttttccttgcagattttaggatagtgcgaatttgaggactttaaatcgattaataattgattatgagtggcactataatcttttgtaccatattattatcggtctcaaacatgacaccgctaaagatcatgtgtgtctgtgatgttacaaatcaatatactatttgataagttagtgatcctttatggtggatattcagcttttgtgagtaatttttcaagccctagttttttaagaacaggtttgtataggtggtgggtctatgtagtgtcatataatctcattgtagttagacaagatcgtttctctatgttgttggtattcaccacggtaagtcagccacgtctcatttttcttccatcttccactgtgcatatgcagtgtaagatgtttaatgtttctttgtgttaaatttggtgaactgtgccagtttccatgataatccgtgtcatgcttgcgtagtgctcaagcaatgctaaagagagcttaggattgtgtgtatcacgctgacactgggcttagcaaccaatgttctattgtgaagttggaatgacattacaagctttgaagattgtacctcagcttttgtaattctacgggcccttgactatgatgtttagtgctggttgcaatctttacgccttctgtttgttgcagagagaacaaaggcagggctgtagatctcgaaggtattcaaaagtcgtggcttactacgctctcactactccgccgtataaacttgtatgttctcctcacctgttaatattgcctcgacagattacattctgccatttaaaaggaaaagattttaacttatagcttgtcctatggtgtccaggatgccctggaaccttatattagcaagaggacagttgaacttcactggggtaagcatcagcaagactatgtggatagcttgaataagcagcttgctaccagcatgttctatgggtacactctggaggaactaataaaagaagcatacaacaacggcaacccattaccagaatataataatgcagcacaggtaatgttgttattatttggcttttttcccccattagttggatattttatttgtacccatcaaattttcatcctgatagcttcagtgtacatgtttaattgttgcacataactgaaagcctgaaaaaaggatgagcagtaggcttattatggttctaattttcaatcttctgaaatacaggtatggaaccatcacttcttctgggaatcaatgcagccagaaggtggtgggtcaccagggcgaggtgtcctgcagcagatagagaaggattttggctcttttactaattttagggaagagtttatacgctcagcattatcacttttggggtctggctgggtttggcttgtctgtaagttttttattttcattttctttgaagttcagcctgtacaggcactgttggttcaatctgacttcctgaaatgttgtttctacaatctaaatttagtttttaaagtctgatttatacacgtctggtctatcttttgcttgtttcagtgaagagaaaagaacgaaaattttcggtagtccatacacaaaatgccatcagtccacttgcacttggtgatattgtatgttttctcatttccttttgaaatgtttagaataatagcatcccaagtataaacctttgtgatgacattccatgccctcttctcttgcagccactcatcaatctagacttgtgggaggtaaggaaatgacactgcgtttagatattacattatgctaaatattgacatatctacttttgtgtttcagcatgcttactacttggattacaaggtattttctagatcctctttttcttcttatacctaaaattgtaattcaccaagtactaagctatcataaatcactggtgatgcttccttttgatgcttcaggatgacaggcgaatgtatgttacaaactttatcgaccatcttgtctcttgggatactgtcactctacgcatgatgcgcgctgaggcttttgtgaaccttggtgaaccaaatatcccagttgcatgatatgagatgatatggatatgacctagagatatctatgcatgtattctcatcatgaggtaaaatccagcattttgcaacatcatatctggtacatatgcagcttaattatgtagttcatcattcagtatatatacaaaaagaaactagagaatcattcagtttttggtgatgacttattttcaactatgacgcatcttcagcattagcaatgccagaaatcatgctcctaggacattatcttataacacaaaaaagttttctcttgaaaaacagcacgtgaggcaatcaatcaaatatcgggattgagatttaaacacatgctgctgggagtatcagggagcatgtcgcttgatgctgttgcttcggctgggttaagaaacagaatcaagtgccctcaaagaaacagaaatcgacaatacatgatagcatcttatgacgaattagattgaagaccgtagcagacaagtcagtaaaatttggttgcacaatcgaatctgattattagattgtgcactaatgagtatgaagagcttagtgttaattacttcattgtgtcctcctttacagatatggtcactaaagaaaggacctatacaacttgcatgcaggccgctttaagaaaatagctaatttgtaactgcacttccactaatacttatggtcttatgcacttaacttaatcgaccactcactatgaaactcttagtgaggtatttttcttgagcaagaatgaagttctattactcctttgatcctttcaataattcgtccattttacttatatatgtagagtcctagttcttttgcaaggtttcctaggactttgaagttgtcagtgaactggttccctgtgaaacttttagtcttaattagacatccacaacttcacattgatgctatattcttacaaaaaggaaaattattactaaagctttactagacctatcgctttccatgtcctacggtgagctagttgatgcaatgttcttgcatccagtatatgtcagtgcacaaccgcgtgggtccttattccccaaagtggtcctcatgtctttccttgtaaccacagacagcgacaacttttttgtttttagactctacattgttttgcttgatatgtagcaggagtagactatgctaaaatgtttttatcttgttctctccaattttcagcgacgccgaggaatttctagatcacatgatacctgatgctgagattcgcatgcatgagagacacttacaccacctcatgtcctgcacggtgaaatagtggaaatctgcttgaggataaacagctttggttttatcgtcaccttggaattttgatatagcatcaaagcaaccttgacactagagcatgattacagagtatgggccatcgatctaacttcttcttgaagctgcaccacttcttgcaaacgtttatgcttcagaactaggacccatggtcccattatgctttttagattagatcttcatcctaagtttcgacaactcatagctgtagtttttgtctttcttttggcacagaattctgtcattgttaagcctagctttgttccctctattatgtaacctgacctttatgtccccattgctcattccttttgtcg

SEQ ID NO: 39291 - DNA, 1125 bp, Oryza sativa
tactccatacaggtgatgtactatcatctgaactggagggacccagatgtcagcaagtgatgtaatttttttttgtcaaattatgaaaaattagtgctttgtttctatgctcttcagaaaaattctctgttttttctgctcattggtcctagtatctgactggataatctacttggctttttctttggaacaagaggctcatgtttgagtggtcagttctgataggctggaataagcagagttctgcccaactgcacaaactaccaaccaactataaaagcaaacaaataattagtattaatcatctctgagttctattaaggagtggtccatggtttgtgcttgaggaacaagatcctctcttccaattaagtggcctgtccactgattaattgttcatgcaaggtcaccaaactcaccatctgcttgccatcattgctagtatcacatcatggttaagtagtattattaacatgaacaaaaggttctgtttgatggccccagattttcttgtcttgtccaaattaatctgaacgcaaggcaggtactgtatctattaacaccaaaagtgatatatgcaggtgctttgcttaactaattaactcatgatatggtgatcctttattgctaatcaaatcgatgagttgtttgcagttgaagtagaaatgagttaaaaataaataatatcagattgtgcaagggaggaagaggagattcgacagagattagccaacagttccgaatttattccaaaacaaaaaaatgcaacttgcaagaacacgtgagaactgagaacctagaatctgaattccctttcaaccaggtctcaagaacaaacgccttgaagtggcacgataaagttcatctcatagtgaaattcaaacaactagtaagtagtaaaaattaatgttgatattaatttagcaggttaattactgcaactgatcaggggaggaagaagagatgaactgaccatgcgtagaggcagcccttctcctcatccgcttggtgcagtgatcgtagtaggacatgtcctgctgcgccggagggttgtacatcttggctagcttctcctcttcgatcgatcaggccaaccaagaatgatctctcttttgatacaaatct

SEQ ID NO: 39292 - DNA, 14141 bp, Oryza sativa
tacttacaccaactacttcggttcacctaatcttgtttgccgatgatgatgacatttggatatattgagataattaatcaagtcatcaatgctcactactgtgtttgatatatgtaagatgattcatgcgtcattgagttctttctgaagtttaaaatgggctgtgcagtacattatttactgtgtatgacctgtgagattaattgaaggtttactaggaaaagaagataggtgtgcttatcagattgcttggcttaactgttgggcacttaatatgcatggattgagcaaaagcaaatgtaagccaaagttactacaaggttttcacagcacctctgcagactgcagtattcttatagtaccatcctaactaaccacaggagcttaatacagatattagaaatgcattttagaggtatttttttagaaaaggaaaatacttcagaatttttgtagtatttgtatcatatacataacaccagacatacatattattagtttaatgctgacttgtataaaattatgggcgtcttatattttagaataaagaataaaggagtaattaattagttcgcatatgctcattgtgtcaaaaaaaagacttaattttttgccatttcatggaaatttagtagtgagaagaaataatcaaaatacccttgctaacaaaaaaaatagtattgctaactagtcagatatataagatatatcgaagggataacactctttagtgattgtcgatcgatttgtcaattgatagtagataagcaagagactataaattattttttaaaataaattttgaaggttggaaacctttttatttttttaaaaaaataaaagaacggatggagtactacatactcctatacacacatatatatttccttggtggctaagagtctactctacatacacaagtgtatgacaagtggatggaatatggctatgactattacgtctcattccgtgtctggatttgtcatttgctgactattaggagacgacgtttcgttctatgtctatgtatgcatcttaatttctttcttgggatttttctcagtcactgttgatatagacaagcaaactcattcttgaccaaacttacgcatgcaatgcaatgccatcagagtcaagaatattataatgtcgcacacgtacgtactccctccgtttcagatcaaacgaaatgcgacgtatcctaatataataaattttgatagatgtatgtttaaatttatagtattagaatgagttatatcccgtattagatttgtttattttgagactcagatcaaacgaaatgcgacgtatcctaatataataaattttgatagatgtatgtttaaatttatagtattagaatgagttatatcccgtattagatttgtttattttgagacagagcgagaacacactcatgtataatcagctagcgtataaatcacggcattgttttggttgttagtgacttaattagcatggaaatggaaatgcacactcttagtgtaattggcaggatacgcacggtggtcaagaagagagaaacatcgtagacttgtagtcgagtatataaaggcgtttggtgggttctaaactccaactttcaaatctaaactttaattttagtgagagctaactcctataagaactgagatgagtataaaaagtgtttagctagattactcagttccacgctaccacatccctcgtcgcatttcgtcgaacatcttgttggcgtcaccctgccgttgccgccgccgttcagcccgcgcgctgcgccgccgggcagcccacaagccgcagccgatcagcttgcgagctaggctgccacctgtcaacaccgctgcccgcacgccgccgccgatgccatctccttgctgccctcggcaccacatgccgccgcccgccgtcaccgcctgccaccgatgctgcgacccacccgccgctcgccgccactacatgccgccgccggccgtcggtaggaggatggggaggagagagaacgggaggagagagggtagcaagaggtagttcagtggcattttgtgtgaatacactaaaaaaattaaagggcagtggatcttttgaggtagagtggagctgtgaaacagaaaaaactcggctccatacaaatttatgaagcagctatactaactccgctccaaaataataaagaaactgtaccatttgcctaaaacctgaagcagagctggcaggccacagagaaaggcaaggtgcgtgcgtgggctggcccagaagagtggccagtgggcttaggcgctgtggcccatggttggcccgtaggttgggctgggatttctggcccaacaaaactaaactgaagttcccactcttctcttctcttctatgaaaatgaaaatattccatgaaaatacaaataaaggtaggacatataaaaaaatcattaacacatgaccaattaagttttaattattataattttaaaaatagatttgtttgatatttttaaaacaacttttatatacagaaagttttcacacgaaacagtgttaaccaaagttgaaataaaattaatatgtatttaatcataaaaaataccatccatatataaatcaaagagagagagagagagacgggcagatggctgctatcggaggcttggagcagctagcctgggtgttcgtccaaaaaaaatagtttttgggatgaatcgaaacaagaacccatccacagattcattcttaaaaattgttttttttttctgaaactggggtgtaattccaagcatatattgatgctgtaacggctgcagggatcgatgacgacgatgttgggtgtgatctcgttaactccggccgttgtttgcgcgcgcccccaaagagatttgtctgatgcacagtcgatcacacacgctgacatgcaacacttcctctcttggaacttcactccagtttaccggcatcatactacaagtattataatgcagatggagtagtaagtatatgctctccctctggttccatattaattaacgttttagacaaggttaacgttaaacttttataatttttatttttaaaggaactaaaacaacgtatatagatttgtcttttaaagcattataataaaagtaagcatgcatttatttattatatattataatagaaaaataagttcaaaaatatatctcgtagaccgtatcattatttaaaatgtcaattaaaataaaaccagagggactatagcagatgcttccagcagctagccagccttcctgatcgacttcttttcacagcagcaaaactgacctgatattcaatcaattttgagtagacgacgatagatatatatattatatataccgtatgatgcatagttaggttttgattcgacctccatagccgtaaaaaactatgcgatcgatcgatcaattacgtgcttaagtacaaaatacagtactatactgactcatcagtatcattcgcactatatatgttaaattttcctgctaaagtacgaattgatcctcttcatttacatcgatcgatgcagagttctaagttctaactagaaaaaccgtgtggctttgccgcgcatggtaaagtgaacccagctcattcgactttagtgaagtaactaattagggcccctttacttgaaagaaaaatatagaaaaatataagaacttttattctatatagaaacaataaattttgctatagaaatttttttatatgattctttgaaccaaaggattattaaaaactattgagtcttatcaaatttctaaggaatgcccaaattcatacaagttttggagtatttttaatataaggtccaatatcacgcgaagtctcttatgagtttatctctctcatctaattcttgcatttttcgtacggtccaatcaaatgattattttatatattattttatgtgttttataattctttgttttgcgcttgattttttgtcagaattctatgtttttcctattcatccctcaatctttgtttcaaagtagcccttacaagacatatataggttgcatttgaccgagggagaaaagagaaggggacaattttgctagtacaattgtacccctactttgatgtcaaataccgattttatcctacattttagggttgttattttttgccctatttttttcaaacgaatgaggcgtttacccctgtttttgatggaagtgagtgggattggacttaatgcggtaaagaattagagaaagaaagagataacgattttttaaattatcgattgacccttttacccctagaaaatatccaagtaccgcttggtgtccctccaggcttgagcacttggcatcgactcttcccttcatgaacccaaatccccgttgtgaagcagtggcggcagtgtccctgggccggccggctaggcaatgggcacgacccgagcaagtgcaggccacccaacccagttgcagcgtgcatgaggaggctaggcattgcgcaaagaggccatggtagagaggaggacaatggtggctgctgtagctcagcgtagggaggaggtgcggctgctcgacgtgtcgaggaggcgatggggaggaggacaacaggtcaacggcggtggtggtggctcgatgagagaaggcgacaacggcagctagcgcggggaggtgatggtggcggctcgacgtggggaggaggcggcggcggctcagtgagaagaggaggcaacaacggtggcggcggtttgtgagaggaggcgacgatgacagcttggcacaggtaggcaatagatttgcttgacttgtctatttgtttttttcaagatatcaaattttgaagcaaatttttattgatgtttatgttaaaattatcatgttggtaaaagtttatcgaatttgcaaggttcatgtgctaaatgtgggcaaattcttaatcatgaacaaaaacaggggaagtttgcaacatgagtaagggtattgaatgccttctcgctaaagatttaatattgttaatctgcccatcaaaagtagaggcaaaatttatctttatttaaaaaaccatgggcaaaaacaaaaccctaaaatactgggcaacatcaatattgaacatcaaagtaggggtaagaatgaaattgccctaaagagaaaagattctatgatttccgtagaggaaaacacaggaaagaaataatataaatcacatgaatacggacacaaaataaggaaacacaggaactgcaaaaggatggatgtttgcagcgtaggaattttagtgggtgatttgattacatcctgttaatcctcttttagtctgatcaaagtatgtatcattatttctttagttctcaatatccggtggtaggaggaagcaatagcttcctgagctttgccagccgtacggcggcaacgcgagaaatcacatagactgctgtgcccccatggacctaattgctcgatcaatagaaacttctggacgaccttctggacaaccgctgcacgcacgcacacgagcgtttcacgctgcacgcgcacaagcaggatcgagccatcccgcgaaaccggtgttgccacgtggcacaattcttctttcaattttttgcatgaaattcgtattataagataagattaacatctcactaactccattttacgtcgtggtccgggcatatacgtagtacgatccgtcaaattatatgtgccagcaatatatgtttattacgcggccttgatgtgtccatggaaattaacgaccggtcgaggacactgcaaggcagctagtgagtgagactagttcgtaaagaacagtagtactgatgaacgaaattaacgacgaggaattaattcaaagctagcaaagcaaacatctccgtccgttgctgtaattaaattaaccgcgtgatcatactgcaccacagcacatccgtgagcagtactccctccgatacatttcatattataagttatttaatttttttaatcaaatttctttaaatttaactaagtttataacaaaatataataatattttcaaatattgtgtcaaaatatattcaatgttaaatttaacaaaactaatttggcatcatagatgctgctaattttctctataatagtcaaatctaaaaaagtttaactgtggaaatatcaaacaacttataatacgaaacatatagagtataactgattaaagtctctactaagcttaatgcttcctccgtagtaaaatattactcactctttttctaattaatcatcatattacataagtacactaagatgaacgaaaatcaattattctcacgtgctacttttactcagtaataaatttaatatatgcactatccccactattttctaaccaataaccaatcaaaatattgtattgcaggttagttggttgtaaagagttaggtgtatgatgcatgtatttattaatattcatttactctgatacacggataacgaataaacttaaggatatatactaatatatattgatcatttataaataaccttaaaagttatatgatgattaatttgagaattgggagattacatagttttagcttaagaacttatcacacaaatactataattttagagtgggatttactatacctatttactagtactttttttccttcttgtttcagccgtcgaatcagtagtacaccatatccttctccttattttctctctattttctatatctgactagcattttagggatggagggattacgtactggcactgtaattaataaatcatgtataacgagttagttatgacttcaagtatatgtatgtccatatccaaccaaagtagctagcagctagtagacaggtgaacacaagaaagctacgtactagtagcaaataattcatcatatgatgatcgactagtaattaattaattaagcaataatgctcggttcttgtctatatatatatatatatatatatatatatatatatatatatatatatatatatatatatatatatatatatatatattcaattttgatccatccatcgatcacctagtttgaccagagctgcttatactgcttacgccaatttggattaattattttaactttttaaattctttcagagatgatggccttcctagttggacttgatctaatgcaaactgtccattctgtacaccaaatcatctactagtcttaaattaattagctaatagcttagcttgttcttagcctcactgcaaggacctaattaaagaatagctagctttattgtccaggaagtcacgcctgcatatatatgtacctttcaacgtttttgatcaattcatagcaggaattgatgcgaacacgaacaattcaaactggcctgaccggaattcatttcgaattgtcaatgttggtacgtagccgaaatgaattgacttccgtagcaacaaagaaaatgagaagaaagtcttgtgttaggccaaagcaaaaatatttatttattttttgacctccgtttctgaccctaaaatggcagaaaaattaaagctctgcaaaattttatcttgcagcgagattgactgtcaagaccttggagctagtggatccgtctctctccgggtttaggcgtttagggctcttttgaattggaggagattcataggactttttcaaaaaaaaaaagagataaagagattcgtaggaattttaattgtaagaattcatttcaactgtcaatgttagtacgtggccgaaatgaattgacttgtgtagcaacaactacaatgagaagaaagtcttctgttaggccaaggcttgtggacctccatttctgaccccaaaaatgacagaaaaagctctgaaaattttcatcttgcgccgagcatgaccgtcaagaccatatggtgtctgtctccaggcttacaatttcggttctggatctccaaaatttcgtgtttaccggtggctccaagtaggaggttcttccgaccgaatttgtaaaatttttgaacttagcaaaaaaataaaaataaaatcaaatttaacaaagtttcttaaaaaaatgatactatttatttataattttaaaaactttcaaagttgtttggtgagcaactgtgcggtggggccaccggcacagaggcatgcacgtggccacggccggtgaagagaacaccctggcagaatggctgggtttctcgaagctaccaccgtttcccaaactacccctctgcctcctcacccacgaatctgaaaccgtcagtgtcatcagcagcagctagcctaaagataatactgttgtgtggcaaaatggcgtcagttcttcctccatcacgtccagctgcctgcctcggaacagcaaacctgatttgcatagctcaatctgagggcaacagacaacagctagctggctattctctgaattttctttgagagagtacagtactcctactccatagaagtttcatcgaagggttattttaatttgtaggaaaaggtatatgaaatttagataattgtagttctatggaaaaaacatcgtatgaaagcttttgaaataaaggattaaatcatatcatttccttttaaaattcttatggaatagataattctacatagattttagaggaaaattagcaagaggtctaaccttttttttaaaaaaaatcatttgagtctatctctctcacctgattcatacgtttttcctgtggttcaattaaacgatcattcctatggatatttctgtatttttcaatcttctgttttacttttatattcctatttaaatcatgtgttttttctattcctccgtttttttacattcctgtgattcaaatgaggccttaaaattctgaatctttgtgaacttcaaattcttgagttactccctccgtcccagaaaaagataaaccctaaattttcgtgttcaactttgactgtccgtcttatatgaaatttttttataattcgtatttttattgttgttagatgataaaacatgattaatactttgtgcgtgacttgtctttttaattttttttataatttttttaaataagacggacggtcaaacgttgggcacggaaatcagggtttgtctttttttgggacggagggagtactccattcaagttccattatcagggtacagtacacatgtgaaatctatgctctctgaacattctggagatactcgattgaagtttcaattttcaaaatttctgaactttctgaaactatagctttcagaggttgggaagattcaggggcacacgtgaagatgtggcgtacatcgatgcaaatgtcgtttgataccggtaggtgtacagggcatctcaaatagagaacggtaggtgtacagaagccataccataccataccatgcagagtttgtacgtatacatgtattcaagagaggatagctagtgatgttggggtggcatgcgtccagaagtacaaggatggcaaatggccgaatgcgtgttttgcgtgcacaacatgtggcatcacacattaaacaatgcttatctgctaattgtgctatcattggtaaattgcatgcgatggatccggagagaagaaagggatggttggggtcatgagggaaaattttccttccttttcgaaagaactgttgaaaacactgaacttaacgatgcatacaagaagaaaaatgacataaaaataagcctattcaactgaatttctactgtagctaccatctttttcagtacttctagtttgttcgagcaaagtgaataaattgttgttaactattccaaccaaaatctattacatttagggacggagggagtactctattcattctaaaatataaacatttttagatctaaatttataccataatataaacatctttggtagcactatgcacgaaaatatgtacatttttcagtcactgagatgtttgaaaagagaattgaagcaattcaaatcttaacaattgaagtaactaaaatagaatatttttctccaccttagttttagtgaagaatataaaaataaaacagagggagtagtgcttaccaccttcagttaaatttattgtcgttttggacacttaattttttccttataatttatttgtccaaaacatcaattgattttgtctggaggaagtagtagtaattgatgcagtgagctgcctaactctattaaaaaacactcgctttctgaaccttacagaaatttcgctggccatgcacataatcttctctttgtcaaagagctggaatccaaaatgattgctcgaagatttcgtgaagatagatagaaccatcggctagcaaaggagaggaaataaaaaaacaaaaaaaaagtttttttgtgggctccaccttgcgctgcactgagctgaccaaattgaccataccgcacagagactgagggaggggcacttccgtcatttcgtataagcgtatacgaatacgtatctcatacgcgctctgtatatatagacggtaacggctccgcgtcgtgtgagttggcgagcccgaggagcggaggcggccacaagtctaatccgcgtcgtctgcgcgttcgtgggcgaggaggagaaagaagaggaggaagagagggaagggggcttgatttgatttgggcgcgtctcgtggagtatccggtgagttcttggcgatctggcgaggcgagtgatgagtgattcctgctgctgctgggggattttggcgtgattttcgttggttgcattttgtttctttttttttgtatcgatttgttggagctttattcggtagatctggtcgattccatggtgagttgtatcggcgccggagtgatagctgattctgtttttttgtgtgattttttttttgttttggaaatagggtttgtgtcgaattgagggcattttttttccttaggcaatgcaggatttcgttttgtatgtttttgcgtggaatggatatgaacagacctcgaacaaatggaagaatttgtattttgtatgatggattgcaatgcgatacttgttttggggcgtgattcgattgaaataaatgaaatattagagttattttgggattcctgtttgctgcgcctttttttttagcatttcttgatatgaacaagagaagaagggctgaatttttttcttagctttggaggcatttactgtcccagtattttctcctaccggaagcagaatattttgtttgattggagggttgcctccctttgccaaattgaatcaaatgttctcggatgttttaaaatttccgtggactctttttgccccaggggagaccgcttttagcagctggatcccgtgttttcatttcaagttcttgttttcctagtctccatatatttctgattgttaactcgtattctctacctcacatatgcaaaatcacacttgcgtcgttctgtaattagttagattctgcaagaaaaatccggaattttcaagcatgctagtagttttaaattgatgccatgttttttagacaatgttaattgatgccatatgactataggacacattatattgcgtttctgaatataccacctcatgaaactcataattttgttgattaattgttcaggttgccccttctagtgtgtaacttggagcaaatttggaccctgagacgcaaatcagtcatggctggttctcttgcggcgtctgcattcttccctgtcccagggtcttcccctgcagcttcggctagaagctctaagaacacaaccggtgaattgccagagaatttgagtgtccgcggaatcgtcgcgaagcctaatccgtctccaggggccatgcaagtcaaggcgcaggcgcaagcccttcctaaggttaatggaaccaaggttaacctgaagactacaagcccagacaaggaggatataataccgtacactgctccgaagacattctataaccaattgccagactggagcatgcttcttgcagctgtcacgaccattttcctggcagctgagaagcagtggactctgcttgactggaagccgaagaagcctgacatgctggctgacacattcggctttggtaggatcatccaagacgggctggtgtttaggcaaaacttcttgattcggtcctacgagattggtgctgatcgtacagcttctattgagacattaatgaatcatttacaggtgatacaatggagctatgctgctttagcttttcttccgtatttttcactattggtacattatgttcgtggcatactaactgtaatttgaagctttgcaggaaacagctctgaaccatgtgaaaactgctggtctcttaggtgatggttttggtgctacgccggagatgagcaaacggaacttaatatgggttgtcagcaaaattcagcttcttgttgagcgatacccatcatggtactttttctgcaatccactactctccacatcattttcttggatggcaaaacttctctttttactcttaattcataacatttctttcattcttaatggagtacttttgtccccggtgcatttagtgtcacaatttaatgtttacatggtacgggaaagatttatcactcaatatccacggtgtaatgtttttagctaaactcaatatccacggtgtaatgtttttagctaaacttgtcttcagtccttttttcctttttccctatgtttgtgtgctgtggcattcgatggatcatcgagactctgagtagacgtagattcttgcattccttatgcgacatgaggcacatgttcgagtgtttatcaccctacatgaaaacctttccctactaagttgctgcttctattgttctgcagatataagcaatatttttgcctatttttcctgtgctttgaacttctcgtaggttcatggcccacaacctttagcaggcatagtgccttgaaatggagtattacactcaaaagcataacaataacatgtattgccttgtatgataagatgagtgatagatcttttgaaatcatttactgaggaaaacgtttgtttatttgacaagacaatgtattgatgaactagaactgctctattaagtggtatctgccctgtgtctcctttcgtacaaattgttgcacccctgttcatgttacttctcacttttcaccatggcaggcatgtttagaaaatcatttgattttacagggcattaccatgtgaccccttaataactaacaaatatattttgggtccaccaaatctgtggtggatggaaagggaaattaataaacacaaatggaaaattcttcattgtgaaacgtgataaggacaaattttgtgaataaataaagtaacaaaaaatggctagtatttgcctacatatagagtacacctcaagagatcagaaaagttgcctttattgatggagtaattgaattagtagtaagcaataaattctgtggacctaggggacatccctgatctagatcgagttttgatctcatgctacatttaatcttccatgtcagcaactttcagtacctgctattaaatttcccctgttcttctgacgattgatgcaattttaagtttatgagaaggaaaacggtctgctgtttttgaattctgaatgtagtttacacaatttctcataggctgaaattttggttgcaaatttttaggggagatatggtccaagttgacacatgggtagctgctgctggcaaaaatggcatgcgtcgagattggcatgttcgggactacaactctggtcaaacaatcttgagggctacaaggtttgtgtttatcgtttgcatttgttgcatttcttttgtttcatgctgtttaccagcatgttttattccttttcgattgctaattgttcctctcttgtttgcagtgtttgggtgatgatgaataagaacactagaagactttcaaaaatgccagatgaagttagagctgaaataggcccgtatttcaatggccgttctgctatatcagaggagcagggtgaaaagttgcctaagccagggaccacatttgatggcgctgctaccaaacaattcacaagaaaagggcttactgtaagtcagttaatattgcttgttaccgtcattcattttgctggtggttctcatgcataaaatttctcatgagggatcctttgttcatgtcagccgaagtggagtgaccttgatgtcaaccagcatgtgaacaatgtgaagtat

SEQ ID NO: 39293 - DNA, 5182 bp, Oryza sativa
attcctgcagcctgtgaagtatattggttggatacttgaggtaacttctttttccttttctctatccgaacatgctatctctagatcagaaaagagagtgtctgatcgtaattagtaacctagttcctagtcatatgccaagctgtaaaaacacttgcactgtatattcaaaagctattcaaatttctgagtacgttttgtttttttttcctcagagtgctccaatttcgatactggagaagcacgagcttgcaagcatgaccttggattacaggaaggagtgtggccgtgacagtgtgcttcagtcgcttaccgctgtttcaggtgaatgcgatgatggcaacacagaatcctccatccagtgtgaccatctgcttcagctggagtccggagcagacattgtgaaggctcacacagagtggcgaccgaagcgagctcagggcgaggggaacatgggctttttcccagctgagagtgcatgagcgcttctgtagtttatccggcaagtaacctctttgagaagtgcagattctaacttggctagcaacacaggacaaatgattgttggtgggaaatttggcatgccgagcctgggttttgtgatgcacacagcacacattcagatttgaagattgagagatgcttcttattggcagcttgttcagaaagatgactaagcggtttgggataaaatcagctgattgggaaacattagcaggatgataagcatgactggtggtaccaatgaaaagggttgaaatcctttgcattgttcatttgttgtggagcaagagtggccgcagttgcttatcacacaggatgatggaggtgtttgtgtgaagcttattgctgaagctggattgtttttgacctgtgtttctaaaagaaaagggaaaagaagaagctgtggattgaggccggagcagcagagatattacaatcgacatagataaataagatgtaatactaatttagcccaggtggtttgtgtgtggagatgcaatccattgtagtaacagcctaacttgtacattcttgccatctttttcttattaattgaatgaatgaatcgcagacctcctgcgttttcatcaataattgaaatgacttctgcttcatcaagaattgaatgaattgtctgtctgaaaaagttgccttcttaaaagattgctttctttcttattctgttgaatcgtcctggaaacaggctatttgttgttcagaggagattgctggaaacctcttaagagcctttcttggaagaacccttgatgatctgtcgttagcacgacagctctgagctttgctcttttgctgtattttgtggttgcatggaaggtgcaactgtaaagtgccttgccttacattacattacaactatggttggagaacgtagagcgacgtgcaaacaaacggcgattaatttgtctctcctctcttttttttaacctgaatattttcgtagaaaactaggtgttgcaaaataaataaatggctaatctgagtgtttaaataaaatttgaaacggagtcagtatacagatttggctgatctgttctaagttccaatagaagatctccaaataatttctggcaccaactgcatgctgcaagcaggagcatcactcgttcggtgacgaccaaatcatcaattcatcgtgagagaaattgcataacaaactgcaagtagcataacgaacaggagtaaacaaatcaaagacccatggcaggagctacataggcagcagaatcagattcagataatgtctctgaatgaatgaatgcaaaggcaatgcagagagagctagctggcgttaggtttgcgaccgtgttgtgcagctgccacctaaaacctaagtgagcggctggaaaccaagccagccagcctaccaaccaacccaaccgccggcatgaatttggtgcgagttgtagtgacacttgtccctgaaatataaaatggatataaaagcatatgggtccccatgacagcctgacacacaacccaacctccatgttacaaaacaggtcgctggaagaagaagaagaatggaatggacgagtgatacatagaaaattttgagcgtcacatcgaacgtttgaccagatgtcggaaggggttttcggacacgaatgaaaaaactaatttcataactcgcatggaaatcgcgagacgaatttattaagcataattaatctgtcattagcacgtatgggttacagtagcatttatggctaattatggactaattaggcttaaaagattcgtctcgcgattttcatgaaaactgtgtaattagtttatcattttatctatatttaacgctctatgcatatgtccaaagattcgatgcgacgtttttgggaaaaaaaataggaactattatactcacccaattttatatgagctggggaaaagttttacccaatttcttattcgctcttgttatccttacccttatataccaataagacaatcatgcaaaacttttgatgaaaaataaagaattgtctctgaaaatcatagatactctttccatcttaaaacatctaaaattttcgtcgaaattttatcttaaaatgcagtgatttctcctgctaccttttcatctcaaccaatcacgattacaggcatgatcatcaaactgaacaattgactaaatcgagtacagtagtatctttctttcctcggtgtagctgttgcctaccggccagccgacgatggcggctagtagctagctggatgataatagctaccagtgtagatccggccatgttaatggcgatccggcgaagaggggtgcaggacatcaatcaattgcatgcctagctcttgcctggctgctgctgcattgcatgctacagctcaagtaccatcagttgacgaatgcctgctctacgcatctcaactctgcacatctccagcgaggtttcaggctttcagctagtgattacagtacacagggagtacagcacaggtccagacccaagaggggtttgctgcgtccccaactcttcatttgcacttccatttggcattttgcatatcatatcatgctattactttcagaaagtagctaggcttgctccgtttgatttagattatgagcaaattattatcacggatacttgcaagcatgtggggtgtcagtgcgattcatctcaaagattggcttagttttcaaattttggacattttaattcatggaatttgtaacgagatggcgcatttaatttactgtaccacctgtctgtatgtactgtatacaacaataggctccaaaagtccaaataatctccggccacctatctattgggctcaaccctgtaggccggtcagagcccacgtaactggaagccccttacggcccaaccaacatagccgcatgtaattcacaatccaaaatgggccgaacgtaaggcccaatcccgttattgggtcgcacataatcgaaatcgctttgcaggccaaccctccatcagcccggcccatggaaaacgccttacctgggctgctagcccgagacatctctctctcccgaattttttttatttatacattttttattaaaatatttacaaaagtaattttttgtttcgaaaatttacaaatcttaaaatcatccttccagagggcggcaagggaactaaatgcaaaatttttatttgtgttcaaaccgtttccaccggttttaattgcttaaaaactaataatgcttattcgatacttcaaatgattttaaatggaaaagtgataaactataaagttatagatctgatcaagatctacaactttcatataaggtttatctccatccaatgtcgtttgaaatgtagatctaagatttttttaaatatgttttatattttgtaacgaatatttggatatctaaaacatcttaaatgaaaaagttgttaataacaaagctgtagatctctttgagctctacaattttgatataaagttttatttcatctgactttatataatataattttaaattgtaaaatcatagagccaacaagttgtgctggaaaatttgcatttaggtcctgtgccgcactctggaaggacgatttttaaactcccaaaaaattattttggtaaattttttaataaaaaaatgtataaataaaaaaaattcctctctcactctctcgctctctctctgcttcgtagttcgaacctccgaatgctcgctgcaagcggcgaatggccgcgtcgcgctgcgcagcgcgacgggcactggcgctggcggcggcggcggcggaggcgttggagcgcgcgtgctgctcctcggacgccgccgcggtcgtctccgggaacaacaggctgatggcggagcacctgagagccggcaggctggaggccgcgcgggaggtgttcgacggaatgccgcggagggacgtcgtgtcctggaacaccatcatggccgtgcaggcgcgggcgggctcgcacgggagggccgtgggggcgttcttggagatgaggcgccaggggttccggccggaccatacctcattctccaccgcgttgtcggcctgcgcgcgcttggaggctctggagatggggaggtgcgtccatgggcttgtgttcaagtcctgctcctctggtaatgtgtttgtgggtgcttcgcttatcacgatgtatgccaactgtggggtggtcagctgcctggagcaagtgctggatggtgttgagagtccaaatgtggccttgtggaacgcgcttatatcaggccttgtgatgaaccatcgtgtaggctatgctcgcaaggcttttgatcggatgccagtgcgtaatgtggtgtcctggactgccatgataaaagggcactttacagcgcatgaggtcgacatggcgtttcagctgtttaaattgatgccggtgaagaactctgtgtcgtggtgcgtcatgattggaggttttgttacgcatgagaaattcagtgaagcagttgaattgtttaatagcttgatgatgaatggggaggaagtgacaaatgtgatcctagttaaaatagtgaatgcttttgctggcatgaaaagtattagaggaggcagatgcattcatggattggctgtgaagtctggttttgcttacgaccttgttcttgaggcttccttggttttgatgtactgcaaatcgttggacatcactgaagcacgactggagtttgataaaa

SEQ ID NO: 39294 - DNA, 1499 bp, Oryza sativa
  unsure (1)..(1499): unsure at all n locations
gctatataaatgatggaaggattgctgatgctactgagttgtactcaaagatgactgaaaagagtttggaagcagctactgctttgatgtcatggtttatagataatggaatgcttgacaaagcacgggatatgttttataatatgccccaaatagatgttatgtcttgcacaactttgctgtttggatatgtgaaaggagggcatatggatgacgcgctggaccttttccacatgatgcaaaaaaggactgttgtcacctataatgtgatgatatccggtttgttccatcaaggtaaaattactgaagcatataagctctttaatgaatctccaacacgtgattcagtgacttggagctgtttagttgctgggctcgctacaaatggtttaatccatgaagcacttcagttctacaaaaagatgctactgtctaatatacgacctagcgagtcagttgtttctagcctcataagctgtttgtcaaattattctatgatggttcatggccagcagtttcatgctacaaccattaagattggactcgattcccacttgctaatccaaaattcactcattagcctgtattgcaaatgtggcgaaatgattatagctcaaagtatttttgacctgatggctaagagagataaagtaacatggaacacgatcattcatggatatgcactcaataatcttggtcaaaatgctgttgaaatgtttgagagtatgacaaaggcacaagttgatcctngatgacatcacatttcttggtgtactttccgcatgtaatcacatgagccttttggaggaagctaaatatttcttcaatgcgatgacatgtacttatggaattttacctaatattatgcactatgcttgcatggttgatctcttttgtagaaaatgcatgattaaggaggctgaaggattagtgaagtcgatgccatttgaacctgattcagcaatatggacttctctattgagcggttgcagattgactggcaatgataagttagcagagcatgcggcgagtcaattaattgccattgatccttgtactaaaatgccttatctgcatctcatcagtgtgcatggattaaccaataaatcgactgtgattgatagtttgagaagtcaaattaaaagcactgccactgaaaaggatgttggctatagctggatttagcatcccattttgatttgcagatgtgtactacagcaatgggatttgatcatttatgcagaaaacttccaacaagcaggtaaaaaatctcacaaagtagatggatcctttggttgaggctttgataactttgatattgttctaatgagatgataaatttgtttacagtgtcattcagattgtttatgagctggttgacccaggtttatttatgagggatagaatagaacaagcatgaaagatgaatgaaatgcatctgtcgactacaacccaggttgcatattccaacttaggacttcgacagcagcaaaatggca

SEQ ID NO: 39295 - DNA, 29098 bp, Oryza sativa
  unsure (1)..(29098): unsure at all n locations
aagatcttgcacactcaccatcagaactcctttctctatcccttgctgaaggcaatgtcttccggacaggggatgagtcccttgtggatgcacggtgtggagcacgctgaccaaaggagaccgacagagaagcctttactgaaggaggccgtcgggcagtatcatctgaaccaaggcgactagagtcccctgttattcctgactgctttgttgggagcttcatcttctcaagatggccagtgacctgtctcaagatcggaagaggcactcgtggaagaagactgtcaaagtagtactgcaaaggaaaaacaggcatggacaccaagtttttaatatcatgtctcaatggtatttctcaactaaatctaccagaacaatagctcaaaaaagaaacactgaacaataacatcaaaatgatcaaccaaaatggaatgaagcaaatatagttgtgaggttaatatgctgtcttggcatgaagtagatagacgtggtgtggggctctcagtaacatgcggctctaagcctctaacatcagatgtgaagacaaactgcgatagtagaaaataaattggaatttaaaaaactgcattaaaaaactactcagttgttttgtgattgtctccggccaactgtaaacactgcttcaactcacccatgaaacattcatcacaatttgctatttgttctctgctaacttgcatggaaaatgaaatctacgaaataactacaatatcatagaagccctgactggcaataattatgaggccgaccagtaaaaggaaaaatcaaaaaagcactttcgtagttcactatttactaaaagttggggtattgctcacccgtttctgttcactatgaacctaaaaaaattataagtaactttcaattattacatgattattacacactgaacttcgttttcatttttgaaaggaaagttgattttctagattagctattccaaaatatcaagcatagacagaatatctcttgccaaagaagaaacaaatatgagacgtagtcctcaacaaatttaaacagaaaaaaacatctcaaaactaaaaaagatagcaccatagcatacatcattttcttttgttataaatccttaactagatgaaacataggaaactctagcagaaaaatggaaaataaacatttgagtaacacatcatgacaaaccttatacaaagtggttactggtggaagagatgatgtctcctcttaaagcaactccacaattgaaatttccgctcagtatgccaaaccaacaggtgagtgattcaacaaacactaattgcatttatgttcagaaaatactatgtcaatgatgtatgcccacggatgtgcttgggtaactaaaggacactgtaacaggaactttacaatactgttctatttaaaggcagaaatgaaatgaagttcacaagatatacctgcccaagtagaagatctcgcacataaacacccatagtagtcattttaccattagatccaggagaaaactcctgagcaagaagaaaggcacagttttcataggtacgttatgcagggattgaactttaataaaaacacagaacatatatttacaactgacaaaggcacacaaaaaagtaacaatttaacatattaaaaatagatccagatggctcagcgctcagttcacatttcatgcacataacatgtttatgctaagaagcaaccattattagtagtctagtgcaggaatagtgatgtatttcactttttcctttctttctggagtttacgctttcatgttttcaatattttttttctggtttgtacaagcattgtccttgacaaacagtaggcatcttatacaaatttagcataccacgtaccatttatagggagcagtactaaagtttgctgaatacttcaaagtacaaaataggatatacgaaggaaaactatagatttatccttttacagcttcaactaatcgtcaaaatgatgcaaaatacaaagaaagctaccaaaaaagataatacctcatcatctttaatgtagggttcataccaactccacaacgtctttggttccgcaacatatcgcaggtaaagaaatccaacctgaaatataaacctaattactgtctgagagcgaaaactcaattgtttgacacagtaaaaaatcatgatgcttcatttactggtttaggtgcagatttatctcaagacacattaacataggtttctatatatccttcatttactggtggaaaatttacctaatagtagcaccaaggctcattttcaatcacactatcaacactcaacagacacacatagtgcagcgatttagcaaaatctacaatattcagtaaatcctctacattgcattctgcacgtaacaaaccatcctaacaaacagaaccataaattaacattgcgggaaccggaagagtagaaaacaacaggcttacagctctgatgtaaggcgagtcagggtgcttcagcaggccgtgcatctgcttaaccgtgagcttcatggtgaagaacttgtagaggaggcagaaggcgctggagggcccgcggcagttgccggtcatccatggctctacgtggtcaacctgattgtagatctcatcaatgacctcgtggtaagtcttcagcctgtagagctccttgaagtagtccgaggagaggatgttcactgacaaaaccttctccatgagcacatcgattggcctccctgatgactgtatctccatttcccctcctctgaaattaacatcacacgacatcattccatcaatcaatcaatcaatcaatccggggagggggtctcctaaacctagttttaatctctgcactaatttaccattgatcatctccaagaatcagtatttcacggttcttagaaaagatcaagattttctaacggggagaggatctcttgtagctcaagaacaagggagattaaagcaggaaaagatgcttctttttgtgcatcaaagatccaaactttcgccgtggaaccgaaagctttacctcttttcttctcaccgggatgcgaagcggcgggcggcgcacgggggaggccacggcgagcggcggcgcggacgagattggggattcgttttggattggggattagggcgacgagaagaggagagagagagagagagagagaggtaaccgatggaggagagatggagtcgtggccgtgcgaccgtggcaacgggcgaggttacatcttacatgtacactctaccgtctgaacagccgtatcgcagccgtccgtcccttgatctacggatggatggatggtatgcaggaatgcaaaatgaaatagttcatgcacaagcacgtattttttaaaagaaacacagtacaaacacagacattcgcaacacgcacacacttatccttataaacacacatcttatttctgtgagtctctctctataagaccgggttgatatatcttaagatcgacgtcttgtgtaccatcaaaacttaaattcaaaaggtacactcgctttgttttaaaatacacacataaaaaaaatatttattttcatacttctaaaagattatttataaatacttaaaaaataccatattgtttaagtgtataacgttgtagacgtacgtatgagactttcgttatttatagtctaattatttaagagtaattagtgatcacaagtaaaacaagttttgtatatttgaaagcagagggagtatcttgcaagcaagtttcaagtagacgggagttacgagattcaaaaatttaagctacatttgccatctatatattgcacatattaaatggtccatgaggtattttataatggtctctattggtaatagaatcaatataggccattcatatttttcaatctattgactcatactatctattaacttattaaaggaatataaaaaggagcatgtacgttcgctctcacggtctataaattctcagattaatcggagaaaaagaaaaacagagtccatatagaaatacaatttagaaatagttgaaattcggaattaaaaaataaggaatattggaagaggagacaagtccatatagaaatacaatttataaataactgaaattcggaattaaaaaataaagaatattggaagagaagactagagtccatatagaaatacaatttataaaaaactgaaaatcggaaataaaaaataaagaatattagaagaagagtatagagttcatatagatatacaattaagaaataatagaaattcggaattaataaataaggaatattagaagtagagtatagagtctatatagaaatacaattaagaaataatagaaattcggaattaaaaataaggaatattagaagtagagtatatagtccatataggaatttaaaactaactaaatttcagaatacacataataaaattaaaagaagagtttagagtccgtataaaaatataatttacgaataactaaaattcaaaattaaaaaaaacatgggaaaaagagtctaaagtcaatataggaatacaatttagaattaactgaaattcgaagttaaaaatttaaaaatattgaaagatgagtttagagtccacatacaaatagaattagaaaaaatagaaattcagaattaaaaataaataatattggaagaagagcctagagtctatatagaaatacaatttacagataacgaaaattcggaattaaaaaaagaaatattgaaagacaagtctagagtctatataggaatataatttacaaataattaaaatttgatattaaaaataattaataactaacacgcatataaaataaaatatgaatattacacattaatagtttcgtaaagttagtacaaaatttaaaattatgttgtcattttaatatatttgaataatacattgagaaaacatatatgctattatatgagagaaaatataatgatactagccgcgcaatttgcgcggaccactatgctagtttatactatctcaacaattagtaaaattaattttctactactagtagaactcataaatcaatagatcatttctattagtcataatattggtagtagaacactgtcaatagaagtcactgtactgtatgtaaaggtactcattttagtagtacggttagcatagcgacagttatgagagaaaattaacatatattctatgaaactagagaatatttcttcaagggagaaagtatgacgattacgagagccttgtgacaacgaggctcgtcaaaagaacgatgatgaagggagattgggagatcacatatattcccttcttttaaaagtgcaagctgaaagcagcaatgatagctgctagacagccaagtcctttgtcatgccgttggcatggtatttactccctccataaaaaaataattaaatccttagctataaacctggatagtattttttttaaaaaaataaattctagctatgaatctgacaaatgctatccaggttcatagctaggatttgatttttttttttacgaaggggtatctaattaagcacattgtgtgaaagagatgttagccggcccatcagtacccactctgccctgtgcgactcgtgagaaacatttttttctgaagagataatgttctttcttttctttggatgaaaagtgatcttgttcttatcttctgagttctgatacaatataatgtaatccttttttcctcttgttctgcattattatgatattatccttgtgaaattctcttatctttctttcttttttaagcagatggaatgagctctacgccattcatttcagagaagaaaaaaggatgatagcttgtgaatatcatagggacaaaatttcagacaaggtgacatctgaacttctgtagttttggacacaacctaaataatcaattgagtgggcttagatcaaaacccgattccattaaggattactttgcaacaactaccaaatcacaagctacaccatacacgccacgcattctggttacatgcttcaaaaactcttccaactcgatcagaagagatcagcacccggagttatttcccatctgcactaccataatcccccctaattaaacacaacacgcgaacaaattaacagcccatagacttgttttttaccaccttcttcttcttcttcttcttcttcttcttcttcttcttcttcttcttcttcttgttctacgcttctatcttaagattcttaattttaattagcctcctccgagaagcaccttgttctactgtgcttctgctggtcagagagtacttctgcttctgctggatctactggtagcaaagcacatctctgctcttgtcagggctgtgttttgtgcggcgccgccgcgacggcctcggcgacgctgaagaacacgcggtctgagccgaacgtcttgccgaccaccgagttgtacagcctctcggtcaccgatccaaccgggttggccagcacaagctgcagaaatccgtcagaaattagctcatgttactattcactgtcactgacaaatctgaatattatctgatagtaaatcactgaaactgacaagaagaacattggtagatagatgtttcagaagttctattacctcgatgtttcttttttccagcaccttcttcagctctgcaagtgcatcgaggccactcgtgtcgatcgctgcaacagctgcaagttcatcgaattctctgtcagtttgtactgatcacaagatagtactattattctgagaatgttatactgaataattagctgctctttttactgaacagttagctcatcgatccatgtgagtttttactgaataattaacaactctttttactgagaatctttttactgatcaagattgtactacaatctttctgagaacgttgtactgaatgaataattagctcatcgatccatgtcagttttaatttactgaataattaaccactcttttcagcatttttttaactgagtatgaattctgtacaggagtagtagcatgcaagagcttattaccactcatgtcgaggatgatgcatctgacagggcactggttgcacttggcggcccgctcgtcttcctcccggagaaacctcatgatcctctcgccgaggtacatggagttggcgaagtagatggcggactcgacgccgacgacgaggaaggacggcacacgcatggcctccctgtactgcgccatgctccggtagctcgccgtgccggggacgacgcccttgaccaccatgtttgggcgggtgacctggaggaggatcttgaagagggagatgccgacggcgatggcgaggcccatctggacggagacgaggaggacgccgaggaaggcggccatgcaggcgaggaagtcgagcttgtcgaccttccacagcctggcggcgccccggacgtcgatgaggccgatcacggcggtgatgatgatcgccgagaggatcacgttgggggtgtagtggaacagcggcatcaggaacagcagcgtcaccagcaccgccgacgccatcacgatgttcgacaccgccgtcttgcaccccgcgctgtagttcaccgccgacctcgagaacgatcctgcgtccattcattcagagttttttttgccaatggtgagccattgcgatcctcatctagcttctatgaatattactcacatcattttatttctcattttgatttatttttatctttgtctttttttttgttgtgcatctcatgacagaagccggagatataatccatttccattatctaaatatgaatattactccctcattccgttcatattataagtcgttttgattttttttagtcaatctttttctataatattgaattaattagtttcattgaatgtaacgttgaatatattttgataacatatttattttatattaaaaatattgttaaaattttctgtaaacttaaacaaacttgaacaagttagagtacctccggtcaaaagatacttatcgtataagatttggtcaaacttttgaaattttgacagctaattttatgttagagtaaatttataaaatataaacattttataatactatgataattacttttcgaggcaaatctatatactatatcgtttgttttggttttgaactatgcatttaagaaattactgatggtcagaattttaaaggtttgatctaattttatctaaaacgacaagtacttaatacgttcagaagctatggtgcaactgacaaaccaacctgtggtgacatagcaggaggcacatgagccagccatgttcatgacaccaatggccatcatctccttgtttccatcaacctggtagttgttgatggatgcaaatgtcctgcctactgctatcccttcctgcaaattcagtcatttttcctttcatgttcagactaaacatcaccatactaaaatagttcagatagtaaataaaatgtgttttttatgtaggtgccttacagtgagagatagtatgccagtcataattcctgtgtttaaggccagtcctacgtaggagccactgaaggtcagcatattcgctgaaggagggttcaatcccttggggagatcgccaatctgtccaaacaccacccaaaaaaagatgaattagtgtgactaatgacgtttctttcatgttctcgatgtgaagctgtccatgaaagattcagaaatggtttagagaagctactcacaacactgatgccatgagctttgctgacgaacgagatgatggtagagatgatcactgatgtcagtggagcagctgctgacacccagaaaagctttgggttcctggcgctctgcaaaaatacagtgaaaattgttaccggctgcatactcgcatcaaagtcagagaaaattgtatacagcgaactgaagaatcagaaggtaaaaaaattattggcaaccacaacagcggttcacataatgaattcagtacatatttttttttaatttttataaaaagagttcagtagatcttgaatcacaaatgaaaagaagttctggttaaaacctattaatttggcaggccccatctcctcacatcttctgaagaattgttctgagatggtcccatgaccgtggaattgtcgcattaattgacactttttaatcattccaggtgaggaacagcgtcattacaaagcagatgacttacttttctcagaggaaaaccattaacagtctaatggatgtgtttatcagatcattctgtttagactgaaaagacaccgaaattcagagagatgagcatgtgaacaaccagcttaacaggtgacacgtcagagtggccaaaccagatccattcttcccaaaagggaaaagagaaatgttccaattgaaaatggctttattagaatatattctaaagccacacacacgccttgctttaattgatgtatatggtctaatcgtattaagactaatgcaagatataaacattctttgtttttgtttagtttgtgagatcatccaaactagaactgctcatcatactagttagagtgcttcatgacatatgtttttgtacacatgatcgattaattaattactaaaagaattagtgcttttctgcaagtgtaaggggagtaaatattattataaactcctttcacaattatgcaattaacaaccttaaatacttctggtcacacgccaacactaactttttagacaccatgtgttagtccaacgttcagatatcttggaagattaggcataagacatgactttttcttggcatagcaactgtttattaagcaagtctaaagaagtttttagattaccctaaagtagtactatactagcttaaataagtttaaacagtttgaaaaaattgaggaacttttatgtgatcccctaattaagaaaaccacccaactactaaagtaagatattcgaatttcgcgacaatcaattatgtgaatggaattcctttaggaaaaatcaaaatatcccatcattatgagatccctataagctggaggtagcttaacttcaccttccattaactattggccattagtttaactgagtggagtcaaattccttgttagtggcaagcaccctttgggcccctccatgaagctcactttgtaatggttttaatcaccacctttcctttttgccatactatctttcctagctatagataagttacctgtctttaaccatggtcaaataattataaagaattttgccgactaattaactaacaataaccatttagtcctgctcataactgcccctagccgaaagtgttctgtactcttccattgtctcagaatttacaacggcaggtctcattacatttttacttatacaggcaaggcaggccagcttttacgatccttgagagataccaagaggtatcgattattttagtgtaaattttggtatctattagtatcgaagatatcaagatgtatcaaattttacattaaaaaatatggtatcttctaataccttcttaagaactataaaatcactttacttgtgaatcactaaatatctagattgttctattaggcgcaacatttaaataacctgtacgcaggttcatgggtcgacatgcttgcatccctgatccccacgcatttcatacgtgtggctattaattgtggttcccttactattttggcgcctagccatttctgcggaactttctataaatagtaatagcaattaaccccctgattaccttctaatcaccacgcgattagcgaagaacaggcaataattaactaatcaatcaagagagcatgcatcatctctgcaggtgatacgctactaggaaggtgtggtagctattagcttacgatgtggcgtgtggtgaggaggacggcgaggaaggcgacgcccatgaggatggtctgccacgcccactcgtcgtggtgcttgaagacggagtgcatcacctggacgaaccccatctgcgacgtgaaatggatgatcccgagcaatcccttgagctgctgcagcgacacgatgatcgccgcgccgcccatgaatcccgtcagcgtcgccttcgacaagaaatccacgatgaaccccagcctaaaaccaagaacacgatatactccatcagttagctaggcatgaggtgatcgatccatcgatccatcgtcaatggaacagtagatgatggatgtgaagtgatcgaataccggaggaagccgagggaggcttggaagacgccggcgaagaaggtggaggtgaaggcgagctggaggtagaggatgggctcctggtccggcgacaccgcctgccggagcatcgaccccatcaccagcgacgctatcgacaccggccctacagccagatcccgcgagctacccaacaacgagtagatcagcggcggcacgaagctcgaatctgcatacatcatatgtgttattcatcacatcgaattgacataatggccggtcattttggttcatcttttacttacatagtccaatgattggaggcaggttggcgagcttggcgtagctgattccctgcaaagaaatcggaattcgaattggaattgggaatggagaatttcaggaggcaaaacaatggcgtgtatgtgtgatcaggttgcgtgcgtgcctgcgggatggcgaggctggcaatggtgaggccggagacgacgtcggagcggaggaggcggaggctgtagtcggagccccaatggaagatggggaagaagtactgcagcgcgagcaccagccgccgcgcggacgactggttcttgaactggtggagcgggtcgtcggggaagaacacctccgccagccgctgcctcagcgccttcgccgtcgacctcctctccggcaccgacaccttgtgcagctccgccgccgccgtcgtcgtcatcgccggcgcctcgccccgcggcgtcggcggcgcggagaccaccgccggggtcgtcggcgcctgcgccggtggcgcctcgacgtcgtaggagaggctgtccaccttgttgttgacaaccatggcgatcgagtcgagagggaggaggcgatcgaggtaggattaggaagggaggcgccttggctgcttgaggggttgggcggaggaagaggaagggcgccatttatagggagatggcgggaagagaaagcgcgggagaggaagaagaaggcgcgggcgcggcgcgtgcaggattaagaggcgagttggggggttaatttaggtgagcccccctattactgggctgcaaagattcgcaatttgggacacatgtgcctcttaagctgtgctactacctaaataaagaactacccaaacaaacatttgggcgtgtcacattttcaaacttctttttttcccttcaaaaaatgtatattaggaattaaaattcaatagtatcttggaattaatgtatctatctatctactagtgcctccatcccccctccctagaaaaaaaacaatttcaactatctatctctctatccatctatttatatgtttatatattactgccatgcgaaaaagaatataattctagctatgaacttggacatatctttgtccacgtgcattgctaaaattgcattcttttttaataaagatagtgtatctatctatctatatatctatctaacatatgctaagagttgtatatcagatccaatttaacttttaaaatctaccatataaattagaattacatttatgaaagttaagaattgtatatctgcacttgttttttttctttccgaatagggctatgtatgtgtccatttaaatattttagaaaactcttttttattggagtgaatactaattataagctggtttttaatgtatttcttttaccaaagtattagttggtttccgcatgttaaacaagaaaatagtatgagaagaaaattccaccaggaaaaggtcgatttaatgagattccagataaagccgagtacgtgttagtatgagttcaacatatagtaattcatgcaaaattgataagacaagtaaaactacaacgagattcgtaatgtctcccatgcgagaattatggtcgatggttgctctctatctcaaacccgaatctatatattcttaaatataaatatctacactccaaaatccccaaaaaatgccacgaccactggcttcttcaagaggaatcagttgaatgatccatgtaaattctgagaaaaaaattttgctcggtggaaggtgaatatgcattttttttttcacttggacgattgattccaaatagttttacgcaattggtgggataaattctctgaatcacttgtagttgtagttagtggggtggccaattttaaccgttgtgtatatccagcggctatggatgattatgagacctactttgatttttgtaagcacaagggagggagttgctgacgtggcatgctagctttgttccacgtgtgcacatgtgggtccacgtcagcggcaaggcaaaaggcatttggaacttggatgcgcaaaccctgcggccttaattaatttattataaaaaatataaatggtaatgttcctttttcctctttttttatggtaaaatagctatgtggagcactcaacatagtgacccaacaagcacattattcactccaaataatctgactaatctattagcaatgggaggtaaagtagttgaacatggaatcattgagattctatcaaagtaaaattgtagccacaaattaaagataaactcaattgcaatacactcatgaggaccacttataatgcacctcctctgttttaagaaatataatgtggtacattatgcaaccaacctatgatgaaaactttaactgataatataaaaaaaaataataataacccttttcacataaaaacattcatgatttttcattagtgtggaggtttatattattcatgatttttcacataaaaacactacctgcaaataatgtttattcgttcataatagtttgaggtgattattaacatagatgatatatatttgacaccagtgaataaaatccactttctcaatcttgagagcaatttgtaacttcatttattgaggtattgcaacaaagttcttatacaaaaaatttctcaaaaatactagatttacatcagaacctgaactgaagataccacaattcatatcatgcaagggtgatacaaccgtgaccctacatcaaaggtgagtagtggtcgactgcaatcatatatgcaccggcctgcacattcctgacacatgttaatctagtagcttccgcgccatcagttgtgacaggagcaccaagacaccatgatcataacaacatatatttttcaatgataaggcaaatctaccacttacaaaatcaagtggaatttccaaccatccatggactccattccataacctggccaagcttgctttctcccaaaggtgacctaggatgcatagctatgcggtagtaggatgcccaaaattttcttgcaaatcttgataaatattttgaataatgcagagagagagtaagaacatgtacaagtggaatatcaccaactgaatgcatatataacaccaattgttggccctaattgtggtgaagatgtgatattagaggccattggcaactgttggccagcaatgcaccttcaaatagatataagtggagaaaccaaaactagcaaatgctaattcagtagtagcacaagctgatttatgtgtttcctatgtttaaatctgtgttttttttctctgactcttcacgtgtgttgtgttcttggccggctagctacctgtacatagttgtgttcttttgtaggaaaagggtagctgtcgagttatctattaataatcctagcaaaaaaaaggagttatctattaataaagaggttggtggcaattgacaaatactacccaacttaaccaaaacaaactgggaactaaagggtgaaacgcctgtttctttgctttaattcacatggccatgagagtctctgaacatgtggttgtctctcaagttagttaacacttggcatgtttacttaggcaataaattacagattaaaagatgaaataaactttagagattttttttgcaagaatttagtgttttgtttccttttattctgttcttgaaaaaaaatcaaaatgtcaaatctttttattccccatttcccctattttccagctagccatgaatcctttttgctgtcacattcctctcacacggtacaaggtacaagatcgaattaatgatcttctttcctgaaaccaacgaattagtgagctgggatgacttttcaaggcaataaaagcttctattgaattcattaaattacaaagagatgatacaattattttaagagaacacttctgacctctacgtaacacacatgcacacaaaacaactcacataatacataacggattataagagcaaggttaatagtatagcccactactagctccaattcatctatagcaaatctaatagcaattcatacaatagttgcttattatactattaatatatggtcccacatgtcatacacacactgtgtcttggagtccgtgttgtagctggctacagatctgtagcccgctgctcttctctctaatcttttatctcattaaaatatatttatagctggctaatagtctgctattgtatccgctctaaggagaattaatggccattaattcaacagaattgactaaatcgtcatctatgtgattctgggtaaaaatctttgaccacccactctgaccgcatgtgattgaagatcagttatattaatggtgaaaagaatgaaaagaaaaaggccggttatatcaggcgtgcatggagaaacatattaatcaactataggactgaacaaagatcgaactgcagatttgtaggactgaactggctgccgaagcatgcatggaaagaccaatatataactacagtacttaaagtgaaaagatgagagattatatgcttttagagatttaaagtggaatttttttgcggctaactgcatgtgtgtgtgtccggagtcaaaaggcacctcttgttagttgtgttaggatcagggcactcactctacagtttggcatgcagctactagatatacttaattaactgtaaaaaggaacataatgcaagttcagttcagttccctgtttcttctcttctttttttttcttttgagacaccagttctgttatgtttgatttaaattattatcttatattatcgatttgattaaatgaaaaataaatattttaagaaacaggattaacagatgcttaaaatgagtggtctaaacagttcactagaaaaatgtttttgagaaaacgtatttttcgaagggtataacaaataatctgtttcaataatccgacacataagctaaaaaaaggggcatcaattcatactacaagttttttttttccatggactatggttgcattagttcatggtaaactaacaaatagtagtgttttggttggtgttaccaaattaattaaacaagacaggacaggacattctaagagatgaattgaaatggacatggaatgtataagctgatgttttcgggggcattttgactctcattcataaatgtacatcagaccatggatctgtttgactctgtttttttaatacatcatctctcttgtcaacccttgcatcttgaaaagtcaatgaattttcttcagatatgagagcgatggaaatcaaactcgatcgagaggaatgagccgggatcatcacacactgaatgtctctccatgcattttctgcatatgcatgcttcaggctttggtgcgttagtttgctgtctgatctgcacctgccactacggatgactgaatgatgaacaaacggagtcaacggtgtgagacacacatatgccctgctcctggagtcaacgacgatgtactttaagtctctttaacgcggtctagatctcgatgggccgatgcatgatctgatcatgtactacactcagctgaaatcattgtagccactaacaaattaagacacaaagtgatgatcgagtgacagtggccggtttagttaggtctactactcgatcgacactatgctctcccctcccggcggcagttcgctttaggacaggtggcaatcttctaggacctgcttatctgagcgtctggcttcgactccctggttctcctggtctcttggcagctatggaaggagcggaacttcagggtagttgaattggcactctcctcggtctctgtgcttattgagtctatctactcggaaggccgtctgtggtctactgtgggcattgccgcttttggagatttgctaggagtgtagtgtggcttcgcctccctctccctttatgttggagaagttttcttttcgcagtagttcctttcatttttcctttgtggttttttctatctctctcccccccccaagcataccccagcataggcctatctagccgattgcgtcgtgtaacaaaatctctatttcttttaatatattgacgtgcaatccttttgcacgttaaaaaaaatcaacactatgcagcatgcatggcactgatgaagattcgaaaggtacaaatcatcaacatgcatatacatcacatatagtcatatactgagctaaaatcaatgttgcttgcaaagatgggatactacatactgacgagaaaatgttccaagatagtagtaacaacacacatggattgaatcgggcttaaacctgaagctagctagtgacacacacaaaggtgagggtgtgatgcatatcgttttcgatcgatagatctccatctctctctccccaagaatatggttctcatgagtagcttatgccagcttccaacagaacaaatgcatgctaagctagctagctctgtacaccgtcgaaatcgatcggtcccaagatccaatcggtcnctagattgctagctgaacgtatctgtacgtaatcacctctccttttcttcgatatgtaccaaatataccattcgtttcgttacagacaagcaacttatacagcaactactctatcgtctgcactactgaagaatgaatgtctgatccagctaattgtcgatatatatctggagtatatatgtagtaacgtagtagctaccagtgttgtggaaaacggtgttaacggccgttaatacgttcgataatacggatacggagatcagtccgtcacgtcacgccaatgcggtcatcattagtcggtaacgaacgcataaatccgatcattaccgattaaatcgtccgtctccgtctaatcagccgtataatcggcgtgatgacaaaggtcgattccacaatccagctcattagctgtgccctttactactattgactagaagtttgctcttccgaaattctcacaaggcagcaagatgtaaaatgacaaggaactgacttaaagtttgtacatgagttccttgattttgacgatgatcaggttattggagtttgtatttgatgaagccgatacatatgttatttgggaccttgattatggtcatttatgctatgtactacattctcttgataattcatttcatgcattatgaacaaaacccatcactacatcagaattgagatatacagtagcagctatccattatgaacttatttaaatatcatatatggttattctatttaaggatatatagaaggaatatattaagttatatgcatttgtttatcaaaaagggaaaactattatcaactatgtacatatattttcaaaacgttatatttccgccaaattccgattaatcgtccgcattccgattaatcgtttagcggtaccctctccgtccgatatccgtataccgtcttccacaacactgatagctactccctccgccccatattataagggattttaagtttttacttgcactgtttgaccattcgtcttattcaaaattattagaattattatttatttttttgacttactttattatctaaagtattttaagcacaacttttcgttttttatatttacataaattttttgaataagacaagtggtcaaacagtaaaaacacaaacttaaaatctcttatattataggacggaggaaatagcatacatgcagtagttaggtatggtgaatgactgtattttgtgtatggatcaatgcaatgtcatccatcaagtatttaagtaggcatctgaaattctctctccttaattgacctggcattgcatgcagaaactatagcaaaagcaagggaaaataaaggagaggacaaacacgatgacacgtcggcgacacgagcagtgtgaggcgatcggtcgcgggccggcgatgtgacggtgcatgcatggagaccgtgtacttgtttggttagcaagtactatctctgtttaaaatataagtattttttgatgtctaaaatataagttttttttgacttcgatacaatttttgagatgctactttgatgaataatatatataaaaataagattttttttaaataaaaagaattgcatattacgatagtttgtttaatgataaatctagcaacaccaattttacatgattgatctgttttattttttctattaatagttaaagttaaaattatttgacttggcactatactaaaaatgcttatattttaggacagatggagtaaaagcaaaggatttagatttagattcttgagtattaattttatatcatttggtttatatataggaacgaagtacgtgagaactatagaaaatttttgtttcctatatagttgtaagacgaaaagcatagaaaattttttatccacttaaatctcattaaaaatcctagattattaatgtgtgcatgcatttttgttccttctattattctatttttatctatgggttgatattactctaaaccaaataagccctgaatgttctaatagatgataagattttctattttttttatgatatttaagggtagaaacaaatgaaataactattacataaagttattttttcaaaacatattttgaataacttgtatacatatatttaacaaattacgcccgtcatagatggcatactatctctgatgaatcatggttatgatctgttatagattatctgtgagggttattttcggtatccatatcataaaccggctgcattgacatattatagatgatccataaaggatgccctaagctgtagtagtgataatctgtaagaggagagggagagaatctgctttactattggagtgtcctttgcttttggaggggaagcggcgagtggccggggtagcttgttgaaagcctctgaattgcattggattcgcctaattcgtcgccggtgacaggtcggcacgtctcgatctcctgcttttttttttcttttttatcattgttctccggtcctcgccacagtgcattggcagcatctcgatctcagctttttttttgcaagtgatgcatggctcaactattcatatgtaggttttatattgttacataattttggtaatttggttccttaattggtatggagacaagatattgtacatatatacttcatcttaaaatcagtgttatgtgtcaatgaactagctagctaggttgaataattcatgctagaatctatgtgattttgaaaatgttatggcaattacgttgattttttttattggtgaaagttaagggtttgtcccatcacatctttttttaatacttttttttacttctaagactttttagttgtatacgcatgaacagagataaaaaaaatataatccatttttattatctgtaatctattttcgttatgtaaaagctaggctaaataatatgtactcgtagtgctgtcatgcactgacaaacacatctcatcaggttcgaattgtagaaatatgttgccaggttatatagttgttatacgtacacactccttgaagcatactctttttatccttaaaaaaaaagacaaccgagtgtctaaattcgttgtcctaggttacatcacatccttatctagtttgtcttttttttaggacggagagagtactatgcatgtataagtgtgctgtatccatccaaatataatttattgaaaaagaataaatatgtgtaccgagagtctaaaaattaagtgaaggccccattcctgaattcaccggccattgtcttttgcgaatttgtcgatagaaaagttacggtaataattaatgttttgttttgtatgagatttgtgtgaagtgaacgtaactgttaaattttttatggtaaaacctactaattcggcttcaagttctaaacttggtacgaacgttcatagctaattattctttctgtggtagacaatttacctatcagcaacaaggtgttcgtgatggtttatacaggcttagtattattttaaagtgcttaagtttacgtgtgtgttcatatgcagagggtgagtatgcgtgcagtgcttgcgtttgtataatgtttctaaaggaaaaaaaaagatgtgtctggttaccgtacaagcagtagctagtattatcttatctgaaagcgtggtgacatacaaatgtgaccaccgaatcaaattctggaatatgaagaaatcctgaagtaaatccatccatgtaccgatgtacgtattaaccacacaataatatctctgaatgaccatctgaagttctgaaccagctaccaactggggatgataagaaattccaaagtaaatccatccatacttagtgcgatttattaaccacacaataatatccctgaatttatacttaaccatgcatctgaaccagctatctattgaggatgcgaaagtttttgtttgtacatgttacacgacaaaaataacacactactaaaaaatcttaacaggtgatagctcatgggtgccggttcatttaaaattgacacatattgaccgtttcccaccattatggggtatttttttaaaaaaaccggcacctttaagaacttatgggtgccggttttagataaaaaaaaatcagtgcctataatattattatgattttttaaaaaaccaacgcttatgctaacattgaataaattttaaaaatatacctattttttcataatttgtatttatatacatgtgtggggaaatttggcgaaaatataccgcctccgcgcgttgggaacgcgggaacaggatgaaagcgcggcgtggcagcgtgggaacgcgatgccgcatactggatgtgcgggatcggctcgatcgcgcaggccgaaggtgcggaaccgagtcggtcccgcgcgatggctgtgcgcgtgcgctatgtaccgcaggaccgggccggcgcaccctcgatcgcgcagaatggaagtgcgggaccgcttcggtaccgccacggtaccgtatttccaggatgcgggaccgatgtcgtcctgcacccccgccctgcgtgatcgttccaaccctcggtcccgcgcatccggcatgtgcttaatcctcgttcccgcattactagcaagctggttaggtatatttttgcaaattaattccacacgggtatataaacagaaattatggaaaaaaatggttttttttaattttttctactaacattatagcctgtaggtgctagttcttaaaaaaaaccaacacctataattaaaaaaaataaaaaaagtcggcacacccagcctgaccggcgttatctactcgtggagccccatgtgagccacatctgccccttccttttcttcctcttcttcctcctcctccttagcccgtgccaccacccctctttttttttcctccctccacctatttttggatccgcagcccctcctcctccttatgtgtcgccgccacccctctttcctactcctcctttccatctgattgacaccaccatgacgatggagaagtccggattgatgacggcgacggtggcgttctctgtgtgtttgcgtttgcgattttgttaattttgtgattgagcttggttgatgggatgatggtatgtcagtgatgattttgattgcatttggttaatggggatgatgttgatcttagtgatgatggacaactgctcgatgcttcggctcgaatgccgactttttgttttttttttcattcctagaatctcaaatgtattgtctgttgggtgtcaattgggaaatctagcacctatggccagttctgaattggcaccaatccccttttctatagtagtgacaagcacgagtactccatggaatatttatttgttcagtttgttgtgccaacaaatttttcgtttagaagcgtagtacaaatgcaatgctcacattttcatgtgtgtagactcactcctataaatatacagacacacaatcgaccatatgagcatctctgagaagctggtctggaatgtttaagattgatgaagttaccattggcataattaattttagattgatgaagtcatcacaaacgtctcactcgacaagtacgtcatatattattaaaagaataattagccataaatacaagcaccctctgtcaagtctattactcgaattagatcggataggtaggtgcaccataagctaaccagctgaactacgctctcttcatgttgtgccaattaatttgaactcagaaccatcgattntgttatataagggcaaaaggaagcatgtagtacagcttggtggaatattactagaatttttatttatggggtttaaaatctgagtgcagtacttctgctcgggtcaaacgaatatgagggtacaactaaaagatcactccaacaacaatcatttgtgtaattgtgtggaactcgaaagtttgttccccatccatgtatgagaaaagaaataaatatttattatatcttgtatttgactatgcaagatttgtgctttctggactaaagaaaaagaacctcttgcctttgttggattgcgaagacatggctccagttttgaatgggatatccatggtagattctcagtagccatctggtttcacctagacaaaaaaatcggagccgttgcctgtgtaggtaatcattagcccaccaattggatggctctggtgtagagagaaatgaaaatggatggctcttgttcacagaacatgtgcgccatgatcaacaagctagagtaaaaggtgccatgattttgtgtgctctcgtcctgcatgtgtacgttttacaacttggttagttgtagatctctatgtgttctatagttatatactgcaatatattatatatgatgtgattaatcatttcaaaagaagacataatgaattggtcagtcttaatatacatgcatggaaaactgcaattgacaaccaaacaacgctaaaatctatgttacaaacaagatggcatccatgaccatgcttgggtattatatagtggctatcttaatatacatcaatacaaaatctaactatatatcttaaaaatatatatagtgtactaaacctgctgtaagatccagaaataaacaactgaaatttaggcggacctagaacgaaatgaaggagggtatctctagcttaatttactctactttatatcaaatttaagttgatgcatatgcctaagttagtattgagggagatgcgcacatggcaaaaatcggtaagttattactaaaaattttcttgaccaggtttctgagcacccctcccatactctacctccgccccctgaccaatagtatagctaaatggagtggtagtatataaaggtctaaacccttaaataaaactaaatttacgatttagattgatttctgctattagtagagagcacagtagcagaactcgtgtaatagtgcgcgtgcacagttgattcgtaccagtcagcggcatggctagctgtctggcaatcacgatacatatatcgtggttgtagcaacagagatgcggcaggaggatacaccagaatcggagggcgattggcgagatcgggagcttgcggccataggtgactgaactagtacatgagtactatcttttccgaagatcggttacagagaaaagctaggcaaatcaatcagaaggcgcacaacgtactaacgtgtgtatggccggtgcagtgcagtgtacagtagttggctagttgcaatatgtagtgagtgagactgtctccaacaagtgacccataagggcacctaaacctaaaataggtctttgatagtactatttcagcctccaacagagtacttataaagaagacccattttacgtgctataagaggcataacctaaatctgagtatcctctctcctgaagacctatttgcagtaagggttctcttttaggtcttattgctggagaagaccaaaaataggtattgaactctttgactgtagcgctatgcaaacgtgaaatgggtcttgtattttgggtttcattgttggagatagcctgaggttaagggtctgttcactttgatgttattttcaaccataccatttttttggtaaagttatctaaaaaatatctatgtttagtttgttgccaaatttggttaatacataggaaatcatgttaaaattttgataatattaccatcttactgaaattttagcagtgctaaaacttggtaaggtttattttggctacattctgaacaagccctaagttttttttaatagcttaaagattctgagaagcatattggttgattattagtttctaaaaatatgaaaaagctgagttttctagcttttgactttttaatttatgtttaaattatatattacaataactttttaaatatgaacgaaaaagctaaagtactagtttgaaagagtttctgattctaaaagaaactgtagctgtcatacgttttcccaaatagatcttaaagttagtgagctgttgaagtagtacgtaggtgtgtttgtggcaggtctgtagcatcgatccaatttattcaatccacccaaatatacgttcgtgggtgcgtgtacaggtcgggccagcaacatgcatgaacagagtagggtccctatcgttcggctaaacggctaaatttgtagataaaaattttataaatatgttcttggtgacttaaaaaccaatgttgaaaaagaaactacgttaaaaatatcttaaaatcaatcttaaaattaagtttaaaaattcaaattttgattttttttttctttggctgattaggccatccgataggagcctagctagtcagatggatattaagctagccgtacgcctcagccattgagcatcgatcgatcggtgaatgcatatgcatgcatgtttagtcgatcgacaagctagatcgtgtcagattttgagatgagatcctccttcgtcgtcgtcgacccaactccggccggacgtcaggccacgccatgcatgcgccgccgccggccggtgagatgagatgatgaggatcgagctggcgatcccacctggcctgtcgctgtgacgatcgagtgcactagctcacgcactgatcgatcgatcaccgcgtaaatactacgtatccactatatacacacacgttgtcggcatctgtcaccgtcaccgtcagtgtcagtatctactccttccgtctcataaaaaactaaattagtactggatgtgacacatcctggttaggggtgaaaacggtatggaaacggacggaatccatctttatcgttttcgttttcatattttttttcggaatcggaaaccccgaatacgaaaacggaatcgaatattatctaaaccgaaaacggagcgaaaacgaaccggcgcgaatacggtaacgaaaatttatcggaataaaaaacccctcaaactgataaatccaattgaataaattatctatgtttaaaagagtaatgttgttgataagtccctatgtaggacaaaaaatattctataattttagatttgcataataaatacttttttaaaaaataacagccaaacaccatggtattcactatttagtgcttcaaaaaagaatccagggtatttcagtcacaaaatttctggtaattccgagaaaatttttggaaattccgagaaaattttcggaaagtttccgaccgattccgagttccgacggaaactgcccttatcatttctgagaaaatatttccgaattcgtttccgtttccgaaaaattccgaccgacatattccgttttcgaaaataggtccagaatctggaaagtttccgtaccgttttcacccctaatcctagtaaatccatctagttcagattcttttttaggacggagggaatacttttacaagctagccacttcttctttcttgaaaaacgaataattaaatgtgatacatcattgtatctaggagttctctttctatcctaaataaattaaatctaatgtgatagtatattcatttcaaagtaaacgaacctagcgtgaaatctagctgctgcaaaatccaccggtagccgatcgagtgcgacgtacgtacgtgcgcgcacgcggagtcagtcgacggtccaacgctcgtcaaaccgcggcgtgacctacctacctacctaccggcacgtacgtacgtactagcgatttcacggcacgattgcatcgtcacggggtaataattaatttttaatctattaaaataattaaggtggtgcttttcctaataaaaattgaagatgacgttaataagtaaggtattaattagggcataataaattaagttttaattattgtaaactaaaaaattgatctatctgataattggaagaaaactttgattgaaaaacgtaacaacgaaaattaagataaaatatagtatatcttaattagaaaaagaggccatatagctattactccctccatactcataaagaaagtcgtttaggacagcgacacggtcttcaaaacataactttgacttcttgtttctatacttttatgagaccgtgttttaggacagttgtgttttggagaccgtgtcgctatactaaacgactttctttacgagtatggagatagtacatataatttttacatttttaaactcaacaacttgagagttatttataatttatattctcaaggtttgacttaaacattatcctaaacgacttacttataattacggagggagtactccgagctttgatgcttattatggtaattaattaaagatcgcacgcacagtgaatatacatattattaagcggccgctttgtgtgtggtctcaaacagtgacggagaaagcctaggcttgtatcctaaacatctactaaaatttatcaacacttagtgaaaattttgaaaacacaagatatataagcaagtttagcccttagcttgtttgtttttttttgtctccggacgtctctggtctcgctaactaaaactggccagacaaattgagcgacaaggtatttcgtcattgtcgagtgtcgattgaaagcgagcaggccagtagtagttatagcttactacccgtacgtctgtcttctcaacaaagcggagaattagagaacttaaaaaaagaactgacgcagcagaggcttctaacagaatggtagtagcatatgcttcacaatatctgttttgggtccgcatatattaatcgaacaccgacccaccgacatcgatcgatccatcgattaggtcttgtttagttgccatttttttttccaaaaacaccacatcaaatctttgtacatatacatgaagcattaaatatagataaaaagaagaactaattgcacagtttacatggaaatcgcaagatgaatcttttaagcctaatttgttcaggattagcgataagtgctacagtaacccacatatgcttatgacggattaattaggctcaataaattcatctcgcggtttccaggcaagttatgaaattagttttttcattcgtgtccgaaaactccttccgacatccggttaaacgtccgatgtaacaccaaaaattttcttttcgtgaactaaacaaacccttagtactcttgtattccaaacctgctactccctctgtcccaaaatgtttaatataaacatttttgaactttgatatattctttcagatgctattttgaccaacaatatttatatgagtaagatattttaaataaaaagaattatatattataatagtttatttaatgataaatctagtagcatcaattttacatgattgatttttttttatttttattcatagtcaa

SEQ ID NO: 39296 - DNA, 954 bp, Oryza sativa
attaatgctagctgaaggtgctagctagctaatagagttttttttttctctctcgagtaaccatcctactgttttgtgtatgttattcaaaactatttacaaccaaatttgttatttttatccttttttcttgtttatatgtatttgtaagttgaatttgatatataagtttacacagtgatatctcacataacgattgaagaaattaaaggtttccaaaaattttttaagtaacatataaaaacgagggaatatttcctgatgaacaaatgcacttcccgagtaaaaatacatactcggccaagtgctgggtcaactggctctctctctctctggctcagtgatcccattccagtcacctcagggcttttgtccaagaacacaattaatcaaaaacatatgtgcttttgcttacggtttactaattggctggtttgattactgcattgcatggcattggccgtgcaagcggatattccagggtattatcccccacttttccgacaaccaatgcatcatcatcatcatcatcgtcctcgtcctctgactgaccacctcttctttaatttttctccttcctttcctccattgccgccctttttcccctacattccacgagccatccactcaagccaatggccgagagaattgtaggagtagtaacagatcagagagatggccaagtctaagctagctagctatatagcctcgcttcgcctctgcttcctttcttccaaaaggctaggcttttttttttcttttcaatttacgtctatctttgtctcgcctaatttcgtttgcacgttaattcccgtggtaaatgaatgcttgagttttggagtgactactggctagtgatgggttaatatataatggccgtttgtttctgatgatcagctctgcttttgaggctagctagacattttttttccttcacaaattaagcagagctag

SEQ ID NO: 39297 - DNA, 2632 bp, Oryza sativa
caagatttatgaactaaccttgcctgtggacatagccagttcacccaactgcttccacttagattcactttgcgcttccatcgcgatagcctgcacagaaaatgtccagaatccattctgtttattagcaatgaacttcacagcatggaagacctttcagaacattatttcaataatgtggaacaaaaacacaatacaacatgttctgtacctttgcaacttctaattttccaagttgcacagctaggtcaaacctgtaatcagcatcagtagctatctcaagtgcttcctccagcatacctcttgactccaagaaatgagcaacactgccatatgaaaagtaatgggaggagtaagaaaccatcaaaacacaacaggacaaaatgcactgctaggaaattttttatgattttgttatttggcacttccattaatcagtactcctttacacgactacaatgaagatagagtagaaacaatatatgtatttttgtttcaaaaaactagatgccaatactcctaacagttgaatctattttaggtgtgatgtgctacataacagtcattcaataaggcacatcatgatagctattgaaatgtaattgtaatttagcatataaatgtattttcacgcttccatctatcattgttttgttacttttaaaaaaggaacaaaattattaagaaaccaaatcaacaggttcaaagagaaacaggtaccaaaataaaagaaactcattgttttggatcaaaagtcagcaactaacttattatattgcgcctttggtatggatggtaaaatatcatttgcacgttcaatatccccacgcatcacaagtgtcttgtactcaatcaaactaagaagtaatgtgtaccccatgacactgcaacaagaaaaatatgttagttcaagaattcaacaccagacaataagcaggcagtattatcaagaaaacacacttgaattccttgtcaataagataaactcggctttgattcgctagatatcccaacaagtacatagggcgatccaagtgatacatcgtggtgacctgtaaatgtacaacgggataaatttgtagtgcacaaaatactacaatagaaaatacattaacaaaataaaaattcttgcatggagcacacaatatatacctcgccaccaacacaatagttcaggcgccatgatgaattgttataaataaagcagtctccaacccagatccctgtccgcactcgctcattaacctcatgaagcagctcaaaagcatcttcaacgccttcctcatccacaggttttccagattctagataagacgcaacgacatctctctgtaggaacacaaattacaaacataacttcatgccatggtaaaaaaagaactttcacgcaataacacattcaagaggagaaaagaaataacataatgaacatttagataatacaataacttacgttgtacttcagtatgtagaatgatgtatcacttgctattgcaactaggtcaccgctatcagcccaataaaggttctaaaaatacagtgacaaaactagttatttcagtatgaaattcgttaaaagtatcaatctataaatatcaatagataatatttgactcactttgacattcacatcaatgcggcgtattagtctacagtcagcccagtcataaaagcaaatgaaatcactggaacacatcgccaataatattccaccaaaaatacgttcagctgaaaatgtagggcgaatagttttcttctcctgcatattggatcattcaaaccagaagatacaatattgataaatgccaacagaatatgatgtgcaattctttgccaaattcattaataaaaggtccttagaacatagtaactaattaaatcaacctacgcttaaattgtttctagatcaatgttatagctaaacataaatggagtattcatgtaggctgattggctgaatgacaacagattgtcaggaagtaagatatatagtgtaagaaaaagaaactgtcatctaggtgactaggtccaatgagatgcaaacctaaatcagtatgtaatttcctttcaccaaacatgatgattgatgaatcatgaacagacattaaaatgcacaacataaaacttttgattgaatgaacgctcgtgttaaccagaaacctttattgattaaataaaagttaactcaatagttagccaaacaatagtacattagacatctcaattgaatattgcaaggtgtaaattcacggttaaaggcaaagtgataaacaggtgaagatggtgcattctccagagtggtgattgaagaaatgaaacactacagttttactgatcaaattcataaaaggaaaggctacaatcaatgtgggccaaacctgaaatgatttactgaaaatctttattcttgatgtactttccctgatagcatactctccttctgatgaccaaacaaactccaatgcagatccaaatgacctattcctccaagccaatgcagtataaattatgaattcaccatctccacaaactacgacaaatcttccattggggttatgctttaagctctgaccaaacaaaaagatgacacatagtaagattgaatactattcaagatatgacaaacaactaa

SEQ ID NO: 39298 - DNA, 4323 bp, Oryza sativa
  unsure (1)..(4323): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgacaatcatcttggtggcgagataccggcctctctctccaacctgtcgaagctgcagacacttgacctgtcgtccaacaatcttaccggcagcatccctgcttcattggctcaaattccaggcatgctatcactcaatgtgtcacaaaatgagctcagcggagagataccggcaatgcttggctcccgctttggcaccccgtcagtgtttgcttccaacccgaacctgtgcggtccgccattggagaacgaatgcagtgcgtaccggcagcatcggaggcggcagaggctgcagcgcctcgctctgctgattggtgtggtggctgctaccgtgctgctgcttgtgctgttctgctgctgctgtgtgtacagcttgctgcggtggaggcgccggttcattgagaagcgagatggtgtcaagaagaggcggcgcagcccgggacggggcagcgggtcgagcggcacaagcacagacagtgtcagccagccgaagctgatcatgttcaattcccggatcacctatgctgacacggtggaggcgacgaggcagttcgatgaggagaatgtgcttagccgaggccgccatggtctcgtgttcaaggcttgctacaatgacggcaccgtgctggcgatcctacggcttccttccacctcatctgatggcgccgtggtgattgaggagggctcgttcaggaaggaggccgagtccctcggcaaggtgaagcacaggaacctcactgtgctccgtggctattacgccgggccgccgccagatgttcggctgctggtctatgactacatgcccaacggcaacctcgccacgttgctgcaggaagcgtcgcaccaagacggacacattctcaattggccaatgaggcacctgatcgccctcggcgtctcccgcggccttgcttttctccaccagtccggtgtcgtgcacggcgacgtcaagccgcagaacatcctcttcgatgccgacttcgagccgcacctgtccgacttcgggctggagccaatggtggtgacggctggtgctgccgctgctgcggcggctgcatcgacgtcagctacaacaacagtcggttcgctcggctacgtcgccccggacgccgcggccgcgggtcaggccacgcgggaaggcgacgtctacagcttcggcatcgtgctgctcgagctgctcaccggccggcgccccggcatgttcgccggggaggacgaagacatcgtgaagtgggtgaagcgtcagctgcagcgcggggcggtggccgagctgctcgagccgggcctgctggagctggacccggagtcgtcggagtgggaggagttcctgctcgggatcaaggtcggcctcctctgcacggcgcccgacccgctggaccgcccggccatgggcgacgtggtgttcatgctcgagggctgccgcgtcggcccggacatcccgtcgtcggccgacccaacctcccagccatccccggcgtgatcgccggctcccctcggccggcggcatcacccgatccagtccactagtgttgttccatccattttccgctaattctttcttctttagttcagattagtcttagcttcatccagccgcggggtcaaaactgacatgtgagcccgggagcaagaacacctgcatttcccgccaagcagaccagaggcttggccccaagtgggaaagtagccgttgagccccttcctaatctcgcggttagtggaggtgtcagtggctgccggggaagcaaatcaccatgtggactgatgcttgcgcggcatgttgcggaggaggaggttggtggtggtggcgtcgtggactcgcgcatgtggggttccccatcgcaacggctactgatgctccatctgttcttggctgctctgtaccctgtactcccttctctctctctctaggaaattgatttcgtgtaggggggcctgcttggcttcttcggatcttgtcttttattaatctccattttttaccatgggcttagatcttttgtaatgttgtgatgtacatcttgtctgtattttgttatcccaattggttcaagaggatggtgggggatgaatgatgcttcatactactagccgttaaatctttttttcccctctgcatggaatgatttgtgtatggcagtatctagcagtagtacatccaaaatactctgtgcacttgttttatccactgtatgattagttggggaccctacctatctatcggatgaatggatatatattactctgtggtcaccttgtttttctttgtcaattggagaaagaaatggttgaaacagtgtattataggcttgactggccagcaatgctgaacgtttgcttggcagttgaggagatcttggtaccactgtacttggtttgagccccagaggcccccttaatacttttctttacctcctgaatccggtcatgtgcgccattgagtaataattagcacctgcgttatatcagtacataaatgcattaaatcatggacttcaaggtgcgtaacgtacactgaagagcacgacgttcgtggatagaccatctcaatgtatagcagtgaatgagccttcaatttggccgagatggaaatcatggaatacagtcagcccctctttccctgtgtctcaatgctgcttgcttgtttttccggaatagtaatttcttacgagcatcaggcggcaggggcccttgctacatttcggaatccagatcatcgcactgaaattttcttcgtcagggagggcacgggcagattggcatgatacgatgacgaagtgcaggctgccatgatcacacgcagcactgcgcgactgcacgaacacacttgaaaagctcacaccgtttttcaggttcggcgcaagtactgtagtagtcaacagccaagcaagaattgcacaattagcgcgcactacgagtctacgattcctctccttttgatctctgactcaccttgtcctcaagcgtgtagacctgcctgtaactcgggataccacatcaaagtttaggcattagcaatcccggatgtcgatacttctaacctgagcagagagaggccgtgagtagggggagagaatgcaacccatggcgtcttgtcaacaagatggcatcaatagtcgtctatcctagtgcctagacctgaataaatcctgaacaagtagcatgtggcatgtataaaacaacacgaggcaaggcaccaactggcaactcggccatcctgttgcgtttgcgcatacatcaccgtagagcaccagggaagattaattactatagctgtaaacttgtgctaacagaatgggggaggataactgaccatgtattctggctgcaacggtggtcagagagaaagaccaccaacaccaggcgtgaaatttgcactgaaactctgcagaatgctgtaaattttgctgtagaggtacagaaaaggctgcatgccgcatgctgaattattggggagccaccagcccgtgcaatcagtggcactgtaaatttttgctgcaggggagtaaactactgagttcactcacggactggtggaaccgaaatcactttggcagcatgttttcctctgtaaccaggggacactggctttctgcatgattgcaacagtactatatacaattctggatggaacacagacgacatttatgtttcggcatgtgcatacttctgttgtcacaatttcacagattcaagctagagtgtttttactactctcccatctcgccctgtcccggcctacatccaagcttgaaatgctcacgttggaatctcttgaaagatgaaatggcccatgtaaaacagtacatttacaatctactccagtcatggaagagaacagacatctatgtcctcctagttctcatattgttgcatgctcaattattgtttcattgagcattgtttcctaccatacacacacctttgcatcattgctgccctactttcttcagtagtttgaaacctttctgcgccactagctcctaattccaaaaccaagtctagtatggtgtactctagatcatcttggaaacttggaaattggaagcacgtcctatgcattcgcatctt

SEQ ID NO: 39299 - DNA, 2913 bp, Oryza sativa
agagaaatcacctaatatatgttgaaagttcatgtttacacctaaaggaaatgtgtactctcatgttgtctaaggggatcaagtggaacaagagcaggtaataactagtcttatcagaaaggatctctttggaatttgaaatatattagtcattgctacatgtttaaaaatactggaacttcctggtgtattattgctggctgaactatggaatagttagccccaaaaatgaagttcatagtgtacacacaatacacaatgttttcctgagattatcccctagcaacatcacactgcaataaaattccctctggtgtttgcatttctatttttcagtcctgtttgtaactttgtatatcttatgtttcgttccttcctcatccttacctttctactgagcttttcaatttaagagatgccaaagataaaaatcactacttattcttctgtgtgtgtgatgcttgtcttttcaggttgcactatgtaattggcataagcttaactaatccttttatttttgcttctgcagttttatgcaggatatggctaccatgggagtaactttgagcaaacataccgttgttatccagcatctttctttgacaaggtatccttctcccctgtgctgttattgaaatatctagcattgttttatccttttacatgatgaactggatttaactgtcttttttttccttttttttttttgcttcatttcttcagccacacctggaaggtggcgacaaaggtatgtcttcagacccctcccccctcctctcacacacacaaacaattcaaaccgcatgccactgacattatattttatcatcatcaatgcagtaattatgccaccatctgctcttgatcggcttggtaagctcaatctcagctcttttatactctggccttagatttacattaattgttttggctcctctaacagcttctctgcacattgaatatcctatgctgtttgagttgcataatgatgcaactcagcggatttcacactgtggtgtgctggaatttgtggcagaagaaggcatgatcatcatgccctactgggtatgtaatatgcagtggattttctttactgatatctgcaattatattccaaagaaacatattgactgatttatgctataattctttcatatatgtgcagatgatgcaaaacatgcttcttcaagagggtgacactgtccgtgtaaaaaatacaacccttcccaagggtacatatgtcaagttgcagcctcacacaactgactttttggacatctcaaatccgaaggccatgtgaggatatgataaaaacgctccatattaaaaccattccgtttcttggggaaatcatcattctaatgataatgctttgctttgtgacattgcagcctggagaaaacactaagaaacttctcttgtttaaccaccggcgatagtatcatggtagcttacaacaacaaacaatactacattgacattgttgaaacaaaacctgcttccgcagttagtattattgagacggactgtgaagtggactttgcacctcctcttgattacaaagaacctgaaaatccgcagcaaccatcagttcctgcaagtgaggcaactgctgaaggtttgtctttagattaagtgcactttagttttcagatgaacttgtattgaaaggctgaattttatcctcctcttctatagcaatttttcaagtgtgctgccatctgggagcatgtactccacaccctgaactagtattttcatctactcccatagtcctgtattttgcatagtaaactgcaacataagttaaacaaagaacaatagaaggaaaactagaactggaagacatgcttgaatcaaagacgtcaagcactctgtccagtggtgtgaagtggcactgttctggattgcttggttttggggttgacagcctttctgtcaacttcttgtatgctactagtttgtttactgggttgtcagcctttctgtcaacttgtattctatggtttgcttctttcttactaaaattcagccggtcatatttggcttgcctggctaaaactacataaaaaaaattcattctttttcatgcttatgtattgaaattctatataaggtgtattttcgtcatatcaagtgtgaacgatctgcaatgttaacgtttctataaaagaaaatatgcgctgttaacatgtattccacatgcatgtttgcatatgtttatcaagtgcattcaatacaagattccagctgccaaggtgtgtagtggtggcatttttgaatttctccttttaaaactatccttttggcgaccttcccaccagatgaaaatgctaaagttgaagatgaactgaaattcaagccgtttactggttctggaaagcggctggatggtaaagcctcaaagctacaagcaacagaggtcccttctgcctcacgttcttccccttcagactcaaacaaaagggtgaatcaggaaacgttagcaccagcatcttcaggagctagcaactccacacgccagaaatcaggaaagcttgttttcggttcaagtgcaaacaacaacaaagaaccgcaaaaggtattacatttttctcgcacttgaacaccctcctttcccttcttttcatgcttcattttttccctactgaatctgtttttttaatctaataaatgcgttactaaatgtgaataaatttgcaagaatgatgagcttgttttctctgcatatgttcacagaatcaccggccaggatggccagctaattgaagggttaaccttataaattctatgtattggccttttgggcgacaaacagaggatgctagccggaacttagattcatctatgatctagaactcaaatatatttagatattttttgttctgtcagttgctttcctagttagtagca

SEQ ID NO: 39300 - DNA, 3271 bp, Oryza sativa
tctacatatacgatactcgatactccctccgtttcaggttacaagatgttttgactttggtcaaagttaaactattttaagtttggctaagtttgtagaaaaaaatagtacaccacccattttaggtaattagacgttttgactttggtcaaagtcaaacttttttaaatttaactaagtttataaataaatatagtaatatttataatactaaattagtttcatcaaatcaataattaaatatattttcctaataaatttgtcttggggtgaaaatgctactattttttctacaaacttggttaaacttaaaacagtttaactttgaccacagtgacgacgtgctataacccgaaacggagggagtcgcatttgcaacccaagacaaatttattatgaaaatatttttcaattatggatttgatgaaactaatttagtattataaatattagtatatttgcctataaacttagttaaatttgaaacagtaagttaaaacgttttataatctaaaacggagggagtagtatatatatttgatatatctcttgtcgtcttgtcgaaatggctcggcatagcagaaaccaagagtgacatgccacttgcacctccatgaatgtacgatgacatccatgatgcgctaacagctaccacagctgatatagatgcaaatttatgcacccatatgcatctgcatgcatgcatgggtaagttgaaatgtcatttggtaattaaagaaaaatgcatgcaaagttcttgcatctacctaccgttgttaaactcgtcgatctgtgttcacagaacgaaaagaaaagaagccagataatcttttcgtggtgatgcttacatgctaccagttcagagtgtaatgcttgtcttaacaaagcaaaatgagacatcacatcacttatggcaagcaaccgcgttctctttagctagctagtcactattattacatgcatgctaaacggtactttatccaaccatatgtaactaacaagagcactgcatatttttggagcagatcgcgatcgagatattaagctagctcttgccatatattctaactagcatggtggcccacgcaaattacgcgtctagcattattatatttttctctcatataatagtatatatatatattttctcattatattatttaaatatattaaaatgataacataattttaaattttgcaataagtttacaaaactactaatgtgtaatattcatattatattttatatatgtgttagttattaattatttttaaaatcaaattttagttattcgtatatatcctatatgtactctagactcgtctttttaatatttctttttttcaattccgaattttctgtaaattgtatttctatatagactctatactcttcttttaatattatttatttttatttctgaatttacatattatattttatatacgtgttagttattaattatttttaatatcaaattttagttatttttaaattatatatattcctatatggactctagactcatcttttaatatttctttttaaaattttgaattttaatattctttaatttttaattttgaatttcagttacttctaaattgtatttctatattgaccttaaactcttcttcccatgtttttcttaattttgaattttagttatttgtaaattgtatttttatacggattctaaactctaattttaattttattatgtttattccaaattttagttagttttaaattcctatatggactctatactctacttctaatattccttatttttttaattccgaatttctatttttttcttaattgtatttctatatggactctatactctacttctaatattccatttttaattccaaatatatattatttcctaattgtatttctatatggactctatactctacttctaatattccttatttttaattctgaattttagttatttcttaattgtatttctatatggactctataatctacttctaatattccttatttttattccgaatttcaattatttccatattgtatttctatatggactccagtctcctcttctaatatttcttattttttaattctgaatttcagttatttcctaattgtatttctatggactctagtctcctcttctaatattccttattttttaattccgaatttcagttatttcctaattgtatttctatatggactccagtctcgtcttctaatattccttattttttattccgaatttaagctatttctaaattgtatttctatatggactctgtcttttttttttctccgattaatgtgagaatttctaggccatgagagcgaatgtattggctcttttttttattcctttaattatataatagatagattgctggacgtgacaaatgcccagtccaaaactgattttaagtgtcacgacttccgtacaaataaggtaccaaccctaactacatgatttgcccccacgtaactacgtactagtaagagtatatggcgagagctagctagctagctgtctggactatagttggccatatgggccgcccggcacggcacggcccaggcacgaccgggcctaggccgaggtcagtcgggccggcacggcccgacgaacaagctgtgccgtgccgtgccgtgccagcccacgggctacaaccacggcccaggcacggcccaagtagcctccggccatgccgggctggcccgacggcccggctagcccatcgtgcccgtgccggcccaagcacgccctggcaaaataccccttcaaaggttcaattgaatacaacaaattgacataacacatcaaattcatgaaattcacatgtaattcatcaaataagtcaaagaatcacaaacaattcatcaagtcaccagtttatcaaatcatgcatacatcaagtcacagatttacaaacaaatgaacaattcttcaagtcaccaatttatcaagtcacagtctcacagatttacaatcagttcaaatcaattcatcaaatgcatacatcaagtcatctactattttccatcaagtccatctcagaatcacaaacctcagaaagttagaatataaaaggggtttatataagctgtgattgtgcaatggctgcctcattaaaaacctttataggtaaaaactcacacctcgtgagaaaaccctagaaaggaaaagagtacgcccatagctaaaatgttcatatcaattacaatcatccagttcaagggtttacatcaatttcatca

SEQ ID NO: 39301 - DNA, 3973 bp, Oryza sativa
cccagtccttttcactgccagaatttccaccagcctagggtttagacgccgccgacggtcctcgatgatcctgccagttaagctaaaagtagactcggacgatatagtagaaacaggaacagtcataacatctttagctaagattgaaagaacatgataagttagtttgtgctgttgccatcaactaaggatattgaagtcatcatcatattggttgacagtgtcactgtcaagatatgcagacagttcagaagaattgagattagcagttgaagaagctgcctgaagcaaagcagtagcagatgtcatcctggataatgaaccagcaccaagcccagcacctggactggcaccagcattaccagcacctggactggcacctgcattaccagcaccaagcccagcagcaacaacagaaccaaaaatcttcccccatgcagtccttttcttaccagtggaagggcctggaatagtggaactatgcaatctaacagaaccaaactttctttcatacttagcaaaagtatcagacaatgaagctctaacagttgttaaataagcagagtaatcatcaccaatgagttgagccataatctgaagcactttactaaaccccctaatcttggccctagggtccaagataaatgcaaatgaataaagaattggaattttagaccagtagttcataaacttagttttcatgggaccaacaacatttgcaatgttttgaacattgccatatgtgtttagatgtctagcaatctctaaaatgtgatgcatgattaatggagatgttggataataaacaccagacaaaacaacagttgaatcataaaattgttcgaggaaacacaaaacagattcagcacatgcccaatgtaagtctgtgagtaatggatggtcattaacaaaaggatgttgtgtactaataaatactgtgaatggttccctatgtggtatgagatgcttaagcattagataagttgaattccatctaacatccatgtccaaaccaaacatacgaggacgataaccagcagcaatgcaaacatttttatatgtagcaatgagctgattagatgcattcaagaatgaaatggcagctctaatgtcatttagcatgggcttgaacttgtcaagtccagccttaacaatcaaattgatgatatgacatgcacagcgttgatgcaaaaataaatcaccaatataaccagacagagcaggagtaagggtgtccatagctttagaattagcataagcattatctaatgtaatagagaaaaccttatcagtaataccatattcttcagcaacagcaatcacacgctcagcaatattagcaccagtatgtgactcatcaataagcctaagacccaagaccctcttttctaattgccaatcagaattaacaaagtgagctacaacactcaaataatcttccttagcatgaccagaccatatatcagatgtcaaagcaatagagctagcagaattgagacgatcaataataacagaacgacgatccttaaacaacttataaaaatctctggtagtagtttgtctagagacaggaacaaatctagggttatgagcagccttaatatagttcacaaaagcaggagattgaccaaaactgattggaagatcctctctagcaatcaatctacacaattcaaacctagcaacttcaggactatattcccatggaataacagaaccatctgcactaaatctaagcatggactgaggcaaagcattagacccaagctttctaggtttgcatgacttaatatgcctaagcaaatgtccagtgccagcagaagaacgagcactcaaagttttatgacagtaattgcatttagcaaagactcgaaccctattaccattggtcgtttcataaagttcctcaaagtcatcccataccttggaggttttggtcttcttgttggtacaagtcgcactagagccagtcggcgtcccattgcctttgtcgtcaaccggcgggtcgtcgtcatcgacattcacatggatcgggatgtcggaggtattgccgaatacctccacacgatcctcctcaacatcatcatcgtcatcaccgcgcatccccatagtcctcaactcgtagttgacagaggtaggatcgtcgtccatcgcaggcactctggtccctcaacggcggctgccgctaagcaacaggcttgcgacctgcaagcagccaacaacactcaaggttagggtcggaaatggagaaaaaaaaaagaaaaacaatggttccatgcttgtaccttcgcagccggagcaccggagttgccgttgaagacgataggctcacggatctacgagaagaccaagggatctggcgaagaagaacaaaagggaaagagacgaagaggaaggctggatctgaaagagtggaaggacgatgactcaggcgaccatgcgtggccggtggcccccatcctcatgcgcccctcatgcaagtcaggcgaggaatcgatcggagacgaagaggaaggctggatctggaagagtggaagggaggcgactcggtgagtctcaccggtgcgcgcctgaggccttgagcgagtgagcggcggacggtggaggaggagatctggtgggcggtggagcgtcggaggcggatcggcggaggcggttgagcggtggcggctagggttagggttaggcggagaggcggagagcgagaggcgagaggggactggggaggggaggggcggcgctcgctggcttatatatgcgggcgcacgcggcgcggcctggctgtctgttgggctgggccgtgctcgtgcctaccgttggtacgggccgtggtcgtgccgaccgttgggccgtgccgtgccgggccggcccatcgtgccgacctcggtccatgccgtgccgggccggcccaccgtgcccagccataggcccaggcacggcccaatagtcgtgccgggtcggcacgggcccgactgctaccgggccgtgccgtgcttgggccgggccaaattcccgtgccgtgggccgggccatcgggcctcgggccatatggccaactatagtctggactggtccttggtgtgcgctagctgcacgttgtccagagagaccgaatgtggcaacagcagccacaataaatacgagctgcaatactagacgagcaatgcatcaacaggcggtcctagctgcctgctggttaagttgttgcttttacacaaagcaacaaacacgaagcctatggatcaactgcgtgtctgcctacgtttagcaggcatcttgtgctcgtcggggagtagtagtggcggatggtgtagtcaaggctccaagctaaacagattcaattcagcgcacgcgagctagctagctttgcaattgtcgctatgagctggagcttggggctcaatcaagggataagccgatatgagggacaagagcacaggaagtatatagctctagagagaaagaaacaaaagtctagaccaccgaaatgattatgataatgacagtacactggatatctgcagcagtttaactaggggtgtgtttagttcatgttaaaattaaaagtttggttgaaattggaacgatgtgacgaaaaagttgaaaatttatatgcgtagaaaagttttgatgtgatggaaaagttagaagtttaaagaaaaagtttgaaactaaacaaggcttagagccagtttagaaccatttctgatcaacgactgatgaataatgtacgtacatacgtcgcagtttaattgaccagctggccatttttactacgtacacagactataagcgcgcgcacggaggcctgacacggtacgtcaggcgcctggcggcacagaaggttcgcttagtacttgcgttatatttctccaggcaaactggtaccgtggaccggccgcgtggtacacatactcctacgcgcgcacccctgttgcccgaatcgtaaacgaggcgcgcaacgcaaggaagg

SEQ ID NO: 39302 - DNA, 11951 bp, Oryza sativa
gggggggggggagcatcgtccgggtaataatccaatatccaagcccctccactccactcgcaatgtaatgttttaagacctgtttctttcggcttggaattattataatctagattattgagtcagattactgtaatagaataagcggttagttgtttctttactaaattattaggtttttaagtctaaagagggagtagggtggcatggtggataatttttcacccaataatctagaaaaagctcatctaatgagcttatcaaattataataagttgggctccagattataataagcgaaacatggcctaaagttaattgttttgagaccacttttctttttgaaatctgaaattaaatattgtcctgataggctgataccctacatgtcagacagcaacaaaggcagctcccagtcaggtttgggcgattgctcgagctccgccgctagctgccaccttcactacaaattaccaatttgccatcgatgtataaaaaatagtaaatcaccgagaaacacaattaaccgtttaaacttgacgatgttgtttgctccgtcactaatattcagtggcacaatgggtggcatatttcaatcgtatacgagagaatttcactcactcttcccattatcgaaaagtagttgcaagtattactcgtatgatcgtatctcactgcaagttaactaggtacgaaataatgattgatggtaagatgcaaattgagctatgttggttgcatatatatattttgagcatacacatgtgcaacaggacggatgggcctcccagacacaaaattgtgcaattccacaagcttaggtggtagtatttaagggtgttttattggttaagatcattgaaacaatatttaatgctgtcttcctctagttttgatatgcaagcttcactttccatgttcatcgcacacgccattagacccatatatttacatctctttgtgagattcacaagtcatgattggggatttacatgaagcaggaatttctaatgtaactgaaagaaaaggaatgactgaaatagaagttgtcaaagtcaaaaagataaaacctcaaaggctattcacgtttttccttctcatacctctccaccatctacaggagtcatctcttctttctttctcctctagtccttccatagtgcgtcatccatactcctatagaaaccttgtgatcaactaactattcatgtaccagtcagtagaaccaaccaatgactataaacgtaattactaattataggaagctcgagagtatagaaaacaaataaattaataaactttcagatttttcaccttatttagttgttagttgaaaaaaacacacgttagcaatatcaagtattttgttatatgtttgatgtggttgtaggcttgacacaccatagttaaaatcatagatttggaatcaatgtattttaattttagaagtacggtgaatatatacacacacttacttatggtttgggagatatttgatacatatgggaatattttaagcctacgtgagattcatatacatgcaaatatagtgattcgatacaaaggagcgaaattttaggatttttgattcctctctctcgctggttttgatggttttggagtccatctttcacaaaggccaactctatcattggctggcgccgcttcgtttggggacctgttaggattatagtagggtttcctccgctccaaatctccctcttgtaggagcaacaggtacaactttcctttttcatagttttttcccttcacagttcctttgcctgtccccggtaatggtcttttcgtccgttgtgttgtgtaatatattaacatataatttttttacgcttttgcgtttttttagtgatgtgacgatgatgtatatggaccgtgtgttctcaattgtatactttcaaaggaactagtaccattcgtattgttgagaggataaacacacaagcgtttaaagtttttaacattgatgaaggggtagtaaacacgcgctgcaaaaaggtgagacaaggtaaagccgagagacgagtggtattaagttcgctcaaaaataaagttataaaaccagggaagcaaaggcggcccgggaaaaaaaagaacccatcgcggccacccgcctcgttcgcttccatcctctccgcagtccgcacccgcgcgcgcgcgctcgactcccgcaccagccgcgtcatggcgccattccagctgcgcttcggcctccggatgtccccctcgcgctcctccgacgaggaggaggaagacgacgaggacgaggaagggttcgagtacgaggagatactgagcgacgacgggacggactcgccgccgccgctgatgatgcaggcggagaagggagggggagggctggtcggggcggtggtgggggcgctgcggaggtcgctggtgatgtgcagcgccgggaaggtcggggaggaggaggacagcgaggacgaggaagaggaggggatggagatcgggcggcccacggacgtgcggcacgtctcccacgtcacattcgaccgcttcggcggcttctcggcctccccgccgacctcgagcccgaagttcccagccccacgcccagcgccaggtgagctcgccggcgctaactctatgcaattcctctgtttcttctactcttcggtctctctctttcagttttctgaggattttacctgaaagaagctagtagctacgtactctacatacccaaatattctttggtacttgtatttttcaatttcacgcagtgtatttttcaatttcacgcagaaatatgtgttagtaaatttgttgttttatccttctctgttctgtgttctccaatgcaattagcgtataacctctttacaaaatatattgtgttcatagaaaggctcccaagaaagttgatagtactaatatgatgtttcagaacgatgatagtgagctttggtttcttttctagtatgtttagttgatcgctcagatgatacagggtagaaagagggcgatttgtttaaggatgtaagattaatttattccacaagtggatctagtaattaaaaaaggacaagtagtacctttttaataaaaagttcagttcttaattctagtatgcggttatatagttagattgctgagtcaagaagtacatgccatcaaacaaggaatggaagtatggaacactatgaaggtatgtgaaggtatacgattctgaagatatatgagggcataagagaagaataactcatatgtaggatttggtacaatactaccatatgacggccatgggttgaactttcaacggatcagacttgagttacttcgttctgtgcttgagctttaagcaacggggctgtttgaggtggttggccagcatgagcaacaaatgggaatcttcaaacctatcttttttattttggattagttctcctgtactttgcatcatcatatatagtaatgttctgtgaagtttgtccttttgcatttacaaatatcatttacaccatctttttaaggttgttaacgtcaaatcagtatttgatgtacaacctagttaaatgagctaggaatataagacattgtcctgttgctactgctgttatgtcataatctcttttttacccctttaacttgtagtggttacagaagtgaagattcaaagtttattcaccttaactacgatccttccctcctttttctttttcttttttaccgtgaaacagtaggggaggcctctaccgtatattaattttcgaaaagtttatgtacatgatacttaacaatttccatgtctaattttccatgcagtgtaaatgtatttggtgtttcaccaacctctttgcaatgttcatttgatcacaaaggaaatagcgtgcccacaatactgttgatgatgcagaggaagttgtatgaacgagagggacttaaggtatggccaccgcaacctaacgattagcattagaaaagtcagtattcaagccttcggaatacttatccattgtgttcttacttcttagatcgaagggatcttcagaattaacgcagagaatagccaggaaatctgtgtcaggaaacaactaaacagtggtgtggttccagatgaggttgacttacactgccttgcagggttgataaaggtagcatgaacttcctcatctctccttaatttttccggtccacggcctgagctgtatgaggcaaaaaagatcgttattatttatcggcaatttgctcttgtttgtttagtttttcagtactgagcattacctcagattgacagacgactaggcagttgcatctatgtatgtgcatcccctttttatgcaatctgaacatttcagaacctgaaatgtttgcagacatgaaggaatacagaataattggtgcaaggaacagtactttttaagtaaaaagtcgaataagtatttgcaggcaactgactattagatgtgcatgctattagtcatatttcttgtacatgggttattggcttactggaggatctattccatgatcactatattccctttttataggcatggtttcgggaactcccaaccggtgtattggactcactgacaccggaacaagtaatgcattgcaacacagaagaggactgtgctctccttgcttcaatgctaccaccagtggaagccgcattactcgattgggctatcaatctgatggctgatgttgtggagcatgaaaactacaacaagatgaatgctagaaacatcgctatggtctttgcgccaaacatgactcaggtattagaaacaactctggattctttcgttagaaaagcatacacatacactaacctgcaatgtttgttttccagatggccgatccattgactgccctgatacatgcagttcaggtcatgaatttcctcaagacattgatcttgaagactttaaaggaaagagaggcagccggaacacctaagacaacggaaccatgctccggttctccaaacggacaagataaacctccgacgccagagaatttggagagacccatcatttgttcagatcagaaaggcatagataaacctatgtttgatatggctacttgtgatcagctgctgtttggacctaaacaattccttgatcatcgtgagaacaacaaatttgaaggaccggagaagcatgacataggccaaccgaagcgccatagcgaagcttctcctcttggtaatgattcgaataaccaagtcagcagccctggaaaagaatttggcaacagaaatgtggaaggcctgttcgacaaatttagttttaggaaaggtgtcgagaggctttgcaggcaccctgtgttccagttgagtaggtccatgaagaagtctgcagacgttgtggtctttgatgctcctggagaagcaagacaagcttggggtttgatatgataatggttgtatatgtagttggtgtggatgtaatgctatcttttctctgtcttgtttgtgtgagcagaagcgattagcatgttagatttataggtgctgcaggttgttgtgtgcattataaccatttacttctgacgaaagcgtctgcctgtggctgctacaagtaaacgaaagccagctgaattctggctcagtactgtatacctcaatagctgctgacctatttattcttcttataaccgtccaaattaatctacccccacaaatatcccttcccaatcctaacatgcatccaaacgccacagtaatgcaaccactgtcagtgaacagcagtataagagcatccccatagcttatccatatttgatcctccaaatacctatatagatgattatccaaaaaaagattcatcattcatattccttccaactccaacaaataatctatattacatcatgcatatcgcaccatcctgtattttaataatatcttccaactaactttatatttgtatttttaagggatatattttgaactactaaattttaactgcgttatttatcgcaataatattttaaaatgagtaaattttaaccgatatatttttaataaataattttttaattgatgatgtatttacatgaatggacttctaatccacattagctagctagcgactgaccttatcctctcgcttaaaaaaaaagaaaaacagaaaagaacggaccttctctcgctaaaaaaaaaaaagaccctaccttatcctctcacgggtgcgtgcgtgcggcatacggaggggcgatgcgggacggcgcgggcggcgctgcatggcggcgcgggcggtggggcacggtggtgccgagctgagcaacggcgcgggctactgggcgacggcggaaggtggcgtccgcgcgcatggtgacggcggcggcggcggaggatgcaagcggcggccgcgagcatggcgacggcggcggcggaggaggcaagcagcggccgcgcgcatcgcgacggcgccagcggtcagccgcgggcagggcgacggctacagacggcggtggcgcggctccagatctggtacgcctctcgatctccactctcactccaccctccctctccaccgtccgctgactcaccttcgccggccggcgacgacggcgatggaggggaggtcgcgctggaggtgaggtcgcgtcgcggaagtccggatgggggcgggagaggcggctgttgcaaaatggcgtgaggagagagacactccatttttgcctcttctctctcctaatttggcgcatccgccacttttggagggcctgttagcgtatctgctggagctgatttttccccttttatacggcaaatgaaggatggatgaccggttagaggaactgctggggatgctctaagtgcattttctttctttcttgaggaggatgcattcaatatcacccaaaaatttataagaacttgtcagtgaattgctgaacaaatgcatagatgcattctctttctctattaactaaaacatggtaacagaagcatataagaacaactgtccgactgcatacggggactactactaatctactattgcagtacggctaaccgaaaatcttctggttcagatcctaatgtgtcaccccaattggtactgctgacaccatgcatgttagtccttttctatctcttcctgaagaccttgtcaaatagtacaatacaaagcagacgcagaaagcatgcatgctgcatgccaaattgccaatgccttgtgtatgggaatatatgcagttgtagagacgtttcagtgttgcatcatacaaaagatggctgtgcttcatccgccctgccgctcttccctcttcttagtagtgacgctgctagtttttcgttcatctccagcattgcctcatactttctttatcttcggagactcccttgttgatgtaggcaacaatgactatcttgtgaccctctccaaggccaatgctccaccatatggtgttgattttgcgttttctggtggcaagccaactggaaggttcacaaatgggaggaccattgccgatgtcattggtaatgtcaagtatgaatctcacgaagaaactctgattttcctgtctcgatctcacatttcttggcactgaactctcaggtgaagccttggggcagaaatcttttgctccaccctacttagctgcaaattcaagtgctgaaatgatgaacagtggtgttaattatgcctctggttcttctggcatatttgatgagaccggctctttttatgtatgtgaacactcaattgttgtgcttcctcatgcttgctttgtttctgaaatatagttgtatgaaaacatacttgatctgtgctgtagattggaagagtgccactagggcagcaaatcagctacttcgagaaaaccagagctcgaatactggagatcatgggggagaaggctgctactgggttcttgaagaaggcgctgttcacggttgctgcaggatccaatgacatcttggagtacctttcaccttccatgccattctttggacgagaaaagtatgatccttcagtttttcaggattccttggcttccaacctgacattttatctgaaggtgctacaacttctaactcgcgattactgaatttttctttcttctaatgttatttcaagatgatatgatactttttgttcctcaatgaagcggttaaatcaacttggagcaagaaaaattgttgttgctgacgttgggccactgggatgcataccgtatgttcgtgctttagagttcattcctgcaggggagtgttcagcatttgctaaccaactcactcaaggttacaacaagaaactgaagaggatgatctacaagctgaaccaggagatggggcctgagagtagatttgtttacgcaaacacgtacgagatcgtgatggaaatcattcagcagtaccgtcaatacggtgagctttcttccttgctgcagctacctcttgcgaaaaccacctgcgaatgctgtgctgcagtctgcagagcattagaaaatgcagaatatttcagtcttgcatttgtcttcaggttttgagaatgcgctggacccatgctgcggaggcagcttccctccatttctctgcatcagcatcgctaactcaacctccaccttatgcaatgaccggtccaagtacgtcttctgggacgcgttccacccgaccgaagccgtcaacttcatcgtcgccggcaagcttctcgacggcaactccgccgttgcttctcccatcaacgtccgagagctgttccaataccaatacaaatgagagatgtgcttttgcccagttgctatggcattcattcctgtttggctgtatcaattcccatcctctttcagtcttttcctctgcaatcttctcgggcataattggactggacagcacgcctttaacgagtagaatgtgactgaaagtgcgctttacgacaccagtttatcttgcttttttgcacttttctgaaggcccgagagaagattcaaccgtcagccaatgaaaaagagacacgtacacgctctccggctagtcgctgtcagtgaacaagaacttgccggtgcagtgcaaacttgaccaacgagcgatgcaacagaagctggcgcactacgtgcaaagaaactgacgaacaattgggcaaagtagcgcccatcttatcacagagtaaataacctatctatgtcactatgtgtgcacggtagccgccggtcagccggtgcaactcacagtggcgatatgcctatatattttacgtgcacgagaaagttgggctcgggtgccccggcactgccaggtacggccacctccggctgatcgatcgatcgatccatggagcctgccgccgcggcggcggggcctgggaaggccggtcaccacaacgccgacgctttccacgcggtggcggcgggcggcgtagctccgcccgcggagacgacgcggtggtcgtccctggcagccacggccgcgagcctcgtggcggtcggcctcggcggtgccgcgctgctggtgtggtgggcgctcgcgttccacccggcgaacgcgcgcctctggatggtgcccgcggggctcgtcctcctcggcacgcccatcctcgcgtggctctccctctgcctgtccgccggcccgtgcgccgccgtccgcgacgcgccggtgcgcgtgtaggagctcctcgcaagagtctcgcgcatttttgctgcttccagctggtccattttgggatcagatgtacatacatgttcattgttcactactagctagtcgtactatgcttctttctttgatttcttgctgattcatttcgggatcagatgcagatacacatacatgttcactactgtacttctttgatttctttgtgaattcagctgggagttgcagcgtgttgctgctagagggagagggacatgtagcattgatatggacatatggtatatatgatctggtgtacacagttgctttccaagattacttccccgtgtgtgtgatctggtgagtgcgaactttcgatcggtttctgcgttcacgcggcctggaaagtctaaagttggagtgtgccggatcgtaatccattggtcggcgtctcgtcgagaaatggacgcgcaatacaagcgcatgggccctcgaatttgagatatttcttaccggaggataggtatgtgtggttaatggtttcccctcgtggattgctttagtgttagattggtgatggattagatatgtgattaatggtagtggattaacataggaaatggagttcaacggaaggctgtactgaaatgctttagtattagataggtgatggattagatgtgtgattgatggtagtggattaacataggacatgaagtttaatggaaggctgtacctgcaatgctttaggactagatatgtgattgatggtagtggattaacataggacatgctttaggaccatgttggagaacgtcgccggcggccgcggcttccgtcgtccacgccccacgtcggaggtcgtcgccggcggcctcgtccttcgctgccacgccccacgtcggagcttgttgctggcagtcgcgtcctccgccgccacgccccacgccgggctcgtcgccggtggccacatcctccactgtccacgctccgcaccatgccggatctcgtcactggaggctgcgtcctccgccatccgcagccatgccacgccaggaactcgtcactggcaaccgcgtcctccaccatccacaccccatgccgcgccggagcttgtgcagcaatacgcatgctttgacagagatgtggtagaatggataaggtagaaggagatagaatcggtggattggttggttgctgccctatcccatttatcacggttgggacgggatcccgtcaggtagcatttctgtaaatttttatatactttttgatactggtacttcatgattagtgctaggatgctatattcctcatacatgtaaaggtccataaaatcatatactatgggtctttgtgcaagaaaattgtaatggaaatgttttttttatcggttcatgtattataatagatactgatgtttaaagttcccaaagttgaccagataagatactatactattatctttatatttatttgtgaacagagtacataacacggaattgtcggtgataagaggtgccattgtgcatccacagatccacttgtaagcgcagaggattaaggggggaaaggacaaaactaaaaactagttggaacatgacgagatacagagatagagatgctccagtccaacatccttattgatatgctacaatgtgaatatggattttcctgataagcaattgctacgtactaacaattgcccaatcattgaagtccagaaacacagcaccatacggatgggcaatattctgttgccatctcctctgttttgccattaactgacccacccttattaacgcattcatcagttccgtaacaggcttcttgttgggtcgcgaactgctcctttcagaagttgccgtcacaaccagcattttgcgtcatgttttcagtttattagtgcccaatcaaaatacgcaaattgctaataagcccccactatttttggtgtaaaccactgcaactatcccccactacttaaggtataaaacactaagactatctgtttccattttttgccatagaaaatggtagccccagtagaggacaggaccattggttggttgccagtcgtggtgcatttaatagttatttagataccttgctgacctgctgttctcctctcaagaaatgtaaaatcacacttagacaacattgccaagatagtgcctccttaacgaaataaccactttcttttatgttgcaattactaatatactaccgccttccccaaatgtttaatgttggttagttcaattttgagctaaccaacgtcaaacaaaaaaaaaaggagggagtacaatataacgggtagtgttcagaggcagaatgcacgcaccagggttcataatttcagaggaacaacatggttcaa

SEQ ID NO: 39303 - DNA, 1281 bp, Oryza sativa
aacagtggagctatcaaggaacttatgtaaaagaagtggtccagcagaaaggcttgtaataactaccatgaagattctttaacgaaaaaaagtcagcaaagggcaccctagcaaaaatcttacaatgtggatattagatggatggttcaaagactcatttgaagtggtagatgcccgtgaattagaatcttttttactttctccattatctgcacttgagctatccacaggtactgctaatagagaaatatcatccaatttcggtaatgcatccggtgcgtcggtctctagcagaattctgtctaagggcatctaaaataagtacaaatgtagacaattagtaaatccctctgagatggcatctaaaagtacagaataaaattacttactgattttagcattttctttgccttcgtggatttcatgcctgtaaggaagccggacaacgaaaagtaacagcctaaaatttcaaggctggacaccatttctgcagatcctagatacgaatgcagcaacacaccagctgggaaaggtccagttctcctgcaagcaacaaaaatgtaggaatcaatacttattggagaaaaacaatcagaagttacatgctatttgtgctagcagttaggtaatctggaccgtatacttcagattggcatttgttgtctaagacaggcaggattctcaaggttttggttatctagtcaataaatgtatccgaactatgttaggaactggtggataccatactataaataatctactaagaatttcaacttaaacatactttgagaacaaatctccatgtcttactttagtatctccagaagatcaccaaaggcgcgcacacaatgaacagaaacaggcttgttcaactccttagcaagttcaagttgctgctggaaaacttcaacctgcagtgatattttttagcttctgatagtcttattggtggcataaagcttgctcatgatgcaaaaggacttgaggcataggttatatggcctagtgatttacacatgttggaacatttggaaggagcagagtaggtgagcttttcaagatcagtgtcttcagccacaacaaatcatttacaagatcgaagaggatattgagcaacaggagagagattttctagcttagcttgcatgagttttatcgcttttgtgttactcccttcttccttgctccttttaaacttctatcctcctttaatgtaataggcaaagctcttggcctttcttttaagaaaaaaatagtcttatgggcataaaggggcgccca

SEQ ID NO: 39304 - DNA, 8465 bp, Oryza sativa
tcacgtgcattttaggccaaaacactaatacatacctttgattaatcctggtattataagctttgctacatcgttggctcatggattcattttagtgtttcaccatgttcataacccgagataatgaatatgttgattagtcatgcacttacttttgataatcatatatttttcggttttaaattgacggattattttattattataactaatcaattgaaagcaatatataatacatgtagatccttttcgagatggtctgagtggcggtttttttatatggcataaaaagtatggtgtggaatatagatcttttaaccaaaatgcacgcactagccaagttgttgcacctatatgctcatttctcaagtttttgcactagattgcaccaacctaccaagtttatgtaccgtagacgcaatttactctatatttcactcaattcagaaacagccttctttacattacacaggggcagcaggacatgattcagttgattaggatgtccagaagaacaacgtatcctagtgatgatgaaacaagatgaacaataaaatacttgtagagaattaatactaatattagagaagtggtacttgcactaggtaggccttagtttgtgctttgaggaaaggaactacagattattaccaaagttctattgctggataattcaatgtacaatttaaaagcgtaaaaaattgccgaataaagtacacctccccaacagccgcctctggtgtttcagcgaagaaccgccggagcgaatccatccaatccggcgatctctccggtacccacctatcaaattcacggaattaagaaccagagagcatagaggtcacggcagcgggagaggcatccagggaatcttgccatgggtggaggccgaagcaggggacgacggacgggtactcctcggccatctgcttcaccaggtgccagtctttctgcgcgcttatccagtagacaagagtcagcgaggagagattccccccgtgttctcgcacgaggtaggcgcgggagcatacctcggaagtgccgttgacggcgaagcgcgcgacgccggcggcggtggcggcgcgtatgagggaaggggcgacggacagcacacgcgggtcctgcaggtggcagtgcgcgtcgaagagccgcacgacggaagcggcgcgcgctggtgcctgggccatatccggcgaccccgcggtggccggaagcggaagtgctcaacggcgcttctagcggtgtgccggtgaccgccgccgcccgagcaagaggggaatcacggccttgtgggccgggatttatcgtgggcccagagaagccgaaatatgtcgttgggctgttcacggaacgcgctagccgcgccatgtgttctgggcttatcggcccagtaacactgggacgcgcgggctgttgcgagcagcccagtcaaattcaccgtggctgtcgaattcacttggctcctgcgcaggtgctcacgacctcgttcgtcgttagtcctagtgggagcgtggccgcgtgagatcatcggaataccacttcgaagaccgagaaaaagccaaagacctactacagaacactgtacaccccagcgaggcagcgatgcagccaacacactacacatggatgcactctgcaattcacggaacgagacagactgatgcatcacctacatagatccgttcttgctgttccgttcctgtacgggcacaatcaagttcaaggaaacggagttagaacatcacatcagcagccgaagataatcatgcaggatcaacagtgctaacccgctatcagtactggcttagctgtctcggaataattgtgcatttgtgcacacgacctcaggctaatgttccctgtgcggtctggccaaatctgataatccctctcatttaccatgacctgctctcagccactcactttgcttatcctcttccggccttaactcttcagccttcactctccgtcagggagcaaacagggagaaatccaggcagcaagtaacgtgaaatatccagagttactcccccacgaaaatatgtcaactgtgtgtgccctgcatcgtagaatagtggtcttacatagtgcagttcccctcaaaagaatgatgccttccaaaagcgacgtgtcccacaagcacatgcgcagtcctatcaggatctggggcgtgtggcctccaaggttagttactaacgcagcagctatgattaactcacgtttactgcataccccgggactggaaaggaaaaggaaaacaagctcccatcacagatacagcatgcttgattttagctttatcatatcatgcatctacagattgccaggtacatgagaagtgcccgggacccgaagatatccagcggaaagcgtggccgacctcactccaaacttccaaagcctccaagttaggacaagctatcgccccaatgtttgcggcgccaccgctcgcccaaaaatctccgtttctcagggctgtagcagtgcaagaacctcatttgagttatctcatataccacataggacaaatgcatattaaatccatttctctcacggtgcaaaatgctttgacaagaactccaacccaacattactttcaccgggacctgtgttgttacttcctttttttaactgctctgcacctgcatgcgtttgttttagctttttgaagtgagttcctcgcatcttagtgaagggacgagggcccacacttagggaagggacgagggtccacaccttttttcctccacgctatcacgcagcttatgtggacgcatgaagcaacgctcaactcctgtgcacggctggtggcggtagtaatggaccatctcaaagctccaccgcgtcggcgtgtatcctgtgattgcacatgcgggcgggcacgccataagtattcgcagggggtggttcccatgtagctgtccaacgatctcgtcgaaggatacagttcgctggccagcttaatgggtacaaatacataatccgtagcttatcggccttaccctgttcaccgcagcatttgctaactaaacggcattcgtcggagttccatcaagaaccagagtacagccaaagaggttagcgacgaatataatacagcaagcacgaatgatccggtttgacgcaagattaatggtgttggggtttttcagatgaagcccgtgattacaaagtcaataatggggtcatacattgtatccttttttcttttcttttcttgtctaatgaagtagagtgcaaacggaaaggaacggtgttgcatgtcacgtcacgaacggatgggtacacggtacatatgctacagttacacgcgctacacaggtgagaccaagcgacgccccgcccgccactagctagctttcgtcgggtccctttatataactcacgagccacatgccaacgggtcgcctcgcctccgtccaagacacttgtgagttgtgagccgcgcgcgcgacacgacacaagtcacaagtggagcgcgtgcgaggatgagccccagcgccgcggccaagatgcggctcggcggcggcggcggcggtggcggtttcatgctcgggtgcggctgcagggatgccaaggctgtggcagtggcggtgtccgccacgtcgccgtgttccgccgccacggagacgtccacggccaccacggcgacctggcgcagggcccggacgcacccgtcggcgtcggcgtcggcgtcgacgggcacgctgaccgtgccgtccgcctcgtcgtccttcctgtgggacgatgccgacgctgaggccgacggcgaagaggtcgacttcaagcgggagagctctgcgaccacgccgagcttctccggccttctgcggcagctgaacgagctcgagcagagcgtcatgacgtgggggtggaagagccctcgccgcggtaatcacttctcgccaccgccgccgcctcctccgccaccgccgttacctttacggccagtcgtcctgcaccgagctgtggacgccggcgggaagcgcagcaacaaagaagacgatgccaagttctcttcgccaccgccgtttttccattgcccgacgacccagctgcaccggaaggtgaagagcgttgaccaacgaaacagagaagatgatgaagcccacttcgcgccaccggcacctccgccattgcccttgccgccgcagcagctgcggaacgtgaagggcgtggacaaaggcggcagcaaagaagacagcaagcactgtccgccaccaccgcaagcgccgaagcaccggaaaacgaagagctgcgacaacaacgacggcttcaccgccggaaagctcgacgggagcttggcggtggtgaaacagtccgaggacccacgcggcgacttccggcggtcgatgctgaacatgatcgtggagaaccgcatcgtgaccggcgacgagctccgggagctgctccaccgcttcctcgagctgaacgcgccgcaccaccacgacgccatcctccgggccttcgccgagatctgggacgaggtgttcgccgggccggacgagccccgtcacggtcccccgaggccgccgccccggcagagaacgccacctcgccgccggcaccctctaccggcttggcgcctgtagtaaccccacacatggatacttaccgcgtagtatgtacaatgtagattactgtactaggttgcgtccaagaaattctcggcctcatctgatcacgtatctaccggaattgtttctgtcaccagattcacctctcgtgcatttagtacagtactacctagtggtcgtacttggtacgtgcaactctcccattttgttaccgtctgtctcctgatttaccaacctattatagtctccgcccatgttctcactcggaaaaagaaactactagtagccgccatggacgcgcgcgacacgggaggtttcacagtaaaaaaccgggtgcgatggtgcaagtggatgcagggcgctttcggccggggttggaattggatggatggatacaatacaaatggaggggagggccccgtgccgtgcatcgagtgggcgcgctcgcggtggacggtggtgcggtggcgatcgagcgaggcggtgggcgcaggtgatggacggacgcacgggagtggaaggggggagacgcgagcctactaatgatggtctagtgcgatgccaaaaactgcggcgacacgctccatcaatgcgcaacctctctctgggggggtcctttcctctttgcttcccttcctggaaggaaagaaacgtccgagcctcaatgcatccaccgcaattcttctgtccaatcctttttggaaattcttcccatgtcctctaattaagttgatctccattgacaagtagccaggactatagtctacagttgcgtttcttgatgcaatgctgtgcagttgcctcggccaaaattgaaggtacgggacatccaggctcatcaggtgcctgctgaagccaaacgcattcaaataagttagctgcagcatgcagtgtttcatgtattgccctctgcggctgtgcctgctctcaatttcgggtaaatagctaggtcgactgttttaatgcgtctcagagcaaccacccatggctgcaaaactgaactgcaacggagtagagagccttgttgttttgtcatgtggaagtggtcggtacggaagaagaaaaatgacaaactcgcccaactggcccaaggctgggccatttcgttttgggccgggagagtaggggacgcctaatttctcgtacaatcaacatcgtcgtgttcggctccgtcccccttggcccgcctagctacgcgccaccgccgatgatacacgtacgagctagtggcctagtacttctctagtactctccaagttgcgctgctccggtggccggtgcaggtaggcgaggacgctgaccagtaggaccaagcaaagcaagcaagcaacgcgatcaattcattcgttgctgccatgatgagttccgtctcagtcgttagtcgtcattaatgtcatgggaaaatgctggccgatgggtcacgcgaaatgcagtctgctgcgctgccgctgctgcgtgaaaacctgccagatgccagtgtgcaacagcgtgaactactgaactcggcccgatgctgaaattgtttaccgcgtaataagcccgagatttaggtagtcttagatcattgatgcatcagaatctacacgctgataactactactcttacatgaggggatggcggtttcaaaatctgtacaatgtgccgactgcctaggcaagtacaggccgagaacttaacatgttcaacgtcagacatatttagtccagtccaggagcaacattttcaatcagcacagtgatggctgaaagcttgctcaagcttatcgttggcaagacatggacaacactaaatgatgttgtgactaaaacagaggaagaaacaccgacgatcggttcaaaattttacatttaataaagacagccttcaatgaaggttcagctagtacaaaattcttcgactgccaaatcgaatttgttcacaccttgtcttgcatataagcagaataaaagacacccaaggcaccaagcgaaagaactagaagaagaccagagggcaccagtttccgggtattgtacagccttatacctgaaagagaaggaatatgttttaacttcccaacatcacaattcaacttcatggaaatggaacacaagagagtgaaatgtaccaaaaacactggcaaacagaaaggcagatccaaatccaacagcgtcacctaacgcctttgtttcaggtgattgcatcagataataagcctgcggtaaggataaaattacgcatatgttacaaataatcttgacaaaacaattcaatgtttaactgtacaaagataaaattactagacaaacagtcagtttcttagcatgagaaatcattatgcttccactagaaaaggagaaacaatgtacttattgatgagattctctaagagattcaaaggggtgccactgacttaagatcagccaaaggaactgaataacagtacctgcaagcatgtatgatgaatatagactttataccaaccagggttccttcgaagataacaaaactaatcaaaccaaaaggtaatgacgatatataatatattgtataccttcttgaatcatcacaaaaataatttattacaccttctcagcttttcataaacgatctcagtaattcataatttgaggactttcaagtctaagttgtgtttagcactatgttatgacaggaacaaattatgaaacttcgttaagaatctgattcaacatcctagttgaatttagtggtgccaagaaaagaatgatgaatagtagttattatgctaaaaagattccagattcaccaccttaattccacaagcatcacaatcctgaattacaattggaattttgaattgaaaacgtatttccacatgattcctgattaatagtcaccagtaataagttcattctgaaattgacaagcaccagcattatcaaagagaaaaaaaatgggaagatcgaataaggactccccattttgcaacaaaatttataactttctgttgttctatttatacataaacccacaaataccagtagtaatatgcatgaagattcacaagcacttcctaaaactctggatacttgtttagttgttttgttactcctgttggtcatgtttcttgtaccagtaagctgattcaaaacaactggttggactaagatttgaaggttgtttcctgcacctagcaaattgtgtccctttccatcttctgttccaactacaagtagtacaccaaaaattccagacatatttgctgtaagttcttccaatgttccgagttctaacttacaagaatcctattctgtccccccaacagcccaataaaactctgcaattttggggaaacatgtgtgtagagttgtgaatgcatgactttagttttccctcaccgacccgaaagttatactttgttaaaaaaaatagcagtttggtctaagcataattgctacagccgtgtaatcaattgtatatcaagaatcataacaaaagaaattcccttaagcatttgatatctaacctgaaagctaggctgctctaaagtgtaaacaaacacaaaagggaaattcagaaaatgtaggaaatatacgccgtccactcacaatgcccataagcgcggatccggacagtcctccaaagatggagcctttactccccgacctcacatctacacaccagaaagagactcatggtcagtacgcagcacatcaggaaaggaatcacgacagctccaaatggcgcacatgcaaaggcgccgccgcccaggaggagggcgccgtaggcggctgatgcggtgggcgcgagctcggacaccgcggaacaccggaggagggcacgacgccggctgcggccgggacgggccacagcactgggacgaggtggcgagggaagggaacggatggcggcggcagggtggtgga
